United States Patent 11,078,247 (RNA ENCODING A THERAPEUTIC PROTEIN) - sequence listing, part 10

SEQ ID NO: 19661 - RNA, 2703 nt, Artificial Sequence
  MARS__Homo_sapiens__NP_004981
augagacuguucgugagcgacggcgugcccggcugccugcccgugcuggccgccgccggcagagccagaggcagagccgaggugcugaucagcaccgugggccccgaggacugcguggugcccuuccugaccagacccaaggugcccgugcugcagcuggacagcggcaacuaccuguucagcaccagcgccaucugcagauacuucuuccugcugagcggcugggagcaggacgaccugaccaaccaguggcuggagugggaggccaccgagcugcagcccgcccugagcgccgcccuguacuaccugguggugcagggcaagaagggcgaggacgugcugggcagcgugagaagagcccugacccacaucgaccacagccugagcagacagaacugccccuuccuggccggcgagaccgagagccuggccgacaucgugcuguggggcgcccuguacccccugcugcaggaccccgccuaccugcccgaggagcugagcgcccugcacagcugguuccagacccugagcacccaggagcccugccagagagccgccgagaccgugcugaagcagcagggcgugcuggcccugagacccuaccugcagaagcagccccagcccagccccgccgagggcagagccgugaccaacgagcccgaggaggaggagcuggccacccugagcgaggaggagaucgccauggccgugaccgccugggagaagggccuggagagccugcccccccugagaccccagcagaaccccgugcugcccguggccggcgagagaaacgugcugaucaccagcgcccugcccuacgugaacaacgugccccaccugggcaacaucaucggcugcgugcugagcgccgacguguucgccagauacagcagacugagacaguggaacacccuguaccugugcggcaccgacgaguacggcaccgccaccgagaccaaggcccuggaggagggccugaccccccaggagaucugcgacaaguaccacaucauccacgccgacaucuacagaugguucaacaucagcuucgacaucuucggcagaaccaccaccccccagcagaccaagaucacccaggacaucuuccagcagcugcugaagagaggcuucgugcugcaggacaccguggagcagcugagaugcgagcacugcgccagauuccuggccgacagauucguggagggcgugugccccuucugcggcuacgaggaggccagaggcgaccagugcgacaagugcggcaagcugaucaacgccguggagcugaagaagccccagugcaaggugugcagaagcugccccguggugcagagcagccagcaccuguuccuggaccugcccaagcuggagaagagacuggaggaguggcugggcagaacccugcccggcagcgacuggacccccaacgcccaguucaucaccagaagcuggcugagagacggccugaagcccagaugcaucaccagagaccugaaguggggcacccccgugccccuggagggcuucgaggacaagguguucuacgugugguucgacgccaccaucggcuaccugagcaucaccgccaacuacaccgaccagugggagagaugguggaagaaccccgagcagguggaccuguaccaguucauggccaaggacaacgugcccuuccacagccugguguuccccugcagcgcccugggcgccgaggacaacuacacccuggugagccaccugaucgccaccgaguaccugaacuacgaggacggcaaguucagcaagagcagaggcgugggcguguucggcgacauggcccaggacaccggcauccccgccgacaucuggagauucuaccugcuguacaucagacccgagggccaggacagcgccuucagcuggaccgaccugcugcugaagaacaacagcgagcugcugaacaaccugggcaacuucaucaacagagccggcauguucgugagcaaguucuucggcggcuacgugcccgagauggugcugacccccgacgaccagagacugcuggcccacgugacccuggagcugcagcacuaccaccagcugcuggagaaggugagaaucagagacgcccugagaagcauccugaccaucagcagacacggcaaccaguacauccaggugaacgagcccuggaagagaaucaagggcagcgaggccgacagacagagagccggcaccgugaccggccuggccgugaacaucgccgcccugcugagcgugaugcugcagcccuacaugcccaccgugagcgccaccauccaggcccagcugcagcugcccccccccgccugcagcauccugcugaccaacuuccugugcacccugcccgccggccaccagaucggcaccgugagcccccuguuccagaagcuggagaacgaccagaucgagagccugagacagagauucggcggcggccaggccaagaccagccccaagcccgccgugguggagaccgugaccaccgccaagccccagcagauccaggcccugauggacgaggugaccaagcagggcaacaucgugagagagcugaaggcccagaaggccgacaagaacgagguggccgccgagguggccaagcugcuggaccugaagaagcagcuggccguggccgagggcaagccccccgaggcccccaagggcaagaagaagaaguaa

SEQ ID NO: 19662 - RNA, 522 nt, Artificial Sequence
  MARVELD1__Homo_sapiens__NP_113672
augcugccccccccccccagacagccccccccccaggccagagccgccagaggcgccgugagacugcagagacccuuccugagaagcccccugggcgugcugagacugcugcagcugcuggccggcgccgccuucuggaucaccaucgccaccagcaaguaccagggccccgugcacuucgcccuguucgugagcgugcuguucuggcugcugacccugggccuguacuuccugacccugcugggcaagcacgagcuggugcccgugcugggcagcagauggcugauggugaacguggcccacgacgugcuggccgccgcccuguacggcgccgccaccggcaucaugagcgaccagaugcagagacacagcuacugcaaccugaaggacuacccccugcccugcgccuaccacgccuuccuggccgccgccgugugcggcggcgugugccacggccuguaccugcugagcgcccuguacggcugcggcagaagaugccagggcaagcaggagguggccuaa

SEQ ID NO: 19663 - RNA, 1641 nt, Artificial Sequence
  MARVELD2__Homo_sapiens__NP_001231663
augagcaacgacggcagaagcagaaacagagacagaagauacgacgaggugcccagcgaccugcccuaccaggacaccaccaucagaacccaccccacccugcacgacagcgagagagccgugagcgccgacccccugcccccccccccccugccccugcagccccccuucggccccgacuucuacagcagcgacaccgaggagcccgccaucgcccccgaccugaagcccgugagaagauucgugcccgacagcuggaagaacuucuucagaggcaagaagaaggaccccgagugggacaagcccgugagcgacaucagauacaucagcgacggcguggagugcagcccccccgccagccccgccagacccaaccacagaagcccccugaacagcugcaaggaccccuacggcggcagcgagggcaccuucagcagcagaaaggaggccgacgccguguuccccagagaccccuacggcagccuggacagacacacccagaccgugagaaccuacagcgagaagguggaggaguacaaccugagauacagcuacaugaagagcugggccggccugcugagaauccugggcgugguggagcugcugcugggcgccggcguguucgccugcgugaccgccuacauccacaaggacagcgagugguacaaccuguucggcuacagccagcccuacggcaugggcggcgugggcggccugggcagcauguacggcggcuacuacuacaccggccccaagacccccuucgugcuggugguggccggccuggccuggaucaccaccaucaucauccuggugcugggcaugagcauguacuacagaaccauccugcuggacagcaacugguggccccugaccgaguucggcaucaacguggcccuguucauccuguacauggccgccgccaucguguacgugaacgacaccaacagaggcggccugugcuacuacccccuguucaacacccccgugaacgccguguucugcagaguggagggcggccagaucgccgccaugaucuuccuguucgugaccaugaucguguaccugaucagcgcccuggugugccugaagcuguggagacacgaggccgccagaagacacagagaguacauggagcagcaggagugcgagauggccaccagcggcgacagacagagagacagcgaggugaacuucaaggagcugagaaccgccaagaugaagcccgagcugcugagcggccacaucccccccggccacauccccaagcccaucgugaugcccgacuacguggccaaguaccccgugauccagaccgacgacgagagagagagauacaaggccguguuccaggaccaguucagcgaguacaaggagcugagcgccgaggugcaggccgugcugagaaaguucgacgagcuggacgccgugaugagcagacugccccaccacagcgagagcagacaggagcacgagagaaucagcagaauccacgaggaguucaagaagaagaagaacgaccccaccuuccuggagaagaaggagagaugcgacuaccugaagaacaagcugagccacaucaagcagagaauccaggaguacgacaaggugaugaacugggacgugcagggcuacagcuaa

SEQ ID NO: 19664 - RNA, 1233 nt, Artificial Sequence
  MARVELD3__Homo_sapiens__NP_001017967
auggaggaccccagcggcgccagagagcccagagccagacccagagagagagaccccggcagaagaccccaccccgaccagggcagaacccacgacagacccagagacagacccggcgaccccagaagaaagagaagcagcgacggcaacagaagaagagacggcgacagagaccccgagagagaccaggagagagacggcaacagagacagaaacagagacagagagagagagagagagagagagagagaccccgacagaggccccagaagagacacccacagagacgccggccccagagccggcgagcacggcgugugggagaagcccagacagagcagaaccagagacggcgccagaggccugaccugggacgccgccgccccccccggccccgcccccugggaggcccccgagcccccccagccccagagaaagggcgaccccggcagaagaagacccgagagcgagccccccagcgagagauaccugcccagcacccccagacccggcagagaggagguggaguacuaccagagcgaggccgagggccugcuggagugccacaagugcaaguaccugugcaccggcagaggcguggugcagaucguggagguggugcugaacggcauggugcugaucugcaucguggccagcuacuucgugcuggccggcuucagcgccagcuucagcagcggcggcggcuucggcaacaacuacuacagccccuucgagggcaccgagcuggagcaggugagacagcuggaccagcaguacaccauccugagaagcccccugaucuacggcggcguggccgugagccugggccugggcgugcugaccaugggcgugcugcugcagggcgccaagagcagaaccaugcugagcggcaaguggcugcugaccgaggccgccuucagccugcuggccgccgugggcuacugcaccggcaucggcguguaccugcacguggcccugcagaucaacagcaccgacaccugcaagaccagagagagacuguacgccagaaagggccugaccuggauggacugccagcuggccggcaccgacggcgccgccgccaccuucgccugccugcuggugaucauguacggcgccagcguggugcuggcccugagaagcuacagagagcagaagagauacaagggcagcagagagcagcccggcagcuacagcgacgcccccgaguaccuguggagcggcacccuguaa

SEQ ID NO: 19665 - RNA, 978 nt, Artificial Sequence
  MAS1__Homo_sapiens__NP_002368
auggacggcagcaacgugaccagcuucgugguggaggagcccaccaacaucagcaccggcagaaacgccagcgugggcaacgcccacagacagauccccaucgugcacugggugaucaugagcaucagccccgugggcuucguggagaacggcauccugcugugguuccugugcuucagaaugagaagaaaccccuucaccguguacaucacccaccugagcaucgccgacaucagccugcuguucugcaucuucauccugagcaucgacuacgcccuggacuacgagcugagcagcggccacuacuacaccaucgugacccugagcgugaccuuccuguucggcuacaacaccggccuguaccugcugaccgccaucagcguggagagaugccugagcgugcuguaccccaucugguacagaugccacagacccaaguaccagagcgcccuggugugcgcccugcugugggcccugagcugccuggugaccaccauggaguacgugaugugcaucgacagagaggaggagagccacagcagaaacgacugcagagccgugaucaucuucaucgccauccugagcuuccugguguucaccccccugaugcuggugagcagcaccauccugguggugaagaucagaaagaacaccugggccagccacagcagcaagcuguacaucgugaucauggugaccaucaucaucuuccugaucuucgccaugcccaugagacugcuguaccugcuguacuacgaguacuggagcaccuucggcaaccugcaccacaucagccugcuguucagcaccaucaacagcagcgccaaccccuucaucuacuucuucgugggcagcagcaagaagaagagauucaaggagagccugaagguggugcugaccagagccuucaaggacgagaugcagcccagaagacagaaggacaacugcaacaccgugaccguggagaccgugguguaa

SEQ ID NO: 19666 - RNA, 1137 nt, Artificial Sequence
  MAS1L__Homo_sapiens__NP_443199
augguguggggcaagaucugcugguucagccagagagccggcuggaccguguucgccgagagccagaucagccugagcugcagccugugccugcacagcggcgaccaggaggcccagaaccccaaccuggugagccagcugugcggcguguuccugcagaacgagaccaacgagaccauccacaugcagaugagcauggccgugggccagcaggcccugccccugaacaucaucgcccccaaggccgugcuggugagccugugcggcgugcugcugaacggcaccguguucuggcugcugugcugcggcgccaccaaccccuacaugguguacauccugcaccugguggccgccgacgugaucuaccugugcugcagcgccgugggcuuccugcaggugacccugcugaccuaccacggcgugguguucuucauccccgacuuccuggccauccugagccccuucagcuucgaggugugccugugccugcugguggccaucagcaccgagagaugcgugugcgugcuguuccccaucugguacagaugccacagacccaaguacaccagcaacguggugugcacccugaucuggggccugcccuucugcaucaacaucgugaagagccuguuccugaccuacuggaagcacgugaaggccugcgugaucuuccugaagcugagcggccuguuccacgccauccugagccuggugaugugcgugagcagccugacccugcugaucagauuccugugcugcagccagcagcagaaggccaccagaguguacgccguggugcagaucagcgcccccauguuccugcugugggcccugccccugagcguggccccccugaucaccgacuucaagauguucgugaccaccagcuaccugaucagccuguuccugaucaucaacagcagcgccaaccccaucaucuacuucuucgugggcagccugagaaagaagagacugaaggagagccugagagugauccugcagagagcccuggccgacaagcccgaggugggcagaaacaagaaggccgccggcaucgaccccauggagcagccccacagcacccagcacguggagaaccugcugcccagagagcacagaguggacguggagaccuaa

SEQ ID NO: 19667 - RNA, 1143 nt, Artificial Sequence
  MASP1__Homo_sapiens__NP_001027019
augagauggcugcugcuguacuacgcccugugcuucagccugagcaaggccagcgcccacaccguggagcugaacaacauguucggccagauccagagccccggcuaccccgacagcuaccccagcgacagcgaggugaccuggaacaucaccgugcccgacggcuucagaaucaagcuguacuucaugcacuucaaccuggagagcagcuaccugugcgaguacgacuacgugaagguggagaccgaggaccaggugcuggccaccuucugcggcagagagaccaccgacaccgagcagacccccggccaggagguggugcugagccccggcagcuucaugagcaucaccuucagaagcgacuucagcaacgaggagagauucaccggcuucgacgcccacuacauggccguggacguggacgagugcaaggagagagaggacgaggagcugagcugcgaccacuacugccacaacuacaucggcggcuacuacugcagcugcagauucggcuacauccugcacaccgacaacagaaccugcagaguggagugcagcgacaaccuguucacccagagaaccggcgugaucaccagccccgacuuccccaaccccuaccccaagagcagcgagugccuguacaccaucgagcuggaggagggcuucauggugaaccugcaguucgaggacaucuucgacaucgaggaccaccccgaggugcccugccccuacgacuacaucaagaucaaggugggccccaaggugcugggccccuucugcggcgagaaggcccccgagcccaucagcacccagagccacagcgugcugauccuguuccacagcgacaacagcggcgagaacagaggcuggagacugagcuacagagccgccggcaacgagugccccgagcugcagccccccgugcacggcaagaucgagcccagccaggccaaguacuucuucaaggaccaggugcuggugagcugcgacaccggcuacaaggugcugaaggacaacguggagauggacaccuuccagaucgagugccugaaggacggcaccuggagcaacaagauccccaccugcaagaagaacgagaucgaccuggagagcgagcugaagagcgagcaggugaccgaguaa

SEQ ID NO: 19668 - RNA, 5592 nt, Artificial Sequence
  MAST2__Homo_sapiens__XP_011539364
augaagagaagcagaugcagagacagaccccagccccccccccccgacagaagagaggacggcgugcagagagccgccgagcugagccagagccugccccccagaagaagagccccccccggcagacagagacuggaggagagaaccggccccgccggccccgagggcaaggagcaggacguggugaccggcgugagcccccugcuguucagaaagcugagcaaccccgacaucuucagcagcaccggcaaggugaagcugcagagacagcugagccaggacgacugcaagcuguggagaggcaaccuggccagcagccugagcggcaagcagcugcugccccugagcagcagcgugcacagcagcgugggccaggugaccuggcagagcagcggcgaggccagcaaccuggugagaaugagaaaccagagccugggccagagcgcccccagccugaccgccggccugaaggagcugagccugcccagaagaggcagccugaucagcacccugugcagaggcgccgaggugaaccagcacauguucagccccaccagcgcccccgcccuguuccugaccaaggugcccuucagcgccgacugcgcccuggccaccagcccccuggccaucuuccugaaccccagagcccacagcagccccggcacccccugcagcagcagaccccugcccuggagcugcagaaccagcaacagaaagagccugaucgugaccagcagcaccagccccacccugcccagaccccacagcccccugcacggccacaccggcaacagcccccuggacagccccagaaacuucagccccaacgcccccgcccacuucagcuucgugcccgccagaagaaccgacggcagaagauggagccuggccagccugcccagcagcggcuacggcaccaacacccccagcagcaccgugagcagcagcugcagcagccaggagaagcugcaccagcugcccuuccagcccaccgccgacgagcugcacuuccugaccaagcacuucagcaccgagagcgugcccgacgaggagggcagacagagccccgccaugagacccagaagcagaagccugagccccggcagaagccccgugagcuucgacagcgagaucaucaugaugaaccacguguacaaggagagauuccccaaggccaccgcccagauggaggagagacuggccgaguucaucagcagcaacacccccgacagcgugcugccccuggccgacggcgcccugagcuucauccaccaccaggugaucgagauggccagagacugccuggacaagagcagaagcggccugaucaccagccaguacuucuacgagcugcaggacaaccuggagaagcugcugcaggacgcccacgagagaagcgagagcagcgagguggccuucgugaugcagcuggugaagaagcugaugaucaucaucgccagacccgccagacugcuggagugccuggaguucgaccccgaggaguucuaccaccugcuggaggccgccgagggccacgccaaggagggccagggcaucaagugcgacauccccagauacaucgugagccagcugggccugaccagagacccccuggaggagauggcccagcugagcagcugcgacagccccgacacccccgagaccgacgacagcaucgagggccacggcgccagccugcccagcaagaagacccccagcgaggaggacuucgagaccaucaagcugaucagcaacggcgccuacggcgccguguuccuggugagacacaagagcaccagacagagauucgccaugaagaagaucaacaagcagaaccugauccugagaaaccagauccagcaggccuucguggagagagacauccugaccuucgccgagaaccccuucguggugagcauguucugcagcuucgacaccaagagacaccugugcauggugauggaguacguggagggcggcgacugcgccacccugcugaagaacaucggcgcccugcccguggacauggugagacuguacuucgccgagaccgugcuggcccuggaguaccugcacaacuacggcaucgugcacagagaccugaagcccgacaaccugcugaucaccagcaugggccacaucaagcugaccgacuucggccugagcaagaucggccugaugagccugaccaccaaccuguacgagggccacaucgagaaggacgccagagaguuccuggacaagcaggugugcggcacccccgaguacaucgcccccgaggugauccugagacagggcuacggcaagcccguggacuggugggccaugggcaucauccuguacgaguuccuggugggcugcgugcccuucuucggcgacacccccgaggagcuguucggccaggugaucagcgacgagaucguguggcccgagggcgacgaggcccugccccccgacgcccaggaccugaccagcaagcugcugcaccagaacccccuggagagacugggcaccggcagcgccuacgaggugaagcagcaccccuucuucaccggccuggacuggaccggccugcugagacagaaggccgaguucaucccccagcuggagagcgaggacgacaccagcuacuucgacaccagaagcgagagauaccaccacauggacagcgaggacgaggaggaggugagcgaggacggcugccuggagaucagacaguucagcagcugcagccccagauucaacaagguguacagcagcauggagagacugagccugcuggaggagagaagaacccccccccccaccaagagaagccugagcgaggagaaggaggaccacagcgacggccuggccggccugaagggcagagacagaagcugggugaucggcagccccgagauccugagaaagagacugagcgugagcgagagcagccacaccgagagcgacagcagcccccccaugaccgugagaagaagaugcagcggccugcuggacgcccccagauuccccgagggccccgaggaggccagcagcacccugagaagacagccccaggagggcaucugggugcugaccccccccagcggcgagggcgugagcggccccgugaccgagcacagcggcgagcagagacccaagcuggacgaggaggccgugggcagaagcagcggcagcagccccgccauggagaccagaggcagaggcaccagccagcuggccgagggcgccaccgccaaggccaucagcgaccuggccgugagaagagccagacacagacugcugagcggcgacagcaccgagaagagaaccgccagacccgugaacaaggugaucaagagcgccagcgccaccgcccugagccugcugauccccagcgagcaccacaccugcagcccccuggccagccccaugagcccccacagccagagcagcaaccccagcagcagagacagcagccccagcagagacuuccugcccgcccugggcagcaugagaccccccaucaucauccacagagccggcaagaaguacggcuucacccugagagccaucagaguguacaugggcgacagcgacguguacaccgugcaccacaugguguggcacguggaggacggcggccccgccagcgaggccggccugagacagggcgaccugaucacccacgugaacggcgagcccgugcacggccuggugcacaccgaggugguggagcugauccugaagagcggcaacaagguggccaucagcaccaccccccuggagaacaccagcaucaaggugggccccgccagaaagggcagcuacaaggccaagauggccagaagaagcaagagaagcagaggcaaggacggccaggagagcagaaagagaagcagccuguucagaaagaucaccaagcaggccagccugcugcacaccagcagaagccugagcagccugaacagaagccugagcagcggcgagagcggccccggcagccccacccacagccacagccugagccccagaagccccacccagggcuacagagugacccccgacgccgugcacagcgugggcggcaacagcagccagagcagcagccccagcagcagcgugcccagcagccccgccggcagcggccacaccagacccagcagccugcacggccuggcccccaagcugcagagacaguacagaagccccagaagaaagagcgccggcagcaucccccugagcccccuggcccacacccccagcccccccccccccaccgccagcccccagagaagccccagcccccugagcggccacguggcccaggccuuccccaccaagcugcaccugagccccccccugggcagacagcugagcagacccaagagcgccgagccccccagaagcccccugcugaagagagugcagagcgccgagaagcuggccgccgcccuggccgccagcgagaagaagcuggccaccagcagaaagcacagccuggaccugccccacagcgagcugaagaaggagcugccccccagagaggugagcccccuggagguggugggcgccagaagcgugcugagcggcaagggcgcccugcccggcaagggcgugcugcagcccgcccccagcagagcccugggcacccugagacaggacagagccgagagaagagagagccugcagaagcaggaggccaucagagagguggacagcagcgaggacgacaccgaggagggccccgagaacagccagggcgcccaggagcugagccuggccccccaccccgaggugagccagagcguggcccccaagggcgccggcgagagcggcgaggaggaccccuuccccagcagagaccccagaagccugggccccauggugcccagccugcugaccggcaucacccugggcccccccagaauggagagccccagcggcccccacagaagacugggcagcccccaggccaucgaggaggccgccagcagcagcagcgccggccccaaccugggccagagcggcgccaccgaccccaucccccccgagggcugcuggaaggcccagcaccugcacacccaggcccugaccgcccugagccccagcaccagcggccugacccccaccagcagcugcagcccccccagcagcaccagcggcaagcugagcauguggagcuggaagagccugaucgagggccccgacagagccagccccagcagaaaggccaccauggccggcggccuggccaaccugcaggaccuggagaacaccacccccgcccagcccaagaaccugagccccagagagcagggcaagacccagccccccagcgcccccagacuggcccaccccagcuacgaggaccccagccagggcuggcugugggagagcgagugcgcccaggccgugaaggaggaccccgcccugagcaucacccaggugcccgacgccagcggcgacagaagacaggacgugcccugcagaggcugcccccugacccagaagagcgagcccagccugagaagaggccaggagcccggcggccaccagaagcacagagaccuggcccuggugcccgacgagcugcugaagcagaccuaa

SEQ ID NO: 19669 - RNA, 7872 nt, Artificial Sequence
  MAST4__Homo_sapiens__NP_001158136
augggcgagaaggugagcgaggcccccgagcccgugcccagaggcugcagcggccacggcagcagaacccccgccagcgcccugguggccgccagcagccccggcgccagcagcgccgagagcagcagcggcagcgagacccugagcgaggagggcgagcccggcggcuucagcagagagcaccagcccccccccccccccccccugggcggcacccugggcgccagagcccccgccgccugggcccccgccagcgugcugcuggagagaggcgugcuggcccugccccccccccugcccggcggcgccgugccccccgcccccagaggcagcagcgccagccaggaggagcaggacgaggagcuggaccacauccugagccccccccccaugcccuucagaaagugcagcaaccccgacguggccagcggccccggcaagagccugaaguacaagagacagcugagcgaggacggcagacagcugagaagaggcagccugggcggcgcccugaccggcagauaccugcugcccaaccccguggccggccaggccuggcccgccagcgccgagaccagcaaccuggugagaaugagaagccaggcccugggccagagcgcccccagccugaccgccagccugaaggagcugagccugcccagaagaggcagcuucugcagaaccagcaacagaaagagccugaucggcaacggccagagccccgcccugcccagaccccacagcccccugagcgcccacgccggcaacagcccccaggacagccccagaaacuucagccccagcgccagcgcccacuucagcuucgccagaagaaccgacggcagaagauggagccuggccagccugcccagcagcggcuacggcaccaacacccccagcagcaccgugagcagcagcugcagcagccaggagaagcugcaccagcugcccuaccagcccacccccgacgagcugcacuuccugagcaagcacuucugcaccaccgagagcaucgccaccgagaacagaugcagaaacacccccaugagacccagaagcagaagccugagccccggcagaagccccgccugcugcgaccacgagaucaucaugaugaaccacguguacaaggagagauuccccaaggccaccgcccagauggaggagagacugaaggagaucaucaccagcuacagccccgacaacgugcugccccuggccgacggcgugcugagcuucacccaccaccagaucaucgagcuggccagagacugccuggacaagagccaccagggccugaucaccagcagauacuuccuggagcugcagcacaagcuggacaagcugcugcaggaggcccacgacagaagcgagagcggcgagcuggccuucaucaagcagcuggugagaaagauccugaucgugaucgccagacccgccagacugcuggagugccuggaguucgaccccgaggaguucuacuaccugcuggaggccgccgagggccacgccaaggagggccagggcaucaagaccgacauccccagauacaucaucagccagcugggccugaacaaggacccccuggaggagauggcccaccugggcaacuacgacagcggcaccgccgagacccccgagaccgacgagagcgugagcagcagcaacgccagccugaagcugagaagaaagcccagagagagcgacuucgagaccaucaagcugaucagcaacggcgccuacggcgccguguacuucgugagacacaaggagagcagacagagauucgccaugaagaagaucaacaagcagaaccugauccugagaaaccagauccagcaggccuucguggagagagacauccugaccuucgccgagaaccccuucguggugagcauguacugcagcuucgagaccagaagacaccugugcauggugauggaguacguggagggcggcgacugcgccacccugaugaagaacaugggcccccugcccguggacauggccagaauguacuucgccgagaccgugcuggcccuggaguaccugcacaacuacggcaucgugcacagagaccugaagcccgacaaccugcuggugaccagcaugggccacaucaagcugaccgacuucggccugagcaaggugggccugaugagcaugaccaccaaccuguacgagggccacaucgagaaggacgccagagaguuccuggacaagcaggugugcggcacccccgaguacaucgcccccgaggugauccugagacagggcuacggcaagcccguggacuggugggccaugggcaucauccuguacgaguuccuggugggcugcgugcccuucuucggcgacacccccgaggagcuguucggccaggugaucagcgacgagaucaacuggcccgagaaggacgaggcccccccccccgacgcccaggaccugaucacccugcugcugagacagaacccccuggagagacugggcaccggcggcgccuacgaggugaagcagcacagauucuucagaagccuggacuggaacagccugcugagacagaaggccgaguucaucccccagcuggagagcgaggacgacaccagcuacuucgacaccagaagcgagaaguaccaccacauggagaccgaggaggaggacgacaccaacgacgaggacuucaacguggagaucagacaguucagcagcugcagccacagauucagcaagguguucagcagcaucgacagaaucacccagaacagcgccgaggagaaggaggacagcguggacaagaccaagagcaccacccugcccagcaccgagacccugagcuggagcagcgaguacagcgagaugcagcagcugagcaccagcaacagcagcgacaccgagagcaacagacacaagcugagcagcggccugcugcccaagcuggccaucagcaccgagggcgagcaggacgaggccgccagcugccccggcgacccccacgaggagcccggcaagcccgcccugccccccgaggagugcgcccaggaggagcccgaggugaccacccccgccagcaccaucagcagcagcacccugagcgugggcagcuucagcgagcaccuggaccagaucaacggcagaagcgagugcguggacagcaccgacaacagcagcaagcccagcagcgagcccgccagccacauggccagacagagacuggagagcaccgagaagaagaagaucagcggcaaggugaccaagagccugagcgccagcgcccugagccugaugauccccggcgacauguucgccgugagcccccugggcagccccaugagcccccacagccugagcagcgaccccagcagcagcagagacagcagccccagcagagacagcagcgccgccagcgccagcccccaccagcccaucgugauccacagcagcggcaagaacuacggcuucaccaucagagccaucagaguguacgugggcgacagcgacaucuacaccgugcaccacaucguguggaacguggaggagggcagccccgccugccaggccggccugaaggccggcgaccugaucacccacaucaacggcgagcccgugcacggccuggugcacaccgaggugaucgagcugcugcugaagagcggcaacaaggugagcaucaccaccacccccuucgagaacaccagcaucaagaccggccccgccagaagaaacagcuacaagagcagaauggugagaagaagcaagaagagcaagaagaaggagagccuggagagaagaagaagccuguucaagaagcuggccaagcagcccagcccccugcugcacaccagcagaagcuucagcugccugaacagaagccugagcagcggcgagagccugcccggcagccccacccacagccugagccccagaagccccacccccagcuacagaagcacccccgacuuccccagcggcaccaacagcagccagagcagcagccccagcagcagcgcccccaacagccccgccggcagcggccacaucagacccagcacccugcacggccuggcccccaagcugggcggccagagauacagaagcggcagaagaaagagcgccggcaacaucccccugagcccccuggccagaacccccagccccaccccccagcccaccagcccccagagaagccccagcccccugcugggccacagccugggcaacagcaagaucgcccaggccuuccccagcaagaugcacagcccccccaccaucgugagacacaucgugagacccaagagcgccgagccccccagaagcccccugcugaagagagugcagagcgaggagaagcugagccccagcuacggcagcgacaagaagcaccugugcagcagaaagcacagccuggaggugacccaggaggaggugcagagagagcagagccagagagaggccccccugcagagccuggacgagaacgugugcgacgugcccccccugagcagagccagacccguggagcagggcugccugaagagacccgugagcagaaaggugggcagacaggagagcguggacgaccuggacagagacaagcugaaggccaaggugguggugaagaaggccgacggcuuccccgagaagcaggagagccaccagaagagccacggccccggcagcgaccuggagaacuucgcccuguucaagcuggaggagagagagaagaagguguaccccaaggccguggagagaagcagcaccuucgagaacaaggccagcaugcaggaggcccccccccugggcagccugcugaaggacgcccugcacaagcaggccagcgugagagccagcgagggcgccaugagcgacggcagagugcccgccgagcacagacagggcggcggcgacuucagaagagcccccgcccccggcacccugcaggacggccugugccacagccuggacagaggcaucagcggcaagggcgagggcaccgagaagagcagccaggccaaggagcugcugagaugcgagaagcuggacagcaagcuggccaacaucgacuaccugagaaagaagaugagccuggaggacaaggaggacaaccugugccccgugcugaagcccaagaugaccgccggcagccacgagugccugcccggcaaccccgugagacccaccggcggccagcaggagcccccccccgccagcgagagcagagccuucgugagcagcacccacgccgcccagaugagcgccgugagcuucgugccccugaaggcccugaccggcagaguggacagcggcaccgagaagcccggccugguggcccccgagagccccgugagaaagagccccagcgaguacaagcuggagggcagaagcgugagcugccugaagcccaucgagggcacccuggacaucgcccugcugagcggcccccaggccagcaagaccgagcugcccagccccgagagcgcccagagccccagccccagcggcgacgugagagccagcgugccccccgugcugcccagcagcagcggcaagaagaacgacaccaccagcgccagagagcugagccccagcagccugaagaugaacaagagcuaccugcuggagcccugguuccugccccccagcagaggccugcagaacagccccgccgugagccugcccgaccccgaguucaagagagacagaaagggcccccaccccaccgccagaagccccggcaccgugauggagagcaacccccagcagagagagggcagcagccccaagcaccaggaccacaccaccgaccccaagcugcugaccugccugggccagaaccugcacagccccgaccuggccagacccagaugcccccugccccccgaggccagccccagcagagagaagcccggccugagagagagcagcgagagaggcccccccaccgccagaagcgagagaagcgccgccagagccgacaccugcagagagcccagcauggagcugugcuuccccgagaccgccaagaccagcgacaacagcaagaaccugcugagcgugggcagaacccaccccgacuucuacacccagacccaggccauggagaaggccugggcccccggcggcaagaccaaccacaaggacggccccggcgaggccagacccccccccagagacaacagcagccugcacagcgccggcauccccugcgagaaggagcugggcaaggugagaagaggcguggagcccaagcccgaggcccugcuggccagaagaagccugcagccccccggcaucgagagcgagaagagcgagaagcugagcagcuuccccagccugcagaaggacggcgccaaggagcccgagagaaaggagcagccccugcagagacaccccagcagcauccccccccccccccugaccgccaaggaccugagcagccccgccgccagacagcacugcagcagccccagccacgccagcggcagagagcccggcgccaagcccagcaccgccgagcccagcagcagcccccaggacccccccaagcccguggccgcccacagcgagagcagcagccacaagcccagacccggccccgaccccggcccccccaagaccaagcaccccgacagaagccugagcagccagaagcccagcgugggcgccaccaagggcaaggagcccgccacccagagccugggcggcagcagcagagagggcaagggccacagcaagagcggccccgacguguuccccgccacccccggcagccagaacaaggccagcgacggcaucggccagggcgagggcggccccagcgugccccugcacaccgacagagccccccuggacgccaagccccagcccaccagcggcggcagaccccuggaggugcuggagaagcccgugcaccugcccagacccggccaccccggccccagcgagcccgccgaccagaagcugagcgccgugggcgagaagcagacccugagccccaagcaccccaagcccagcaccgugaaggacugccccacccugugcaagcagaccgacaacagacagaccgacaagagccccagccagcccgccgccaacaccgacagaagagccgagggcaagaagugcaccgaggcccuguacgcccccgccgagggcgacaagcuggaggccggccugagcuucgugcacagcgagaacagacugaagggcgccgagagacccgccgccggcgugggcaagggcuuccccgaggccagaggcaagggccccggcccccagaagccccccaccgaggccgacaagcccaacggcaugaagagaagccccagcgccaccggccagagcagcuucagaagcaccgcccugcccgagaagagccugagcugcagcagcagcuuccccgagaccagagccggcgugagagaggccagcgccgccagcagcgacaccagcagcgccaaggccgccggcggcaugcuggagcugcccgcccccagcaacagagaccacagaaaggcccagcccgccggcgagggcagaacccacaugaccaagagcgacagccugcccagcuucagagugagcacccugccccuggagagccaccaccccgaccccaacaccaugggcggcgccagccacagagacagagcccugagcgugaccgccaccgugggcgagaccaagggcaaggaccccgcccccgcccagcccccccccgccagaaagcagaacgugggcagagacgugaccaagcccagccccgcccccaacaccgacagacccaucagccugagcaacgagaaggacuucguggugagacagagaagaggcaaggagagccugagaagcagcccccacaagaaggcccuguaa

SEQ ID NO: 19670 - RNA, 2640 nt, Artificial Sequence
  MASTL__Homo_sapiens__NP_001165774
auggaccccaccgccggcagcaagaaggagcccggcggcggcgccgccaccgaggagggcgugaacagaaucgccgugcccaagccccccagcaucgaggaguucagcaucgugaagcccaucagcagaggcgccuucggcaagguguaccugggccagaagggcggcaagcuguacgccgugaagguggugaagaaggccgacaugaucaacaagaacaugacccaccaggugcaggccgagagagacgcccuggcccugagcaagagccccuucaucgugcaccuguacuacagccugcagagcgccaacaacguguaccuggugauggaguaccugaucggcggcgacgugaagagccugcugcacaucuacggcuacuucgacgaggagauggccgugaaguacaucagcgagguggcccuggcccuggacuaccugcacagacacggcaucauccacagagaccugaagcccgacaacaugcugaucagcaacgagggccacaucaagcugaccgacuucggccugagcaaggugacccugaacagagacaucaacaugauggacauccugaccacccccagcauggccaagcccagacaggacuacagcagaacccccggccaggugcugagccugaucagcagccugggcuucaacacccccaucgccgagaagaaccaggaccccgccaacauccugagcgccugccugagcgagaccagccagcugagccagggccuggugugccccaugagcguggaccagaaggacaccacccccuacagcagcaagcugcugaagagcugccuggagaccguggccagcaaccccggcaugcccgugaagugccugaccagcaaccugcugcagagcagaaagagacuggccaccagcagcgccagcagccagagccacaccuucaucagcagcguggagagcgagugccacagcagccccaagugggagaaggacugccaggagagcgacgaggcccugggccccaccaugaugagcuggaacgccguggagaagcugugcgccaagagcgccaacgccaucgagaccaagggcuucaacaagaaggaccuggagcuggcccugagccccauccacaacagcagcgcccugcccaccaccggcagaagcugcgugaaccuggccaagaagugcuucagcggcgaggugagcugggaggccguggagcuggacgugaacaacaucaacauggacaccgacaccagccagcugggcuuccaccagagcaaccagugggccguggacagcggcggcaucagcgaggagcaccugggcaagagaagccugaagagaaacuucgagcugguggacagcagccccugcaagaagaucauccagaacaagaagaccugcguggaguacaagcacaacgagaugaccaacugcuacaccaaccagaacaccggccugaccguggaggugcaggaccugaagcugagcgugcacaagagccagcagaacgacugcgccaacaaggagaacaucgugaacagcuucaccgacaagcagcagacccccgagaagcugcccauccccaugaucgccaagaaccugaugugcgagcuggacgaggacugcgagaagaacagcaagagagacuaccugagcagcagcuuccugugcagcgacgacgacagagccagcaagaacaucagcaugaacagcgacagcagcuuccccggcaucagcaucauggagagcccccuggagagccagccccuggacagcgacagaagcaucaaggagagcagcuucgaggagagcaacaucgaggacccccugaucgugacccccgacugccaggagaagaccagccccaagggcguggagaaccccgccgugcaggagagcaaccagaagaugcugggccccccccuggaggugcugaagacccuggccagcaagagaaacgccguggccuucagaagcuucaacagccacaucaacgccagcaacaacagcgagcccagcagaaugaacaugaccagccuggacgccauggacaucagcugcgccuacagcggcagcuaccccauggccaucacccccacccagaagagaagaagcugcaugccccaccagcagacccccaaccagaucaagagcggcacccccuacagaacccccaagagcgugagaagaggcguggcccccguggacgacggcagaauccugggcacccccgacuaccuggcccccgagcugcugcugggcagagcccacggccccgccguggacuggugggcccugggcgugugccuguucgaguuccugaccggcaucccccccuucaacgacgagaccccccagcagguguuccagaacauccugaagagagacauccccuggcccgagggcgaggagaagcugagcgacaacgcccagagcgccguggagauccugcugaccaucgacgacaccaagagagccggcaugaaggagcugaagagacacccccuguucagcgacguggacugggagaaccugcagcaccagaccaugcccuucaucccccagcccgacgacgagaccgacaccagcuacuucgaggccagaaacaccgcccagcaccugaccgugagcggcuucagccuguaa

SEQ ID NO: 19671 - RNA, 1188 nt, Artificial Sequence
  MAT1A__Homo_sapiens__XP_005269899
augaacggccccguggacggccugugcgaccacagccugagcgagggcguguucauguucaccagcgagagcgugggcgagggccaccccgacaagaucugcgaccagaucagcgacgccgugcuggacgcccaccugaagcaggaccccaacgccaagguggccugcgagaccgugugcaagaccggcauggugcugcugugcggcgagaucaccagcauggccaugguggacuaccagagaguggugagagacaccaucaagcacaucggcuacgacgacagcgccaagggcuucgacuucaagaccugcaacgugcugguggcccuggagcagcagagccccgacaucgcccagugcgugcaccuggacagaaacgaggaggacgugggcgccggcgaccagggccugauguucggcuacgccaccgacgagaccgaggagugcaugccccugaccaucauccuggcccacaagcugaacgccagaauggccgaccugagaagaagcggccugcugcccuggcugagacccgacagcaagacccaggugaccgugcaguacaugcaggacaacggcgccgugauccccgugagaauccacaccaucgugaucagcgugcagcacaacgaggacaucacccuggaggagaugagaagagcccugaaggagcaggugaucagagccguggugcccgccaaguaccuggacgaggacaccguguaccaccugcagcccagcggcagauucgugaucggcggcccccagggcgacgccggcgugaccggcagaaagaucaucguggacaccuacggcggcuggggcgcccacggcggcggcgccuucagcggcaaggacuacaccaagguggacagaagcgccgccuacgccgccagauggguggccaagagccuggugaaggccggccugugcagaagagugcuggugcaggugagcuacgccaucggcguggccgagccccugagcaucagcaucuucaccuacggcaccagccagaagaccgagagagagcugcuggacguggugcacaagaacuucgaccugagacccggcgugaucgugagagaccuggaccugaagaagcccaucuaccagaagaccgccugcuacggccacuucggcagaagcgaguuccccugggaggugcccagaaagcugguguucuaa

SEQ ID NO: 19672 - RNA, 1188 nt, Artificial Sequence
  MAT2A__Homo_sapiens__NP_005902
augaacggccagcugaacggcuuccacgaggccuucaucgaggagggcaccuuccuguucaccagcgagagcgugggcgagggccaccccgacaagaucugcgaccagaucagcgacgccgugcuggacgcccaccugcagcaggaccccgacgccaagguggccugcgagaccguggccaagaccggcaugauccugcuggccggcgagaucaccagcagagccgccguggacuaccagaagguggugagagaggccgugaagcacaucggcuacgacgacagcagcaagggcuucgacuacaagaccugcaacgugcugguggcccuggagcagcagagccccgacaucgcccagggcgugcaccuggacagaaacgaggaggacaucggcgccggcgaccagggccugauguucggcuacgccaccgacgagaccgaggagugcaugccccugaccaucgugcuggcccacaagcugaacgccaagcuggccgagcugagaagaaacggcacccugcccuggcugagacccgacagcaagacccaggugaccgugcaguacaugcaggacagaggcgccgugcugcccaucagagugcacaccaucgugaucagcgugcagcacgacgaggaggugugccuggacgagaugagagacgcccugaaggagaaggugaucaaggccguggugcccgccaaguaccuggacgaggacaccaucuaccaccugcagcccagcggcagauucgugaucggcggcccccagggcgacgccggccugaccggcagaaagaucaucguggacaccuacggcggcuggggcgcccacggcggcggcgccuucagcggcaaggacuacaccaagguggacagaagcgccgccuacgccgccagauggguggccaagagccuggugaagggcggccugugcagaagagugcuggugcaggugagcuacgccaucggcgugagccacccccugagcaucagcaucuuccacuacggcaccagccagaagagcgagagagagcugcuggagaucgugaagaagaacuucgaccugagacccggcgugaucgugagagaccuggaccugaagaagcccaucuaccagagaaccgccgccuacggccacuucggcagagacagcuuccccugggaggugcccaagaagcugaaguacuaa

SEQ ID NO: 19673 - RNA, 1005 nt, Artificial Sequence
  MAT2B__Homo_sapiens__NP_037415
auggugggcagagagaaggagcugagcauccacuucgugcccggcagcugcagacugguggaggaggaggugaacauccccaacagaagagugcuggugaccggcgccaccggccugcugggcagagccgugcacaaggaguuccagcagaacaacuggcacgccgugggcugcggcuucagaagagccagacccaaguucgagcaggugaaccugcuggacagcaacgccgugcaccacaucauccacgacuuccagccccacgugaucgugcacugcgccgccgagagaagacccgacgugguggagaaccagcccgacgccgccagccagcugaacguggacgccagcggcaaccuggccaaggaggccgccgccgugggcgccuuccugaucuacaucagcagcgacuacguguucgacggcaccaacccccccuacagagaggaggacauccccgccccccugaaccuguacggcaagaccaagcuggacggcgagaaggccgugcuggagaacaaccugggcgccgccgugcugagaauccccauccuguacggcgagguggagaagcuggaggagagcgccgugaccgugauguucgacaaggugcaguucagcaacaagagcgccaacauggaccacuggcagcagagauuccccacccacgugaaggacguggccaccgugugcagacagcuggccgagaagagaaugcuggaccccagcaucaagggcaccuuccacuggagcggcaacgagcagaugaccaaguacgagauggccugcgccaucgccgacgccuucaaccugcccagcagccaccugagacccaucaccgacagccccgugcugggcgcccagagacccagaaacgcccagcuggacugcagcaagcuggagacccugggcaucggccagagaacccccuucagaaucggcaucaaggagagccuguggcccuuccugaucgacaagagauggagacagaccguguuccacuaa

SEQ ID NO: 19674 - RNA, 1527 nt, Artificial Sequence
  MATK__Homo_sapiens__NP_002369
augcagggccacuuccccgccgagagaagagagggcagacccagaagaggcaccagaggccagcagcagcugcuggugagccccagauuccugagagccuggcaccccccccccgugagcgccagaaugcccaccagaagaugggcccccggcacccagugcaucaccaagugcgagcacaccagacccaagcccggcgagcuggccuucagaaagggcgacguggugaccauccuggaggccugcgagaacaagagcugguacagagugaagcaccacaccagcggccaggagggccugcuggccgccggcgcccugagagagagagaggcccugagcgccgaccccaagcugagccugaugcccugguuccacggcaagaucagcggccaggaggccgugcagcagcugcagccccccgaggacggccuguuccuggugagagagagcgccagacaccccggcgacuacgugcugugcgugagcuucggcagagacgugauccacuacagagugcugcacagagacggccaccugaccaucgacgaggccguguucuucugcaaccugauggacaugguggagcacuacagcaaggacaagggcgccaucugcaccaagcuggugagacccaagagaaagcacggcaccaagagcgccgaggaggagcuggccagagccggcuggcugcugaaccugcagcaccugacccugggcgcccagaucggcgagggcgaguucggcgccgugcugcagggcgaguaccugggccagaagguggccgugaagaacaucaagugcgacgugaccgcccaggccuuccuggacgagaccgccgugaugaccaagaugcagcacgagaaccuggugagacugcugggcgugauccugcaccagggccuguacaucgugauggagcacgugagcaagggcaaccuggugaacuuccugagaaccagaggcagagcccuggugaacaccgcccagcugcugcaguucagccugcacguggccgagggcauggaguaccuggagagcaagaagcuggugcacagagaccuggccgccagaaacauccuggugagcgaggaccugguggccaaggugagcgacuucggccuggccaaggccgagagaaagggccuggacagcagcagacugcccgugaaguggaccgcccccgaggcccugaagcacggcaaguucaccagcaagagcgacguguggagcuucggcgugcugcugugggagguguucagcuacggcagagcccccuaccccaagaugagccugaaggaggugagcgaggccguggagaagggcuacagaauggagccccccgagggcugccccggccccgugcacgugcugaugagcagcugcugggaggccgagcccgccagaagaccccccuucagaaagcuggccgagaagcuggccagagagcugagaagcgccggcgcccccgccagcgugagcggccaggacgccgacggcagcaccagccccagaagccaggagcccuaa

SEQ ID NO: 19675 - RNA, 2871 nt, Artificial Sequence
  MATN2__Homo_sapiens__NP_002371
auggagaagaugcuggccggcugcuuccugcugauccugggccagaucgugcugcugcccgccgaggccagagagagaagcagaggcagaagcaucagcagaggcagacacgccagaacccacccccagaccgcccugcuggagagcagcugcgagaacaagagagccgaccugguguucaucaucgacagcagcagaagcgugaacacccacgacuacgccaaggugaaggaguucaucguggacauccugcaguuccuggacaucggccccgacgugaccagagugggccugcugcaguacggcagcaccgugaagaacgaguucagccugaagaccuucaagagaaagagcgagguggagagagccgugaagagaaugagacaccugagcaccggcaccaugaccggccuggccauccaguacgcccugaacaucgccuucagcgaggccgagggcgccagaccccugagagagaacgugcccagagugaucaugaucgugaccgacggcagaccccaggacagcguggccgagguggccgccaaggccagagacaccggcauccugaucuucgccaucggcgugggccagguggacuucaacacccugaagagcaucggcagcgagccccacgaggaccacguguuccugguggccaacuucagccagaucgagacccugaccagcguguuccagaagaagcugugcaccgcccacaugugcagcacccuggagcacaacugcgcccacuucugcaucaacauccccggcagcuacgugugcagaugcaagcagggcuacauccugaacagcgaccagaccaccugcagaauccaggaccugugcgccauggaggaccacaacugcgagcagcugugcgugaacgugcccggcagcuucgugugccagugcuacagcggcuacgcccuggccgaggacggcaagagaugcguggccguggacuacugcgccagcgagaaccacggcugcgagcacgagugcgugaacgccgacggcagcuaccugugccagugccacgagggcuucgcccugaaccccgacaagaagaccugcaccaagaucgacuacugcgccagcagcaaccacggcugccagcacgagugcgugaacaccgacgacagcuacagcugccacugccugaagggcuucacccugaaccccgacaagaagaccugcagaagaaucaacuacugcgcccugaacaagcccggcugcgagcacgagugcgugaacauggaggagagcuacuacugcagaugccacagaggcuacacccuggaccccaacggcaagaccugcagcagaguggaccacugcgcccagcaggaccacggcugcgagcagcugugccugaacaccgaggacagcuucgugugccagugcagcgagggcuuccugaucaacgaggaccugaagaccugcagcagaguggacuacugccugcugagcgaccacggcugcgaguacagcugcgugaacauggacagaagcuucgccugccagugccccgagggccacgugcugagaagcgacggcaagaccugcgccaagcuggacagcugcgcccugggcgaccacggcugcgagcacagcugcgugagcagcgaggacagcuucgugugccagugcuucgagggcuacauccugagagaggacggcaagaccugcagaagaaaggacgugugccaggccaucgaccacggcugcgagcacaucugcgugaacagcgacgacagcuacaccugcgagugccuggagggcuucagacuggccgaggacggcaagagaugcagaagaaaggacgugugcaagagcacccaccacggcugcgagcacaucugcgugaacaacggcaacagcuacaucugcaagugcagcgagggcuucgugcuggccgaggacggcagaagaugcaagaagugcaccgagggccccaucgaccugguguucgugaucgacggcagcaagagccugggcgaggagaacuucgagguggugaagcaguucgugaccggcaucaucgacagccugaccaucagccccaaggccgccagagugggccugcugcaguacagcacccaggugcacaccgaguucacccugagaaacuucaacagcgccaaggacaugaagaaggccguggcccacaugaaguacaugggcaagggcagcaugaccggccuggcccugaagcacauguucgagagaagcuucacccagggcgagggcgccagaccccugagcaccagagugcccagagccgccaucguguucaccgacggcagagcccaggacgacgugagcgagugggccagcaaggccaaggccaacggcaucaccauguacgccgugggcgugggcaaggccaucgaggaggagcugcaggagaucgccagcgagcccaccaacaagcaccuguucuacgccgaggacuucagcaccauggacgagaucagcgagaagcugaagaagggcaucugcgaggcccuggaggacagcgacggcagacaggacagccccgccggcgagcugcccaagaccgugcagcagcccaccgagagcgagcccgugaccaucaacauccaggaccugcugagcugcagcaacuucgccgugcagcacagauaccuguucgaggaggacaaccugcugagaagcacccagaagcugagccacagcaccaagcccagcggcagcccccuggaggagaagcacgaccagugcaagugcgagaaccugaucauguuccagaaccuggccaacgaggaggugagaaagcugacccagagacuggaggagaugacccagagaauggaggcccuggagaacagacugagauacagauaa

SEQ ID NO: 19676 - RNA, 1461 nt, Artificial Sequence
  MATN3__Homo_sapiens__NP_002372
augcccagacccgcccccgccagaagacugcccggccugcugcugcugcuguggccccugcugcugcugcccagcgccgcccccgaccccguggccagacccggcuucagaagacuggagaccagaggccccggcggcagccccggcagaagacccagccccgccgcccccgacggcgcccccgccagcggcaccagcgagcccggcagagccagaggcgccggcgugugcaagagcagaccccuggaccugguguucaucaucgacagcagcagaagcgugagaccccuggaguucaccaaggugaagaccuucgugagcagaaucaucgacacccuggacaucggccccgccgacaccagaguggccguggugaacuacgccagcaccgugaagaucgaguuccagcugcaggccuacaccgacaagcagagccugaagcaggccgugggcagaaucaccccccugagcaccggcaccaugagcggccuggccauccagaccgccauggacgaggccuucaccguggaggccggcgccagagagcccagcagcaacauccccaagguggccaucaucgugaccgacggcagaccccaggaccaggugaacgagguggccgccagagcccaggccagcggcaucgagcuguacgccgugggcguggacagagccgacauggccagccugaagaugauggccagcgagccccuggaggagcacguguucuacguggagaccuacggcgugaucgagaagcugagcagcagauuccaggagaccuucugcgcccuggaccccugcgugcugggcacccaccagugccagcacgugugcaucagcgacggcgagggcaagcaccacugcgagugcagccagggcuacacccugaacgccgacaagaagaccugcagcgcccuggacagaugcgcccugaacacccacggcugcgagcacaucugcgugaacgacagaagcggcagcuaccacugcgagugcuacgagggcuacacccugaacgaggacagaaagaccugcagcgcccaggacaagugcgcccugggcacccacggcugccagcacaucugcgugaacgacagaaccggcagccaccacugcgagugcuacgagggcuacacccugaacgccgacaagaagaccugcagcgugagagacaagugcgcccugggcagccacggcugccagcacaucugcgugagcgacggcgccgccagcuaccacugcgacugcuaccccggcuacacccugaacgaggacaagaagaccugcagcgccaccgaggaggccagaagacuggugagcaccgaggacgccugcggcugcgaggccacccuggccuuccaggacaaggugagcagcuaccugcagagacugaacaccaagcuggacgacauccuggagaagcugaagaucaacgaguacggccagauccacagauaa

SEQ ID NO: 19677 - RNA, 2544 nt, Artificial Sequence
  MATR3__Homo_sapiens__NP_001181883
augagcaagagcuuccagcagagcagccugagcagagacagccagggccacggcagagaccugagcgccgccggcaucggccugcuggccgccgccacccagagccugagcaugcccgccagccugggcagaaugaaccagggcaccgccagacuggccagccugaugaaccugggcaugagcagcagccugaaccagcagggcgcccacagcgcccugagcagcgccagcaccagcagccacaaccugcagagcaucuucaacaucggcagcagaggcccccugccccugagcagccagcacagaggcgacgccgaccaggccagcaacauccuggccagcuucggccugagcgccagagaccuggacgagcugagcagauaccccgaggacaagaucacccccgagaaccugccccagauccugcugcagcugaagagaagaagaaccgaggagggccccacccugagcuacggcagagacggcagaagcgccaccagagagccccccuacagagugcccagagacgacugggaggagaagagacacuucagaagagacagcuucgacgacagaggccccagccugaaccccgugcuggacuacgaccacggcagcagaagccaggagagcggcuacuacgacagaauggacuacgaggacgacagacugagagacggcgagagaugcagagacgacagcuucuucggcgagaccagccacaacuaccacaaguucgacagcgaguacgagagaaugggcagaggccccggcccccugcaggagagaagccuguucgagaagaagagaggcgccccccccagcagcaacaucgaggacuuccacggccugcugcccaagggcuacccccaccugugcagcaucugcgaccugcccgugcacagcaacaaggaguggagccagcacaucaacggcgccagccacagcagaagaugccagcugcugcuggagaucuaccccgaguggaaccccgacaacgacaccggccacaccaugggcgaccccuucaugcugcagcagagcaccaaccccgcccccggcauccugggcccccccccccccagcuuccaccugggcggccccgccgugggccccagaggcaaccugggcgccggcaacggcaaccugcagggccccagacacaugcagaagggcagaguggagaccagcagaguggugcacaucauggacuuccagagaggcaagaaccugagauaccagcugcugcagcugguggagcccuucggcgugaucagcaaccaccugauccugaacaagaucaacgaggccuucaucgagauggccaccaccgaggacgcccaggccgccguggacuacuacaccaccacccccgcccugguguucggcaagcccgugagagugcaccugagccagaaguacaagagaaucaagaagcccgagggcaagcccgaccagaaguucgaccagaagcaggagcugggcagagugauccaccugagcaaccugccccacagcggcuacagcgacagcgccgugcugaagcuggccgagcccuacggcaagaucaagaacuacauccugaugagaaugaagagccaggccuucaucgagauggagaccagagaggacgccauggccaugguggaccacugccugaagaaggcccugugguuccagggcagaugcgugaagguggaccugagcgagaaguacaagaagcuggugcugagaauccccaacagaggcaucgaccugcugaagaaggacaagagcagaaagagaagcuacagccccgacggcaaggagagccccagcgacaagaagagcaagaccgacggcagccagaagaccgagagcagcaccgagggcaaggagcaggaggagaagagcggcgaggacggcgagaaggacaccaaggacgaccagaccgagcaggagcccaacaugcugcuggagagcgaggacgagcugcugguggacgaggaggaggccgccgcccugcuggagagcggcagcagcgugggcgacgagaccgaccuggccaaccugggcgacguggccagcgacggcaagaaggagcccagcgacaaggccgugaagaaggacggcagcgccagcgccgccgccaagaagaagcugaagaagguggacaagaucgaggagcuggaccaggagaacgaggccgcccuggagaacggcaucaagaacgaggagaacaccgagcccggcgccgagagcagcgagaacgccgacgaccccaacaaggacaccagcgagaacgccgacggccagagcgacgagaacaaggacgacuacaccauccccgacgaguacagaaucggccccuaccagcccaacgugcccgugggcaucgacuacgugauccccaagaccggcuucuacugcaagcugugcagccuguucuacaccaacgaggagguggccaagaacacccacugcagcagccugccccacuaccagaagcugaagaaguuccugaacaagcuggccgaggagagaagacagaagaaggagaccuaa

SEQ ID NO: 19678 - RNA, 1842 nt, Artificial Sequence
  MAU2__Homo_sapiens__NP_056144
auggccgcccaggccgccgccgccgcccaggccgccgccgcccaggccgcccaggccgaggccgccgacagcugguaccuggcccugcugggcuucgccgagcacuucagaaccagcagcccccccaagaucagacugugcgugcacugccugcaggccguguuccccuucaagcccccccagagaaucgaggccagaacccaccugcagcugggcagcgugcuguaccaccacaccaagaacagcgagcaggccagaagccaccuggagaaggccuggcugaucagccagcagaucccccaguucgaggacgugaaguucgaggccgccagccugcugagcgagcuguacugccaggagaacagcguggacgccgccaagccccugcugagaaaggccauccagaucagccagcagacccccuacuggcacugcagacugcuguuccagcuggcccagcugcacacccuggagaaggaccuggugagcgccugcgaccugcugggcgugggcgccgaguacgccagaguggugggcagcgaguacaccagagcccuguuccugcugagcaagggcaugcugcugcugauggagagaaagcugcaggaggugcacccccugcugacccugugcggccagaucguggagaacuggcagggcaaccccauccagaaggagagccugagaguguucuuccuggugcugcaggugacccacuaccuggacgccggccaggugaagagcgugaagcccugccugaagcagcugcagcagugcauccagaccaucagcacccugcacgacgacgagauccugcccagcaaccccgccgaccuguuccacuggcugcccaaggagcacaugugcgugcugguguaccuggugaccgugaugcacagcaugcaggccggcuaccuggagaaggcccagaaguacaccgacaaggcccugaugcagcuggagaagcugaagaugcuggacugcagccccauccugagcagcuuccaggugauccugcuggagcacaucaucaugugcagacuggugaccggccacaaggccaccgcccugcaggagaucagccaggugugccagcugugccagcagagccccagacuguucagcaaccacgccgcccagcugcacacccugcugggccuguacugcgugagcgugaacugcauggacaacgccgaggcccaguucaccaccgcccugagacugaccaaccaccaggagcugugggccuucaucgugaccaaccuggccagcguguacaucagagagggcaacagacaccaggaggugcuguacagccugcuggagagaaucaaccccgaccacagcuuccccgugagcagccacugccugagagccgccgccuucuacgugagaggccuguucagcuucuuccagggcagauacaacgaggccaagagauuccugagagagacccugaagaugagcaacgccgaggaccugaacagacugaccgccugcagccuggugcugcugggccacaucuucuacgugcugggcaaccacagagagagcaacaacaugguggugcccgccaugcagcuggccagcaagauccccgacaugagcgugcagcuguggagcagcgcccugcugagagaccugaacaaggccugcggcaacgccauggacgcccacgaggccgcccagaugcaccagaacuucagccagcagcugcugcaggaccacaucgaggccugcagccugcccgagcacaaccugaucaccuggaccgacggccccccccccgugcaguuccaggcccagaacggccccaacaccagccuggccagccugcuguaa

SEQ ID NO: 19679 - RNA, 1200 nt, Artificial Sequence
  MAVS__Homo_sapiens__NP_001193420
augcccgugcaggagacccaggcccccgagagccccggcgagaacagcgagcaggcccugcagacccugagccccagagccauccccagaaaccccgacggcggcccccuggagagcagcagcgaccuggccgcccugagcccccugaccagcagcggccaccaggagcaggacaccgagcugggcagcacccacaccgccggcgccaccagcagccugacccccagcagaggccccgugagccccagcgugagcuuccagccccuggccagaagcacccccagagccagcagacugcccggccccaccggcagcguggugagcaccggcaccagcuucagcagcagcagccccggccuggccagcgccggcgccgccgagggcaagcagggcgccgagagcgaccaggccgagcccaucaucugcagcagcggcgccgaggcccccgccaacagccugcccagcaaggugcccaccacccugaugcccgugaacaccguggcccugaaggugcccgccaaccccgccagcgugagcaccgugcccagcaagcugcccaccagcagcaagccccccggcgccgugcccagcaacgcccugaccaaccccgcccccagcaagcugcccaucaacagcaccagagccggcauggugcccagcaaggugcccaccagcauggugcugaccaaggugagcgccagcaccgugcccaccgacggcagcagcagaaacgaggagacccccgccgcccccacccccgccggcgccaccggcggcagcagcgccuggcuggacagcagcagcgagaacagaggccugggcagcgagcugagcaagcccggcgugcuggccagccagguggacagccccuucagcggcugcuucgaggaccuggccaucagcgccagcaccagccugggcaugggccccugccacggccccgaggagaacgaguacaagagcgagggcaccuucggcauccacguggccgagaaccccagcauccagcugcuggagggcaaccccggcccccccgccgaccccgacggcggccccagaccccaggccgacagaaaguuccaggagagagaggugcccugccacagacccagccccggcgcccuguggcugcagguggccgugaccggcgugcugguggugacccugcugguggugcuguacagaagaagacugcacuaa

SEQ ID NO: 19680 - RNA, 483 nt, Artificial Sequence
  MAX__Homo_sapiens__NP_002373
augagcgacaacgacgacaucgagguggagagcgacgaggagcagcccagauuccagagcgccgccgacaagagagcccaccacaacgcccuggagagaaagagaagagaccacaucaaggacagcuuccacagccugagagacagcgugcccagccugcagggcgagaaggccagcagagcccagauccuggacaaggccaccgaguacauccaguacaugagaagaaagaaccacacccaccagcaggacaucgacgaccugaagagacagaacgcccugcuggagcagcaggugagagcccuggagaaggccagaagcagcgcccagcugcagaccaacuaccccagcagcgacaacagccuguacaccaacgccaagggcagcaccaucagcgccuucgacggcggcagcgacagcagcagcgagagcgagcccgaggagccccagagcagaaagaagcugagaauggaggccagcuaa

SEQ ID NO: 19681 - RNA, 1482 nt, Artificial Sequence
  MAZ__Homo_sapiens__NP_001036004
auguuccccguguuccccugcacccugcuggccccccccuuccccgugcugggccuggacagcagaggcgugggcggccugaugaacagcuucccccccccccagggccacgcccagaacccccugcaggugggcgccgagcugcagagcagauucuucgccagccagggcugcgcccagagccccuuccaggccgcccccgcccccccccccaccccccaggcccccgccgccgagccccugcagguggaccugcugcccgugcuggccgccgcccaggagagcgccgccgccgccgccgccgccgccgccgccgccgccgccguggccgccgccccccccgcccccgccgccgccagcaccguggacaccgccgcccugaagcagccccccgcccccccccccccccccccccccgugagcgcccccgccgccgaggccgccccccccgccagcgccgccaccaucgccgccgccgccgccaccgccgugguggcccccaccagcaccguggccguggcccccguggccagcgcccuggagaagaagaccaagagcaagggccccuacaucugcgcccugugcgccaaggaguucaagaacggcuacaaccugagaagacacgaggccauccacaccggcgccaaggccggcagagugcccagcggcgccaugaagaugcccaccauggugccccugagccugcugagcgugccccagcugagcggcgccggcggcggcggcggcgaggccggcgccggcggcggcgccgccgccguggccgccggcggcguggugaccaccaccgccagcggcaagagaaucagaaagaaccacgccugcgagaugugcggcaaggccuucagagacguguaccaccugaacagacacaagcugagccacagcgacgagaagcccuaccagugccccgugugccagcagagauucaagagaaaggacagaaugagcuaccacgugagaagccacgacggcgccgugcacaagcccuacaacugcagccacugcggcaagagcuucagcagacccgaccaccugaacagccacgugagacaggugcacagcaccgagagacccuucaagugcgagaagugcgaggccgccuucgccaccaaggacagacugagagcccacaccgugagacacgaggagaaggugcccugccacgugugcggcaagaugcugagcagcgccuacaucagcgaccacaugaaggugcacagccagggcccccaccacgugugcgagcugugcaacaagggcuucaccaccgccgccuaccugagaauccacgccgugaaggaccacggccugcaggcccccagagccgacagaauccugugcaagcugugcagcgugcacugcaagacccccgcccagcuggccggccacaugcagacccaccugggcggcgccgccccccccgugcccggcgacgccccccagccccagcccaccugcuaa

SEQ ID NO: 19682 - RNA, 1569 nt, Artificial Sequence
  MB21D1__Homo_sapiens__NP_612450
augcagcccuggcacggcaaggccaugcagagagccagcgaggccggcgccaccgcccccaaggccagcgccagaaacgccagaggcgcccccauggaccccaccgagagccccgccgcccccgaggccgcccugcccaaggccggcaaguucggccccgccagaaagagcggcagcagacagaagaagagcgcccccgacacccaggagagaccccccgugagagccaccggcgccagagccaagaaggccccccagagagcccaggacacccagcccagcgacgccaccagcgcccccggcgccgagggccuggagccccccgccgccagagagcccgcccugagcagagccggcagcugcagacagagaggcgccagaugcagcaccaagcccagacccccccccggccccugggacgugcccagccccggccugcccgugagcgcccccauccuggugagaagagacgccgcccccggcgccagcaagcugagagccgugcuggagaagcugaagcugagcagagacgacaucagcaccgccgccggcauggugaagggcgugguggaccaccugcugcugagacugaagugcgacagcgccuucagaggcgugggccugcugaacaccggcagcuacuacgagcacgugaagaucagcgcccccaacgaguucgacgugauguucaagcuggaggugcccagaauccagcuggaggaguacagcaacaccagagccuacuacuucgugaaguucaagagaaaccccaaggagaacccccugagccaguuccuggagggcgagauccugagcgccagcaagaugcugagcaaguucagaaagaucaucaaggaggagaucaacgacaucaaggacaccgacgugaucaugaagagaaagagaggcggcagccccgccgugacccugcugaucagcgagaagaucagcguggacaucacccuggcccuggagagcaagagcagcuggcccgccagcacccaggagggccugagaauccagaacuggcugagcgccaaggugagaaagcagcugagacugaagcccuucuaccuggugcccaagcacgccaaggagggcaacggcuuccaggaggagaccuggagacugagcuucagccacaucgagaaggagauccugaacaaccacggcaagagcaagaccugcugcgagaacaaggaggagaagugcugcagaaaggacugccugaagcugaugaaguaccugcuggagcagcugaaggagagauucaaggacaagaagcaccuggacaaguucagcagcuaccacgugaagaccgccuucuuccacgugugcacccagaacccccaggacagccagugggacagaaaggaccugggccugugcuucgacaacugcgugaccuacuuccugcagugccugagaaccgagaagcuggagaacuacuucauccccgaguucaaccuguucagcagcaaccugaucgacaagagaagcaaggaguuccugaccaagcagaucgaguacgagagaaacaacgaguuccccguguucgacgaguucuaa

SEQ ID NO: 19683 - RNA, 1476 nt, Artificial Sequence
  MB21D2__Homo_sapiens__NP_848591
augaagauggccgcccccaccgccaacaaggccgccagccugggcugcaacaacaagcccgccuuccccgagcuggacuucagaagcggcgccagaguggaggagcugaacaagcugauccaggaguucaccaagcacgaccagagagaguacgacgaccagagagcccuggagauccacaccgccaaggacuucaucuucagcaugcugggcauggugcagaagcuggaccagaagcugcccguggccaacgaguaccugcugcugagcggcggcgugagagagggcgugguggaccuggaccuggacgagcugaacguguacgccagaggcaccgacuacgacauggacuucacccugcuggugcccgcccugaagcugcacgacagaaaccagcccgugacccuggacaugagacacagcgcccugugccacagcuggcugagccugagacuguucgacgagggcaccaucagcaaguggaaggacugcugcaccaucguggaccacaucaacggcgccaccaacuacuucuucagccccaccaagguggccgacugguucuacgacagcaucagcaucgugcugagcgagauccagaagaagccccagagaggcaugcccaagguggagaagguggagaagaacggcaccaucaucagcaucauccugggcgugggcagcagcagaaugcuguacgacaucgugcccguggugagcuucaagggcuggcccgccguggcccagagcuggcugauggagaaccacuucugggacggcaagaucaccgaggaggaggugaucagcggcuucuaccuggugcccgccugcagcuacaagggcaagaaggacaacgaguggagacugagcuucgccagaagcgaggugcagcugaagaagugcaucagcagcagccugaugcaggccuaccaggccugcaaggccaucaucaucaagcugcugagcagacccaaggccaucagccccuaccaccugagaagcaugaugcugugggccugcgacagacugcccgccaacuaccuggcccaggaggacuacgccgcccacuuccugcugggccugaucgacgaccugcagcacugccuggugaacaagaugugccccaacuacuucaucccccagugcaacaugcuggagcaccugagcgaggagaccgugaugcugcacgccagaaagcugagcagcgugagaagcgaccccgccgagcaccugagaaccgccaucgagcacgugaaggccgccaacagacugacccuggagcugcagagaagaggcagcaccaccagcauccccagcccccagagcgacggcggcgaccccaaccagcccgacgacagacuggccaagaagcugcagcagcuggugaccgagaaccccggcaagagcaucagcguguucaucaaccccgacgacgugaccagaccccacuucagaaucgacgacaaguucuucuaa

SEQ ID NO: 19684 - RNA, 1968 nt, Artificial Sequence
  MBD1__Homo_sapiens__NP_001191065
auggccgaggacuggcuggacugccccgcccugggccccggcuggaagagaagagagguguucagaaagagcggcgccaccugcggcagaagcgacaccuacuaccagagccccaccggcgacagaaucagaagcaagguggagcugaccagauaccugggccccgccugcgaccugacccuguucgacuucaagcagggcauccugugcuaccccgcccccaaggcccaccccguggccguggccagcaagaagagaaagaagcccagcagacccgccaagaccagaaagagacaggugggcccccagagcggcgaggugagaaaggaggcccccagagacgagaccaaggccgacaccgacaccgcccccgccagcuuccccgcccccggcugcugcgagaacugcggcaucagcuucagcggcgacggcacccagagacagagacugaagacccugugcaaggacugcagagcccagagaaucgccuucaacagagagcagagaauguucaagagagugggcugcggcgagugcgccgccugccaggugaccgaggacugcggcgccugcagcaccugccugcugcagcugccccacgacguggccagcggccuguucugcaagugcgagagaagaagaugccugagaaucguggagagaagcagaggcugcggcgugugcagaggcugccagacccaggaggacugcggccacugccccaucugccugagaccccccagacccggccugagaagacaguggaagugcgugcagagaagaugccugagaggcaagcacgccagaagaaagggcggcugcgacagcaagauggccgccagaagaagacccggcgcccagccccugcccccccccccccccagccagagccccgagcccaccgagccccaccccagagcccuggcccccagcccccccgccgaguucaucuacuacugcguggacgaggacgagcugcagcccuacaccaacagaagacagaacagaaagugcggcgccugcgccgccugccugagaagaauggacugcggcagaugcgacuucugcugcgacaagcccaaguucggcggcagcaaccagaagagacagaagugcagauggagacagugccugcaguucgccaugaagagacugcugcccagcguguggagcgagagcgaggacggcgccggcagccccccccccuacagaagaagaaagagacccagcagcgccagaagacaccaccugggccccacccugaagcccacccuggccaccagaaccgcccagcccgaccacacccaggcccccaccaagcaggaggccggcggcggcuucgugcugcccccccccggcaccgaccugguguuccugagagagggcgccagcagccccgugcaggugcccggccccguggccgccagcaccgaggcccugcugcaggaggcccagugcagcggccugagcugggugguggcccugccccaggugaagcaggagaaggccgacacccaggacgaguggacccccggcaccgccgugcugaccagccccgugcuggugcccggcugccccagcaaggccguggaccccggccugcccagcgugaagcaggagccccccgaccccgaggaggacaaggaggagaacaaggacgacagcgccagcaagcuggcccccgaggaggaggccggcggcgccggcacccccgugaucaccgagaucuucagccugggcggcaccagauucagagacaccgccguguggcugcccagccugcagggcagacacagcggcagagaggacggcugcaaggugugggagaccgaggacaccguggagcccaccagcaccagcuggaaccccagaggcuggcccggcacccacgugagccugagccccccccccgccagcaugaugugggugagcugcagaagaagcuggugccccagcagccagagcuaa

SEQ ID NO: 19685 - RNA, 1236 nt, Artificial Sequence
  MBD2__Homo_sapiens__NP_003918
augagagcccaccccggcggcggcagaugcugccccgagcaggaggagggcgagagcgccgccggcggcagcggcgccggcggcgacagcgccaucgagcagggcggccagggcagcgcccuggcccccagccccgugagcggcgugagaagagagggcgccagaggcggcggcagaggcagaggcagauggaagcaggccggcagaggcggcggcgugugcggcagaggcagaggcagaggcagaggcagaggcagaggcagaggcagaggcagaggcagaggcagaccccccagcggcggcagcggccugggcggcgacggcggcggcugcggcggcggcggcagcggcggcggcggcgcccccagaagagagcccgugcccuuccccagcggcagcgccggccccggccccagaggccccagagccaccgagagcggcaagagaauggacugccccgcccugccccccggcuggaagaaggaggaggugaucagaaagagcggccugagcgccggcaagagcgacguguacuacuucagccccagcggcaagaaguucagaagcaagccccagcuggccagauaccugggcaacaccguggaccugagcagcuucgacuucagaaccggcaagaugaugcccagcaagcugcagaagaacaagcagagacugagaaacgacccccugaaccagaacaagggcaagcccgaccugaacaccacccugcccaucagacagaccgccagcaucuucaagcagcccgugaccaaggugaccaaccaccccagcaacaaggugaagagcgacccccagagaaugaacgagcagcccagacagcuguucugggagaagagacugcagggccugagcgccagcgacgugaccgagcagaucaucaagaccauggagcugcccaagggccugcagggcgugggccccggcagcaacgacgagacccugcugagcgccguggccagcgcccugcacaccagcagcgcccccaucaccggccaggugagcgccgccguggagaagaaccccgccguguggcugaacaccagccagccccugugcaaggccuucaucgugaccgacgaggacaucagaaagcaggaggagagagugcagcaggugagaaagaagcuggaggaggcccugauggccgacauccugagcagagccgccgacaccgaggagauggacaucgagauggacagcggcgacgaggccuaa

SEQ ID NO: 19686 - RNA, 876 nt, Artificial Sequence
  MBD3__Homo_sapiens__NP_001268382
auggagagaaagagaugggagugccccgcccugccccagggcugggagagagaggaggugcccagaagaagcggccugagcgccggccacagagacguguucuacuacagccccagcggcaagaaguucagaagcaagccccagcuggccagauaccugggcggcagcauggaccugagcaccuucgacuucagaaccggcaagaugcugaugagcaagaugaacaagagcagacagagagugagauacgacagcagcaaccaggugaagggcaagcccgaccugaacaccgcccugcccgugagacagaccgccagcaucuucaagcagcccgugaccaagaucaccaaccaccccagcaacaaggugaagagcgacccccagaaggccguggaccagcccagacagcuguucugggagaagaagcugagcggccugaacgccuucgacaucgccgaggagcuggugaagaccauggaccugcccaagggccugcagggcgugggccccggcugcaccgacgagacccugcugagcgccaucgccagcgcccugcacaccagcaccaugcccaucaccggccagcugagcgccgccguggagaagaaccccggcguguggcugaacaccacccagccccugugcaaggccuucauggugaccgacgaggacaucagaaagcaggaggagcuggugcagcaggugagaaagagacuggaggaggcccugauggccgacaugcuggcccacguggaggagcuggccagagacggcgaggccccccuggacaaggccugcgccgaggacgacgacgaggaggacgaggaggaggaggaggaggagcccgaccccgaccccgagauggagcacguguaa

SEQ ID NO: 19687 - RNA, 627 nt, Artificial Sequence
  MBD3L2__Homo_sapiens__NP_653215
augggcgagcccgccuucaccagcuuccccagccugcccgugcugggcaagcugaagagaaacaugaugcccugggcccugcagaagaagagagagauccacauggccaaggcccacagaagaagagccgccagaagcgcccugcccaugagacugaccagcugcaucuucagaagacccgugaccagaaucagaagccaccccgacaaccaggugagaagaagaaagggcgacgagcaccuggagaagccccagcagcugugcgccuacagaagacugcaggcccugcagcccugcagcagccagggcgagggcagcagcccccugcaccuggagagcgugcugagcauccuggcccccggcaccgccggcgagagccuggacagagccggcgccgagagagugagaagcccccuggagcccacccccggcagauuccccgccguggccggcggccccacccccggcaugggcugccagcugccccccccccugagcggccagcuggugacccccgccgacaucagaagacaggccagaagagugaagaaggccagagagagacuggccaaggcccugcaggccgacagacuggccagaagagccgagaugcugaccggcggcuaa

SEQ ID NO: 19688 - RNA, 1725 nt, Artificial Sequence
  MBD4__Homo_sapiens__NP_001263199
augggcaccaccggccuggagagccugagccugggcgacagaggcgccgcccccaccgugaccagcagcgagagacuggugcccgacccccccaacgaccugagaaaggaggacguggccauggagcuggagagagugggcgaggacgaggagcagaugaugaucaagagaagcagcgagugcaacccccugcugcaggagcccaucgccagcgcccaguucggcgccaccgccggcaccgagugcagaaagagcgugcccugcggcugggagagaguggugaagcagagacuguucggcaagaccgccggcagauucgacguguacuucaucagcccccagggccugaaguucagaagcaagagcagccuggccaacuaccugcacaagaacggcgagaccagccugaagcccgaggacuucgacuucaccgugcugagcaagagaggcaucaagagcagauacaaggacugcagcauggccgcccugaccagccaccugcagaaccagagcaacaacagcaacuggaaccugagaaccagaagcaagugcaagaaggacguguucaugccccccagcagcagcagcgagcugcaggagagcagaggccugagcaacuucaccagcacccaccugcugcugaaggaggacgagggcguggacgacgugaacuucagaaaggugagaaagcccaagggcaaggugaccauccugaagggcauccccaucaagaagaccaagaagggcugcagaaagagcugcagcggcuucgugcagagcgacagcaagagagagagcgugugcaacaaggccgacgccgagagcgagcccguggcccagaagagccagcuggacagaaccgugugcaucagcgacgccggcgccugcggcgagacccugagcgugaccagcgaggagaacagccuggugaagaagaaggagagaagccugagcagcggcagcaacuucugcagcgagcagaagaccagcggcaucaucaacaaguucugcagcgccaaggacagcgagcacaacgagaaguacgaggacaccuuccuggagagcgaggagaucggcaccaagguggaggugguggagagaaaggagcaccugcacaccgacauccugaagagaggcagcgagauggacaacaacugcagccccaccagaaaggacuucaccgaggacaccauccccagaacccagaucgagagaagaaagaccagccuguacuucagcagcaaguacaacaaggaggcccugagcccccccagaagaaaggccuucaagaaguggaccccccccagaagccccuucaaccuggugcaggagacccuguuccacgaccccuggaagcugcugaucgccaccaucuuccugaacagaaccagcggcaagauggccauccccgugcuguggaaguuccuggagaaguaccccagcgccgagguggccagaaccgccgacuggagagacgugagcgagcugcugaagccccugggccuguacgaccugagagccaagaccaucgugaaguucagcgacgaguaccugaccaagcaguggaaguaccccaucgagcugcacggcaucggcaaguacggcaacgacagcuacagaaucuucugcgugaacgaguggaagcaggugcaccccgaggaccacaagcugaacaaguaccacgacuggcugugggagaaccacgagaagcugagccugagcuaa

SEQ ID NO: 19689 - RNA, 4485 nt, Artificial Sequence
  MBD5__Homo_sapiens__NP_060798
augaacggcggcaaggagugcgacggcggcgacaaggagggcggccugcccgccauccaggugcccgugggcuggcagagaagaguggaccagaacggcgugcuguacgugagccccagcggcagccugcugagcugccuggagcaggugaagaccuaccugcugaccgacggcaccugcaagugcggccuggagugcccccugauccugcccaagguguucaacuucgaccccggcgccgccgugaagcagagaaccgccgaggacgugaaggccgacgaggacgugaccaagcugugcauccacaagagaaagaucaucgccguggccacccugcacaagagcauggaggccccccaccccagccuggugcugaccagccccggcggcggcaccaacgccacccccguggugcccagcagagccgccacccccagaagcgugagaaacaagagccacgagggcaucaccaacagcgugaugcccgagugcaagaaccccuucaagcugaugaucggcagcagcaacgccaugggcagacuguacgugcaggagcugcccggcagccagcagcaggagcugcaccccguguaccccagacagagacugggcagcagcgagcacggccagaagagccccuucagaggcagccacggcggccugcccagccccgccagcagcggcagccagaucuacggcgacggcagcaucagccccagaaccgacccccugggcagccccgacguguucaccagaagcaaccccggcuuccacggcgcccccaacagcagccccauccaccugaacagaaccccccugagcccccccagcgugaugcugcacggcagccccgugcagagcagcugcgccauggccggcagaaccaacaucccccugagccccacccugaccaccaagagccccgugaugaagaagcccaugugcaacuucagcaccaacauggagauccccagagccauguuccaccacaagcccccccagggccccccccccccccccccccccagcugcgcccugcagaagaagccccugaccagcgagaaggacccccugggcauccuggaccccauccccagcaagcccgugaaccagaaccccgugaucaucaaccccaccagcuuccacagcaacgugcacagccaggugcccaugaugaacgugagcaugccccccgccguggugccccugcccagcaaccugccccugcccaccgugaagcccggccacaugaaccacggcagccacgugcagagagugcagcacagcgccagcaccagccugagccccagccccgugaccagccccgugcacaugaugggcaccggcaucggcagaaucgaggccagcccccagagaagcagaagcagcagcaccagcagcgaccacggcaacuucaugaugccccccgugggcccccaggccaccagcagcggcaucaaggugccccccagaagccccagaagcaccaucggcagccccagacccagcaugcccagcagccccagcaccaagagcgacggccaccaccaguacaaggacauccccaacccccugaucgccggcaucagcaacgugcugaacacccccagcagcgccgccuuccccaccgccagcgccggcagcagcagcgugaagagccagcccggccugcugggcaugccccugaaccagauccugaaccagcacaacgccgccagcuuccccgccagcagccugcugagcgccgccgccaaggcccagcuggccaaccagaacaagcuggccggcaacaacagcagcagcagcagcaacagcggcgccguggccggcagcggcaacaccgagggccacagcacccugaacaccauguucccccccaccgccaacaugcugcugcccaccggcgagggccagagcggcagagccgcccugagagacaagcugaugagccagcagaaggacgcccugagaaagagaaagcagccccccaccaccgugcugagccugcugagacagagccagauggacagcagcgccgugcccaagcccggccccgaccugcugagaaagcagggccagggcagcuuccccaucagcagcaugagccagcugcugcagagcaugagcugccagagcagccaccugagcagcaacagcacccccggcugcggcgccagcaacaccgcccugcccugcagcgccaaccagcugcacuucaccgaccccagcaugaacagcagcgugcugcagaacaucccccugagaggcgaggccgugcacugccacaacgccaacaccaacuucgugcacagcaacagccccgugcccaaccaccaccuggccggccugaucaaccagauccaggccagcggcaacugcggcaugcugagccagagcggcauggcccugggcaacagccugcaccccaaccccccccagagcagaaucagcaccagcagcacccccgugauccccaacagcaucgugagcagcuacaaccagaccagcagcgaggccggcggcagcggccccagcagcagcaucgccaucgccggcaccaaccaccccgccaucaccaagaccaccagcgugcugcaggacggcgugaucgugaccaccgccgccggcaacccccugcagagccagcugcccaucggcagcgacuuccccuucgugggccaggagcacgcccugcacuuccccagcaacagcaccagcaacaaccaccugccccacccccugaaccccagccugcugagcagccugcccaucagccugcccgugaaccagcagcaccugcugaaccagaaccugcugaacauccugcagcccagcgccggcgagggcgacaugagcagcaucaacaacacccugagcaaccaccagcugacccaccugcagagccugcugaacaacaaccagauguucccccccaaccagcagcagcagcagcugcugcagggcuaccagaaccugcaggccuuccagggccagagcaccauccccugccccgccaacaacaaccccauggccugccuguuccagaacuuccaggugagaaugcaggaggacgccgcccugcugaacaagagaaucagcacccagcccggccugaccgcccugcccgagaaccccaacaccacccugccccccuuccaggacacccccugcgagcugcagcccagaaucgaccccagccugggccagcaggugaaggacggccugguggugggcggccccggcgacgccagcguggacgccaucuacaaggccgugguggacgccgccagcaagggcaugcagguggugaucaccaccgccgugaacagcaccacccagaucagccccauccccgcccugagcgccaugagcgccuucaccgccagcaucggcgacccccugaaccugagcagcgccgugagcgccgugauccacggcagaaacaugggcggcguggaccacgacggcagacugagaaacagcagaggcgccagacugcccaagaaccuggaccacggcaagaacgugaacgagggcgacggcuucgaguacuucaagagcgccagcugccacaccagcaagaagcagugggacggcgagcagagccccagaggcgagagaaacagauggaaguacgaggaguuccuggaccaccccggccacauccacagcagccccugccacgagagacccaacaacgugagcacccugcccuuccugcccggcgagcagcaccccauccugcugccccccagaaacugccccggcgacaagauccuggaggagaacuucagauacaacaacuacaagagaaccaugaugagcuucaaggagagacuggagaacaccguggagagaugcgcccacaucaacggcaacagacccagacagagcagaggcuucggcgagcugcugagcaccgccaagcaggaccuggugcuggaggagcagagccccagcagcagcaacagccuggagaacagccuggugaaggacuacauccacuacaacggcgacuucaacgccaagagcgugaacggcugcgugcccagccccagcgacgccaagagcaucagcagcgaggacgaccugagaaaccccgacagccccagcagcaacgagcugauccacuacagacccagaaccuucaacgugggcgaccugguguggggccagaucaagggccugaccagcuggcccggcaagcuggugagagaggacgacgugcacaacagcugccagcagagccccgaggagggcaagguggagcccgagaagcugaagacccugaccgagggccuggaggccuacagcagagugagaaagagaaacagaaagagcggcaagcugaacaaccaccuggaggccgccauccacgaggccaugagcgagcuggacaagaugagcggcaccgugcaccagaucccccagggcgacagacagaugagaccccccaagcccaagagaagaaagaucagcagauaa

SEQ ID NO: 19690 - RNA, 3012 nt, Artificial Sequence
  MBD6__Homo_sapiens__NP_443129
augaacggcggcaacgagagcagcggcgccgacagagccggcggccccguggccaccagcgugcccaucggcuggcagagaugcgugagagagggcgccgugcuguacaucagccccagcggcaccgagcugagcagccuggagcagaccagaagcuaccugcugagcgacggcaccugcaagugcggccuggagugcccccugaacgugcccaagguguucaacuucgacccccuggcccccgugacccccggcggcgccggcgugggccccgccagcgaggaggacaugaccaagcugugcaaccacagaagaaaggccguggccauggccacccuguacagaagcauggagaccaccugcagccacagcagccccggcgagggcgccagcccccagauguuccacaccgugagccccggcccccccagcgccagaccccccugcagagugccccccaccaccccccugaacggcggccccggcagccugccccccgagccccccagcgugagccaggccuuccccacccuggccggccccggcggccuguucccccccagacuggccgaccccgugcccagcggcggcagcagcagccccagauuccugcccagaggcaacgcccccagccccgcccccccccccccccccgccaucagccugaacgcccccagcuacaacuggggcgccgcccugagaagcagccuggugcccagcgaccugggcagcccccccgccccccacgccagcagcagcccccccagcgaccccccccuguuccacugcagcgacgcccugaccccccccccccugccccccagcaacaaccugcccgcccaccccggccccgccagccagccccccgugagcagcgccaccaugcaccugccccuggugcugggcccccugggcggcgcccccaccguggagggccccggcgccccccccuuccuggccagcagccugcugagcgccgccgccaaggcccagcaccccccccugcccccccccagcacccugcagggcagaagacccagagcccaggcccccagcgccagccacagcagcagccugagacccagccagagaagacccagaagaccccccaccguguucagacugcuggagggcagaggcccccagacccccagaagaagcagacccagagcccccgcccccgugccccagcccuucagccugcccgagcccagccagcccauccugcccagcgugcugagccugcugggccugcccacccccggccccagccacagcgacggcagcuucaaccugcugggcagcgacgcccaccugccccccccccccacccugagcagcggcagccccccccagcccagacaccccauccagcccagccugcccggcaccaccagcggcagccugagcagcgugcccggcgcccccgccccccccgccgccagcaaggcccccguggugcccagccccgugcugcagagccccagcgagggccugggcaugggcgccggccccgccugcccccugcccccccuggccggcggcgaggccuuccccuuccccagccccgagcagggccuggcccugagcggcgccggcuuccccggcaugcugggcgcccugccccugccccugagccugggccagcccccccccagcccccugcugaaccacagccuguucggcgugcugaccggcggcggcggccagcccccccccgagccccugcugcccccccccggcggccccggccccccccuggcccccggcgagcccgagggccccagccugcugguggccagccugcugccccccccccccagcgaccugcugcccccccccagcgccccccccagcaaccugcuggccagcuuccugccccugcuggcccugggccccaccgccggcgacggcgagggcagcgccgagggcgccggcggccccagcggcgagcccuucagcggccugggcgaccugagcccccugcuguuccccccccugagcgccccccccacccugaucgcccugaacagcgcccugcuggccgccacccuggacccccccagcggcacccccccccagcccugcgugcugagcgccccccagcccggcccccccaccagcagcgugaccaccgccaccaccgaccccggcgccagcagccugggcaaggcccccagcaacagcggcagacccccccagcugcugagcccccugcugggcgccagccugcugggcgaccugagcagccugaccagcagccccggcgcccugcccagccugcugcagccccccggcccccugcugagcggccagcugggccugcagcugcugcccggcggcggcgccccccccccccugagcgaggccagcagcccccuggccugccugcugcagagccugcagaucccccccgagcagcccgaggcccccugccugccccccgagagccccgccagcgcccuggagcccgagcccgccagacccccccugagcgcccuggcccccccccacggcagccccgacccccccgugcccgagcugcugaccggcagaggcagcggcaagagaggcagaagaggcggcggcggccugagaggcaucaacggcgaggccagacccgccagaggcagaaagcccggcagcagaagagagcccggcagacuggcccugaaguggggcaccagaggcggcuucaacggccagauggagagaagccccagaagaacccaccacuggcagcacaacggcgagcuggccgagggcggcgccgagcccaaggacccccccccccccggcccccacagcgaggaccugaaggugccccccggcguggugagaaagagcagaagaggcagaagaagaaaguacaaccccaccagaaacagcaacagcagcagacaggacaucacccuggagcccagccccaccgccagagccgccgugccccugccccccagagccagacccggcagacccgccaagaacaagagaagaaagcuggcccccuaa

SEQ ID NO: 19691 - RNA, 465 nt, Artificial Sequence
  MB__Homo_sapiens__XP_005261662
augggccugagcgacggcgaguggcagcuggugcugaacguguggggcaagguggaggccgacauccccggccacggccaggaggugcugaucagacuguucaagggccaccccgagacccuggagaaguucgacaaguucaagcaccugaagagcgaggacgagaugaaggccagcgaggaccugaagaagcacggcgccaccgugcugaccgcccugggcggcauccugaagaagaagggccaccacgaggccgagaucaagccccuggcccagagccacgccaccaagcacaagauccccgugaaguaccuggaguucaucagcgagugcaucauccaggugcugcagagcaagcaccccggcgacuucggcgccgacgcccagggcgccaugaacaaggcccuggagcuguucagaaaggacauggccagcaacuacaaggagcugggcuuccagggcuaa

SEQ ID NO: 19692 - RNA, 1032 nt, Artificial Sequence
  MBIP__Homo_sapiens__NP_001138363
auggccgccgccaccgagcugaacagacccagcagcggcgacagaaaccuggagagaagaugcagacccaaccugagcagagaggugcuguacgagaucuucagaagccugcacacccuggugggccagcuggaccugagagacgacguggugaagaucaccaucgacuggaacaagcugcagagccugagcgccuuccagcccgcccugcuguucagcgcccuggagcagcacauccuguaccugcagcccuuccuggccaagcugcagagccccaucaaggaggagaacaccaccgccguggaggagaucggcagaaccgagaugggcaacaagaacgaggugaacgacaaguucagcaucggcgaccugcaggaggaggagaagcacaaggagagcgaccugagagacgugaagaagacccagauccacuucgaccccgagguggugcagaucaaggccggcaaggccgagaucgacagaagaaucagcgccuucaucgagagaaagcaggccgagaucaacgagaacaacgugagagaguucugcaacgugaucgacugcaaccaggagaacagcugcgccagaaccgacgccaucuucacccccuaccccggcuucaagagccacgugaaggugagcagaguggugaacaccuacggcccccagaccagacccgagggcauccccggcagcggccacaagcccaacagcaugcugagagacugcggcaaccaggccguggaggagagacugcagaacaucgaggcccaccugagacugcagaccggcggccccgugcccagagacaucuaccagagaaucaagaagcuggaggacaagauccuggagcuggagggcaucagccccgaguacuuccagagcgugagcuucagcggcaagagaagaaaggugcagcccccccagaacuacagccuggccgagcuggacgagaagaucagcgcccugaagcaggcccugcugagaaagagcagagaggccgagagcauggccacccaccaccugcccuaa

SEQ ID NO: 19693 - RNA, 747 nt, Artificial Sequence
  MBL2__Homo_sapiens__XP_011538118
augagccuguuccccagccugccccugcugcugcugagcaugguggccgccagcuacagcgagaccgugaccugcgaggacgcccagaagaccugccccgccgugaucgccugcagcagccccggcaucaacggcuuccccggcaaggacggcagagacggcaccaagggcgagaagggcgagcccggccagggccugagaggccugcagggcccccccggcaagcugggcccccccggcaaccccggccccagcggcagccccggccccaagggccagaagggcgaccccggcaagagccccgacggcgacagcagccuggccgccagcgagagaaaggcccugcagaccgagauggccagaaucaagaaguggcugaccuucagccugggcaagcaggugggcaacaaguucuuccugaccaacggcgagaucaugaccuucgagaaggugaaggcccugugcgugaaguuccaggccagcguggccacccccagaaacgccgccgagaacggcgccauccagaaccugaucaaggaggaggccuuccugggcaucaccgacgagaagaccgagggccaguucguggaccugaccggcaacagacugaccuacaccaacuggaacgagggcgagcccaacaacgccggcagcgacgaggacugcgugcugcugcugaagaacggccaguggaacgacgugcccugcagcaccagccaccuggccgugugcgaguuccccaucuaa

SEQ ID NO: 19694 - RNA, 1149 nt, Artificial Sequence
  MBNL1__Homo_sapiens__NP_066368
auggccgugagcgugacccccaucagagacaccaaguggcugacccuggaggugugcagagaguuccagagaggcaccugcagcagacccgacaccgagugcaaguucgcccaccccagcaagagcugccagguggagaacggcagagugaucgccugcuucgacagccugaagggcagaugcagcagagagaacugcaaguaccugcacccccccccccaccugaagacccagcuggagaucaacggcagaaacaaccugauccagcagaagaacauggccaugcuggcccagcagaugcagcuggccaacgccaugaugcccggcgccccccugcagcccgugcccauguucagcguggcccccagccuggccaccaacgccagcgccgccgccuucaaccccuaccugggccccgugagccccagccuggugcccgccgagauccugcccaccgcccccaugcuggugaccggcaaccccggcgugcccgugcccgccgccgccgccgccgccgcccagaagcugaugagaaccgacagacuggaggugugcagagaguaccagagaggcaacugcaacagaggcgagaacgacugcagauucgcccaccccgccgacagcaccaugaucgacaccaacgacaacaccgugaccgugugcauggacuacaucaagggcagaugcagcagagagaagugcaaguacuuccacccccccgcccaccugcaggccaagaucaaggccgcccaguaccaggugaaccaggccgccgccgcccaggccgccgccaccgccgccgccaugggcaucccccaggccgugcugcccccccugcccaagagacccgcccuggagaagaccaacggcgccaccgccguguucaacaccggcaucuuccaguaccagcaggcccuggccaacaugcagcugcagcagcacaccgccuuccugccccccggcagcauccugugcaugacccccgccaccagcguggugcccauggugcacggcgccacccccgccaccgugagcgccgccaccaccagcgccaccagcgugcccuucgccgccaccgccaccgccaaccagauccccaucaucagcgccgagcaccugaccagccacaaguacgugacccagauguaa

SEQ ID NO: 19695 - RNA, 1104 nt, Artificial Sequence
  MBNL2__Homo_sapiens__NP_659002
auggcccugaacguggcccccgugagagacaccaaguggcugacccuggaggugugcagacaguuccagagaggcaccugcagcagaagcgacgaggagugcaaguucgcccacccccccaagagcugccagguggagaacggcagagugaucgccugcuucgacagccugaagggcagaugcagcagagagaacugcaaguaccugcacccccccacccaccugaagacccagcuggagaucaacggcagaaacaaccugauccagcagaagaccgccgccgccaugcuggcccagcagaugcaguucauguuccccggcaccccccugcaccccgugcccaccuuccccgugggccccgccaucggcaccaacaccgccaucagcuucgcccccuaccuggcccccgugacccccggcgugggccuggugcccaccgagauccugcccaccacccccgugaucgugcccggcagcccccccgugaccgugcccggcagcaccgccacccagaagcugcugagaaccgacaagcuggaggugugcagagaguuccagagaggcaacugcgccagaggcgagaccgacugcagauucgcccaccccgccgacagcaccaugaucgacaccagcgacaacaccgugaccgugugcauggacuacaucaagggcagaugcaugagagagaagugcaaguacuuccacccccccgcccaccugcaggccaagaucaaggccgcccagcaccaggccaaccaggccgccguggccgcccaggccgccgccgccgccgccaccgugauggccuucccccccggcgcccugcacccccugcccaagagacaggcccuggagaagagcaacggcaccagcgccguguucaaccccagcgugcugcacuaccagcaggcccugaccagcgcccagcugcagcagcacgccgccuucauccccaccggcagcgugcugugcaugacccccgccaccagcaucgugcccaugaugcacagcgccaccagcgccaccgugagcgccgccaccacccccgccaccagcgugcccuucgccgccaccgccaccgccaaccagaucauccugaaguaa

SEQ ID NO: 19696 - RNA, 1488 nt, Artificial Sequence
  MBOAT1__Homo_sapiens__NP_001073949
auggccgccgagccccagcccagcagccugagcuacagaaccaccggcagcaccuaccugcacccccugagcgagcugcugggcaucccccuggaccaggugaacuucguggugugccagcugguggcccuguucgccgccuucugguucagaaucuaccugagacccggcaccaccagcagcgacgugagacacgccguggccaccaucuucggcaucuacuucgugaucuucugcuucggcugguacagcgugcaccuguucgugcuggugcugaugugcuacgccaucauggugaccgccagcgugagcaacauccacagauacagcuucuucguggccaugggcuaccugaccaucugccacaucagcagaaucuacaucuuccacuacggcauccugaccaccgacuucagcggcccccugaugaucgugacccagaagaucaccacccuggccuuccaggugcacgacggccugggcagaagagccgaggaccugagcgccgagcagcacagacuggccaucaaggugaagcccagcuuccuggaguaccugagcuaccugcugaacuucaugagcgugaucgccggccccugcaacaacuucaaggacuacaucgccuucaucgagggcaagcacauccacaugaagcugcuggaggugaacuggaagagaaagggcuuccacagccugcccgagcccagccccaccggcgccgugauccacaagcugggcaucacccuggugagccugcugcuguuccugacccugaccaagaccuuccccgugaccugccugguggacgacugguucgugcacaaggccagcuuccccgccagacugugcuaccuguacguggugaugcaggccagcaagcccaaguacuacuucgccuggacccuggccgacgccgugaacaacgccgccggcuucggcuucagcggcguggacaagaacggcaacuucugcugggaccugcugagcaaccugaacaucuggaagaucgagaccgccaccagcuucaagauguaccuggagaacuggaacauccagaccgccaccuggcugaagugcgugugcuaccagagagugcccugguaccccaccgugcugaccuucauccugagcgcccuguggcacggcguguaccccggcuacuacuucaccuuccugaccggcauccuggugacccuggccgccagagccgugagaaacaacuacagacacuacuuccugagcagcagagcccugaaggccguguacgacgccggcaccugggccgugacccagcuggccgugagcuacaccguggcccccuucgugaugcuggccguggagcccaccaucagccuguacaagagcauguacuucuaccugcacaucaucagccugcugaucauccuguuccugcccaugaagccccaggcccacacccagagaagaccccagacccugaacagcaucaacaagagaaagaccgacuaa

SEQ ID NO: 19697 - RNA, 1563 nt, Artificial Sequence
  MBOAT2__Homo_sapiens__NP_620154
auggccaccaccagcaccaccggcagcacccugcugcagccccugagcaacgccgugcagcugcccaucgaccaggugaacuucguggugugccagcuguucgcccugcuggccgccaucugguucagaaccuaccugcacagcagcaagaccagcagcuucaucagacacgugguggccacccugcugggccuguaccuggcccuguucugcuucggcugguacgcccugcacuuccuggugcagagcggcaucagcuacugcaucaugaucaucaucggcguggagaacaugcacaacuacugcuucguguucgcccugggcuaccugaccgugugccaggugaccagaguguacaucuucgacuacggccaguacagcgccgacuucagcggccccaugaugaucaucacccagaagaucaccagccuggccugcgagauccacgacggcauguucagaaaggacgaggagcugaccagcagccagagagaccuggccgugagaagaaugcccagccugcuggaguaccugagcuacaacugcaacuucaugggcauccuggccggcccccugugcagcuacaaggacuacaucaccuucaucgagggcagaagcuaccacaucacccagagcggcgagaacggcaaggaggagacccaguacgagagaaccgagcccagccccaacaccgccguggugcagaagcugcuggugugcggccugagccugcuguuccaccugaccaucugcaccacccugcccguggaguacaacaucgacgagcacuuccaggccaccgccagcuggcccaccaagaucaucuaccuguacaucagccugcuggccgccagacccaaguacuacuucgccuggacccuggccgacgccaucaacaacgccgccggcuucggcuucagaggcuacgacgagaacggcgccgccagaugggaccugaucagcaaccugagaauccagcagaucgagaugagcaccagcuucaagauguuccuggacaacuggaacauccagaccgcccuguggcugaagagagugugcuacgagagaaccagcuucagccccaccauccagaccuucauccugagcgccaucuggcacggcguguaccccggcuacuaccugaccuuccugaccggcgugcugaugacccuggccgccagagccaugagaaacaacuucagacacuacuucaucgagcccagccagcugaagcuguucuacgacgugaucaccuggaucgugacccagguggccaucagcuacaccguggugcccuucgugcugcugagcaucaagcccagccugaccuucuacagcagcugguacuacugccugcacauccugggcauccuggugcugcugcugcugcccgugaagaagacccagagaagaaagaacacccacgagaacauccagcugagccagagcaagaaguucgacgagggcgagaacagccugggccagaacagcuucagcaccaccaacaacgugugcaaccagaaccaggagaucgccagcagacacagcagccugaagcaguaa

SEQ ID NO: 19698 - RNA, 1308 nt, Artificial Sequence
  MBOAT4__Homo_sapiens__XP_011542911
auggaguggcuguggcuguucuuccugcaccccaucagcuucuaccagggcgccgccuuccccuucgcccugcuguucaacuaccugugcaucauggacagcuucagcaccagagccagauaccuguuccugcugaccggcggcggcgcccuggccguggccgccaugggcagcuacgccgugcugguguucacccccgccgugugcgccguggcccugcugugcagccuggccccccagcaggugcacagauggaccuucugcuuccagaugagcuggcagacccugugccaccugggccugcacuacaccgaguacuaccugcacgagccccccagcgugagauucugcaucacccugagcagccugaugcugcugacccagagagugaccagccugagccuggacaucugcgagggcaaggugaaggccgccagcggcggcuucagaagcagaagcagccugagcgagcacgugugcaaggcccugcccuacuucagcuaccugcuguucuuccccgcccugcugggcggcagccugugcagcuuccagagauuccaggccagagugcagggcagcagcgcccugcaccccagacacagcuucugggcccugagcuggagaggccugcagauccugggccuggagugccugaacguggccgugagcagagugguggacgccggcgccggccugaccgacugccagcaguucgagugcaucuacgugguguggaccaccgccggccuguucaagcugaccuacuacagccacuggauccuggacgacagccugcugcacgccgccggcuucggccccgagcugggccagagccccggcgaggagggcuacgugcccgacgccgacaucuggacccuggagagaacccacagaaucagcguguucagcagaaaguggaaccagagcaccgccagauggcugagaagacugguguuccagcacagcagagccuggccccugcugcagaccuucgccuucagcgccugguggcacggccugcaccccggccagguguucggcuucgugugcugggccgugaugguggaggccgacuaccugauccacagcuucgccaacgaguucaucagaagcuggcccaugagacuguucuacagaacccugaccugggcccacacccagcugaucaucgccuacaucaugcuggccguggaggugagaagccugagcagccuguggcugcugugcaacagcuacaacagcguguuccccaugguguacugcauccugcugcugcugcuggccaagagaaagcacaagugcaacuaa

SEQ ID NO: 19699 - RNA, 594 nt, Artificial Sequence
  MBP__Homo_sapiens__NP_001020252
auggccagccagaagagacccagccagagacacggcagcaaguaccuggccaccgccagcaccauggaccacgccagacacggcuuccugcccagacacagagacaccggcauccuggacagcaucggcagauucuucggcggcgacagaggcgcccccaagagaggcagcggcaaggugcccuggcugaagcccggcagaagcccccugcccagccacgccagaagccagcccggccugugcaacauguacaaggacagccaccaccccgccagaaccgcccacuacggcagccugccccagaagagccacggcagaacccaggacgagaaccccguggugcacuucuucaagaacaucgugacccccagaacccccccccccagccagggcaagggcagaggccugagccugagcagauucagcuggggcgccgagggccagagacccggcuucggcuacggcggcagagccagcgacuacaagagcgcccacaagggcuucaagggcguggacgcccagggcacccugagcaagaucuucaagcugggcggcagagacagcagaagcggcagccccauggccagaagauaa

SEQ ID NO: 19700 - RNA, 1956 nt, Artificial Sequence
  MBTD1__Homo_sapiens__XP_005257525
auggagaacaccaaggaccugaccgagcacagcagcagaagcgagagaaagagaagagacagcuucggcauguucgacggcuacgacagcugcagcgaggacaccagcagcagcagcagcagcgaggagagcgaggaggagguggccccccugcccagcaaccugcccaucaucaagaacaacggccagguguacaccuaccccgacggcaagagcggcauggccaccugcgagaugugcggcauggugggcgugagagacgccuucuacagcaagaccaagagauucugcagcgugagcugcagcagaagcuacagcagcaacagcaagaaggccagcauccuggccagacugcagggcaagccccccaccaagaaggccaaggugcugcagaagcagccccugguggccaagcuggccgccuacgcccaguaccaggccacccugcagaaccaggccaagaccaaggccgccgugagcauggagggcuucagcuggggcaacuacaucaacagcaacagcuucaucgccgcccccgugaccugcuucaagcacgcccccaugggcaccugcuggggcgacaucagcgagaacgugagaguggaggugcccaacaccgacugcagccugcccaccaagguguucuggaucgccggcaucgugaagcuggccggcuacaacgcccugcugagauacgagggcuucgagaacgacagcggccuggacuucuggugcaacaucugcggcagcgacauccaccccgugggcuggugcgccgccagcggcaagccccuggugccccccagaaccauccagcacaaguacaccaacuggaaggccuuccuggugaagagacugaccggcgccaagacccugccccccgacuucagccagaaggugagcgagagcaugcaguaccccuucaagcccugcaugagaguggaggugguggacaagagacaccugugcagaaccagaguggccgugguggagagcgugaucggcggcagacugagacugguguacgaggagagcgaggacagaaccgacgacuucuggugccacaugcacagcccccugauccaccacaucggcuggagcagaagcaucggccacagauucaagagaagcgacaucaccaagaagcaggacggccacuucgacacccccccccaccuguucgccaaggugaaggagguggaccagagcggcgagugguucaaggagggcaugaagcuggaggccaucgacccccugaaccugagcaccaucugcguggccaccaucagaaaggugcuggccgacggcuuccugaugaucggcaucgacggcagcgaggccgccgacggcagcgacugguucugcuaccacgccaccagccccagcaucuuccccgugggcuucugcgagaucaacaugaucgagcugaccccccccagaggcuacaccaagcugcccuucaagugguucgacuaccugagagagaccggcagcaucgccgcccccgugaagcuguucaacaaggacgugcccaaccacggcuucagagugggcaugaagcuggaggccguggaccugauggagcccagacugaucugcguggccaccgugaccagaaucauccacagacugcugagaauccacuucgacggcugggaggaggaguacgaccaguggguggacugcgagagccccgaccuguaccccgugggcuggugccagcugaccggcuaccagcugcagccccccgccagccagagcagcagagagaaccagagcgccagcagcaagcagaagaagaaggccaagagccagcaguacaagggccacaagaagaugaccacccugcagcugaaggaggagcugcuggacggcgaggacuacaacuuccugcagggcgccagcgaccaggagagcaacggcagcgccaacuucuacaucaagcaggagcccuaa

SEQ ID NO: 19701 - RNA, 3159 nt, Artificial Sequence
  MBTPS1__Homo_sapiens__NP_003782
augaagcuggugaacaucuggcugcugcugcugguggugcugcugugcggcaagaagcaccugggcgacagacuggagaagaagagcuucgagaaggcccccugccccggcugcagccaccugacccugaagguggaguucagcagcaccgugguggaguacgaguacaucguggccuucaacggcuacuucaccgccaaggccagaaacagcuucaucagcagcgcccugaagagcagcgagguggacaacuggagaaucauccccagaaacaaccccagcagcgacuaccccagcgacuucgaggugauccagaucaaggagaagcagaaggccggccugcugacccuggaggaccaccccaacaucaagagagugaccccccagagaaagguguucagaagccugaaguacgccgagagcgaccccaccgugcccugcaacgagaccagauggagccagaaguggcagagcagcagaccccugagaagagccagccugagccugggcagcggcuucuggcacgccaccggcagacacagcagcagaagacugcugagagccauccccagacagguggcccagacccugcaggccgacgugcuguggcagaugggcuacaccggcgccaacgugagaguggccguguucgacaccggccugagcgagaagcacccccacuucaagaacgugaaggagagaaccaacuggaccaacgagagaacccuggacgacggccugggccacggcaccuucguggccggcgugaucgccagcaugagagagugccagggcuucgcccccgacgccgagcugcacaucuucagaguguucaccaacaaccaggugagcuacaccagcugguuccuggacgccuucaacuacgccauccugaagaagaucgacgugcugaaccugagcaucggcggccccgacuucauggaccaccccuucguggacaaggugugggagcugaccgccaacaacgugaucauggugagcgccaucggcaacgacggcccccuguacggcacccugaacaaccccgccgaccagauggacgugaucggcgugggcggcaucgacuucgaggacaacaucgccagauucagcagcagaggcaugaccaccugggagcugcccggcggcuacggcagaaugaagcccgacaucgugaccuacggcgccggcgugagaggcagcggcgugaagggcggcugcagagcccugagcggcaccagcguggccagccccgugguggccggcgccgugacccugcuggugagcaccgugcagaagagagagcuggugaaccccgccagcaugaagcaggcccugaucgccagcgccagaagacugcccggcgugaacauguucgagcagggccacggcaagcuggaccugcugagagccuaccagauccugaacagcuacaagccccaggccagccugagccccagcuacaucgaccugaccgagugccccuacauguggcccuacugcagccagcccaucuacuacggcggcaugcccaccguggugaacgugaccauccugaacggcaugggcgugaccggcagaaucguggacaagcccgacuggcagcccuaccugccccagaacggcgacaacaucgagguggccuucagcuacagcagcgugcuguggcccuggagcggcuaccuggccaucagcaucagcgugaccaagaaggccgccagcugggagggcaucgcccagggccacgugaugaucaccguggccagccccgccgagaccgagagcaagaacggcgccgagcagaccagcaccgugaagcugcccaucaaggugaagaucauccccaccccccccagaagcaagagagugcugugggaccaguaccacaaccugagauacccccccggcuacuuccccagagacaaccugagaaugaagaacgacccccuggacuggaacggcgaccacauccacaccaacuucagagacauguaccagcaccugagaagcaugggcuacuucguggaggugcugggcgcccccuucaccugcuucgacgccagccaguacggcacccugcugaugguggacagcgaggaggaguacuuccccgaggagaucgccaagcugagaagagacguggacaacggccugagccuggugaucuucagcgacugguacaacaccagcgugaugagaaaggugaaguucuacgacgagaacaccagacagugguggaugcccgacaccggcggcgccaacauccccgcccugaacgagcugcugagcguguggaacaugggcuucagcgacggccuguacgagggcgaguucacccuggccaaccacgacauguacuacgccagcggcugcagcaucgccaaguuccccgaggacggcguggugaucacccagaccuucaaggaccagggccuggaggugcugaagcaggagaccgccgugguggagaacgugcccauccugggccuguaccagauccccgccgagggcggcggcagaaucgugcuguacggcgacagcaacugccuggacgacagccacagacagaaggacugcuucuggcugcuggacgcccugcugcaguacaccagcuacggcgugaccccccccagccugagccacagcggcaacagacagagaccccccagcggcgccggcagcgugacccccgagagaauggagggcaaccaccugcacagauacagcaaggugcuggaggcccaccugggcgaccccaagcccagaccccugcccgccugccccagacugagcugggccaagccccagccccugaacgagaccgcccccagcaaccuguggaagcaccagaagcugcugagcaucgaccuggacaagguggugcugcccaacuucagaagcaacagaccccaggugagaccccugagccccggcgagagcggcgccugggacauccccggcggcaucaugcccggcagauacaaccaggaggugggccagaccauccccguguucgccuuccugggcgccaugguggugcuggccuucuucguggugcagaucaacaaggccaagagcagacccaagagaagaaagcccagagugaagagaccccagcugaugcagcaggugcacccccccaagacccccagcguguaa

SEQ ID NO: 19702 - RNA, 1560 nt, Artificial Sequence
  MBTPS2__Homo_sapiens__NP_056968
augauccccgugagccuggugguggugguggugggcggcuggaccgugguguaccugaccgaccuggugcugaagagcagcguguacuucaagcacagcuacgaggacuggcuggagaacaacggccugagcaucagccccuuccacaucagauggcagaccgccguguucaacagagccuucuacagcuggggcagaagaaaggccagaaugcuguaccagugguucaacuucggcaugguguucggcgugaucgccauguucagcagcuucuuccugcugggcaagacccugaugcagacccuggcccagaugauggccgacagccccagcagcuacagcagcagcagcagcagcagcagcagcagcagcagcagcagcagcagcagcagcagcagcagcagcagccugcacaacgagcaggugcugcaggugguggugcccggcaucaaccugcccgugaaccagcugaccuacuucuucaccgccgugcugaucagcggcguggugcacgagaucggccacggcaucgccgccaucagagagcaggugagauucaacggcuucggcaucuuccuguucaucaucuaccccggcgccuucguggaccuguucaccacccaccugcagcugaucagccccgugcagcagcugagaaucuucugcgccggcaucuggcacaacuucgugcuggcccugcugggcauccuggcccuggugcugcugcccgugauccugcugcccuucuacuacaccggcgugggcgugcugaucaccgagguggccgaggacagccccgccaucggccccagaggccuguucgugggcgaccuggugacccaccugcaggacugccccgugaccaacgugcaggacuggaacgagugccuggacaccaucgccuacgagccccagaucggcuacugcaucagcgccagcacccugcagcagcugagcuuccccgugagagccuacaagagacuggacggcagcaccgagugcugcaacaaccacagccugaccgacgugugcuucagcuacagaaacaacuucaacaagagacugcacaccugccugcccgccagaaaggccguggaggccacccaggugugcagaaccaacaaggacugcaagaagagcagcagcagcagcuucugcaucauccccagccuggagacccacaccagacugaucaaggugaagcaccccccccagaucgacaugcuguacgugggccacccccugcaccugcacuacaccgugagcaucaccagcuucauccccagauucaacuuccugagcaucgaccugcccguggugguggagaccuucgugaaguaccugaucagccugagcggcgcccuggccaucgugaacgccgugcccugcuucgcccuggacggccaguggauccugaacagcuuccuggacgccacccugaccagcgugaucggcgacaacgacgugaaggaccugaucggcuucuucauccugcugggcggcagcgugcugcuggccgccaacgugacccugggccuguggauggugaccgccagauaa

SEQ ID NO: 19703 - RNA, 954 nt, Artificial Sequence
  MC1R__Homo_sapiens__NP_002377
auggccgugcagggcagccagagaagacugcugggcagccugaacagcacccccaccgccaucccccagcugggccuggccgccaaccagaccggcgccagaugccuggaggugagcaucagcgacggccuguuccugagccugggccuggugagccugguggagaacgcccuggugguggccaccaucgccaagaacagaaaccugcacagccccauguacugcuucaucugcugccuggcccugagcgaccugcuggugagcggcagcaacgugcuggagaccgccgugauccugcugcuggaggccggcgcccugguggccagagccgccgugcugcagcagcuggacaacgugaucgacgugaucaccugcagcagcaugcugagcagccugugcuuccugggcgccaucgccguggacagauacaucagcaucuucuacgcccugagauaccacagcaucgugacccugcccagagccagaagagccguggccgccaucuggguggccagcgugguguucagcacccuguucaucgccuacuacgaccacguggccgugcugcugugccuggugguguucuuccuggccaugcuggugcugauggccgugcuguacgugcacaugcuggccagagccugccagcacgcccagggcaucgccagacugcacaagagacagagacccgugcaccagggcuucggccugaagggcgccgugacccugaccauccugcugggcaucuucuuccugugcuggggccccuucuuccugcaccugacccugaucgugcugugccccgagcaccccaccugcggcugcaucuucaagaacuucaaccuguuccuggcccugaucaucugcaacgccaucaucgacccccugaucuacgccuuccacagccaggagcugagaagaacccugaaggaggugcugaccugcagcugguaa

SEQ ID NO: 19704 - RNA, 894 nt, Artificial Sequence
  MC2R__Homo_sapiens__NP_001278840
augaagcacaucaucaacagcuacgagaacaucaacaacaccgccagaaacaacagcgacugccccagaguggugcugcccgaggagaucuucuucaccaucagcaucgugggcgugcuggagaaccugaucgugcugcuggccguguucaagaacaagaaccugcaggcccccauguacuucuucaucugcagccuggccaucagcgacaugcugggcagccuguacaagauccuggagaacauccugaucauccugagaaacaugggcuaccugaagcccagaggcagcuucgagaccaccgccgacgacaucaucgacagccuguucgugcugagccugcugggcagcaucuucagccugagcgugaucgccgccgacagauacaucaccaucuuccacgcccugagauaccacagcaucgugaccaugagaagaaccgugguggugcugaccgugaucuggaccuucugcaccggcaccggcaucaccauggugaucuucagccaccacgugcccaccgugaucaccuucaccagccuguucccccugaugcugguguucauccugugccuguacgugcacauguuccugcuggccagaagccacaccagaaagaucagcacccugcccagagccaacaugaagggcgccaucacccugaccauccugcugggcguguucaucuucugcugggcccccuucgugcugcacgugcugcugaugaccuucugccccagcaaccccuacugcgccugcuacaugagccuguuccaggugaacggcaugcugaucaugugcaacgccgugaucgaccccuucaucuacgccuucagaagccccgagcugagagacgccuucaagaagaugaucuucugcagcagauacugguaa

SEQ ID NO: 19705 - RNA, 972 nt, Artificial Sequence
  MC3R__Homo_sapiens__NP_063941
augaacgccagcugcugccugcccagcgugcagcccacccugcccaacggcagcgagcaccugcaggcccccuucuucagcaaccagagcagcagcgccuucugcgagcagguguucaucaagcccgagguguuccugagccugggcaucgugagccugcuggagaacauccuggugauccuggccguggugagaaacggcaaccugcacagccccauguacuucuuccugugcagccuggccguggccgacaugcuggugagcgugagcaacgcccuggagaccaucaugaucgccaucgugcacagcgacuaccugaccuucgaggaccaguucauccagcacauggacaacaucuucgacagcaugaucugcaucagccugguggccagcaucugcaaccugcuggccaucgccguggacagauacgugaccaucuucuacgcccugagauaccacagcaucaugaccgugagaaaggcccugacccugaucguggccaucugggugugcugcggcgugugcggcgugguguucaucguguacagcgagagcaagauggugaucgugugccugaucaccauguucuucgccaugaugcugcugaugggcacccuguacgugcacauguuccuguucgccagacugcacgugaagagaaucgccgcccugccccccgccgacggcguggccccccagcagcacagcugcaugaagggcgccgugaccaucaccauccugcugggcguguucaucuucugcugggcccccuucuuccugcaccuggugcugaucaucaccugccccaccaaccccuacugcaucugcuacaccgcccacuucaacaccuaccuggugcugaucaugugcaacagcgugaucgacccccugaucuacgccuucagaagccuggagcugagaaacaccuucagagagauccugugcggcugcaacggcaugaaccugggcuaa

SEQ ID NO: 19706 - RNA, 999 nt, Artificial Sequence
  MC4R__Homo_sapiens__NP_005903
auggugaacagcacccacagaggcaugcacaccagccugcaccuguggaacagaagcagcuacagacugcacagcaacgccagcgagagccugggcaagggcuacagcgacggcggcugcuacgagcagcuguucgugagccccgagguguucgugacccugggcgugaucagccugcuggagaacauccuggugaucguggccaucgccaagaacaagaaccugcacagccccauguacuucuucaucugcagccuggccguggccgacaugcuggugagcgugagcaacggcagcgagaccaucgugaucacccugcugaacagcaccgacaccgacgcccagagcuucaccgugaacaucgacaacgugaucgacagcgugaucugcagcagccugcuggccagcaucugcagccugcugagcaucgccguggacagauacuucaccaucuucuacgcccugcaguaccacaacaucaugaccgugaagagagugggcaucaucaucagcugcaucugggccgccugcaccgugagcggcauccuguucaucaucuacagcgacagcagcgccgugaucaucugccugaucaccauguucuucaccaugcuggcccugauggccagccuguacgugcacauguuccugauggccagacugcacaucaagagaaucgccgugcugcccggcaccggcgccaucagacagggcgccaacaugaagggcgccaucacccugaccauccugaucggcguguucguggugugcugggcccccuucuuccugcaccugaucuucuacaucagcugcccccagaaccccuacugcgugugcuucaugagccacuucaaccuguaccugauccugaucaugugcaacagcaucaucgacccccugaucuacgcccugagaagccaggagcugagaaagaccuucaaggagaucaucugcugcuacccccugggcggccugugcgaccugagcagcagauacuaa

SEQ ID NO: 19707 - RNA, 978 nt, Artificial Sequence
  MC5R__Homo_sapiens__NP_005904
augaacagcagcuuccaccugcacuuccuggaccugaaccugaacgccaccgagggcaaccugagcggccccaacgugaagaacaagagcagccccugcgaggacaugggcaucgccguggagguguuccugacccugggcgugaucagccugcuggagaacauccuggugaucggcgccaucgugaagaacaagaaccugcacagccccauguacuucuucgugugcagccuggccguggccgacaugcuggugagcaugagcagcgccugggagaccaucaccaucuaccugcugaacaacaagcaccuggugaucgccgacgccuucgugagacacaucgacaacguguucgacagcaugaucugcaucagcgugguggccagcaugugcagccugcuggccaucgccguggacagauacgugaccaucuucuacgcccugagauaccaccacaucaugaccgccagaagaagcggcgccaucaucgccggcaucugggccuucugcaccggcugcggcaucguguucauccuguacagcgagagcaccuacgugauccugugccugaucagcauguucuucgccaugcuguuccugcuggugagccuguacauccacauguuccugcuggccagaacccacgugaagagaaucgccgcccugcccggcgccagcagcgccagacagagaaccagcaugcagggcgccgugaccgugaccaugcugcugggcguguucaccgugugcugggcccccuucuuccugcaccugacccugaugcugagcugcccccagaaccuguacugcagcagauucaugagccacuucaacauguaccugauccugaucaugugcaacagcgugauggacccccugaucuacgccuucagaagccaggagaugagaaagaccuucaaggagaucaucugcugcagaggcuucagaaucgccugcagcuuccccagaagagacuaa

SEQ ID NO: 19708 - RNA, 1941 nt, Artificial Sequence
  MCAM__Homo_sapiens__NP_006491
augggccugcccagacuggugugcgccuuccugcuggccgccugcugcugcugccccagaguggccggcgugcccggcgaggccgagcagcccgcccccgagcugguggagguggaggugggcagcaccgcccugcugaagugcggccugagccagagccagggcaaccugagccacguggacugguucagcgugcacaaggagaagagaacccugaucuucagagugagacagggccagggccagagcgagcccggcgaguacgagcagagacugagccugcaggacagaggcgccacccuggcccugacccaggugaccccccaggacgagagaaucuuccugugccagggcaagagacccagaagccaggaguacagaauccagcugagaguguacaaggcccccgaggagcccaacauccaggugaacccccugggcauccccgugaacagcaaggagcccgaggagguggccaccugcgugggcagaaacggcuaccccaucccccaggugaucugguacaagaacggcagaccccugaaggaggagaagaacagagugcacauccagagcagccagaccguggagagcagcggccuguacacccugcagagcauccugaaggcccagcuggugaaggaggacaaggacgcccaguucuacugcgagcugaacuacagacugcccagcggcaaccacaugaaggagagcagagaggugaccgugcccguguucuaccccaccgagaagguguggcuggagguggagcccgugggcaugcugaaggagggcgacagaguggagaucagaugccuggccgacggcaacccccccccccacuucagcaucagcaagcagaaccccagcaccagagaggccgaggaggagaccaccaacgacaacggcgugcuggugcuggagcccgccagaaaggagcacagcggcagauacgagugccagggccuggaccuggacaccaugaucagccugcugagcgagccccaggagcugcuggugaacuacgugagcgacgugagagugagccccgccgcccccgagagacaggagggcagcagccugacccugaccugcgaggccgagagcagccaggaccuggaguuccaguggcugagagaggagaccggccaggugcuggagagaggccccgugcugcagcugcacgaccugaagagagaggccggcggcggcuacagaugcguggccagcgugcccagcauccccggccugaacagaacccagcuggugaacguggccaucuucggcccccccuggauggccuucaaggagagaaaggugugggugaaggagaacauggugcugaaccugagcugcgaggccagcggccaccccagacccaccaucagcuggaacgugaacggcaccgccagcgagcaggaccaggacccccagagagugcugagcacccugaacgugcuggugacccccgagcugcuggagaccggcguggagugcaccgccagcaacgaccugggcaagaacaccagcauccuguuccuggagcuggugaaccugaccacccugacccccgacagcaacaccaccaccggccugagcaccagcaccgccagcccccacaccagagccaacagcaccagcaccgagagaaagcugcccgagcccgagagcagaggcguggugaucguggccgugaucgugugcauccuggugcuggccgugcugggcgccgugcuguacuuccuguacaagaagggcaagcugcccugcagaagaagcggcaagcaggagaucacccugccccccagcagaaagagcgagcuggugguggaggugaagagcgacaagcugcccgaggagaugggccugcugcagggcagcagcggcgacaagagagcccccggcgaccagggcgagaaguacaucgaccugagacacuaa

SEQ ID NO: 19709 - RNA, 543 nt, Artificial Sequence
  MCAT__Homo_sapiens__NP_055322
augagcgugagaguggccagaguggccugggugagaggccugggcgccagcuacagaagaggcgccagcagcuuccccgugcccccccccggcgcccagggcguggccgagcugcugagagacgccaccggcgccgaggaggaggcccccugggccgccaccgagagaagaaugcccggccagugcagcgugcugcuguuccccggccagggcagccagguggugggcaugggcagaggccugcugaacuaccccagagugagagagcuguacgccgccgccagaagagugcugggcuacgaccugcuggagcugagccugcacggcccccaggagacccuggacagaaccgugcacugccagcccgccaucuucguggccagccuggccgccguggagaagcugcaccaccugcagcccagcgugaucgagaacugcguggccgccgccggcuucagcgugggcgaguucgccgcccugguguucgccggcgccauggaguucgccgagggcagcaccgugagccccgaggaguuccuguaa

SEQ ID NO: 19710 - RNA, 2178 nt, Artificial Sequence
  MCCC1__Homo_sapiens__NP_064551
auggccgccgccagcgccgugagcgugcugcugguggccgccgagagaaacagauggcacagacugcccagccugcugcugccccccagaaccuggguguggagacagagaaccaugaaguacaccaccgccaccggcagaaacaucaccaaggugcugaucgccaacagaggcgagaucgccugcagagugaugagaaccgccaagaagcugggcgugcagaccguggccguguacagcgaggccgacagaaacagcaugcacguggacauggccgacgaggccuacagcaucggccccgcccccagccagcagagcuaccugagcauggagaagaucauccagguggccaagaccagcgccgcccaggccauccaccccggcugcggcuuccugagcgagaacauggaguucgccgagcugugcaagcaggagggcaucaucuucaucggccccccccccagcgccaucagagacaugggcaucaagagcaccagcaagagcaucauggccgccgccggcgugcccgugguggagggcuaccacggcgaggaccagagcgaccagugccugaaggagcacgccagaagaaucggcuaccccgugaugaucaaggccgugagaggcggcggcggcaagggcaugagaaucgugagaagcgagcaggaguuccaggagcagcuggagagcgccagaagagaggccaagaagagcuucaacgacgacgccaugcugaucgagaaguucguggacacccccagacacguggaggugcagguguucggcgaccaccacggcaacgccguguaccuguucgagagagacugcagcgugcagagaagacaccagaagaucaucgaggaggcccccgcccccggcaucaagagcgaggugagaaagaagcugggcgaggccgccgugagagccgccaaggccgugaacuacgugggcgccggcaccguggaguucaucauggacagcaagcacaacuucugcuucauggagaugaacaccagacugcagguggagcaccccgugaccgagaugaucaccggcaccgaccugguggaguggcagcugagaaucgccgccggcgagaagaucccccugagccaggaggagaucacccugcagggccacgccuucgaggccagaaucuacgccgaggaccccagcaacaacuucaugcccguggccggcccccuggugcaccugagcacccccagagccgaccccagcaccagaaucgagaccggcgugagacagggcgacgaggugagcgugcacuacgaccccaugaucgccaagcugguggugugggccgccgacagacaggccgcccugaccaagcugagauacagccugagacaguacaacaucgugggccugcacaccaacaucgacuuccugcugaaccugagcggccaccccgaguucgaggccggcaacgugcacaccgacuucaucccccagcaccacaagcagcugcugcugagcagaaaggccgccgccaaggagagccugugccaggccgcccugggccugauccugaaggagaaggccaugaccgacaccuucacccugcaggcccacgaccaguucagccccuucagcagcagcagcggcagaagacugaacaucagcuacaccagaaacaugacccugaaggacggcaagaacaacguggccaucgccgugaccuacaaccacgacggcagcuacagcaugcagaucgaggacaagaccuuccaggugcugggcaaccuguacagcgagggcgacugcaccuaccugaagugcagcgugaacggcguggccagcaaggccaagcugaucauccuggagaacaccaucuaccuguucagcaaggagggcagcaucgagaucgacauccccgugcccaaguaccugagcagcgugagcagccaggagacccagggcggcccccuggcccccaugaccggcaccaucgagaagguguucgugaaggccggcgacaaggugaaggccggcgacagccugauggugaugaucgccaugaagauggagcacaccaucaagagccccaaggacggcaccgugaagaagguguucuacagagagggcgcccaggccaacagacacaccccccugguggaguucgaggaggaggagagcgacaagagagagagcgaguaa

SEQ ID NO: 19711 - RNA, 1692 nt, Artificial Sequence
  MCCC2__Homo_sapiens__NP_071415
augugggccgugcugagacuggcccugagacccugcgccagagccagccccgccggccccagagccuaccacggcgacagcguggccagccugggcacccagcccgaccugggcagcgcccuguaccaggagaacuacaagcagaugaaggcccuggugaaccagcugcacgagagaguggagcacaucaagcugggcggcggcgagaaggccagagcccugcacaucagcagaggcaagcugcugcccagagagagaaucgacaaccugaucgaccccggcagccccuuccuggagcugagccaguucgccggcuaccagcuguacgacaacgaggaggugcccggcggcggcaucaucaccggcaucggcagagugagcggcguggagugcaugaucaucgccaacgacgccaccgugaagggcggcgccuacuaccccgugaccgugaagaagcagcugagagcccaggagaucgccaugcagaacagacugcccugcaucuaccugguggacagcggcggcgccuaccugcccagacaggccgacguguuccccgacagagaccacuucggcagaaccuucuacaaccaggccaucaugagcagcaagaacaucgcccagaucgccguggugaugggcagcugcaccgccggcggcgccuacgugcccgccauggccgacgagaacaucaucgugagaaagcagggcaccaucuuccuggccggccccccccuggugaaggccgccaccggcgaggaggugagcgccgaggaccugggcggcgccgaccugcacugcagaaagagcggcgugagcgaccacugggcccuggacgaccaccacgcccugcaccugaccagaaagguggugagaaaccugaacuaccagaagaagcuggacgugaccaucgagcccagcgaggagccccuguuccccgccgacgagcuguacggcaucgugggcgccaaccugaagagaagcuucgacgugagagaggugaucgccagaaucguggacggcagcagauucaccgaguucaaggccuucuacggcgacacccuggugaccggcuucgccagaaucuucggcuaccccgugggcaucgugggcaacaacggcgugcuguucagcgagagcgccaagaagggcacccacuucgugcagcugugcugccagagaaacaucccccugcuguuccugcagaacaucaccggcuucauggugggcagagaguacgaggccgagggcaucgccaaggacggcgccaagaugguggccgccguggccugcgcccaggugcccaagaucacccugaucaucggcggcagcuacggcgccggcaacuacggcaugugcggcagagccuacagccccagauuccuguacaucuggcccaacgccagaaucagcgugaugggcggcgagcaggccgccaacgugcuggccaccaucaccaaggaccagagagccagagagggcaagcaguucagcagcgccgacgaggccgcccugaaggagcccaucaucaagaaguucgaggaggagggcaaccccuacuacagcagcgccagagugugggacgacggcaucaucgaccccgccgacaccagacuggugcugggccugagcuucagcgccgcccugaacgcccccaucgagaagaccgacuucggcaucuucagaauguaa

SEQ ID NO: 19712 - RNA, 360 nt, Artificial Sequence
  MCCD1__Homo_sapiens__NP_001011700
auggugcugccccugcccuggcugagcagauaccacuuccugagacugcugcugcccagcuggagccuggccccccagggcagccacggcugcugcagccagaaccccaaggccagcauggaggagcagaccagcagcagaggcaacggcaagaugaccagcccccccagaggccccggcacccacagaaccgccgagcuggccagagccgaggagcugcuggagcagcagcuggagcuguaccaggcccugcuggagggccaggagggcgccugggaggcccaggcccuggugcugaagauccagaagcugaaggagcagaugagaagacaccaggagagccugggcggcggcgccuaa

SEQ ID NO: 19713 - RNA, 3060 nt, Artificial Sequence
  MCC__Homo_sapiens__NP_001078846
augauggccgccgccgccgccgccgccgccggcagcagcagcagcggcggcggcggcggcggcagcggcagcagcagcagcagcagcgacaccagcagcaccggcgaggaggagagaaugagaagacuguuccagaccugcgacggcgacggcgacggcuacaucagcagaaacgaccugcugauggugugcagacagcugaacauggaggagagcguggccgagaucaugaaccagcugggcgccgacgagaacggcaagaucagcuuccaggacuucaccagaugcagaaugcagcuggugagagagaucagaaaggaggagguggaccugagcgccaagagcgacaacagcugcaccaagaagcugagagacagaaucgccagcuggcccaccagcagcgacaacagccugggcgcccugagcgccgccagagagagcugggaguacgacagcggcgccagagaccugcagagccccgacgugcagagccagagcgcccugcagaagcugcuggaguacggcggcagcagccugcaccagcaggccgcccugcacaagcugcugacccagagcccccacaucggcaacagcgugggcggcagcuaccuggagcuggccaacacccugcacagcgccgcccuggccagccugaagggcgacaucguggagcugaacaagagacugcagcagaccgagagagagagagaccugcuggagaagaagcuggccaaggcccagugcgagcagagccaccugaugagagagcacgaggacgugcaggagagaaccacccugagauacgaggagagaaucaccgagcugcacagcgugaucgccgagcugaacaagaagaucgacagacugcagggcaccaccaucagagaggaggacgaguacagcgagcugagaagcgagcugagccagagccagcacgaggugaacgaggacagcagaagcauggaccaggaccagaccagcgugagcauccccgagaaccagagcaccauggugaccgccgacauggacaacugcagcgaccugaacagcgagcugcagagagugcugaccggccuggagaacguggugugcggcagaaagaagagcagcugcagccugagcguggccgagguggacagacacaucgagcagcugaccaccgccagcgagcacugcgaccuggccaucaagaccguggaggagaucgagggcgugcugggcagagaccuguaccccaaccuggccgaggagagaagcagaugggagaaggagcuggccggccugagagaggagaacgagagccugaccgccaugcugugcagcaaggaggaggagcugaacagaaccaaggccaccaugaacgccaucagagaggagagagacagacugagaagaagagugagagagcugcagaccagacugcagagcgugcaggccaccggccccagcagccccggcagacugaccagcaccaacagacccaucaaccccagcaccggcgagcugagcaccagcagcagcagcaacgacauccccaucgccaagaucgccgagagagugaagcugagcaagaccagaagcgagagcagcagcagcgacagacccgugcugggcagcgagaucagcagcaucggcgugagcagcagcguggccgagcaccuggcccacagccugcaggacugcagcaacauccaggagaucuuccagacccuguacagccacggcagcgccaucagcgagagcaagaucagagaguucgagguggagaccgagagacugaacagcagaaucgagcaccugaagagccagaacgaccugcugaccaucacccuggaggagugcaagagcaacgccgagagaaugagcaugcuggugggcaaguacgagagcaacgccaccgcccugagacuggcccugcaguacagcgagcagugcaucgaggccuacgagcugcugcuggcccuggccgagagcgagcagagccugauccugggccaguucagagccgccggcgugggcagcagccccggcgaccagagcggcgacgagaacaucacccagaugcugaagagagcccacgacugcagaaagaccgccgagaacgccgccaaggcccugcugaugaagcuggacggcagcugcggcggcgccuucgccguggccggcugcagcgugcagcccugggagagccugagcagcaacagccacaccagcaccaccagcagcaccgccagcagcugcgacaccgaguucaccaaggaggacgagcagagacugaaggacuacauccagcagcugaagaacgacagagccgccgugaagcugaccaugcuggagcuggagagcauccacaucgacccccugagcuacgacgugaagcccagaggcgacagccagagacuggaccuggagaacgccgugcugaugcaggagcugauggccaugaaggaggagauggccgagcugaaggcccagcuguaccugcuggagaaggagaagaaggcccuggagcugaagcugagcaccagagaggcccaggagcaggccuaccuggugcacaucgagcaccugaagagcgagguggaggagcagaaggagcagagaaugagaagccugagcagcaccagcagcggcagcaaggacaagcccggcaaggagugcgccgacgccgccagccccgcccugagccuggccgagcugagaaccaccugcagcgagaacgagcuggccgccgaguucaccaacgccaucagaagagagaagaagcugaaggccagagugcaggagcuggugagcgcccuggagagacugaccaagagcagcgagaucagacaccagcagagcgccgaguucgugaacgaccugaagagagccaacagcaaccugguggccgccuacgagaaggccaagaagaagcaccagaacaagcugaagaagcuggagagccagaugauggccaugguggagagacacgagacccaggugagaaugcugaagcagagaaucgcccugcuggaggaggagaacagcagaccccacaccaacgagaccagccuguaa

SEQ ID NO: 19714 - RNA, 531 nt, Artificial Sequence
  MCEE__Homo_sapiens__NP_115990
auggccagagugcugaaggccgccgccgccaacgccgugggccuguucagcagacugcaggcccccauccccaccgugagagccagcagcaccagccagccccuggaccaggugaccggcagcguguggaaccugggcagacugaaccacguggccaucgccgugcccgaccuggagaaggccgccgccuucuacaagaacauccugggcgcccaggugagcgaggccgugccccugcccgagcacggcgugagcgugguguucgugaaccugggcaacaccaagauggagcugcugcacccccugggcagagacagccccaucgccggcuuccugcagaagaacaaggccggcggcaugcaccacaucugcaucgagguggacaacaucaacgccgccgugauggaccugaagaagaagaagaucagaagccugagcgaggaggugaagaucggcgcccacggcaagcccgugaucuuccugcaccccaaggacugcggcggcgugcugguggagcuggagcaggccuaa

SEQ ID NO: 19715 - RNA, 2958 nt, Artificial Sequence
  MCF2__Homo_sapiens__NP_001093325
augcaggacaucgccuuccugagcggcggcagaggcaaggacaacgccuggaucaucaccuuccccgagaacugcaacuucagaugcauccccgaggaggugaucgccaaggugcugaccuaccugaccagcaucgccagacagaacggcagcgacagcagauucaccaucauccuggacagaagacuggacaccuggagcagccugaagaucagccugcagaagaucagcgccagcuuccccggcaaccugcaccuggugcuggugcugagacccaccagcuuccugcagagaaccuucaccgacaucggcuucugguucagccaggaggacuucaugcugaagcugcccguggugaugcugagcagcgugagcgaccugcugaccuacaucgacgacaagcagcugacccccgagcugggcggcacccugcaguacugccacagcgaguggaucaucuucagaaacgccaucgagaacuucgcccugaccgugaaggagauggcccagaugcugcagagcuucggcaccgagcuggccgagaccgagcugcccgacgacauccccagcaucgaggagauccuggccaucagagccgagagauaccaccugcugaagaacgacaucaccgccgugaccaaggagggcaagauccugcugaccaaccuggaggugcccgacaccgagggcgccgugagcagcagacuggagugccacagacagaucagcggcgacuggcagaccaucaacaagcugcugacccaggugcacgacauggagaccgccuucgacggcuucugggagaagcaccagcugaagauggagcaguaccugcagcuguggaaguucgagcaggacuuccagcagcuggugaccgagguggaguuccugcugaaccagcaggccgagcuggccgacgugaccggcaccaucgcccaggugaagcagaagaucaagaagcuggagaaccuggacgagaacagccaggagcugcugagcaaggcccaguucgugauccugcacggccacaagcuggccgccaaccaccacuacgcccuggaccugaucugccagagaugcaacgagcugagauaccugagcgacauccuggugaacgagaucaaggccaagagaauccagcugagcagaaccuucaagaugcacaagcugcugcagcaggccagacagugcugcgacgagggcgagugccugcuggccaaccaggagaucgacaaguuccagagcaaggaggacgcccagaaggcccugcaggacaucgagaacuuccuggagauggcccugcccuucaucaacuacgagcccgagacccugcaguacgaguucgacgugauccugagccccgagcugaaggugcagaugaagaccauccagcugaagcuggagaacaucagaagcaucuucgagaaccagcaggccggcuucagaaaccuggccgacaagcacgugagacccauccaguucguggugcccacccccgagaaccuggugaccagcggcacccccuucuucagcagcaagcagggcaagaagaccuggagacagaaccagagcaaccugaagaucgagguggugcccgacugccaggagaagagaagcagcggccccagcagcagccuggacaacggcaacagccuggacgugcugaagaaccacgugcugaacgagcugauccagaccgagagaguguacgugagagagcuguacaccgugcugcugggcuacagagccgagauggacaaccccgagauguucgaccugaugcccccccugcugagaaacaagaaggacauccuguucggcaacauggccgagaucuacgaguuccacaacgacaucuuccugagcagccuggagaacugcgcccacgcccccgagagagugggccccugcuuccuggagagaaaggacgacuuccagauguacgccaaguacugccagaacaagcccagaagcgagaccaucuggagaaaguacagcgagugcgccuucuuccaggagugccagagaaagcugaagcacagacugagacuggacagcuaccugcugaagcccgugcagagaaucaccaaguaccagcugcugcugaaggagcugcugaaguacagcaaggacugcgagggcagcgcccugcugaagaaggcccuggacgccaugcuggaccugcugaagagcgugaacgacagcaugcaccagaucgccaucaacggcuacaucggcaaccugaacgagcugggcaagaugaucaugcagggcggcuucagcguguggaucggccacaagaagggcgccaccaagaugaaggaccuggccagauucaagcccaugcagagacaccuguuccuguacgagaaggccaucguguucugcaagagaagaguggagagcggcgagggcagcgacagauaccccagcuacagcuucaagcacugcuggaagauggacgaggugggcaucaccgaguacgugaagggcgacaacagaaaguucgagaucugguacggcgagaaggaggagguguacaucgugcaggccagcaacguggacgugaagaugaccuggcugaaggagaucagaaacauccugcugaagcagcaggagcugcugaccgugaagaagagaaagcagcaggaccagcugaccgagagagacaaguuccagaucagccugcagcagaacgacgagaagcagcagggcgccuucaucagcaccgaggagaccgagcuggagcacaccagcaccgugguggaggugugcgaggccaucgccagcgugcaggccgaggccaacaccguguggaccgaggccagccagagcgccgagaucagcgaggagcccgccgaguggagcagcaacuacuucuaccccaccuacgacgagaacgaggaggagaacagaccccugaugagacccgugagcgagauggcccugcuguacuaa

SEQ ID NO: 19716 - RNA, 3345 nt, Artificial Sequence
  MCF2L2__Homo_sapiens__NP_055893
augcugagcugccugaaggaggagaugcccccccaggagcugaccagaagacuggccaccgugaucacccacguggacgagaucaugcagcaggaggugagaccccugauggccguggagaucaucgagcagcugcacagacaguucgccauccugagcggcggcagaggcgaggacggcgcccccaucaucaccuuccccgaguucagcggcuucaagcacauccccgacgaggacuuccugaacgugaugaccuaccugaccagcauccccagcguggaggccgccagcaucggcuucaucguggugaucgacagaagaagagacaaguggagcagcgugaaggccagccugaccagaaucgccguggccuuccccggcaaccugcagcugaucuucauccugagacccagcagauucauccagagaaccuucaccgacaucggcaucaaguacuacagaaacgaguucaagaccaaggugcccaucaucauggugaacagcgugagcgaccugcacggcuacaucgacaagagccagcugaccagagagcugggcggcacccuggaguacagacacggccagugggugaaccacagaaccgccaucgagaacuucgcccugacccugaagaccaccgcccagaugcugcagaccuucggcagcugccuggccaccgccgagcugcccagaagcaugcugagcaccgaggaccugcugaugagccacaccagacagagagacaagcugcaggacgagcugaagcugcugggcaagcagggcaccacccugcugagcugcauccaggagcccgccaccaagugccccaacagcaagcugaaccugaaccagcuggagaacgugaccaccauggagagacugcuggugcagcuggacgagaccgagaaggccuucagccacuucuggagcgagcaccaccugaagcugaaccagugccugcagcugcagcacuucgagcacgacuucugcaaggccaagcuggcccuggacaaccugcuggaggagcaggccgaguucaccggcaucggcgacagcgugaugcacguggagcagauccugaaggagcacaagaagcuggaggagaagagccaggagccccuggagaaggcccagcugcuggcccuggugggcgaccagcugauccagagccaccacuacgccgccgacgccaucagacccagaugcguggagcugagacaccugugcgacgacuucaucaacggcaacaagaagaagugggacauccugggcaagagccuggaguuccacagacagcuggacaaggugagccaguggugcgaggccggcaucuaccugcuggccagccaggccguggacaagugccagagcagagagggcguggacaucgcccugaacgacaucgccaccuuccugggcaccgugaaggaguacccccugcugagccccaaggaguucuacaacgaguucgagcugcugcugacccuggacgccaaggccaaggcccagaaggugcugcagagacuggacgacgugcaggagaucuuccacaagagacaggugagccugaugaagcuggccgccaagcagaccagacccgugcagcccguggccccccaccccgagagcagccccaagugggugagcagcaagaccagccagcccagcaccagcgugccccuggccagaccccugagaaccagcgaggagcccuacaccgagaccgagcugaacagcagaggcaaggaggacgacgagaccaaguucgaggugaagagcgaggagaucuucgagagccaccacgagagaggcaaccccgagcuggagcagcaggccagacugggcgaccugagccccagaagaagaaucaucagagaccugcuggagaccgaggagaucuacaucaaggagaucaagagcaucaucgacggcuacaucacccccauggacuucaucuggcugaagcaccugauccccgacgugcugcagaacaacaaggacuuccuguucggcaacaucagagagcuguacgaguuccacaacagaaccuuccugaaggagcuggagaagugcgccgagaaccccgagcugcuggcccacugcuuccugaagagaaaggaggaccugcagaucuacuucaaguaccacaagaaccugcccagagccagagccaucuggcaggagugccaggacugcgccuacuucggcgugugccagagacagcuggaccacaaccugccccuguucaaguaccugaagggccccagccagagacugaucaaguaccagaugcugcugaagggccugcuggacuucgagagccccgaggacauggagaucgaccccggcgagcugggcggcagcgccaaggacggccccaagagaaccaaggacagcgccuucagcaccgagcugcagcaggcccuggccgugaucgaggaccugaucaagagcugcgagcuggccguggaccuggccgccgugaccgagugccccgacgacaucggcaagcugggcaagcugcugcugcacggccccuucagcguguggaccauccacaaggacagauacaagaugaaggaccugaucagauucaagcccagccagagacagaucuaccuguucgagagaggcaucguguucugcaagaucagaauggagcccggcgaccagggccugagcccccacuacagcuucaagaaggccaugaagcugaugacccugagcaucagacagcugggcagaggcagccacagaaaguucgagaucgccagcagaaacggccuggagaaguacauccugcaggccgccagcaaggagaucagagacugcugguucagcgagaucagcaagcugcugauggagcagcagaacaacaucaaggaccagggcaacccccaguucgagaugagcaccagcaagggcagcggcgccggcagcggccccuggaucaagaacauggagagagccaccaccagcaaggaggaccccgccagcagcaccggcggcaucaagggcugcagcagcagagaguucagcagcauggacaccuucgaggacugcgagggcgccgaggacauggagaaggagagcagcgcccugagccuggccggccuguuccagagcgacgacagccacgagaccugcagcagcaagagcgccuuccuggagagaggcgagagcagccagggcgagaaggaggagagagacgaggaggagaccgccaccagaagcaccgaggaggagagagccggcgccagcaccggcagacuggcccccgccggcgccaccgccggcuuccaggccagagcccugagacccagaaccagcgcccaggagagcuaa

SEQ ID NO: 19717 - RNA, 3378 nt, Artificial Sequence
  MCF2L__Homo_sapiens__NP_001106203
augagauucuggcugagaaccgaggagauggcccuggaggagauggugcagagacugaacgccgugagcaagcacaccgacgagaucaugcaccaggacaucgugccccugugcgccgccgacauccaggaccagcugaagaagagauucgccuaccugagcggcggcagaggccaggacggcagccccgugaucaccuuccccgacuaccccgccuucagcgagauccccgacaaggaguuccagaacgugaugaccuaccugaccagcauccccagccugcaggacgccggcaucggcuucauccuggugaucgacagaagaagagacaaguggaccagcgugaaggccagcgugcugagaaucgccgccagcuuccccgccaaccugcagcuggugcuggugcugagacccaccggcuucuuccagagaacccugagcgacaucgccuucaaguucaacagagacgacuucaagaugaaggugcccgugaucaugcugagcagcgugcccgaccugcacggcuacaucgacaagagccagcugaccgaggaccugggcggcacccuggacuacugccacagcagauggcugugccagagaaccgccaucgagagcuucgcccugauggugaagcagaccgcccagaugcugcagagcuucggcaccgagcuggccgagaccgagcugcccaacgacgugcagagcaccagcagcgugcugugcgcccacaccgagaagaaggacaaggccaaggaggaccugagacuggcccugaaggagggccacagcgugcuggagagccugagagagcugcaggccgagggcagcgagcccagcgugaaccaggaccagcuggacaaccaggccaccgugcagagacugcuggcccagcugaacgagaccgaggccgccuucgacgaguucugggccaagcaccagcagaagcuggagcagugccugcagcugagacacuucgagcagggcuucagagaggugaaggccauccuggacgccgccagccagaagaucgccaccuucaccgacaucggcaacagccuggcccacguggagcaccugcugagagaccuggccagcuucgaggagaagagcggcguggccguggagagagccagagcccugagccuggacggcgagcagcugaucggcaacaagcacuacgccguggacagcaucagacccaagugccaggagcugagacaccugugcgaccaguucagcgccgagaucgccagaagaagaggccugcugagcaagagccuggagcugcacagaagacuggagaccagcaugaaguggugcgacgagggcaucuaccugcuggccagccagcccguggacaagugccagagccaggacggcgccgaggccgcccugcaggagaucgagaaguuccuggagaccggcgccgagaacaagauccaggagcugaacgccaucuacaaggaguacgagagcauccugaaccaggaccugauggagcacgugagaaagguguuccagaagcaggccagcauggaggagguguuccacagaagacaggccagccugaagaagcuggccgccagacagaccagacccgugcagcccguggcccccagacccgaggcccuggccaagagccccugccccagccccggcaucagaagaggcagcgagaacagcagcagcgagggcggcgcccugagaagaggccccuacagaagagccaagagcgagaugagcgagagcagacagggcagaggcagcgccggcgaggaggaggagagccuggccauccugagaagacacgugaugagcgagcugcuggacaccgagagagccuacguggaggagcugcugugcgugcuggagggcuacgccgccgagauggacaacccccugauggcccaccugcugagcaccggccugcacaacaagaaggacgugcuguucggcaacauggaggagaucuaccacuuccacaacagaaucuuccugagagagcuggagaacuacaccgacugccccgagcuggugggcagaugcuuccuggagagaauggaggacuuccagaucuacgagaaguacugccagaacaagcccagaagcgagagccuguggagacagugcagcgacugccccuucuuccaggagugccagagaaagcuggaccacaagcugagccuggacagcuaccugcugaagcccgugcagagaaucaccaaguaccagcugcugcugaaggagaugcugaaguacagcagaaacugcgagggcgccgaggaccugcaggaggcccugagcagcauccugggcauccugaaggccgugaacgacagcaugcaccugaucgccaucaccggcuacgacggcaaccugggcgaccugggcaagcugcugaugcagggcagcuucagcguguggaccgaccacaagagaggccacaccaaggugaaggagcuggccagauucaagcccaugcagagacaccuguuccugcacgagaaggccgugcuguucugcaagaagagagaggagaacggcgagggcuacgagaaggcccccagcuacagcuacaagcagagccugaacauggccgccgugggcaucaccgagaacgugaagggcgacgccaagaaguucgagaucugguacaacgccagagaggagguguacaucgugcaggcccccacccccgagaucaaggccgccugggugaacgagaucagaaaggugcugaccagccagcugcaggccugcagagaggccagccagcacagagcccuggagcagagccagagccugccccugcccgcccccaccagcaccagccccagcagaggcaacagcagaaacaucaagaagcuggaggagagaaagaccgacccccugagccuggagggcuacgugagcagcgccccccugaccaagccccccgagaagggcaagggcuggagcaagaccagccacagccuggaggcccccgaggacgacggcggcuggagcagcgccgaggagcagaucaacagcagcgacgccgaggaggacggcggccugggccccaagaagcuggugcccggcaaguacaccgugguggccgaccacgagaagggcggccccgacgcccugagagugagaagcggcgacgugguggagcuggugcaggagggcgacgagggccugugguacgugagagaccccaccaccggcaaggagggcugggugcccgccagcagccugagcgugagacugggccccagcggcagcgcccagugccugagcagcagcgagagcagccccggcagcgccgugcugagcaacagcagcagcugcagcgagggcggccaggcccccuucagcgaccugcagggcuaa

SEQ ID NO: 19718 - RNA, 441 nt, Artificial Sequence
  MCFD2__Homo_sapiens__NP_001164979
augaccaugagaagccugcugagaacccccuuccugugcggccugcugugggccuucugcgcccccggcgccagagccgaggagcccgccgccagcuucagccagcccggcagcaugggccuggacaagaacaccgugcacgaccaggagcacaucauggagcaccuggagggcgugaucaacaagcccgaggccgagaugagcccccaggagcugcagcugcacuacuucaagaugcacgacuacgacggcaacaaccugcuggacggccuggagcugagcaccgccaucacccacgugcacaaggaggagggcagcgagcaggccccccugaugagcgaggacgagcugaucaacaucaucgacggcgugcugagagacgacgacaagaacaacgacggcuacaucgacuacgccgaguucgccaagagccugcaguaa

SEQ ID NO: 19719 - RNA, 1269 nt, Artificial Sequence
  MCHR1__Homo_sapiens__NP_005288
augagcgugggcgccaugaagaagggcgugggcagagccgugggccugggcggcggcagcggcugccaggccaccgaggaggacccccugcccaacugcggcgccugcgcccccggccagggcggcagaagauggagacugccccagcccgccuggguggagggcagcagcgccagacugugggagcaggccaccggcaccggcuggauggaccuggaggccagccugcugcccaccggccccaacgccagcaacaccagcgacggccccgacaaccugaccagcgccggcagcccccccagaaccggcagcaucagcuacaucaacaucaucaugcccagcguguucggcaccaucugccugcugggcaucaucggcaacagcaccgugaucuucgccguggugaagaagagcaagcugcacuggugcaacaacgugcccgacaucuucaucaucaaccugagcgugguggaccugcuguuccugcugggcaugcccuucaugauccaccagcugaugggcaacggcguguggcacuucggcgagaccaugugcacccugaucaccgccauggacgccaacagccaguucaccagcaccuacauccugaccgccauggccaucgacagauaccuggccaccgugcaccccaucagcagcaccaaguucagaaagcccagcguggccacccuggugaucugccugcugugggcccugagcuucaucagcaucacccccguguggcuguacgccagacugauccccuuccccggcggcgccgugggcugcggcaucagacugcccaaccccgacaccgaccuguacugguucacccuguaccaguucuuccuggccuucgcccugcccuucguggugaucaccgccgccuacgugagaauccugcagagaaugaccagcagcguggcccccgccagccagagaagcaucagacugagaaccaagagagugaccagaaccgccaucgccaucugccugguguucuucgugugcugggcccccuacuacgugcugcagcugacccagcugagcaucagcagacccacccugaccuucguguaccuguacaacgccgccaucagccugggcuacgccaacagcugccugaaccccuucguguacaucgugcugugcgagaccuucagaaagagacuggugcugagcgugaagcccgccgcccagggccagcugagagccgugagcaacgcccagaccgccgacgaggagagaaccgagagcaagggcaccuaa

SEQ ID NO: 19720 - RNA, 1023 nt, Artificial Sequence
  MCHR2__Homo_sapiens__NP_001035269
augaaccccuuccacgccagcugcuggaacaccagcgccgagcugcugaacaagagcuggaacaaggaguucgccuaccagaccgccagcgugguggacaccgugauccugcccagcaugaucggcaucaucugcagcaccggccuggugggcaacauccugaucguguucaccaucaucagaagcagaaagaagaccgugcccgacaucuacaucugcaaccuggccguggccgaccuggugcacaucgugggcaugcccuuccugauccaccagugggccagaggcggcgaguggguguucggcggcccccugugcaccaucaucaccagccuggacaccugcaaccaguucgccugcagcgccaucaugaccgugaugagcguggacagauacuucgcccuggugcagcccuucagacugaccagauggagaaccagauacaagaccaucagaaucaaccugggccugugggccgccagcuucauccuggcccugcccguguggguguacagcaaggugaucaaguucaaggacggcguggagagcugcgccuucgaccugaccagccccgacgacgugcugugguacacccuguaccugaccaucaccaccuucuucuucccccugccccugauccuggugugcuacauccugauccugugcuacaccugggagauguaccagcagaacaaggacgccagaugcugcaaccccagcgugcccaagcagagagugaugaagcugaccaagauggugcuggugcugguggugguguucauccugagcgccgcccccuaccacgugauccagcuggugaaccugcagauggagcagcccacccuggccuucuacgugggcuacuaccugagcaucugccugagcuacgccagcagcagcaucaaccccuuccuguacauccugcugagcggcaacuuccagaagagacugccccagauccagagaagagccaccgagaaggagaucaacaacaugggcaacacccugaagagccacuucuaa

SEQ ID NO: 19721 - RNA, 1158 nt, Artificial Sequence
  MCIDAS__Homo_sapiens__NP_001177716
augcaggccugcggcggcggcgccgccggcagaagagccuucgacagcaucugccccaacagaaugcuggcccugcccggcagagcccugcugugcaagcccggcaagcccgagagaaaguucgccccccccagaaaguucuuccccggcugcaccggcggcagccccgugagcguguacgaggacccccccgacgccgagcccaccgcccugcccgcccugaccaccaucgaccugcaggaccuggccgacugcagcagccugcugggcagcgacgccccccccggcggcgaccuggccgccagccagaaccacagccaccagaccgaggccgacuucaaccugcaggacuucagagacaccguggacgaccugaucagcgacagcagcagcaugaugagccccacccuggccagcggcgacuuccccuucagccccugcgacaucagccccuucggccccugccugagccccccccuggaccccagagcccugcagagccccccccugagaccccccgacgugcccccccccgagcaguacuggaaggagguggccgaccagaaccagagagcccugggcgacgcccugguggagaacaaccagcugcacgugacccugacccagaagcaggaggagaucgccagccugaaggagagaaacgugcagcugaaggagcuggccagcagaaccagacaccuggccagcgugcuggacaagcugaugaucacccagagcagagacugcggcgccgccgccgagcccuuccugcugaaggccaaggccaagagaagccuggaggagcuggugagcgccgccggccaggacugcgccgagguggacgccauccugagagagaucagcgagagaugcgacgaggcccugcagagcagagaccccaagagacccagacugcugcccgagcccgccaacaccgacaccagacccggcaaccugcacggcgccuucagaggccugagaaccgacugcagcagaagcgcccugaaccugagccacagcgagcuggaggagggcggcagcuucagcaccagaaucagaagccacagcaccaucagaacccuggccuucccccagggcaacgccuucaccaucagaaccgccaacggcggcuacaaguucagaugggugcccagcuaa

SEQ ID NO: 19722 - RNA, 2625 nt, Artificial Sequence
  MCM10__Homo_sapiens__NP_060988
auggacgaggaggaggacaaccugagccugcugaccgcccugcuggaggagaacgagagcgcccuggacugcaacagcgaggagaacaacuuccugaccagagagaacggcgagcccgacgccuucgacgagcuguucgacgccgacggcgacggcgagagcuacaccgaggaggccgacgacggcgagaccggcgagaccagagacgagaaggagaaccuggccacccuguucggcgacauggaggaccugaccgacgaggaggaggugcccgccagccagagcaccgagaacagagugcugcccgcccccgcccccagaagagagaagaccaacgaggagcugcaggaggagcugagaaaccugcaggagcagaugaaggcccugcaggagcagcugaaggugaccaccaucaagcagaccgccagccccgccagacugcagaagagccccgagaagagccccagacccccccugaaggagagaagagugcagagaauccaggagagcaccugcuucagcgccgagcuggacgugcccgcccugcccagaaccaagagaguggccagaacccccaaggccagcccccccgaccccaagagcagcagcagcagaaugaccagcgcccccagccagccccugcagaccaucagcagaaacaagcccagcggcaucaccagaggccagaucgugggcacccccggcagcagcggcgagaccacccagcccaucugcguggaggccuucagcggccugagacugagaagacccagagugagcagcaccgagaugaacaagaagaugaccggcagaaagcugaucagacugagccagaucaaggagaagauggccagagagaagcuggaggagaucgacugggugaccuucggcgugauccugaagaaggugaccccccagagcgugaacagcggcaagaccuucagcaucuggaagcugaacgaccugagagaccugacccagugcgugagccuguuccuguucggcgaggugcacaaggcccuguggaagaccgagcagggcaccguggugggcauccugaacgccaaccccaugaagcccaaggacggcagcgaggaggugugccugagcaucgaccacccccagaaggugcugaucaugggcgaggcccuggaccugggcaccugcaaggccaagaagaagaacggcgagcccugcacccagaccgugaaccugagagacugcgaguacugccaguaccacgugcaggcccaguacaagaagcugagcgccaagagagccgaccugcagagcaccuucagcggcggcagaauccccaagaaguucgccagaagaggcaccagccugaaggagagacugugccaggacggcuucuacuacggcggcgugagcagcgccagcuacgccgccagcaucgccgccgccguggcccccaagaagaagauccagaccacccugagcaaccugguggugaagggcaccaaccugaucauccaggagaccagacagaagcugggcaucccccagaagagccugagcugcagcgaggaguucaaggagcugauggaccugcccaccugcggcgccagaaaccugaagcagcaccuggccaaggccaccgccagcggcaucaugggcagccccaagcccgccaucaagagcaucagcgccagcgcccugcugaagcagcagaagcagagaaugcuggagaugagaagaagaaagagcgaggagauccagaagagauuccugcagagcagcagcgagguggagagccccgccgugcccagcagcagcagacagccccccgcccagccccccagaaccggcagcgaguuccccagacuggagggcgcccccgccaccaugacccccaagcugggcagaggcgugcuggagggcgacgacgugcuguucuacgacgagagccccccccccagacccaagcugagcgcccuggccgaggccaagaagcuggccgccaucaccaagcugagagccaagggccaggugcugaccaagaccaaccccaacagcaucaagaagaagcagaaggacccccaggacauccuggaggugaaggagagaguggagaagaacaccauguucagcagccaggccgaggacgagcuggagcccgccagaaagaagagaagagagcagcuggccuaccuggagagcgaggaguuccagaagauccugaaggccaagagcaagcacaccggcauccugaaggaggccgaggccgagaugcaggagagauacuucgagccccuggugaagaaggagcagauggaggagaagaugagaaacaucagagaggugaagugcagaguggugaccugcaagaccugcgccuacacccacuucaagcugcuggagaccugcgugagcgagcagcacgaguaccacuggcacgacggcgugaagagauucuucaagugccccugcggcaacagaagcaucagccuggacagacugcccaacaagcacugcagcaacugcggccuguacaagugggagagagacggcaugcugaaggagaagaccggccccaagaucggcggcgagacccugcugcccagaggcgaggagcacgccaaguuccugaacagccugaaguaa

SEQ ID NO: 19723 - RNA, 2715 nt, Artificial Sequence
  MCM2__Homo_sapiens__NP_004517
auggccgagagcagcgagagcuucaccauggccagcagccccgcccagagaagaagaggcaacgacccccugaccagcagccccggcagaagcagcagaagaaccgacgcccugaccagcagccccggcagagaccugccccccuucgaggacgagagcgagggccugcugggcaccgagggcccccuggaggaggaggaggacggcgaggagcugaucggcgacggcauggagagagacuacagagccauccccgagcuggacgccuacgaggccgagggccuggcccuggacgacgaggacguggaggagcugaccgccagccagagagaggccgccgagagagccaugagacagagagacagagaggccggcagaggccugggcagaaugagaagaggccugcuguacgacagcgacgaggaggacgaggagagacccgccagaaagagaagacagguggagagagccaccgaggacggcgaggaggacgaggagaugaucgagagcaucgagaaccuggaggaccugaagggccacagcgugagagagugggugagcauggccggccccagacuggagauccaccacagauucaagaacuuccugagaacccacguggacagccacggccacaacguguucaaggagagaaucagcgacaugugcaaggagaacagagagagccugguggugaacuacgaggaccuggccgccagagagcacgugcuggccuacuuccugcccgaggcccccgccgagcugcugcagaucuucgacgaggccgcccuggagguggugcuggccauguaccccaaguacgacagaaucaccaaccacauccacgugagaaucagccaccugccccugguggaggagcugagaagccugagacagcugcaccugaaccagcugaucagaaccagcggcguggugaccagcugcaccggcgugcugccccagcugagcauggugaaguacaacugcaacaagugcaacuucgugcugggccccuucugccagagccagaaccaggaggugaagcccggcagcugccccgagugccagagcgccggccccuucgaggugaacauggaggagaccaucuaccagaacuaccagagaaucagaauccaggagagccccggcaagguggccgccggcagacugcccagaagcaaggacgccauccugcuggccgaccugguggacagcugcaagcccggcgacgagaucgagcugaccggcaucuaccacaacaacuacgacggcagccugaacaccgccaacggcuuccccguguucgccaccgugauccuggccaaccacguggccaagaaggacaacaagguggccgugggcgagcugaccgacgaggacgugaagaugaucaccagccugagcaaggaccagcagaucggcgagaagaucuucgccagcaucgcccccagcaucuacggccacgaggacaucaagagaggccuggcccuggcccuguucggcggcgagcccaagaaccccggcggcaagcacaaggugagaggcgacaucaacgugcugcugugcggcgaccccggcaccgccaagagccaguuccugaaguacaucgagaaggugagcagcagagccaucuucaccaccggccagggcgccagcgccgugggccugaccgccuacgugcagagacaccccgugagcagagaguggacccuggaggccggcgcccuggugcuggccgacagaggcgugugccugaucgacgaguucgacaagaugaacgaccaggacagaaccagcauccacgaggccauggagcagcagagcaucagcaucagcaaggccggcaucgugaccagccugcaggccagaugcaccgugaucgccgccgccaaccccaucggcggcagauacgaccccagccugaccuucagcgagaacguggaccugaccgagcccaucaucagcagauucgacauccugugcguggugagagacaccguggaccccgugcaggacgagaugcuggccagauucguggugggcagccacgugagacaccaccccagcaacaaggaggaggagggccuggccaacggcagcgccgccgagcccgccaugcccaacaccuacggcguggagccccugccccaggaggugcugaagaaguacaucaucuacgccaaggagagagugcaccccaagcugaaccagauggaccaggacaagguggccaagauguacagcgaccugagaaaggagagcauggccaccggcagcauccccaucaccgugagacacaucgagagcaugaucagaauggccgaggcccacgccagaauccaccugagagacuacgugaucgaggacgacgugaacauggccaucagagugaugcuggagagcuucaucgacacccagaaguucagcgugaugagaagcaugagaaagaccuucgccagauaccugagcuucagaagagacaacaacgagcugcugcuguucauccugaagcagcugguggccgagcaggugaccuaccagagaaacagauucggcgcccagcaggacaccaucgaggugcccgagaaggaccugguggacaaggccagacagaucaacauccacaaccugagcgccuucuacgacagcgagcuguucagaaugaacaaguucagccacgaccugaagagaaagaugauccugcagcaguucuaa

SEQ ID NO: 19724 - RNA, 5943 nt, Artificial Sequence
  MCM3AP__Homo_sapiens__XP_006724127
augaaccccaccaaccccuucagcggccagcagcccagcgccuucagcgccagcagcagcaacgugggcacccugcccagcaagccccccuucagauucggccagcccagccuguucggccagaacagcacccugagcggcaagagcagcggcuucagccaggugagcagcuuccccgccagcagcggcgugagccacagcagcagcgugcagacccugggcuucacccagaccagcagcgugggccccuucagcggccuggagcacaccagcaccuucguggccaccagcggccccagcagcagcagcgugcugggcaacaccggcuucagcuucaagagccccaccagcgugggcgccuuccccagcaccagcgccuucggccaggaggccggcgagaucgugaacagcggcuucggcaagaccgaguucagcuucaagccccuggagaacgccguguucaagcccauccugggcgccgagagcgagcccgagaagacccagagccagaucgccagcggcuucuucaccuucagccaccccaucagcagcgcccccggcggccuggcccccuucagcuucccccaggugaccagcagcagcgccaccaccagcaacuucaccuucagcaagcccgugagcagcaacaacagccugagcgccuucacccccgcccugagcaaccagaacguggaggaggagaagagaggccccaagagcaucuucggcagcagcaacaacagcuucagcagcuuccccgugagcagcgccgugcugggcgagcccuuccaggccagcaaggccggcgugagacagggcugcgaggaggccgugagccagguggagccccugcccagccugaugaagggccugaagagaaaggaggaccaggacagaagccccagaagacacggccacgagcccgccgaggacagcgacccccugagcagaggcgaccacccccccgacaagagacccgugagacugaacagacccagaggcggcacccuguucggcagaaccauccaggacguguucaagagcaacaaggaggugggcagacugggcaacaaggaggccaagaaggagaccggcuucguggagagcgccgagagcgaccacauggccauccccggcggcaaccagagcgugcuggcccccagcagaauccccggcgugaacaaggaggaggagaccgagagcagagagaagaaggaggacagccugagaggcacccccgccagacagagcaacagaagcgagagcaccgacagccugggcggccugagccccagcgaggugaccgccauccagugcaagaacauccccgacuaccugaacgacagaaccauccuggagaaccacuucggcaagaucgccaaggugcagagaaucuucaccagaagaagcaagaagcuggccguggugcacuucuucgaccacgccagcgccgcccuggccagaaagaagggcaagagccugcacaaggacauggccaucuucuggcacagaaagaagaucagccccaacaagaagcccuucagccugaaggagaagaagcccggcgacggcgaggugagccccagcaccgaggacgcccccuuccagcacagcccccugggcaaggccgccggcagaaccggcgccagcagccugcugaacaagagcagccccgugaagaagcccagccugcugaaggcccaccaguucgagggcgacagcuucgacagcgccagcgagggcagcgagggccugggccccugcgugcugagccugagcacccugaucggcaccguggccgagaccagcaaggagaaguacagacugcuggaccagagagacagaaucaugagacaggccagagugaagagaaccgaccuggacaaggccagaaccuucgugggcaccugccuggacaugugccccgagaaggagagauacaugagagagaccagaagccagcugagcguguucgagguggugcccggcaccgaccagguggaccacgccgccgccgugaaggaguacagcagaagcagcgccgaccaggaggagccccugccccacgagcugagaccccugcccgugcugagcagaaccauggacuaccuggugacccagaucauggaccagaaggagggcagccugagagacugguacgacuucguguggaacagaaccagaggcaucagaaaggacaucacccagcagcaccugugcgacccccugaccgugagccugaucgagaagugcaccagauuccacauccacugcgcccacuucaugugcgaggagcccaugagcagcuucgacgccaagaucaacaacgagaacaugaccaagugccugcagagccugaaggagauguaccaggaccugagaaacaagggcguguucugcgccagcgaggccgaguuccagggcuacaacgugcugcugagccugaacaagggcgacauccugagagaggugcagcaguuccaccccgccgugagaaacagcagcgaggugaaguucgccgugcaggccuucgccgcccugaacagcaacaacuucgugagauucuucaagcuggugcagagcgccagcuaccugaacgccugccugcugcacugcuacuucagccagaucagaaaggacgcccugagagcccugaacuucgccuacaccgugagcacccagagaagcaccaucuucccccuggacggcguggugagaaugcugcuguucagagacugcgaggaggccaccgacuuccugaccugccacggccugaccgugagcgacggcugcguggagcugaacagaagcgccuuccuggagcccgagggccugagcaagaccagaaagagcguguucaucaccagaaagcugaccgugagcgugggcgagaucgugaacggcggcccccugccccccgugcccagacacacccccgugugcagcuucaacagccagaacaaguacaucggcgagagccuggccgccgagcugcccgugagcacccagagacccggcagcgacaccgugggcggcggcagaggcgaggagugcggcguggagcccgacgccccccugagcagccugccccagagccugcccgcccccgcccccagccccgugccccugccccccgugcuggcccugacccccagcguggcccccagccuguuccagcugagcgugcagcccgagccccccccccccgagcccgugcccauguacagcgacgaggaccuggcccaggugguggacgagcugauccaggaggcccugcagagagacugcgaggaggugggcagcgccggcgccgccuacgccgccgccgcccugggcgugagcaacgccgccauggaggaccugcugaccgccgccaccaccggcauccugagacacaucgccgccgaggaggugagcaaggagagagagagaagagagcaggagagacagagagccgaggaggagagacugaagcaggagagagagcuggugcugagcgagcugagccagggccuggccguggagcugauggagagagugaugauggaguucgugagagagaccugcagccaggagcugaagaacgccguggagaccgaccagagagugagaguggccagaugcugcgaggacgugugcgcccaccugguggaccuguuccugguggaggagaucuuccagaccgccaaggagacccugcaggagcugcagugcuucugcaaguaccugcagagauggagagaggccgugaccgccagaaagaagcugagaagacagaugagagccuuccccgccgcccccugcugcguggacgugagcgacagacugagagcccuggcccccagcgccgagugccccaucgccgaggagaaccuggccagaggccugcuggaccugggccacgccggcagacugggcaucagcugcaccagacugagaagacugagaaacaagaccgcccaccagaugaaggugcagcacuucuaccagcagcugcugagcgacguggccugggccagccuggaccugcccagccugguggccgagcaccugcccggcagacaggagcacguguucuggaagcuggugcuggugcugcccgacguggaggagcagagccccgagagcugcggcagaauccuggccaacuggcugaaggugaaguucaugggcgacgagggcagcguggacgacaccagcagcgacgccggcggcauccagacccugagccuguucaacagccugagcagcaagggcgaccagaugaucagcgugaacgugugcaucaagguggcccacggcgcccugagcgacggcgccaucgacgccguggagacccagaaggaccugcugggcgccagcggccugaugcugcugcugccccccaagaugaagagcgaggacauggccgaggaggacguguacuggcugagcgcccugcugcagcugaagcagcugcugcaggccaagcccuuccagcccgcccugccccugguggugcuggugcccagccccggcggcgacgccguggagaaggagguggaggacggccugaugcugcaggaccuggugagcgccaagcugaucagcgacuacaccgugaccgagauccccgacaccaucaacgaccugcagggcagcaccaaggugcugcaggccgugcaguggcuggugagccacugcccccacagccuggaccugugcugccagacccugauccaguacguggaggacggcaucggccacgaguucagcggcagauucuuccacgacagaagagagagaagacugggcggccuggccagccaggagcccggcgccaucaucgagcuguucaacagcgugcugcaguuccuggccagcguggugagcagcgagcagcugugcgaccugagcuggcccgugaccgaguucgccgaggccggcggcagcagacugcugccccaccugcacuggaacgcccccgagcaccuggccuggcugaagcaggccgugcugggcuuccagcugccccagauggaccugcccccccugggcgcccccuggcugcccgugugcagcaugguggugcaguacgccagccagauccccagcagcagacagacccagcccgugcugcagagccagguggagaaccugcugcacagaaccuacugcagauggaagagcaagagccccagccccgugcacggcgccggccccagcgugauggagauccccugggacgaccugaucgcccugugcaucaaccacaagcugagagacuggaccccccccagacugcccgugaccagcgaggcccugagcgaggacggccagaucugcguguacuucuucaagaacgaccugaagaaguacgacgugccccugagcugggagcaggccagacugcagacccagaaggagcugcagcugagagagggcagacuggccaucaagcccuuccaccccagcgccaacaacuuccccaucccccugcugcacaugcacagaaacuggaagagaagcaccgagugcgcccaggagggcagaauccccagcaccgaggaccugaugagaggcgccagcgccgaggagcugcuggcccagugccugagcagcagccugcugcuggagaaggaggagaacaagagauucgaggaccagcugcagcaguggcugagcgaggacagcggcgccuucaccgaccugaccagccugccccuguaccugccccagacccuggugagccugagccacaccaucgagcccgugaugaagaccagcgugaccaccagcccccagagcgacaugaugagagagcagcugcagcugagcgaggccaccggcaccugccugggcgagagacugaagcaccuggagagacugaucagaagcagcagagaggaggagguggccagcgagcugcaccugagcgcccugcuggacaugguggacaucuaa

SEQ ID NO: 19725 - RNA, 2457 nt, Artificial Sequence
  MCM3__Homo_sapiens__NP_001257401
augcugaucugcagccagggccccagacuguuccuggaggugaccuucggcggcggcaagagcagcgagguguucgcccccggcuggagccaccccggcaaccugcacgccacccugguggagguggugcuguggcagagagccuggagagugcccuggugcuggaccauguggagcugcggcagacugagagagaucaccuggaccagcuggaccaccagacugcugaacaacgccuucgaggagcugguggccuuccagagagcccugaaggacuucguggccagcaucgacgccaccuacgccaagcaguacgaggaguucuacgugggccuggagggcagcuucggcagcaagcacgugagccccagaacccugaccagcugcuuccugagcugcguggugugcguggagggcaucgugaccaagugcagccuggugagacccaagguggugagaagcgugcacuacugccccgccaccaagaagaccaucgagagaagauacagcgaccugaccacccugguggccuuccccagcagcagcguguaccccaccaaggacgaggagaacaacccccuggagaccgaguacggccugagcguguacaaggaccaccagaccaucaccauccaggagaugcccgagaaggcccccgccggccagcugcccagaagcguggacgugauccuggacgacgaccugguggacaaggccaagcccggcgacagagugcagguggugggcaccuacagaugccugcccggcaagaagggcggcuacaccagcggcaccuucagaaccgugcugaucgccugcaacgugaagcagaugagcaaggacgcccagcccagcuucagcgccgaggacaucgccaagaucaagaaguucagcaagaccagaagcaaggacaucuucgaccagcuggccaagagccuggcccccagcauccacggccacgacuacgugaagaaggccauccugugccugcugcugggcggcguggagagagaccuggagaacggcagccacaucagaggcgacaucaacauccugcugaucggcgaccccagcguggccaagagccagcugcugagauacgugcugugcaccgcccccagagccauccccaccaccggcagaggcagcagcggcgugggccugaccgccgccgugaccaccgaccaggagaccggcgagagaagacuggaggccggcgccauggugcuggccgacagaggcguggugugcaucgacgaguucgacaagaugagcgacauggacagaaccgccauccacgaggugauggagcagggcagagugaccaucgccaaggccggcauccacgccagacugaacgccagaugcagcgugcuggccgccgccaaccccguguacggcagauacgaccaguacaagacccccauggagaacaucggccugcaggacagccugcugagcagauucgaccugcuguucaucaugcuggaccagauggaccccgagcaggacagagagaucagcgaccacgugcugagaaugcacagauacagagcccccggcgagcaggacggcgacgccaugccccugggcagcgccguggacauccuggccaccgacgaccccaacuucagccaggaggaccagcaggacacccagaucuacgagaagcacgacaaccugcugcacggcaccaagaagaagaaggagaagauggugagcgccgccuucaugaagaaguacauccacguggccaagaucaucaagcccgugcugacccaggagagcgccaccuacaucgccgaggaguacagcagacugagaagccaggacagcaugagcagcgacaccgccagaaccagccccgugaccgccagaacccuggagacccugaucagacuggccaccgcccacgccaaggccagaaugagcaagaccguggaccugcaggacgccgaggaggccguggagcuggugcaguacgccuacuucaagaaggugcuggagaaggagaagaagagaaagaagagaagcgaggacgagagcgagaccgaggacgaggaggagaagagccaggaggaccaggagcagaagagaaagagaagaaagaccagacagcccgacgccaaggacggcgacagcuacgaccccuacgacuucagcgacaccgaggaggagaugccccaggugcacacccccaagaccgccgacagccaggagaccaaggagagccagaagguggagcugagcgagagcagacugaaggccuucaagguggcccugcuggacguguucagagaggcccacgcccagagcaucggcaugaacagacugaccgagagcaucaacagagacagcgaggagcccuucagcagcguggagauccaggccgcccugagcaagaugcaggacgacaaccaggugauggugagcgagggcaucaucuuccugaucuaa

SEQ ID NO: 19726 - RNA, 2592 nt, Artificial Sequence
  MCM4__Homo_sapiens__NP_877423
augagcagccccgccagcacccccagcagaagaggcagcagaagaggcagagccacccccgcccagacccccagaagcgaggacgccagaagcagccccagccagagaagaagaggcgaggacagcaccagcaccggcgagcugcagcccaugcccaccagccccggcguggaccugcagagccccgccgcccaggacgugcuguucagcagccccccccagaugcacagcagcgccaucccccuggacuucgacgugagcagcccccugaccuacggcacccccagcagcagaguggagggcacccccagaagcggcgugagaggcacccccgugagacagagacccgaccugggcagcgcccagaagggccugcagguggaccugcagagcgacggcgccgccgccgaggacaucguggccagcgagcagagccugggccagaagcuggugaucuggggcaccgacgugaacguggccgccugcaaggagaacuuccagagauuccugcagagauucaucgacccccuggccaaggaggaggagaacgugggcaucgacaucaccgagccccuguacaugcagagacugggcgagaucaacgugaucggcgagcccuuccugaacgugaacugcgagcacaucaagagcuucgacaagaaccuguacagacagcugaucagcuacccccaggaggugauccccaccuucgacauggccgugaacgagaucuucuucgacagauaccccgacagcauccuggagcaccagauccaggugagacccuucaacgcccugaagaccaagaacaugagaaaccugaaccccgaggacaucgaccagcugaucaccaucagcggcauggugaucagaaccagccagcugauccccgagaugcaggaggccuucuuccagugccaggugugcgcccacaccaccagaguggagauggacagaggcagaaucgccgagcccagcgugugcggcagaugccacaccacccacagcauggcccugauccacaacagaagccuguucagcgacaagcagaugaucaagcugcaggagagccccgaggacaugcccgccggccagaccccccacaccgugauccuguucgcccacaacgaccugguggacaaggugcagcccggcgacagagugaacgugaccggcaucuacagagccgugcccaucagagugaaccccagagugagcaacgugaagagcguguacaagacccacaucgacgugauccacuacagaaagaccgacgccaagagacugcacggccuggacgaggaggccgagcagaagcuguucagcgagaagagaguggagcugcugaaggagcugagcagaaagcccgacaucuacgagagacuggccagcgcccuggcccccagcaucuacgagcacgaggacaucaagaagggcauccugcugcagcuguucggcggcaccagaaaggacuucagccacaccggcagaggcaaguucagagccgagaucaacauccugcugugcggcgaccccggcaccagcaagagccagcugcugcaguacguguacaaccuggugcccagaggccaguacaccagcggcaagggcagcagcgccgugggccugaccgccuacgugaugaaggaccccgagaccagacagcuggugcugcagaccggcgcccuggugcugagcgacaacggcaucugcugcaucgacgaguucgacaagaugaacgagagcaccagaagcgugcugcacgaggugauggagcagcagacccugagcaucgccaaggccggcaucaucugccagcugaacgccagaaccagcgugcuggccgccgccaaccccaucgagagccaguggaaccccaagaagaccaccaucgagaacauccagcugccccacacccugcugagcagauucgaccugaucuuccugcugcuggacccccaggacgaggccuacgacagaagacuggcccaccaccugguggcccuguacuaccagagcgaggagcaggccgaggaggagcugcuggacauggccgugcugaaggacuacaucgccuacgcccacagcaccaucaugcccagacugagcgaggaggccagccaggcccugaucgaggccuacguggacaugagaaagaucggcagcagcagaggcauggugagcgccuaccccagacagcuggagagccugaucagacuggccgaggcccacgccaaggugagacugagcaacaagguggaggccaucgacguggaggaggccaagagacugcacagagaggcccugaagcagagcgccaccgaccccagaaccggcaucguggacaucagcauccugaccaccggcaugagcgccaccagcagaaagagaaaggaggagcuggccgaggcccugaagaagcugauccugagcaagggcaagacccccgcccugaaguaccagcagcuguucgaggacaucagaggccagagcgacaucgccaucaccaaggacauguucgaggaggcccugagagcccuggccgacgacgacuuccugaccgugaccggcaagaccgugagacugcuguaa

SEQ ID NO: 19727 - RNA, 2205 nt, Artificial Sequence
  MCM5__Homo_sapiens__NP_006730
augagcggcuucgacgaccccggcaucuucuacagcgacagcuucggcggcgacgcccaggccgacgagggccaggccagaaagagccagcugcagagaagauucaaggaguuccugagacaguacagagugggcaccgacagaaccggcuucaccuucaaguacagagacgagcugaagagacacuacaaccugggcgaguacuggaucgagguggagauggaggaccuggccagcuucgacgaggaccuggccgacuaccuguacaagcagcccgccgagcaccugcagcugcuggaggaggccgccaaggagguggccgacgaggugaccagacccagacccagcggcgaggaggugcugcaggacauccaggugaugcugaagagcgacgccagccccagcagcaucagaagccugaagagcgacaugaugagccaccuggugaagauccccggcaucaucaucgccgccagcgccgugagagccaaggccaccagaaucagcauccagugcagaagcugcagaaacacccugaccaacaucgccaugagacccggccuggagggcuacgcccugcccagaaagugcaacaccgaccaggccggcagacccaagugcccccuggaccccuacuucaucaugcccgacaagugcaagugcguggacuuccagacccugaagcugcaggagcugcccgacgccgugccccacggcgagaugcccagacacaugcagcuguacugcgacagauaccugugcgacaagguggugcccggcaacagagugaccaucaugggcaucuacagcaucaagaaguucggccugaccaccagcagaggcagagacagagugggcgugggcaucagaagcagcuacaucagagugcugggcauccagguggacaccgacggcagcggcagaagcuucgccggcgccgugagcccccaggaggaggaggaguucagaagacuggccgcccugcccaacguguacgaggugaucagcaagagcaucgcccccagcaucuucggcggcaccgacaugaagaaggccaucgccugccugcuguucggcggcagcagaaagagacugcccgacggccugaccagaagaggcgacaucaaccugcugaugcugggcgaccccggcaccgccaagagccagcugcugaaguucguggagaagugcagccccaucggcguguacaccagcggcaagggcagcagcgccgccggccugaccgccagcgugaugagagaccccagcagcagaaacuucaucauggagggcggcgccauggugcuggccgacggcggcguggugugcaucgacgaguucgacaagaugagagaggacgacagaguggccauccacgaggccauggagcagcagaccaucagcaucgccaaggccggcaucaccaccacccugaacagcagaugcagcgugcuggccgccgccaacagcguguucggcagaugggacgagaccaagggcgaggacaacaucgacuucaugcccaccauccugagcagauucgacaugaucuucaucgugaaggacgagcacaacgaggagagagacgugaugcuggccaagcacgugaucacccugcacgugagcgcccugacccagacccaggccguggagggcgagaucgaccuggccaagcugaagaaguucaucgccuacugcagagugaagugcggccccagacugagcgccgaggccgccgagaagcugaagaacagauacaucaucaugagaagcggcgccagacagcacgagagagacagcgacagaagaagcagcauccccaucaccgugagacagcuggaggccaucgugagaaucgccgaggcccugagcaagaugaagcugcagcccuucgccaccgaggccgacguggaggaggcccugagacuguuccaggugagcacccuggacgccgcccugagcggcacccugagcggcguggagggcuucaccagccaggaggaccaggagaugcugagcagaaucgagaagcagcugaagagaagauucgccaucggcagccaggugagcgagcacagcaucaucaaggacuucaccaagcagaaguaccccgagcacgccauccacaaggugcugcagcugaugcugagaagaggcgagauccagcacagaaugcagagaaaggugcuguacagacugaaguaa

SEQ ID NO: 19728 - RNA, 2466 nt, Artificial Sequence
  MCM6__Homo_sapiens__NP_005906
auggaccuggccgccgccgccgagcccggcgccggcagccagcaccuggaggugagagacgagguggccgagaagugccagaagcuguuccuggacuuccuggaggaguuccagagcagcgacggcgagaucaaguaccugcagcuggccgaggagcugaucagacccgagagaaacacccugguggugagcuucguggaccuggagcaguucaaccagcagcugagcaccaccauccaggaggaguucuacagaguguaccccuaccugugcagagcccugaagaccuucgugaaggacagaaaggagaucccccuggccaaggacuucuacguggccuuccaggaccugcccaccagacacaagaucagagagcugaccagcagcagaaucggccugcugaccagaaucagcggccagguggugagaacccaccccgugcaccccgagcuggugagcggcaccuuccugugccuggacugccagaccgugaucagagacguggagcagcaguucaaguacacccagcccaacaucugcagaaaccccgugugcgccaacagaagaagauuccugcuggacaccaacaagagcagauucguggacuuccagaaggugagaauccaggagacccaggccgagcugcccagaggcagcauccccagaagccuggaggugauccugagagccgaggccguggagagcgcccaggccggcgacaagugcgacuucaccggcacccugaucguggugcccgacgugagcaagcugagcacccccggcgccagagccgagaccaacagcagagugagcggcguggacggcuacgagaccgagggcaucagaggccugagagcccugggcgugagagaccugagcuacagacugguguuccuggccugcugcguggcccccaccaaccccagauucggcggcaaggagcugagagacgaggagcagaccgccgagagcaucaagaaccagaugaccgugaaggagugggagaagguguucgagaugagccaggacaagaaccuguaccacaaccugugcaccagccuguuccccaccauccacggcaacgacgaggugaagagaggcgugcugcugaugcuguucggcggcgugcccaagaccaccggcgagggcaccagccugagaggcgacaucaacgugugcaucgugggcgaccccagcaccgccaagagccaguuccugaagcacguggaggaguucagccccagagccguguacaccagcggcaaggccagcagcgccgccggccugaccgccgccguggugagagacgaggagagccacgaguucgugaucgaggccggcgcccugaugcuggccgacaacggcgugugcugcaucgacgaguucgacaagauggacgugagagaccagguggccauccacgaggccauggagcagcagaccaucagcaucaccaaggccggcgugaaggccacccugaacgccagaaccagcauccuggccgccgccaaccccaucagcggccacuacgacagaagcaagagccugaagcagaacaucaaccugagcgcccccaucaugagcagauucgaccuguucuucauccugguggacgagugcaacgaggugaccgacuacgccaucgccagaagaaucguggaccugcacagcagaaucgaggagagcaucgacagaguguacagccuggacgacaucagaagauaccugcuguucgccagacaguucaagcccaagaucagcaaggagagcgaggacuucaucguggagcaguacaagcaccugagacagagagacggcagcggcgugaccaagagcagcuggagaaucaccgugagacagcuggagagcaugaucagacugagcgaggccauggccagaaugcacugcugcgacgaggugcagcccaagcacgugaaggaggccuucagacugcugaacaagagcaucaucagaguggagacccccgacgugaaccuggaccaggaggaggagauccagauggagguggacgagggcgccggcggcaucaacggccacgccgacagccccgcccccgugaacggcaucaacggcuacaacgaggacaucaaccaggagagcgcccccaaggccagccugagacugggcuucagcgaguacugcagaaucagcaaccugaucgugcugcaccugagaaagguggaggaggaggaggacgagagcgcccugaagagaagcgagcuggugaacugguaccugaaggagaucgagagcgagaucgacagcgaggaggagcugaucaacaagaagagaaucaucgagaaggugauccacagacugacccacuacgaccacgugcugaucgagcugacccaggccggccugaagggcagcaccgagggcagcgagagcuacgaggaggaccccuaccugguggugaaccccaacuaccugcuggaggacuaa

SEQ ID NO: 19729 - RNA, 2160 nt, Artificial Sequence
  MCM7__Homo_sapiens__NP_005907
auggcccugaaggacuacgcccuggagaaggagaaggugaagaaguuccugcaggaguucuaccaggacgacgagcugggcaagaagcaguucaaguacggcaaccagcuggugagacuggcccacagagagcagguggcccuguacguggaccuggacgacguggccgaggacgaccccgagcugguggacagcaucugcgagaacgccagaagauacgccaagcuguucgccgacgccgugcaggagcugcugccccaguacaaggagagagagguggugaacaaggacgugcuggacguguacaucgagcacagacugaugauggagcagagaagcagagaccccggcauggugagaagcccccagaaccaguaccccgccgagcugaugagaagauucgagcuguacuuccagggccccagcagcaacaagcccagagugaucagagaggugagagccgacagcgugggcaagcuggugaccgugagaggcaucgugaccagagugagcgaggugaagcccaagauggugguggccaccuacaccugcgaccagugcggcgccgagaccuaccagcccauccagagccccaccuucaugccccugaucaugugccccagccaggagugccagaccaacagaagcggcggcagacuguaccugcagaccagaggcagcagauucaucaaguuccaggagaugaagaugcaggagcacagcgaccaggugcccgugggcaacauccccagaagcaucaccgugcugguggagggcgagaacaccagaaucgcccagcccggcgaccacgugagcgugaccggcaucuuccugcccauccugagaaccggcuucagacagguggugcagggccugcugagcgagaccuaccuggaggcccacagaaucgugaagaugaacaagagcgaggacgacgagagcggcgccggcgagcugaccagagaggagcugagacagaucgccgaggaggacuucuacgagaagcuggccgccagcaucgcccccgagaucuacggccacgaggacgugaagaaggcccugcugcugcugcuggugggcggcguggaccagagccccagaggcaugaagaucagaggcaacaucaacaucugccugaugggcgaccccggcguggccaagagccagcugcugagcuacaucgacagacuggcccccagaagccaguacaccaccggcagaggcagcagcggcgugggccugaccgccgccgugcugagagacagcgugagcggcgagcugacccuggagggcggcgcccuggugcuggccgaccagggcgugugcugcaucgacgaguucgacaagauggccgaggccgacagaaccgccauccacgaggugauggagcagcagaccaucagcaucgccaaggccggcauccugaccacccugaacgccagaugcagcauccuggccgccgccaaccccgccuacggcagauacaaccccagaagaagccuggagcagaacauccagcugcccgccgcccugcugagcagauucgaccugcuguggcugauccaggacagacccgacagagacaacgaccugagacuggcccagcacaucaccuacgugcaccagcacagcagacagccccccagccaguucgagccccuggacaugaagcugaugagaagauacaucgccaugugcagagagaagcagcccauggugcccgagagccuggccgacuacaucaccgccgccuacguggagaugagaagagaggccugggccagcaaggacgccaccuacaccagcgccagaacccugcuggccauccugagacugagcaccgcccuggccagacugagaaugguggacgugguggagaaggaggacgugaacgaggccaucagacugauggagaugagcaaggacagccugcugggcgacaagggccagaccgccagaacccagagacccgccgacgugaucuucgccaccgugagagagcuggugagcggcggcagaagcgugagauucagcgaggccgagcagagaugcgugagcagaggcuucacccccgcccaguuccaggccgcccuggacgaguacgaggagcugaacguguggcaggugaacgccagcagaaccagaaucaccuucguguaa

SEQ ID NO: 19730 - RNA, 2523 nt, Artificial Sequence
  MCM8__Homo_sapiens__NP_001268449
augaacggcgaguacagaggcagaggcuucggcagaggcagauuccagagcuggaagagaggcagaggcggcggcaacuucagcggcaaguggagagagagagagcacagacccgaccugagcaagaccaccggcaagagaaccagcgagcagaccccccaguuccugcugagcaccaagaccccccagagcaugcagagcacccuggacagauucauccccuacaagggcuggaagcuguacuucagcgagguguacagcgacagcagcccccugaucgagaagauccaggccuucgagaaguucuucaccagacacaucgaccuguacgacaaggacgagaucgagagaaagggcagcauccugguggacuucaaggagcugaccgagggcggcgaggugaccaaccugauccccgacaucgccaccgagcugagagacgcccccgagaagacccuggccugcaugggccuggccauccaccaggugcugaccaaggaccuggagagacacgccgccgagcugcaggcccaggagggccugagcaacgacggcgagaccauggugaacgugccccacauccacgccagaguguacaacuacgagccccugacccagcugaagaacgugagagccaacuacuacggcaaguacaucgcccugagaggcaccguggugagagugagcaacaucaagccccugugcaccaagauggccuuccugugcgccgccugcggcgagauccagagcuucccccugcccgacggcaaguacagccugcccaccaagugccccgugcccgugugcagaggcagaagcuucaccgcccugagaagcagcccccugaccgugaccauggacuggcagagcaucaagauccaggagcugaugagcgacgaccagagagaggccggcagaauccccagaaccaucgagugcgagcuggugcacgaccugguggacagcugcgugcccggcgacaccgugaccaucaccggcaucgugaaggugagcaacgccgaggagggcagcagaaacaagaacgacaagugcauguuccugcuguacaucgaggccaacagcaucagcaacagcaagggccagaagaccaagagcagcgaggacggcugcaagcacggcaugcugauggaguucagccugaaggaccuguacgccauccaggagauccaggccgaggagaaccuguucaagcugaucgugaacagccugugccccgugaucuucggccacgagcuggugaaggccggccuggcccuggcccuguucggcggcagccagaaguacgccgacgacaagaacagaauccccaucagaggcgacccccacauccugguggugggcgaccccggccugggcaagagccagaugcugcaggccgccugcaacguggcccccagaggcguguacgugugcggcaacaccaccaccaccagcggccugaccgugacccugagcaaggacagcagcagcggcgacuucgcccuggaggccggcgcccuggugcugggcgaccagggcaucugcggcaucgacgaguucgacaagaugggcaaccagcaccaggcccugcuggaggccauggagcagcagagcaucagccuggccaaggccggcguggugugcagccugcccgccagaaccagcaucaucgccgccgccaaccccgugggcggccacuacaacaaggccaagaccgugagcgagaaccugaagaugggcagcgcccugcugagcagauucgaccugguguucauccugcuggacacccccaacgagcaccacgaccaccugcugagcgagcacgugaucgccaucagagccggcaagcagagaaccaucagcagcgccaccguggccagaaugaacagccaggacagcaacaccagcgugcuggagguggugagcgagaagccccugagcgagagacugaagguggugcccggcgagaccaucgaccccaucccccaccagcugcugagaaaguacaucggcuacgccagacaguacguguaccccagacugagcaccgaggccgccagagugcugcaggacuucuaccuggagcugagaaagcagagccagagacugaacagcagccccaucaccaccagacagcuggagagccugaucagacugaccgaggccagagccagacuggagcugagagaggaggccaccaaggaggacgccgaggacaucguggagaucaugaaguacagcaugcugggcaccuacagcgacgaguucggcaaccuggacuucgagagaagccagcacggcagcggcaugagcaacagaagcaccgccaagagauucaucagcgcccugaacaacguggccgagagaaccuacaacaacaucuuccaguuccaccagcugagacagaucgccaaggagcugaacauccagguggccgacuucgagaacuucaucggcagccugaacgaccagggcuaccugcugaagaagggccccaagguguaccagcugcagaccauguaa

SEQ ID NO: 19731 - RNA, 3432 nt, Artificial Sequence
  MCM9__Homo_sapiens__NP_060166
augaacagcgaccaggugacccuggugggccagguguucgagagcuacgugagcgaguaccacaagaacgacauccugcugauccugaaggagagagacgaggacgcccacuaccccgugguggugaacgccaugacccuguucgagaccaacauggagaucggcgaguacuucaacauguuccccagcgaggugcugaccaucuucgacagcgcccugagaagaagcgcccugaccauccugcagagccugagccagcccgaggccgugagcaugaagcagaaccugcacgccagaaucagcggccugcccgugugccccgagcuggugagagagcacauccccaagaccaaggacgugggccacuuccugagcgugaccggcaccgugaucagaaccagccuggugaaggugcuggaguucgagagagacuacaugugcaacaagugcaagcacguguucgugaucaaggccgacuucgagcaguacuacaccuucugcagacccagcagcugccccagccuggagagcugcgacagcagcaaguucaccugccugagcggccugagcagcagccccaccagaugcagagacuaccaggagaucaagauccaggagcaggugcagagacugagcgugggcagcauccccagaagcaugaaggugauccuggaggacgaccugguggacagcugcaagagcggcgacgaccugaccaucuacggcaucgugaugcagagauggaagcccuuccagcaggacgugagaugcgagguggagaucgugcugaaggccaacuacauccaggugaacaacgagcagagcagcggcaucaucauggacgaggaggugcagaaggaguucgaggacuucugggaguacuacaagagcgaccccuucgccggcagaaacgugauccuggccagccugugcccccagguguucggcauguaccuggugaagcuggccguggccauggugcuggccggcggcauccagagaaccgacgccaccggcaccagagugagaggcgagagccaccugcugcuggugggcgaccccggcaccggcaagagccaguuccugaaguacgccgccaagaucacccccagaagcgugcugaccaccggcaucggcagcaccagcgccggccugaccgugaccgccgugaaggacagcggcgaguggaaccuggaggccggcgcccuggugcuggccgacgccggccugugcugcaucgacgaguucaacagccugaaggagcacgacagaaccagcauccacgaggccauggagcagcagaccaucagcguggccaaggccggccuggugugcaagcugaacaccagaaccaccauccuggccgccaccaaccccaagggccaguacgacccccaggagagcgugagcgugaacaucgcccugggcagcccccugcugagcagauucgaccugauccuggugcugcuggacaccaagaacgaggacugggacagaaucaucagcagcuucauccuggagaacaagggcuaccccagcaagagcgagaagcuguggagcauggagaagaugaagaccuacuucugccugaucagaaaccugcagcccacccugagcgacgugggcaaccaggugcugcugagauacuaccagaugcagagacagagcgacugcagaaacgccgccagaaccaccaucagacugcuggagagccugaucagacuggccgaggcccacgccagacugauguucagagacaccgugacccuggaggacgccaucaccguggugagcgugauggagagcagcaugcagggcggcgcccugcugggcggcgugaacgcccugcacaccagcuuccccgagaaccccggcgagcaguaccagagacagugcgagcugauccuggagaagcuggagcugcagagccugcugagcgaggagcugagaagacuggagagacugcagaaccagagcgugcaccagagccagcccagagugcuggagguggagaccacccccggcagccugagaaacggccccggcgaggagagcaacuucagaaccagcagccagcaggagaucaacuacagcacccacaucuucagccccggcggcagccccgagggcagccccgugcuggacccccccccccaccuggagcccaacagaagcaccagcagaaagcacagcgcccagcacaagaacaacagagacgacagccuggacugguucgacuucauggccacccaccagagcgagcccaagaacaccgugguggugagcccccaccccaagaccagcggcgagaacauggccagcaagaucagcaacagcaccagccagggcaaggagaagagcgagcccggccagagaagcaagguggacaucggccugcugcccagccccggcgagaccggcgugcccuggagagccgacaacguggagagcaacaagaagaagagacuggcccuggacagcgaggccgccgugagcgccgacaagcccgacagcgugcugacccaccacgugcccagaaaccugcagaagcugugcaaggagagagcccagaagcugugcagaaacagcaccagagugcccgcccagugcaccgugcccagccacccccagagcacccccgugcacagccccgacagaaugcuggacagccccaagagaaagagacccaagagccuggcccagguggaggagcccgccaucgagaacgugaagccccccggcagccccguggccaagcuggccaaguucaccuucaagcagaagagcaagcugauccacagcuucgaggaccacagccacgugagccccggcgccaccaagaucgccgugcacagccccaagaucagccagagaagaaccagaagagacgccgcccugcccgugaagagacccggcaagcugaccagcacccccggcaaccagaucagcagccagccccagggcgagaccaaggaggugagccagcagccccccgagaagcacggccccagagagaaggugaugugcgcccccgagaagagaaucauccagcccgagcuggagcugggcaacgagaccggcugcgcccaccugaccugcgagggcgacaagaaggaggaggugagcggcagcaacaagagcggcaaggugcacgccugcacccuggccagacuggccaacuucugcuucaccccccccagcgagagcaagagcaagagccccccccccgagagaaagaacagaggcgagagaggccccagcagcccccccaccaccaccgcccccaugagagugagcaagagaaagagcuuccagcugagaggcagcaccgagaagcugaucgugagcaaggagagccuguucacccugcccgagcugggcgacgaggccuucgacugcgacugggacgaggagaugagaaagaagagcuaa

SEQ ID NO: 19732 - RNA, 1923 nt, Artificial Sequence
  MCMBP__Homo_sapiens__NP_001243307
augcccugcggcgaggacuggcugagccacccccugggcaucgugcagggcuucuucgcccagaacggcgugaaccccgacugggagaagaaggugaucgaguacuucaaggagaagcugaaggagaacaacgcccccaagugggugcccagccugaacgaggugccccugcacuaccugaagcccaacagcuucgugaaguucagaugcaugauccaggacauguucgaccccgaguucuacaugggcguguacgagaccgugaaccagaacaccaaggcccacgugcugcacuucggcaaguacagagacguggccgagugcggcccccagcaggagcuggaccugaacagccccagaaacaccacccuggagagacagaccuucuacugcgugcccgugcccggcgagagcaccugggugaaggaggccuacgugaacgccaaccaggccagagugagccccagcaccagcuacacccccagcagacacaagagaagcuacgaggacgacgacgacauggaccugcagcccaacaagcagaaggaccagcacgccggcgccagacaggccggcagcgugggcggccugcaguggugcggcgagcccaagagacuggagaccgaggccagcaccggccagcagcugaacagccugaaccugagcagccccuucgaccugaacuucccccugcccggcgagaagggccccgccugccuggugaagguguacgaggacugggacugcuucaaggugaacgacauccuggagcuguacggcauccugagcguggaccccgugcugagcauccugaacaacgacgagagagacgccagcgcccugcuggaccccauggagugcaccgacaccgccgaggagcagagagugcacagcccccccgccagccuggugcccagaauccacgugauccuggcccagaagcugcagcacaucaacccccugcugcccgccugccugaacaaggaggagagcaagaccuucgugagcagcuucaugagcgagcugagccccgugagagccgagcugcugggcuuccugacccacgcccugcugggcgacagccuggccgccgaguaccugauccugcaccugaucagcaccguguacaccagaagagacgugcugccccugggcaaguucaccgugaaccugagcggcugccccagaaacagcaccuucaccgagcaccuguacagaaucauccagcaccuggugcccgccagcuucagacugcagaugaccaucgagaacaugaaccaccugaaguucaucccccacaaggacuacaccgccaacagacuggugagcggccugcugcagcugcccagcaacaccagccuggugaucgacgagacccugcuggagcagggccagcuggacacccccggcgugcacaacgugaccgcccugagcaaccugaucaccuggcagaagguggacuacgacuucagcuaccaccagauggaguuccccugcaacaucaacguguucaucaccagcgagggcagaagccugcugcccgccgacugccagauccaccugcagccccagcugaucccccccaacauggaggaguacaugaacagccugcugagcgccgugcugcccagcgugcugaacaaguucagaaucuaccugacccugcugagauuccuggaguacagcaucagcgacgagaucaccaaggccguggaggacgacuucguggagaugagaaagaacgacccccagagcaucaccgccgacgaccugcaccagcugcuggugguggccagaugccugagccugagcgccggccagaccacccugagcagagagagauggcugagagccaagcagcuggagagccugagaagaaccagacugcagcagcagaagugcgugaacggcaacgagcuguaa

SEQ ID NO: 19733 - RNA, 1743 nt, Artificial Sequence
  MCOLN1__Homo_sapiens__NP_065394
augaccgcccccgccggccccagaggcagcgagaccgagagacugcugacccccaaccccggcuacggcacccaggccggccccagccccgccccccccaccccccccgaggaggaggaccugagaagaagacugaaguacuucuucaugagccccugcgacaaguucagagccaagggcagaaagcccugcaagcugaugcugcagguggugaagauccugguggugaccgugcagcugauccuguucggccugagcaaccagcuggccgugaccuucagagaggagaacaccaucgccuucagacaccuguuccugcugggcuacagcgacggcgccgacgacaccuucgccgccuacaccagagagcagcuguaccaggccaucuuccacgccguggaccaguaccuggcccugcccgacgugagccugggcagauacgccuacgugagaggcggcggcgaccccuggaccaacggcagcggccuggcccugugccagagauacuaccacagaggccacguggaccccgccaacgacaccuucgacaucgaccccaugguggugaccgacugcauccagguggacccccccgagagacccccccccccccccagcgacgaccugacccugcuggagagcagcagcagcuacaagaaccugacccugaaguuccacaagcuggugaacgugaccauccacuucagacugaagaccaucaaccugcagagccugaucaacaacgagauccccgacugcuacaccuucagcgugcugaucaccuucgacaacaaggcccacagcggcagaauccccaucagccuggagacccaggcccacauccaggagugcaagcaccccagcguguuccagcacggcgacaacagcuucagacugcuguucgacgugguggugauccugaccugcagccugagcuuccugcugugcgccagaagccugcugagaggcuuccugcugcagaacgaguucgugggcuucauguggagacagagaggcagagugaucagccugugggagagacuggaguucgugaacggcugguacauccugcuggugaccagcgacgugcugaccaucagcggcaccaucaugaagaucggcaucgaggccaagaaccuggccagcuacgacgugugcagcauccugcugggcaccagcacccugcuggugugggugggcgugaucagauaccugaccuucuuccacaacuacaacauccugaucgccacccugagaguggcccugcccagcgugaugagauucugcugcugcguggccgugaucuaccugggcuacugcuucugcggcuggaucgugcugggccccuaccacgugaaguucagaagccugagcauggugagcgagugccuguucagccugaucaacggcgacgacauguucgugaccuucgccgccaugcaggcccagcagggcagaagcagccugguguggcuguucagccagcuguaccuguacagcuucaucagccuguucaucuacauggugcugagccuguucaucgcccugaucaccggcgccuacgacaccaucaagcaccccggcggcgccggcgccgaggagagcgagcugcaggccuacaucgcccagugccaggacagccccaccagcggcaaguucagaagaggcagcggcagcgccugcagccugcugugcugcugcggcagagaccccagcgaggagcacagccugcuggugaacuaa

SEQ ID NO: 19734 - RNA, 1734 nt, Artificial Sequence
  MCOLN3__Homo_sapiens__XP_011540041
auggagggcagaagagccggcgccggcagagagaugcagcuguucagagccgcccccaagccccccgccgagauggccgaccccgaggugguggugagcagcugcagcagccacgaggaggagaacagaugcaacuucaaccagcagaccagccccagcgaggagcugcugcuggaggaccagaugagaagaaagcugaaguucuucuucaugaaccccugcgagaaguucugggccagaggcagaaagcccuggaagcuggccauccagauccugaagaucgccauggugaccauccagcuggugcuguucggccugagcaaccagauggugguggccuucaaggaggagaacaccaucgccuucaagcaccuguuccugaagggcuacauggacagaauggacgacaccuacgccguguacacccagagcgacguguacgaccagcugaucuucgccgugaaccaguaccugcagcuguacaacgugagcgugggcaaccacgccuacgagaacaagggcaccaagcagagcgccauggccaucugccagcacuucuacaagagaggcaacaucuaccccggcaacgacaccuucgacaucgaccccgagaucgagaccgagugcuucuucguggagcccgacgagcccuuccacaucggcacccccgccgagaacaagcugaaccugacccuggacuuccacagacugcugaccguggagcugcaguucaagcugaaggccaucaaccugcagaccgugagacaccaggagcugcccgacugcuacgacuucacccugaccaucaccuucgacaacaaggcccacagcggcagaaucaagaucagccuggacaacgacaucagcaucagagagugcaaggacuggcacgugagcggcagcauccagaagaacacccacuacaugaugaucuucgacgccuucgugauccugaccugccuggugagccugauccugugcaucagaagcgugaucagaggccugcagcugcagcaggaguucgugaacuucuuccugcugcacuacaagaaggaggugagcgugagcgaccagauggaguucgugaacggcugguacaucaugaucaucaucagcgacauccugaccaucaucggcagcauccugaagauggagauccaggccaagagccugaccagcuacgacgugugcagcauccugcugggcaccagcaccaugcugguguggcugggcgugaucagauaccugggcuucuucgccaaguacaaccugcugauccugacccugcaggccgcccugcccaacgugaucagauucugcugcugcgccgccaugaucuaccugggcuacugcuucugcggcuggaucgugcugggccccuaccacgacaaguucagaagccugaacauggugagcgagugccuguucagccugaucaacggcgacgacauguucgccaccuucgccaagaugcagcagaagagcuaccugguguggcuguucagcagaaucuaccuguacagcuucaucagccuguucaucuacaugauccugagccuguucaucgcccugaucaccgacaccuacgagaccaucaagcaguaccagcaggacggcuuccccgagaccgagcugagaaccuucaucagcgagugcaaggaccugcccaacagcggcaaguacagacuggaggacgacccccccgugagccuguucugcugcugcaagaaguaa

SEQ ID NO: 19735 - RNA, 1833 nt, Artificial Sequence
  MCPH1__Homo_sapiens__NP_001166045
auggccgcccccauccugaaggacgugguggccuacguggagguguggagcagcaacggcaccgagaacuacagcaagaccuucaccacccagcugguggacaugggcgccaaggugagcaagaccuucaacaagcaggugacccacgugaucuucaaggacggcuaccagagcaccugggacaaggcccagaagagaggcgugaagcuggugagcgugcuguggguggagaagugcagaaccgccggcgcccacaucgacgagagccuguuccccgccgccaacaugaacgagcaccugagcagccugaucaagaagaagagaaagugcaugcagcccaaggacuucaacuucaagacccccgagaacgacaagagauuccagaagaaguucgagaagauggccaaggagcugcagagacagaagaccaaccuggacgacgacgugcccauccugcuguucgagagcaacggcagccugaucuacacccccaccaucgagaucaacagcagccaccacagcgccauggagaagagacugcaggagaugaaggagaagagagagaaccugagccccaccagcagccagaugauccagcagagccacgacaaccccagcaacagccugugcgaggccccccugaacaucagcagagacacccugugcagcgacgaguacuucgccggcggccugcacagcagcuucgacgaccugugcggcaacagcggcugcggcaaccaggagagaaagcuggagggcagcaucaacgacaucaagagcgacgugugcaucagcagccuggugcugaaggccaacaacauccacagcagccccagcuucacccaccuggacaagagcagcccccagaaguuccugagcaaccugagcaaggaggagaucaaccugcagagaaacaucgccggcaagguggugacccccgaccagaagcaggccgccggcaugagccaggagaccuucgaggagaaguacagacugagccccacccugagcagcaccaagggccaccugcugauccacagcagacccagaagcagcagcgugaagagaaagagagugagccacggcagccacagcccccccaaggagaagugcaagagaaagagaagcaccagaagaagcaucaugcccagacugcagcugugcagaagcgaggacagacugcagcacguggccggccccgcccuggaggcccugagcugcggcgagagcagcuacgacgacuacuucagccccgacaaccugaaggagagauacagcgagaaccugccccccgagagccagcugcccagcagccccgcccagcugagcugcagaagccugagcaagaaggagagaaccagcaucuucgagaugagcgacuucagcugcgugggcaagaagaccagaaccguggacaucaccaacuucaccgccaagaccaucagcagccccagaaagaccggcaacggcgagggcagagccaccagcagcugcgugaccagcgcccccgaggaggcccugagaugcugcagacaggccggcaaggaggacgccugccccgagggcaacggcuucagcuacaccaucgaggaccccgcccugcccaagggccacgacgacgaccugaccccccuggagggcagccuggaggagaugaaggaggccgugggccugaagagcacccagaacaagggcaccaccagcaagaucagcaacagcagcgagggcgaggcccagagcgagcacgagcccugcuucaucguggacugcaacauggagaccagcaccgaggagaaggagaaccugcccggcggcuacagcggcagcauguaa

SEQ ID NO: 19736 - RNA, 1428 nt, Artificial Sequence
  MCRS1__Homo_sapiens__NP_001012300
augaccagaggcaccggcggcaccgcccagagaggcagaagcggccccgacagccagggccugcuggacagcagccugauggccagcggcaccgccagcagaagcgaggacgaggagagccuggccggccagaagagagccagcagccaggcccugggcaccauccccaagagaagaagcagcagcagauucaucaagagaaagaaguucgacgacgagcugguggagagcagccuggccaagagcagcaccagagccaagggcgccagcggcguggagcccggcagaugcagcggcagcgagcccagcagcagcgagaagaagaaggugagcaaggcccccagcacccccgugccccccagccccgcccccgcccccggccugaccaagagagugaagaagagcaagcagccccugcaggugaccaaggaccugggcagauggaagcccgccgacgaccugcugcugaucaacgccgugcugcagaccaacgaccugaccagcgugcaccugggcgugaaguucagcugcagauucacccugagagaggugcaggagagaugguacgcccugcuguacgaccccgugaucagcaagcuggccugccaggccaugagacagcugcaccccgaggccaucgccgccauccagagcaaggcccuguucagcaaggccgaggagcagcugcugagcaaggugggcagcaccagccagcccacccuggagaccuuccaggaccugcugcacagacaccccgacgccuucuaccuggccagaaccgccaaggcccugcaggcccacuggcagcugaugaagcaguacuaccugcuggaggaccagaccgugcagccccugcccaagggcgaccaggugcugaacuucagcgacgccgaggaccugaucgacgacagcaagcugaaggacaugagagacgaggugcuggagcacgagcugaugguggccgacagaagacagaagagagagaucagacagcuggagcaggagcugcacaaguggcaggugcugguggacagcaucaccggcaugagcagccccgacuucgacaaccagacccuggccgugcugagaggcagaauggugagauaccugaugagaagcagagagaucacccugggcagagccaccaaggacaaccagaucgacguggaccugagccuggagggccccgccuggaagaucagcagaaagcagggcgugaucaagcugaagaacaacggcgacuucuucaucgccaacgagggcagaagacccaucuacaucgacggcagacccgugcugugcggcagcaaguggagacugagcaacaacagcgugguggagaucgccagccugagauucguguuccugaucaaccaggaccugaucgcccugaucagagccgaggccgccaagaucaccccccaguaa

SEQ ID NO: 19737 - RNA, 2337 nt, Artificial Sequence
  MCTP1__Homo_sapiens__NP_001002796
augcuggacagcugcaagcugaagagcgccugcaaccugcccuucaucugcaacaagaagaucaucaacaccgccggcaccagcaacgccgaggugccccuggccgaccccggcauguaccagcuggacaucacccugagaagaggccagagccuggccgccagagacagaggcggcaccagcgaccccuacgugaaguucaagaucggcggcaaggagguguucagaagcaagaucauccacaagaaccugaaccccgugugggaggagaaggccugcauccugguggaccaccugagagagccccuguacaucaagguguucgacuacgacuucggccugcaggacgacuucaugggcagcgccuuccuggaccugacccagcuggagcugaacagacccaccgacgugacccugacccugaaggacccccacuaccccgaccacgaccugggcaucauccugcugagcgugauccugacccccaaggagggcgagagcagagacgugaccaugcugaugagaaagagcuggaagagaagcagcaaggagcugagcgagaacgagguggugggcagcuacuucagcgugaagagccuguucuggagaaccugcggcagacccgcccugcccgugcugggcuucugcagagccgagcugcagaaccccuacugcaagaacgugcaguuccagacccagagccugagacugagcgaccugcacagaaagagccaccuguggagaggcaucgugagcaucacccugaucgagggcagagaccugaaggccauggacagcaacggccugagcgaccccuacgugaaguucagacugggccaccagaaguacaagagcaagaucaugcccaagacccugaacccccaguggagagagcaguucgacuuccaccuguacgaggagagaggcggcgugaucgacaucaccgccugggacaaggacgccggcaagagagacgacuucaucggcagaugccagguggaccugagcgcccugagcagagagcagacccacaagcuggagcugcagcuggaggagggcgagggccaccuggugcugcuggugacccugaccgccagcgccaccgugagcaucagcgaccugagcgugaacagccuggaggaccagaaggagagagaggagauccugaagagauacagcccccugagaaucuuccacaaccugaaggacgugggcuuccugcaggugaaggugaucagagccgagggccugauggccgccgacgugaccggcaagagcgaccccuucugcgugguggagcugaacaacgacagacugcugacccacaccguguacaagaaccugaaccccgaguggaacaagguguucaccuucaacaucaaggacauccacagcgugcuggaggugaccguguacgacgaggacagagacagaagcgccgacuuccugggcaagguggccaucccccugcugagcauccagaacggcgagcagaaggccuacgugcugaagaacaagcagcugaccggccccaccaagggcgugaucuaccuggagaucgacgugaucuucaacgccgugaaggccagccugagaacccugauccccaaggagcagaaguacaucgaggaggagaacagacugagcaagcagcugcugcugagaaacuucaucagaaugaagagaugcgugauggugcuggugaacgccgccuacuacgugaacagcugcuucgacugggacagcccccccagaagccuggccgccuucgugcuguuccuguucgugguguggaacuucgagcuguacaugaucccccuggugcugcugcugcugcugaccuggaacuacuuccugaucaucagcggcaaggacaacagacagagagacaccgugguggaggacaugcuggaggacgaggaggaggaggacgacaaggacgacaaggacagcgagaagaagggcuucaucaacaagaucuacgccauccaggaggugugcgugagcgugcagaacauccuggacgagguggccagcuucggcgagagaaucaagaacaccuucaacuggaccgugcccuuccugagcuggcuggccaucguggcccugugcguguucaccgccauccuguacugcaucccccugagauacaucgugcugguguggggcaucaacaaguucaccaagaagcugagaagccccuacgccaucgacaacaacgagcugcuggacuuccugagcagagugcccagcgacgugcagguggugcaguaccaggagcugaagcccgaccccagccacagccccuacaagagaaagaagaacaaccugggcuaa

SEQ ID NO: 19738 - RNA, 2472 nt, Artificial Sequence
  MCTP2__Homo_sapiens__NP_001153115
auggaccuggacaagcccagcguguggggcagccugaagcagagaaccagaccccugcugaucaaccugagcaagaagaaggugaagaagaaccccagcaagccccccgaccugagagccagacaccaccuggacagaagacugagccugagcgugcccgaccugcuggaggccgaggcccuggcccccgagggcagacccuacagcggcccccagagcagcuacaccagcgugcccagcagccugagcaccgccggcaucuuccccaagagcagcagcagcagccugaagcagagcgaggaggagcuggacuggagccaggaggaggccagccaccugcacgugguggagaccgacagcgaggaggccuacgccagccccgccgagagaagaagagugagcagcaacggcaucuucgaccugcagaagaccagccugggcggcgacgcccccgaggagcccgagaagcugugcggcagcagcgaccugaacgccagcaugaccagccagcacuucgaggagcagagcgugcccggcgaggccagcgacggccugagcaaccugcccagccccuucgccuaccugcugaccauccaccugaaggagggcagaaaccugguggugagagacagaugcggcaccagcgaccccuacgugaaguucaagcugaacggcaagacccuguacaagagcaaggugaucuacaagaaccugaaccccgugugggacgagaucguggugcugcccauccagagccuggaccagaagcugagagugaagguguacgacagagaccugaccaccagcgacuucaugggcagcgccuucgugauccugagcgaccuggagcugaacagaaccaccgagcacauccugaagcuggaggaccccaacagccuggaggacgacaugggcgugaucgugcugaaccugaaccugguggugaagcagggcgacuucaagagacacagauggagcaacagaaagagacugagcgccagcaagagcagccugaucagaaaccugagacugagcgagagccugaagaagaaccagcuguggaacggcaucaucagcaucacccugcuggagggcaagaacgugagcggcggcagcaugaccgagauguucgugcagcugaagcugggcgaccagagauacaagagcaagacccugugcaagagcgccaacccccaguggcaggagcaguucgacuuccacuacuucagcgacagaaugggcauccuggacaucgagguguggggcaaggacaacaagaagcacgaggagagacugggcaccugcaagguggacaucagcgcccugccccugaagcaggccaacugccuggagcugccccuggacagcugccugggcgcccugcugaugcuggugacccugacccccugcgccggcgugagcgugagcgaccugugcgugugcccccuggccgaccugagcgagagaaagcagaucacccagagauacugccugcagaacagccugaaggacgugaaggacgugggcauccugcaggugaaggugcugaaggccgccgaccugcuggccgccgacuucagcggcaagagcgaccccuucugccugcuggagcugggcaacgacagacugcagacccacaccguguacaagaaccugaaccccgaguggaacaagguguucaccuuccccaucaaggacauccacgacgugcuggaggugaccguguucgacgaggacggcgacaagccccccgacuuccugggcaagguggccaucccccugcugagcaucagagacggccagcccaacugcuacgugcugaagaacaaggaccuggagcaggccuucaagggcgugaucuaccuggagauggaccugaucuacaaccccgugaaggccagcaucagaaccuucacccccagagagaagagauucguggaggacagcagaaagcugagcaagaagauccugagcagagacguggacagagugaagagaaucaccauggccaucuggaacaccaugcaguuccugaagagcugcuuccagugggagagcacccugagaagcaccaucgccuucgccgagagcgagaagaagggccugaucgagagaaucuacauggugcaggacaucgugagcaccgugcagaacgugcuggaggagaucgccagcuucggcgagagaaucaagaacaccuucaacuggaccgugcccuuccugagcagccuggccugccugauccuggccgccgccaccaucauccuguacuucaucccccugagauacaucauccugaucuggggcaucaacaaguucaccaagaagcugagaaaccccuacagcaucgacaacaacgagcugcuggacuuccugagcagagugcccagcgacgugcagaaggugcaguacgccgagcugaagcugugcagcagccacagcccccugagaaagaagagaagcgcccuguaa

SEQ ID NO: 19739 - RNA, 549 nt, Artificial Sequence
  MCTS1__Homo_sapiens__NP_001131026
augggcaagggcagauucgacgagaaggagaacgugagcaacugcauccagcugaagaccagcgugaucaagggcaucaagaaccagcugaucgagcaguuccccggcaucgagcccuggcugaaccagaucaugcccaagaaggaccccgugaagaucgugagaugccacgagcacaucgagauccugaccgugaacggcgagcugcuguucuucagacagagagagggccccuucuaccccacccugagacugcugcacaaguaccccuucauccugccccaccagcagguggacaagggcgccaucaaguucgugcugagcggcgccaacaucaugugccccggccugaccagccccggcgccaagcuguaccccgccgccguggacaccaucguggccaucauggccgagggcaagcagcacgcccugugcgugggcgugaugaagaugagcgccgaggacaucgagaaggugaacaagggcaucggcaucgagaacauccacuaccugaacgacggccuguggcacaugaagaccuacaaguaa

SEQ ID NO: 19740 - RNA, 993 nt, Artificial Sequence
  MCU__Homo_sapiens__NP_001257608
auggccgccgccgccggcagaagccugcugcugcugcugagcagcagaggcggcggcggcggcggcgccggcggcugcggcgcccugaccgccggcugcuuccccggccugggcgugagcagacacagacagcagcagcaccacagaaccgugcaccagagaaucgccagcuggcagaaccugggcgccguguacugcagcaccguggugcccagcgacgacgugaccgugguguaccagaacggccugcccgugaucagcgugagacugcccagcagaagagagagaugccaguucacccugaagcccaucagcgacagcgugggcguguuccugagacagcugcaggaggaggacagaggcaucgacagaguggccaucuacagccccgacggcgugagaguggccgccagcaccggcaucgaccugcugcugcuggacgacuucaagcuggugaucaacgaccugaccuaccacgugagaccccccaagagaguggagaugggcuucugccacgugggccagaacggcuucgagcugcugaccagcagcuaccugcccgccagcgccagccagagcgccgagaucaucgccgugagaaucgagaucagcagaaaggccgagaagagaaccacccuggugcuguggggcggccuggccuacauggccacccaguucggcauccuggccagacugaccuggugggaguacagcugggacaucauggagcccgugaccuacuucaucaccuacggcagcgccauggccauguacgccuacuucgugaugaccagacaggaguacguguaccccgaggccagagacagacaguaccugcuguucuuccacaagggcgccaagaagagcagauucgaccuggagaaguacaaccagcugaaggacgccaucgcccaggccgagauggaccugaagagacugagagacccccugcaggugcaccugccccugagacagaucggcgagaaggacuaa

SEQ ID NO: 19741 - RNA, 1080 nt, Artificial Sequence
  MCUR1__Homo_sapiens__NP_001026883
auggacugcggcagcgugggcggccagagaacccagagacugcccggcagacagagacugcuguuccugcccgugggccugagcggcagacccggcggcagcgagaccagcgccagaagaugccugagcgcccugagcgacggccugggcgcccugagacccagagcccccgccgccagaggcggcgugagcagagccagcccccugcugcugcugcugcuggugcccagccccagacuggccgccgccgcccccagaagacagcugggcgacugggagagaagcagacugggcuacgccgccccccccgccggcagaagcagcgccuggagaugcagccccggcguggccgccgccgccggcgcccugccccaguaccacggccccgcccccgcccuggugagcugcagaagagagcugagccugagcgccggcagccugcagcuggagagaaagagaagagacuucaccagcagcggcagcagaaagcuguacuucgacacccacgcccuggugugccugcuggaggacaacggcuucgccacccagcaggccgagaucaucgugagcgcccuggugaagauccuggaggccaacauggacaucguguacaaggacauggugaccaagaugcagcaggagaucaccuuccagcaggugaugagccagaucgccaacgugaagaaggacaugaucauccuggagaagagcgaguucagcgcccugagagccgagaacgagaagaucaagcuggagcugcaccagcugaagcagcaggugauggacgaggugaucaaggugagaaccgacaccaagcuggacuucaaccuggagaagagcagagugaaggagcuguacagccugaacgagaagaagcugcuggagcugagaaccgagaucguggcccugcacgcccagcaggacagagcccugacccagaccgacagaaagaucgagaccgagguggccggccugaagaccaugcuggagagccacaagcuggacaacaucaaguaccuggccggcagcaucuucaccugccugaccguggcccugggcuucuacagacuguggaucuaa

SEQ ID NO: 19742 - RNA, 6270 nt, Artificial Sequence
  MDC1__Homo_sapiens__NP_055456
auggaggacacccaggccaucgacugggacguggaggaggaggaggagaccgagcagagcagcgagagccugagaugcaacguggagcccgugggcagacugcacaucuucagcggcgcccacggccccgagaaggacuucccccugcaccugggcaagaacguggugggcagaaugcccgacugcagcguggcccugcccuuccccagcaucagcaagcagcacgccgagaucgagauccuggccugggacaaggcccccauccugagagacugcggcagccugaacggcacccagauccugagaccccccaaggugcugagccccggcgugagccacagacugagagaccaggagcugauccuguucgccgaccugcugugccaguaccacagacuggacgugagccugcccuucgugagcagaggcccccugaccguggaggagacccccagagugcagggcgagacccagccccagagacugcugcuggccgaggacagcgaggaggagguggacuuccugagcgagagaagaauggugaagaagagcagaaccaccagcagcagcgugaucgugcccgagagcgacgaggagggccacagccccgugcugggcggccugggcccccccuucgccuucaaccugaacagcgacaccgacguggaggagggccagcagcccgccaccgaggaggccagcagcgccgccagaagaggcgccaccguggaggccaagcagagcgaggccgagguggugaccgagauccagcuggagaaggaccagccccuggugaaggagagagacaacgacaccaaggugaagagaggcgccggcaacggcguggugcccgccggcgugauccuggagagaagccagccccccggcgaggacagcgacaccgacguggacgacgacagcagaccccccggcagacccgccgaggugcaccuggagagagcccagcccuucggcuucaucgacagcgacaccgacgccgaggaggagagaauccccgccacccccguggugauccccaugaagaagagaaagaucuuccacggcgugggcaccagaggccccggcgcccccggccuggcccaccugcaggagagccaggccggcagcgacaccgacguggaggagggcaaggccccccaggccgugccccuggagaagagccaggccagcauggugaucaacagcgacaccgacgacgaggaggaggugagcgccgcccugacccuggcccaccugaaggagagccagcccgccaucuggaacagagacgccgaggaggacaugccccagagaguggugcugcugcagagaagccagaccaccaccgagagagacagcgacaccgacguggaggaggaggagcugcccguggagaacagagaggccgugcugaaggaccacaccaagaucagagcccuggugagagcccacagcgagaaggaccagccccccuucggcgacagcgacgacagcguggaggccgacaagagcagccccggcauccaccuggagagaagccaggccagcaccaccguggacaucaacacccagguggagaaggaggugccccccggcagcgccaucauccacaucaagaagcaccaggugagcguggagggcaccaaccagaccgacgugaaggccgugggcggccccgccaagcugcugguggugagccuggaggaggccuggccccugcacggcgacugcgagaccgacgccgaggagggcaccagccugaccgccagcgugguggccgacgugagaaagagccagcugcccgccgagggcgacgccggcgccgagugggccgccgccgugcugaagcaggagagagcccacgaggugggcgcccagggcggcccccccguggcccagguggagcaggaccugcccaucagcagagagaaccugaccgaccuggugguggacaccgacacccugggcgagagcacccagccccagagagagggcgcccaggugcccaccggcagagagagagagcagcacgugggcggcaccaaggacagcgaggacaacuacggcgacagcgaggaccuggaccugcaggccacccagugcuuccuggagaaccagggccuggaggccgugcagagcauggaggacgagcccacccaggccuucaugcugacccccccccaggagcugggccccagccacugcagcuuccagaccaccggcacccuggacgagcccugggaggugcuggccacccagcccuucugccugagagagagcgaggacagcgagacccagcccuucgacacccaccuggaggccuacggccccugccugagcccccccagagccauccccggcgaccagcaccccgagagccccgugcacaccgagcccaugggcauccagggcagaggcagacagaccguggacaaggugaugggcauccccaaggagaccgccgagagagugggccccgagagaggcccccuggagagagagaccgagaagcugcugcccgagagacagaccgacgugaccggcgaggaggagcugaccaagggcaagcaggacagagagcagaagcagcugcuggccagagacacccagagacaggagagcgacaagaacggcgagagcgccagccccgagagagacagagagagccugaagguggagaucgagaccagcgaggagauccaggagaagcaggugcagaagcagacccugcccagcaaggccuucgagagagagguggagagacccguggccaacagagagugcgaccccgccgagcuggaggagaaggugcccaaggugauccuggagagagacacccagagaggcgagcccgagggcggcagccaggaccagaagggccaggccagcagccccacccccgagcccggcgugggcgccggcgaccugcccggccccaccagcgcccccgugcccagcggcagccagagcggcggcagaggcagccccgugagccccagaagacaccagaagggccugcugaacugcaagaugccccccgccgagaaggccagcagaaucagagccgccgagaaggugagcagaggcgaccaggagagccccgacgccugccugccccccaccgugcccgaggcccccgcccccccccagaagccccugaacagccagagccagaagcaccuggccccccccccccugcugagcccccugcugcccagcaucaagcccaccgugagaaagaccagacaggacggcagccaggaggcccccgaggccccccugagcagcgagcuggagcccuuccaccccaagcccaagaucagaaccagaaagagcagcagaaugacccccuuccccgccaccagcgccgcccccgagccccaccccagcaccagcaccgcccagcccgugacccccaagcccaccagccaggccaccagaagcagaaccaacagaagcagcgugaagacccccgagcccguggugcccaccgcccccgagcugcagcccagcaccagcaccgaccagcccgugaccagcgagcccaccagccaggugaccagaggcagaaagagcagaagcagcgugaagacccccgagaccguggugcccaccgcccuggagcugcagcccagcaccagcaccgacagacccgugaccagcgagcccaccagccaggccaccagaggcagaaagaacagaagcagcgugaagacccccgagcccguggugcccaccgcccccgagcugcagcccagcaccagcaccgaccagcccgugaccagcgagcccaccuaccaggccaccagaggcagaaagaacagaagcagcgugaagacccccgagcccguggugcccaccgcccccgagcugagacccagcaccagcaccgacagacccgugacccccaagcccaccagcagaaccaccagaagcagaaccaacaugagcagcgugaagacccccgagaccguggugcccaccgcccccgagcugcagaucagcaccagcaccgaccagcccgugacccccaagcccaccagcagaaccaccagaagcagaaccaacaugagcagcgugaagaaccccgagagcaccgugcccaucgcccccgagcugccccccagcaccagcaccgagcagcccgugacccccgagcccaccagcagagccaccagaggcagaaagaacagaagcagcggcaagacccccgagacccuggugcccaccgcccccaagcuggagcccagcaccagcaccgaccagcccgugacccccgagcccaccagccaggccaccagaggcagaaccaacagaagcagcgugaagacccccgagaccguggugcccaccgcccccgagcugcagcccagcaccagcaccgaccagcccgugacccccgagcccaccagccaggccaccagaggcagaaccgacagaagcagcgugaagacccccgagaccguggugcccaccgcccccgagcugcaggccagcgccagcaccgaccagcccgugaccagcgagcccaccagcagaaccaccagaggcagaaagaacagaagcagcgugaagacccccgagaccguggugcccgccgcccccgagcugcagcccagcaccagcaccgaccagcccgugacccccgagcccaccagcagagccaccagaggcagaaccaacagaagcagcgugaagacccccgagagcaucgugcccaucgcccccgagcugcagcccagcaccagcagaaaccagcuggugacccccgagcccaccagcagagccaccagaugcagaaccaacagaagcagcgugaagacccccgagcccguggugcccaccgcccccgagccccaccccaccaccagcaccgaccagcccgugacccccaagcugaccagcagagccaccagaagaaagaccaacagaagcagcgugaagacccccaagcccguggagcccgccgccagcgaccuggagcccuucacccccaccgaccagagcgugacccccgaggccaucgcccagggcggccagagcaagacccugagaagcagcaccgugagagccaugcccgugcccaccacccccgaguuccagagccccgugaccaccgaccagcccaucagccccgagcccaucacccagcccagcugcaucaagagacagagagccgccggcaaccccggcagccuggccgcccccaucgaccacaagcccugcagcgccccccuggagcccaagagccaggccagcagaaaccagagauggggcgccgugagagccgccgagagccugaccgccauccccgagcccgccagcccccagcugcuggagacccccauccacgccagccagauccagaagguggagcccgccggcagaagcagauucacccccgagcugcagcccaaggccagccagagcagaaagagaagccuggccaccauggacagccccccccaccagaagcagccccagagaggcgaggugagccagaagaccgugaucaucaaggaggaggaggaggacaccgccgagaagcccggcaaggaggaggacguggugacccccaagcccggcaagagaaagagagaccaggccgaggaggagcccaacagaauccccagcagaagccugagaagaaccaagcugaaccaggagagcaccgcccccaaggugcuguucaccggcgugguggacgccagaggcgagagagccgugcuggcccugggcggcagccuggccggcagcgccgccgaggccagccaccuggugaccgacagaaucagaagaaccgugaaguuccugugcgcccugggcagaggcauccccauccugagccuggacuggcugcaccagagcagaaaggccggcuucuuccugccccccgacgaguacguggugaccgaccccgagcaggagaagaacuucggcuucagccugcaggacgcccugagcagagccagagagagaagacugcuggagggcuacgagaucuacgugacccccggcgugcagcccccccccccccagaugggcgagaucaucagcugcugcggcggcaccuaccugcccagcaugcccagaagcuacaagccccagagaguggugaucaccugcccccaggacuucccccacugcagcaucccccugagagugggccugccccugcugagccccgaguuccugcugaccggcgugcugaagcaggaggccaagcccgaggccuucgugcugagcccccuggagaugagcagcaccuaa

SEQ ID NO: 19743 - RNA, 741 nt, Artificial Sequence
  MDFIC__Homo_sapiens__NP_001159817
augagcggcgccggcgaggcccuggcccccggccccgugggcccccagagaguggccgaggccggcggcggccagcugggcagcaccgcccagggcaagugcgacaaggacaacaccgagaaggacaucacccaggccaccaacagccacuucacccacggcgagaugcaggaccagagcaucuggggcaaccccagcgacggcgagcugaucagaacccagccccagagacugccccagcugcagaccagcgcccaggugcccagcggcgaggagaucggcaagaucaagaacggccacaccggccugagcaacggcaacggcauccaccacggcgccaagcacggcagcgccgacaacagaaagcugagcgcccccgugagccagaagaugcacagaaagauccagagcagccugagcgugaacagcgacaucagcaagaagagcaaggugaacgccguguucagccagaagaccggcagcagccccgaggacugcugcgugcacugcauccuggccugccuguucugcgaguuccugacccugugcaacaucgugcugggccaggccagcugcggcaucugcaccagcgaggccugcugcugcugcugcggcgacgagaugggcgacgacugcaacugccccugcgacauggacugcggcaucauggacgccugcugcgagagcagcgacugccuggagaucugcauggagugcugcggcaucugcuuccccagcuaa

SEQ ID NO: 19744 - RNA, 741 nt, Artificial Sequence
  MDFI__Homo_sapiens__NP_001287733
auguaccaggugagcggccagagacccagcggcugcgacgcccccuacggcgcccccagcgccgcccccggccccgcccagacccugagccugcugcccggccuggagguggugaccggcagcacccaccccgccgaggccgcccccgaggagggcagccuggaggaggccgccacccccaugccccagggcaacggccccggcaucccccagggccuggacagcaccgaccuggacgugcccaccgaggccgugaccugccagccccagggcaacccccugggcugcaccccccugcugcccaacgacagcggccaccccagcgagcugggcggcaccagaagagccggcaacggcgcccugggcggccccaaggcccacagaaagcugcagacccaccccagccuggccagccagggcagcaagaagagcaagagcagcagcaagagcaccaccagccagaucccccugcaggcccaggaggacugcugcgugcacugcauccugagcugccuguucugcgaguuccugacccugugcaacaucgugcuggacugcgccaccugcggcagcugcagcagcgaggacagcugccugugcugcugcugcugcggcagcggcgagugcgccgacugcgaccugcccugcgaccuggacugcggcauccuggacgccugcugcgagagcgccgacugccuggagaucugcauggagugcugcggccugugcuucagcagcuaa

SEQ ID NO: 19745 - RNA, 2868 nt, Artificial Sequence
  MDGA1__Homo_sapiens__NP_705691
auggaggugaccugccugcugcugcuggcccugauccccuuccacugcagaggccagggcguguacgcccccgcccaggcccagaucgugcacgccggccaggccugcguggugaaggaggacaacaucagcgagagaguguacaccaucagagagggcgacacccugaugcugcagugccuggugaccggccaccccagaccccaggugagauggaccaagaccgccggcagcgccagcgacaaguuccaggagaccagcguguucaacgagacccugagaaucgagagaaucgccagaacccagggcggcagauacuacugcaaggccgagaacggcgugggcgugcccgccaucaagagcaucagaguggacgugcaguaccuggacgagcccaugcugaccgugcaccagaccgugagcgacgugagaggcaacuucuaccaggagaagaccguguuccugagaugcaccgugaacagcaacccccccgccagauucaucuggaagagaggcagcgacacccugagccacagccaggacaacggcguggacaucuacgagccccuguacacccagggcgagaccaaggugcugaagcugaagaaccugagaccccaggacuacgccagcuacaccugccaggugagcgugagaaacgugugcggcauccccgacaaggccaucaccuucagacugaccaacaccaccgccccccccgcccugaagcugagcgugaacgagacccugguggugaaccccggcgagaacgugaccgugcagugccugcugaccggcggcgacccccugccccagcugcaguggagccacggccccggcccccugccccugggcgcccuggcccagggcggcacccugagcauccccagcgugcaggccagagacagcggcuacuacaacugcaccgccaccaacaacgugggcaaccccgccaagaagaccgugaaccugcuggugagaagcaugaagaacgccaccuuccagaucacccccgacgugaucaaggagagcgagaacauccagcugggccaggaccugaagcugagcugccacguggacgccgugccccaggagaaggugaccuaccagugguucaagaacggcaagcccgccagaaugagcaagagacugcuggugaccagaaacgaccccgagcugcccgccgugaccagcagccuggagcugaucgaccugcacuucagcgacuacggcaccuaccugugcauggccagcuuccccggcgcccccgugcccgaccugagcguggaggugaacaucagcagcgagaccgugccccccaccaucagcgugcccaagggcagagccguggugaccgugagagagggcagccccgccgagcugcagugcgaggugagaggcaagcccagaccccccgugcuguggagcagaguggacaaggaggccgcccugcugcccagcggccugccccuggaggagacccccgacggcaagcugagacuggagagagugagcagagacaugagcggcaccuacagaugccagaccgccagauacaacggcuucaacgugagacccagagaggcccaggugcagcugaacgugcaguucccccccgagguggagcccagcagccaggacgugagacaggcccugggcagacccgugcugcugagaugcagccugcugagaggcagcccccagagaaucgccagcgccguguggagauucaagggccagcugcugccccccccccccguggugcccgccgccgccgaggcccccgaccacgccgagcugagacuggacgccgugaccagagacagcagcggcagcuacgagugcagcgugagcaacgacgugggcagcgccgccugccuguuccaggugagcgccaaggccuacagccccgaguucuacuucgacacccccaaccccaccagaagccacaagcugagcaagaacuacagcuacgugcugcaguggacccagagagagcccgacgccguggaccccgugcugaacuacagacugagcaucagacagcugaaccagcacaacgccguggugaaggccauccccgugagaagaguggagaagggccagcugcuggaguacauccugaccgaccugagagugccccacagcuacgaggugagacugacccccuacaccaccuucggcgccggcgacauggccagcagaaucauccacuacaccgagcccaucaacagccccaaccugagcgacaacaccugccacuucgaggacgagaagaucugcggcuacacccaggaccugaccgacaacuucgacuggaccagacagaacgcccugacccagaaccccaagagaagccccaacaccggcccccccaccgacaucagcggcacccccgagggcuacuacauguucaucgagaccagcagacccagagagcugggcgacagagccagacuggugagcccccuguacaacgccagcgccaaguucuacugcgugagcuucuucuaccacauguacggcaagcacaucggcagccugaaccugcuggugagaagcagaaacaagggcgcccuggacacccacgccuggagccugagcggcaacaagggcaacguguggcagcaggcccacgugcccaucagccccagcggccccuuccagaucaucuucgagggcgugagaggccccggcuaccugggcgacaucgccaucgacgacgugacccugaagaagggcgagugccccagaaagcagaccgaccccaacaaggugguggugaugcccggcagcggcgcccccugccagagcagcccccagcuguggggccccauggccaucuuccugcuggcccugcagagauaa

SEQ ID NO: 19746 - RNA, 2871 nt, Artificial Sequence
  MDGA2__Homo_sapiens__NP_001106970
auggaccugcuguacggccugguguggcugcugaccgugcugcuggagggcaucagcggccagggcguguacgccccccccaccgugagaaucgugcacagcggccuggccugcaacaucgaggaggagagauacagcgagagaguguacaccaucagagagggcgagacccuggagcugaccugccuggugaccggccaccccagaccccagaucagauggaccaagaccgccggcagcgccagcgacagauuccaggacagcagcguguucaacgagacccugagaaucaccaacauccagagacaccagggcggcagauacuacugcaaggccgagaacggccugggcagccccgccaucaagagcaucagaguggacguguacuaccuggacgaccccguggugaccgugcaccagagcaucggcgaggccaaggagcaguucuacuacgagagaaccguguuccugagaugcguggccaacagcaacccccccgugagauacagcuggagaagaggccaggaggugcugcugcagggcagcgacaagggcguggagaucuacgagcccuucuucacccagggcgagaccaagauccugaagcugaagaaccugagaccccaggacuacgccaacuacagcugcaucgccagcgugagaaacgugugcaacauccccgacaagauggugagcuucagacugagcaacaagaccgccagccccagcaucaagcugcugguggacgaccccaucguggugaaccccggcgaggccaucacccuggugugcgugaccaccggcggcgagcccgcccccagccugaccugggugagaagcuucggcacccugcccgagaagaccgugcugaacggcggcacccugaccauccccgccaucaccagcgacgacgccggcaccuacagcugcaucgccaacaacaacgugggcaaccccgccaagaagagcaccaacaucaucgugagagcccugaagaagggcagauucuggaucacccccgaccccuaccacaaggacgacaacauccagaucggcagagaggugaagaucagcugccagguggaggccgugcccagcgaggagcugaccuucagcugguucaagaacggcagaccccugagaagcagcgagagaauggugaucacccagaccgaccccgacgugagccccggcaccaccaaccuggacaucaucgaccugaaguucaccgacuucggcaccuacaccugcguggccagccugaagggcggcggcaucagcgacaucagcaucgacgugaacaucagcagcagcaccgugccccccaaccugaccgugccccaggagaagagcccccuggugaccagagagggcgacaccaucgagcugcagugccaggugaccggcaagcccaagcccaucauccuguggagcagagccgacaaggagguggccaugcccgacggcagcaugcagauggagagcuacgacggcacccugagaaucgugaacgugagcagagagaugagcggcauguacagaugccagaccagccaguacaacggcuucaacgugaagcccagagaggcccuggugcagcugaucgugcaguacccccccgccguggagcccgccuuccuggagaucagacagggccaggacagaagcgugaccaugagcugcagagugcugagagccuaccccaucagagugcugaccuacgaguggagacugggcaacaagcugcugagaaccggccaguucgacagccaggaguacaccgaguacgccgugaagagccugagcaacgagaacuacggcguguacaacugcagcaucaucaacgaggccggcgccggcagaugcagcuuccuggugaccggcaaggccuacgcccccgaguucuacuacgacaccuacaaccccguguggcagaacagacacagaguguacagcuacagccugcaguggacccagaugaaccccgacgccguggacagaaucguggccuacagacugggcaucagacaggccggccagcagagauggugggagcaggagaucaagaucaacggcaacauccagaagggcgagcugaucaccuacaaccugaccgagcugaucaagcccgaggccuacgaggugagacugaccccccugaccaaguucggcgagggcgacagcaccaucagagugaucaaguacagcgcccccgugaacccccaccugagagaguuccacugcggcuucgaggacggcaacaucugccuguucacccaggacgacaccgacaacuucgacuggaccaagcagagcaccgccaccagaaacaccaaguacacccccaacaccggccccaacgccgacagaagcggcagcaaggagggcuucuacauguacaucgagaccagcagacccagacuggagggcgagaaggccagacugcugagccccguguucagcaucgcccccaagaaccccuacggccccaccaacaccgccuacugcuucagcuucuucuaccacauguacggccagcacaucggcgugcugaacguguaccugagacugaagggccagaccaccaucgagaacccccuguggagcagcagcggcaacaagggccagagauggaacgaggcccacgugaacaucuaccccaucaccagcuuccagcugaucuucgagggcaucagaggccccggcaucgagggcgacaucgccaucgacgacgugagcaucgccgagggcgagugcgccaagcaggaccuggccaccaagaacagcguggacggcgccgugggcauccuggugcacaucuggcuguuccccaucaucgugcugaucagcauccugagccccagaagauaa

SEQ ID NO: 19747 - RNA, 1059 nt, Artificial Sequence
  MDH1__Homo_sapiens__NP_001186040
augagaagaugcagcuacuuccccaaggacgugaccguguucgacaaggacgacaagagcgagcccaucagagugcuggugaccggcgccgccggccagaucgccuacagccugcuguacagcaucggcaacggcagcguguucggcaaggaccagcccaucauccuggugcugcuggacaucacccccaugaugggcgugcuggacggcgugcugauggagcugcaggacugcgcccugccccugcugaaggacgugaucgccaccgacaaggaggacguggccuucaaggaccuggacguggccauccuggugggcagcaugcccagaagagagggcauggagagaaaggaccugcugaaggccaacgugaagaucuucaagagccagggcgccgcccuggacaaguacgccaagaagagcgugaaggugaucguggugggcaaccccgccaacaccaacugccugaccgccagcaagagcgcccccagcauccccaaggagaacuucagcugccugaccagacuggaccacaacagagccaaggcccagaucgcccugaagcugggcgugaccgccaacgacgugaagaacgugaucaucuggggcaaccacagcagcacccaguaccccgacgugaaccacgccaaggugaagcugcagggcaaggaggugggcguguacgaggcccugaaggacgacagcuggcugaagggcgaguucgugaccaccgugcagcagagaggcgccgccgugaucaaggccagaaagcugagcagcgccaugagcgccgccaaggccaucugcgaccacgugagagacaucugguucggcacccccgagggcgaguucgugagcaugggcgugaucagcgacggcaacagcuacggcgugcccgacgaccugcuguacagcuuccccguggugaucaagaacaagaccuggaaguucguggagggccugcccaucaacgacuucagcagagagaagauggaccugaccgccaaggagcugaccgaggagaaggagagcgccuucgaguuccugagcagcgccuaa

SEQ ID NO: 19748 - RNA, 1017 nt, Artificial Sequence
  MDH2__Homo_sapiens__NP_005909
augcugagcgcccuggccagacccgccagcgccgcccugagaagaagcuucagcaccagcgcccagaacaacgccaagguggccgugcugggcgccagcggcggcaucggccagccccugagccugcugcugaagaacagcccccuggugagcagacugacccuguacgacaucgcccacacccccggcguggccgccgaccugagccacaucgagaccaaggccgccgugaagggcuaccugggccccgagcagcugcccgacugccugaagggcugcgacgugguggugauccccgccggcgugcccagaaagcccggcaugaccagagacgaccuguucaacaccaacgccaccaucguggccacccugaccgccgccugcgcccagcacugccccgaggccaugaucugcgugaucgccaaccccgugaacagcaccauccccaucaccgccgagguguucaagaagcacggcguguacaaccccaacaagaucuucggcgugaccacccuggacaucgugagagccaacaccuucguggccgagcugaagggccuggaccccgccagagugaacgugcccgugaucggcggccacgccggcaagaccaucaucccccugaucagccagugcacccccaagguggacuucccccaggaccagcugaccgcccugaccggcagaauccaggaggccggcaccgagguggugaaggccaaggccggcgccggcagcgccacccugagcauggccuacgccggcgccagauucguguucagccugguggacgccaugaacggcaaggagggcgugguggagugcagcuucgugaagagccaggagaccgagugcaccuacuucagcaccccccugcugcugggcaagaagggcaucgagaagaaccugggcaucggcaaggugagcagcuucgaggagaagaugaucagcgacgccauccccgagcugaaggccagcaucaagaagggcgaggacuucgugaagacccugaaguaa

SEQ ID NO: 19749 - RNA, 264 nt, Artificial Sequence
  MDK__Homo_sapiens__NP_001257481
augcagcacagaggcuuccugcugcugacccugcuggcccugcuggcccugaccagcgccguggccaagaagaaggccgacugcaaguacaaguucgagaacuggggcgccugcgacggcggcaccggcaccaaggugagacagggcacccugaagaaggccagauacaacgcccagugccaggagaccaucagagugaccaagcccugcacccccaagaccaaggccaaggccaaggccaagaagggcaagggcaaggacuaa

SEQ ID NO: 19750 - RNA, 2040 nt, Artificial Sequence
  MDM1__Homo_sapiens__NP_001191957
augcccgugagauucaagggccugagcgaguaccagagaaacuuccuguggaagaagagcuaccugagcgagagcugcaacagcagcgugggcagaaaguaccccugggccggccugagaagcgaccagcugggcaucaccaaggagcccagcuucaucagcaagagaagagugcccuaccacgacccccagaucagcaagagccuggaguggaacggcgccaucagcgagagcaacgugguggccagccccgagcccgaggcccccgagacccccaagagccaggaggccgagcagaaggacgugacccaggagagagugcacagccuggaggccagcagagugcccaagagaaccagaagccacagcgccgacagcagagccgagggcgccagcgacguggagaacaacgagggcgugaccaaccacacccccgugaacgagaacguggagcuggagcacagcaccaaggugcugagcgagaacguggacaacggcguguuccacaacaagagccaguucgugccccccuucaagggcaacagcgugauccacgagaccgaguacaagagaaacuucaagggccugagccccgugaaggagcccaagcugagaaacgaccugagagagaacagaaaccuggagaccgugagccccgagagaaagagcaacaagaucgacgacagacugaagcuggaggccgagauggagcugaaggaccugcaccagcccaagagaaagcugacccccuggaagcaccagagacugggcaaggugaacagcgaguacagagccaaguuccugagccccgcccaguaccuguacaaggccggcgccuggacccacgugaagggcaacaugcccaaccagggcagccugaacgccaugugguacgccgaggugaaggagcugagagagaaggccgaguucuacagaaagagagugcagggcacccacuucagcagagaccaccugaaccagauccugagcgacagcaacugcugcugggacgugagcagcaccaccagcagcgagggcaccgugagcagcaacaucagagcccuggaccuggccggcgaccccaccagccacaagacccugcagaagugccccagcaccgagcccgaggagaagggcaacaucguggaggagcagccccagaagaacaccaccgagaagcugggcgugagcgcccccaccauccccgugagaagaagacuggccugggacaccgagaacaccagcgaggacgugcagaagcagcccggcgagaaggaggaggaggacgacaacgaggaggagggcgacagaaagaccggcaagcaggccuucaugggcgagcaggagaagcuggacgugagagagaagagcaaggccgacaagaugaaggagggcagcgacagcagcgugagcagcgagaagggcggcagacugcccacccccaagcugagagagcugggcggcauccagagaacccaccacgaccugaccacccccgccgugggcggcgccgugcuggugagccccagcaagaugaagccccccgcccccgagcagagaaagagaaugaccagccaggacugccuggagaccagcaagaacgacuucaccaagaaggagagcagagccgugagccugcugaccagccccgccgccggcaucaagaccguggacccccugccccugagagaggacagcgaggacaacauccacaaguucgccgaggccacccugcccgugagcaagauccccaaguaccccaccaacccccccggccagcugcccagccccccccacgugcccagcuacuggcaccccagcagaagaauccagggcagccugagagaccccgaguuccagcacaacgugggcaaggccagaaugaacaaccugcagcugccccagcacgaggccuucaacgacgaggacgaggacagacugagcgagaucagcgccagaagcgccgccagcagccugagagccuuccagacccuggccagagccaagaagagaaaggagaacuucuggggcaagaccuaa

SEQ ID NO: 19751 - RNA, 1335 nt, Artificial Sequence
  MDM2__Homo_sapiens__NP_001138809
augugcaacaccaacaugagcgugcccaccgacggcgccgugaccaccagccagauccccgccagcgagcaggagacccuggugagacccaagccccugcugcugaagcugcugaagagcgugggcgcccagaaggacaccuacaccaugaaggaggugcuguucuaccugggccaguacaucaugaccaagagacuguacgacgagaagcagcagcacaucguguacugcagcaacgaccugcugggcgaccuguucggcgugcccagcuucagcgugaaggagcacagaaagaucuacaccaugaucuacagaaaccuggugguggugaaccagcaggagagcagcgacagcggcaccagcgugagcgagaacagaugccaccuggagggcggcagcgaccagaaggaccuggugcaggagcugcaggaggagaagcccagcagcagccaccuggugagcagacccagcaccagcagcagaagaagagccaucagcgagaccgaggagaacagcgacgagcugagcggcgagagacagagaaagagacacaagagcgacagcaucagccugagcuucgacgagagccuggcccugugcgugaucagagagaucugcugcgagagaagcagcagcagcgagagcaccggcacccccagcaaccccgaccuggacgccggcguguaccaggugaccguguaccaggccggcgagagcgacaccgacagcuucgaggaggaccccgagaucagccuggccgacuacuggaagugcaccagcugcaacgagaugaaccccccccugcccagccacugcaacagaugcugggcccugagagagaacuggcugcccgaggacaagggcaaggacaagggcgagaucagcgagaaggccaagcuggagaacagcacccaggccgaggagggcuucgacgugcccgacugcaagaagaccaucgugaacgacagcagagagagcugcguggaggagaacgacgacaagaucacccaggccagccagagccaggagagcgaggacuacagccagcccagcaccagcagcagcaucaucuacagcagccaggaggacgugaaggaguucgagagagaggagacccaggacaaggaggagagcguggagagcagccugccccugaacgccaucgagcccugcgugaucugccagggcagacccaagaacggcugcaucgugcacggcaagaccggccaccugauggccugcuucaccugcgccaagaagcugaagaagagaaacaagcccugccccgugugcagacagcccauccagaugaucgugcugaccuacuuccccuaa

SEQ ID NO: 19752 - RNA, 1323 nt, Artificial Sequence
  MDM4__Homo_sapiens__NP_001191100
augaccagcuucagcaccagcgcccagugcagcaccagcgacagcgccugcagaaucagccccggccagaucaaccaggugagacccaagcugccccugcugaagauccugcacgccgccggcgcccagggcgagauguucaccgugaaggaggugaugcacuaccugggccaguacaucauggugaagcagcuguacgaccagcaggagcagcacaugguguacugcggcggcgaccugcugggcgagcugcugggcagacagagcuucagcgugaaggaccccagcccccuguacgacaugcugagaaagaaccuggugacccuggccaccgccaccaccgacgccgcccagacccuggcccuggcccaggaccacagcauggacauccccagccaggaccagcugaagcagagcgccgaggagagcagcaccagcagaaagagaaccaccgaggacgacauccccacccugcccaccagcgagcacaagugcauccacagcagagaggacgaggaccugaucgagaaccuggcccaggacgagaccagcagacuggaccugggcuucgaggagugggacguggccggccugcccuggugguuccugggcaaccugagaagcaacuacacccccagaagcaacggcagcaccgaccugcagaccaaccaggugaucgaggugggcaagaacgacgaccuggaggacagcaagagccugagcgacgacaccgacguggaggugaccagcgaggacgaguggcagugcaccgagugcaagaaguucaacagccccagcaagagauacugcuucagaugcugggcccugagaaaggacugguacagcgacugcagcaagcugacccacagccugagcaccagcgacaucaccgccauccccgagaaggagaacgagggcaacgacgugcccgacugcagaagaaccaucagcgcccccguggugagacccaaggacgccuacaucaagaaggagaacagcaagcuguucgaccccugcaacagcguggaguuccuggaccuggcccacagcagcgagagccaggagaccaucagcagcaugggcgagcagcuggacaaccugagcgagcagagaaccgacaccgagaacauggaggacugccagaaccugcugaagcccugcagccugugcgagaagagacccagagacggcaacaucauccacggcagaaccggccaccuggugaccugcuuccacugcgccagaagacugaagaaggccggcgccagcugccccaucugcaagaaggagauccagcuggugaucaagguguucaucgccuaa

SEQ ID NO: 19753 - RNA, 1719 nt, Artificial Sequence
  ME1__Homo_sapiens__NP_002386
auggagcccgaggcccccagaagaagacacacccaccagagaggcuaccugcugaccagaaacccccaccugaacaaggaccuggccuucacccuggaggagagacagcagcugaacauccacggccugcugccccccagcuucaacagccaggagauccaggugcugagaguggugaagaacuucgagcaccugaacagcgacuucgacagauaccugcugcugauggaccugcaggacagaaacgagaagcuguucuacagagugcugaccagcgacaucgagaaguucaugcccaucguguacacccccaccgugggccuggccugccagcaguacagccugguguucagaaagcccagaggccuguucaucaccauccacgacagaggccacaucgccagcgugcugaacgccuggcccgaggacgugaucaaggccaucguggugaccgacggcgagagaauccugggccugggcgaccugggcugcaacggcaugggcauccccgugggcaagcuggcccuguacaccgccugcggcggcaugaacccccaggagugccugcccgugauccuggacgugggcaccgagaacgaggagcugcugaaggacccccuguacaucggccugagacagagaagagugagaggcagcgaguacgacgacuuccuggacgaguucauggaggccgugagcagcaaguacggcaugaacugccugauccaguucgaggacuucgccaacgugaacgccuucagacugcugaacaaguacagaaaccaguacugcaccuucaacgacgacauccagggcaccgccagcguggccguggccggccugcuggccgcccugagaaucaccaagaacaagcugagcgaccagaccauccuguuccagggcgccggcgaggccgcccugggcaucgcccaccugaucgugauggcccuggagaaggagggccugcccaaggagaaggccaucaagaagaucuggcugguggacagcaagggccugaucgugaagggcagagccagccugacccaggagaaggagaaguucgcccacgagcacgaggagaugaagaaccuggaggccaucgugcaggagaucaagcccaccgcccugaucggcguggccgccaucggcggcgccuucagcgagcagauccugaaggacauggccgccuucaacgagagacccaucaucuucgcccugagcaaccccaccagcaaggccgagugcagcgccgagcagugcuacaagaucaccaagggcagagccaucuucgccagcggcagccccuucgaccccgugacccugcccaacggccagacccuguaccccggccagggcaacaacagcuacguguuccccggcguggcccugggcgugguggccugcggccugagacagaucaccgacaacaucuuccugaccaccgccgaggugaucgcccagcaggugagcgacaagcaccuggaggagggcagacuguaccccccccugaacaccaucagagacgugagccugaagaucgccgagaagaucgugaaggacgccuaccaggagaagaccgccaccguguaccccgagccccagaacaaggaggccuucgugagaagccagauguacagcaccgacuacgaccagauccugcccgacugcuacagcuggcccgaggaggugcagaagauccagaccaagguggaccaguaa

SEQ ID NO: 19754 - RNA, 1440 nt, Artificial Sequence
  ME2__Homo_sapiens__NP_001161807
augcugagcagacugagaguggugagcaccaccugcacccuggccugcagacaccugcacaucaaggagaagggcaagccccugaugcugaaccccagaaccaacaagggcauggccuucacccugcaggagagacagaugcugggccugcagggccugcugccccccaagaucgagacccaggacauccaggcccugagauuccacagaaaccugaagaagaugaccagcccccuggagaaguacaucuacaucaugggcauccaggagagaaacgagaagcuguucuacagaauccugcaggacgacaucgagagccugaugcccaucguguacacccccaccgugggccuggccugcagccaguacggccacaucuucagaagacccaagggccuguucaucagcaucagcgacagaggccacgugagaagcaucguggacaacuggcccgagaaccacgugaaggccgugguggugaccgacggcgagagaauccugggccugggcgaccugggcguguacggcaugggcauccccgugggcaagcugugccuguacaccgccugcgccggcaucagacccgacagaugccugcccgugugcaucgacgugggcaccgacaacaucgcccugcugaaggaccccuucuacaugggccuguaccagaagagagacagaacccagcaguacgacgaccugaucgacgaguucaugaaggccaucaccgacagauacggcagaaacacccugauccaguucgaggacuucggcaaccacaacgccuucagauuccugagaaaguacagagagaaguacugcaccuucaacgacgacauccagggcaccgccgccguggcccuggccggccugcuggccgcccagaaggugaucagcaagcccaucagcgagcacaagauccuguuccugggcgccggcgaggccgcccugggcaucgccaaccugaucgugaugagcaugguggagaacggccugagcgagcaggaggcccagaagaagaucuggauguucgacaaguacggccugcuggugaagggcagaaaggccaagaucgacagcuaccaggagcccuucacccacagcgcccccgagagcauccccgacaccuucgaggacgccgugaacauccugaagcccagcaccaucaucggcguggccggcgccggcagacuguucacccccgacgugaucagagccauggccagcaucaacgagagacccgugaucuucgcccugagcaaccccaccgcccaggccgagugcaccgccgaggaggccuacacccugaccgagggcagaugccuguucgccagcggcagccccuucggccccgugaagcugaccgacggcagaguguucacccccggccagggcaacaacguguacaucuuccccggcuacagaauccccaucugcuaa

SEQ ID NO: 19755 - RNA, 1815 nt, Artificial Sequence
  ME3__Homo_sapiens__NP_001155058
augggcgccgcccugggcaccggcaccagacuggcccccuggcccggcagagccugcggcgcccugcccagauggacccccaccgcccccgcccagggcugccacagcaagcccggccccgccagacccgugccccugaagaagagaggcuacgacgugaccagaaacccccaccugaacaagggcauggccuucacccuggaggagagacugcagcugggcauccacggccugaucccccccugcuuccugagccaggacgugcagcugcugagaaucaugagauacuacgagagacagcagagcgaccuggacaaguacaucauccugaugacccugcaggacagaaacgagaagcuguucuacagagugcugaccagcgacguggagaaguucaugcccaucguguacacccccaccgugggccuggccugccagcacuacggccugaccuucagaagacccagaggccuguucaucaccauccacgacaagggccaccuggccaccaugcugaacagcuggcccgaggacaacaucaaggccgugguggugaccgacggcgagagaauccugggccugggcgaccugggcugcuacggcaugggcauccccgugggcaagcuggcccuguacaccgccugcggcggcgugaacccccagcagugccugcccgugcugcuggacgugggcaccaacaacgaggagcugcugagagacccccuguacaucggccugaagcaccagagagugcacggcaaggccuacgacgaccugcuggacgaguucaugcaggccgugaccgacaaguucggcaucaacugccugauccaguucgaggacuucgccaacgccaacgccuucagacugcugaacaaguacagaaacaaguacugcauguucaacgacgacauccagggcaccgccagcguggccguggccggcauccuggccgcccugagaaucaccaagaacaagcugagcaaccacguguucguguuccagggcgccggcgaggccgccaugggcaucgcccaccugcuggugauggcccuggagaaggagggcgugcccaaggccgaggccaccagaaagaucuggaugguggacagcaagggccugaucgugaagggcagaagccaccugaaccacgagaaggagauguucgcccaggaccaccccgaggugaacagccuggaggagguggugagacuggugaagcccaccgccaucaucggcguggccgccaucgccggcgccuucaccgagcagauccugagagacauggccagcuuccacgagagacccaucaucuucgcccugagcaaccccaccagcaaggccgagugcaccgccgagaagugcuacagagugaccgagggcagaggcaucuucgccagcggcagccccuucaagagcgugacccuggaggacggcaagaccuucauccccggccagggcaacaacgccuacguguuccccggcguggcccugggcgugaucgccggcggcaucagacacauccccgacgagaucuuccugcugaccgccgagcagaucgcccaggaggugagcgagcagcaccugagccagggcagacuguaccccccccugagcaccaucagagacgugagccugagaaucgccaucaaggugcuggacuacgccuacaagcacaaccuggccagcuacuaccccgagcccaaggacaaggaggccuucgugagaagccugguguacacccccgacuacgacagcuucacccuggacagcuacaccuggcccaaggaggccaugaacgugcagaccguguaa

SEQ ID NO: 19756 - RNA, 558 nt, Artificial Sequence
  MEA1__Homo_sapiens__NP_055438
augggccccgagagacaccugagcggcgcccccgccagaauggccaccguggugcugggcggcgacaccaugggccccgagagaaucuuccccaaccagaccgaggagcugggccaccagggccccagcgagggcaccggcgacuggagcagcgaggagcccgaggaggagcaggaggagaccggcagcggccccgccggcuacagcuaccagccccugaaccaggaccccgagcaggaggagguggagcuggcccccgugggcgacggcgacgugguggccgacauccaggacagaauccaggcccugggccugcaccugcccgaccccccccuggagagcgaggacgaggacgaggagggcgccaccgcccugaacaaccacagcagcauccccauggaccccgagcacguggagcuggugaagagaaccauggccggcgugagccugcccgcccccggcgugcccgccugggccagagagaucagcgacgcccagugggaggacguggugcagaaggcccugcaggccagacaggccagccccgccuggaaguaa

SEQ ID NO: 19757 - RNA, 3351 nt, Artificial Sequence
  MECOM__Homo_sapiens__NP_001098547
augauccuggacgaguucuacaacgugaaguucugcaucgacgccagccagcccgacgugggcagcuggcugaaguacaucagauucgccggcugcuacgaccagcacaaccugguggccugccagaucaacgaccagaucuucuacagagugguggccgacaucgcccccggcgaggagcugcugcuguucaugaagagcgaggacuacccccacgagaccauggcccccgacauccacgaggagagacaguacagaugcgaggacugcgaccagcuguucgagagcaaggccgagcuggccgaccaccagaaguuccccugcagcaccccccacagcgccuucagcaugguggaggaggacuuccagcagaagcuggagagcgagaacgaccugcaggagauccacaccauccaggagugcaaggagugcgaccagguguuccccgaccugcagagccuggagaagcacaugcugagccacaccgaggagagagaguacaagugcgaccagugccccaaggccuucaacuggaagagcaaccugaucagacaccagaugagccacgacagcggcaagcacuacgagugcgagaacugcgccaagcagguguucaccgaccccagcaaccugcagagacacaucagaagccagcacgugggcgccagagcccacgccugccccgagugcggcaagaccuucgccaccagcagcggccugaagcagcacaagcacauccacagcagcgugaagcccuucaucugcgaggugugccacaagagcuacacccaguucagcaaccugugcagacacaagagaaugcacgccgacugcagaacccagaucaagugcaaggacugcggccagauguucagcaccaccagcagccugaacaagcacagaagauucugcgagggcaagaaccacuucgccgccggcggcuucuucggccagggcaucagccugcccggcacccccgccauggacaagaccagcauggugaacaugagccacgccaaccccggccuggccgacuacuucggcgccaacagacaccccgccggccugaccuuccccaccgcccccggcuucagcuucagcuuccccggccuguuccccagcggccuguaccacagacccccccugauccccgccagcagccccgugaagggccugagcagcaccgagcagaccaacaagagccagagcccccugaugacccacccccagauccugcccgccacccaggacauccugaaggcccugagcaagcaccccagcgugggcgacaacaagcccguggagcugcagcccgagagaagcagcgaggagagacccuucgagaagaucagcgaccagagcgagagcagcgaccuggacgacgugagcacccccagcggcagcgaccuggagaccaccagcggcagcgaccuggagagcgacaucgagagcgacaaggagaaguucaaggagaacggcaagauguucaaggacaaggugagcccccugcagaaccuggccagcaucaacaacaagaaggaguacagcaaccacagcaucuucagccccagccuggaggagcagaccgccgugagcggcgccgugaacgacagcaucaaggccaucgccagcaucgccgagaaguacuucggcagcaccggccuggugggccugcaggacaagaaggugggcgcccugcccuaccccagcauguucccccugcccuucuuccccgccuucagccagagcauguaccccuuccccgacagagaccugagaagccugccccugaagauggagccccagagccccggcgaggugaagaagcugcagaagggcagcagcgagagccccuucgaccugaccaccaagagaaaggacgagaagccccugacccccgugcccagcaagccccccgugacccccgccaccagccaggaccagccccuggaccugagcaugggcagcagaagcagagccagcggcaccaagcugaccgagcccagaaagaaccacguguucggcggcaagaagggcagcaacguggagagcagacccgccagcgacggcagccugcagcacgccagacccacccccuucuucauggaccccaucuacagaguggagaagagaaagcugaccgacccccuggaggcccugaaggagaaguaccugagacccagccccggcuuccuguuccacccccaguuccagcugcccgaccagagaaccuggaugagcgccaucgagaacauggccgagaagcuggagagcuucagcgcccugaagcccgaggccagcgagcugcugcagagcgugcccagcauguucaacuucagagccccccccaacgcccugcccgagaaccugcugagaaagggcaaggagagauacaccugcagauacugcggcaagaucuuccccagaagcgccaaccugaccagacaccugagaacccacaccggcgagcagcccuacagaugcaaguacugcgacagaagcuucagcaucagcagcaaccugcagagacacgugagaaacauccacaacaaggagaagcccuucaagugccaccugugcgacagaugcuucggccagcagaccaaccuggacagacaccugaagaagcacgagaacggcaacaugagcggcaccgccaccagcagcccccacagcgagcuggagagcaccggcgccauccuggacgacaaggaggacgccuacuucaccgagaucagaaacuucaucggcaacagcaaccacggcagccagagccccagaaacguggaggagagaaugaacggcagccacuucaaggacgagaaggcccuggugaccagccagaacagcgaccugcuggacgacgaggagguggaggacgaggugcugcuggacgaggaggacgaggacaacgacaucaccggcaagaccggcaaggagcccgugaccagcaaccugcacgagggcaaccccgaggacgacuacgaggagaccagcgcccuggagaugagcugcaagaccagccccgugagauacaaggaggaggaguacaagagcggccugagcgcccuggaccacaucagacacuucaccgacagccugaagaugagaaagauggaggacaaccaguacagcgaggccgagcugagcagcuucagcaccagccacgugcccgaggagcugaagcagccccugcacagaaagagcaagagccaggccuacgccaugaugcugagccugagcgacaaggagagccugcacagcaccagccacagcagcagcaacguguggcacagcauggccagagccgccgccgagagcagcgccauccagagcaucagccacguguaa

SEQ ID NO: 19758 - RNA, 1497 nt, Artificial Sequence
  MECP2__Homo_sapiens__NP_001104262
auggccgccgccgccgccgccgcccccagcggcggcggcggcggcggcgaggaggagagacuggaggagaagagcgaggaccaggaccugcagggccugaaggacaagccccugaaguucaagaaggugaagaaggacaagaaggaggagaaggagggcaagcacgagcccgugcagcccagcgcccaccacagcgccgagcccgccgaggccggcaaggccgagaccagcgagggcagcggcagcgcccccgccgugcccgaggccagcgccagccccaagcagagaagaagcaucaucagagacagaggccccauguacgacgaccccacccugcccgagggcuggaccagaaagcugaagcagagaaagagcggcagaagcgccggcaaguacgacguguaccugaucaacccccagggcaaggccuucagaagcaagguggagcugaucgccuacuucgagaaggugggcgacaccagccuggaccccaacgacuucgacuucaccgugaccggcagaggcagccccagcagaagagagcagaagccccccaagaagcccaagagccccaaggcccccggcaccggcagaggcagaggcagacccaagggcagcggcaccaccagacccaaggccgccaccagcgagggcgugcaggugaagagagugcuggagaagagccccggcaagcugcuggugaagaugcccuuccagaccagccccggcggcaaggccgagggcggcggcgccaccaccagcacccaggugauggugaucaagagacccggcagaaagagaaaggccgaggccgacccccaggccauccccaagaagagaggcagaaagcccggcagcgugguggccgccgccgccgccgaggccaagaagaaggccgugaaggagagcagcaucagaagcgugcaggagaccgugcugcccaucaagaagagaaagaccagagagaccgugagcaucgaggugaaggagguggugaagccccugcuggugagcacccugggcgagaagagcggcaagggccugaagaccugcaagagccccggcagaaagagcaaggagagcagccccaagggcagaagcagcagcgccagcagcccccccaagaaggagcaccaccaccaccaccaccacagcgagagccccaaggcccccgugccccugcugcccccccugcccccccccccccccgagcccgagagcagcgaggaccccaccagcccccccgagccccaggaccugagcagcagcgugugcaaggaggagaagaugcccagaggcggcagccuggagagcgacggcugccccaaggagcccgccaagacccagcccgccguggccaccgccgccaccgccgccgagaaguacaagcacagaggcgagggcgagagaaaggacaucgugagcagcagcaugcccagacccaacagagaggagcccguggacagcagaacccccgugaccgagagagugagcuaa

SEQ ID NO: 19759 - RNA, 6534 nt, Artificial Sequence
  MED12__Homo_sapiens__NP_005111
auggccgccuucggcauccugagcuacgagcacagaccccugaagagacccagacugggcccccccgacguguacccccaggaccccaagcagaaggaggacgagcugaccgcccugaacgugaagcagggcuucaacaaccagcccgccgugagcggcgacgagcacggcagcgccaagaacgugagcuucaaccccgccaagaucagcagcaacuucagcagcaucaucgccgagaagcugagaugcaacacccugcccgacaccggcagaagaaagccccaggugaaccagaaggacaacuucuggcuggugaccgccagaagccagagcgccaucaacaccugguucaccgaccuggccggcaccaagccccugacccagcuggccaagaaggugcccaucuucagcaagaaggaggagguguucggcuaccuggccaaguacaccgugcccgugaugagagccgccuggcugaucaagaugaccugcgccuacuacgccgccaucagcgagaccaaggugaagaagagacacguggaccccuucauggaguggacccagaucaucaccaaguaccugugggagcagcugcagaagauggccgaguacuacagacccggccccgccggcagcggcggcugcggcagcaccaucggcccccugccccacgacguggagguggccaucagacagugggacuacaccgagaagcuggccauguucauguuccaggacggcaugcuggacagacacgaguuccugaccugggugcuggagugcuucgagaagaucagacccggcgaggacgagcugcugaagcugcugcugccccugcugcugagauacagcggcgaguucgugcagagcgccuaccugagcagaagacuggccuacuucugcaccagaagacuggcccugcagcuggacggcgugagcagccacagcagccacgugaucagcgcccagagcaccagcacccugcccaccacccccgccccccagccccccaccagcagcacccccagcacccccuucagcgaccugcugaugugcccccagcacagaccccugguguucggccugagcugcauccugcagaccauccugcugugcugccccagcgcccugguguggcacuacagccugaccgacagcagaaucaagaccggcagcccccuggaccaccugcccaucgcccccagcaaccugcccaugcccgagggcaacagcgccuucacccagcaggugagagccaagcugagagagaucgagcagcagaucaaggagagaggccaggccguggaggugagauggagcuucgacaagugccaggaggccaccgccggcuucaccaucggcagagugcugcacacccuggaggugcuggacagccacagcuucgagagaagcgacuucagcaacagccuggacagccugugcaacagaaucuucggccugggccccagcaaggacggccacgagaucagcagcgacgacgacgccguggugagccugcugugcgagugggccgugagcugcaagagaagcggcagacacagagccauggugguggccaagcugcuggagaagagacaggccgagaucgaggccgagagaugcggcgagagcgaggccgccgacgagaagggcagcaucgccagcggcagccugagcgcccccagcgcccccaucuuccaggacgugcugcugcaguuccuggacacccaggcccccaugcugaccgaccccagaagcgagagcgagagaguggaguucuucaaccuggugcugcuguucugcgagcugaucagacacgacguguucagccacaacauguacaccugcacccugaucagcagaggcgaccuggccuucggcgcccccggccccagaccccccagccccuucgacgaccccgccgacgaccccgagcacaaggaggccgagggcagcagcagcagcaagcuggaggaccccggccugagcgagagcauggacaucgaccccagcagcagcgugcuguucgaggacauggagaagcccgacuucagccuguucagccccaccaugcccugcgagggcaagggcagccccagccccgagaagcccgacguggagaaggaggugaagcccccccccaaggagaagaucgagggcacccugggcgugcuguacgaccagcccagacacgugcaguacgccacccacuuccccaucccccaggaggagagcugcagccacgagugcaaccagagacugguggugcuguucggcgugggcaagcagagagacgacgccagacacgccaucaagaagaucaccaaggacauccugaaggugcugaacagaaagggcaccgccgagaccgaccagcuggcccccaucgugccccugaaccccggcgaccugaccuuccugggcggcgaggacggccagaagagaagaagaaacagacccgaggccuuccccaccgccgaggacaucuucgccaaguuccagcaccugagccacuacgaccagcaccaggugaccgcccaggugagcagaaacgugcuggagcagaucaccagcuucgcccugggcaugagcuaccaccugccccuggugcagcacgugcaguucaucuucgaccugauggaguacagccugagcaucagcggccugaucgacuucgccauccagcugcugaacgagcugagcgugguggaggccgagcugcugcugaagagcagcgaccuggugggcagcuacaccaccagccugugccugugcaucguggccgugcugagacacuaccacgccugccugauccugaaccaggaccagauggcccagguguucgagggccugugcggcguggugaagcacggcaugaacagaagcgacggcagcagcgccgagagaugcauccuggccuaccuguacgaccuguacaccagcugcagccaccugaagaacaaguucggcgagcuguucagcgacuucugcagcaaggugaagaacaccaucuacugcaacguggagcccagcgagagcaacaugagaugggcccccgaguucaugaucgacacccuggagaaccccgccgcccacaccuucaccuacaccggccugggcaagagccugagcgagaaccccgccaacagauacagcuucgugugcaacgcccugaugcacgugugcgugggccaccacgaccccgacagagugaacgacaucgccauccugugcgccgagcugaccggcuacugcaagagccugagcgccgaguggcugggcgugcugaaggcccugugcugcagcagcaacaacggcaccugcggcuucaacgaccugcugugcaacguggacgugagcgaccugagcuuccacgacagccuggccaccuucguggccauccugaucgccagacagugccugcugcuggaggaccugaucagaugcgccgccauccccagccugcugaacgccgccugcagcgagcaggacagcgagcccggcgccagacugaccugcagaauccugcugcaccuguucaagaccccccagcugaaccccugccagagcgacggcaacaagcccaccgugggcaucagaagcagcugcgacagacaccugcuggccgccagccagaacagaaucguggacggcgccguguucgccgugcugaaggccguguucgugcugggcgacgccgagcugaagggcagcggcuucaccgugaccggcggcaccgaggagcugcccgaggaggagggcggcggcggcagcggcggcagaagacagggcggcagaaacaucagcguggagaccgccagccuggacguguacgccaaguacgugcugagaagcaucugccagcaggagugggugggcgagagaugccugaagagccugugcgaggacagcaacgaccugcaggaccccgugcugagcagcgcccaggcccagagacugaugcagcugaucugcuacccccacagacugcuggacaacgaggacggcgagaacccccagagacagagaaucaagagaauccugcagaaccuggaccaguggaccaugagacagagcagccuggagcugcagcugaugaucaagcagacccccaacaacgagaugaacagccugcuggagaacaucgccaaggccaccaucgagguguuccagcagagcgccgagaccggcagcagcagcggcagcaccgccagcaacaugcccagcagcagcaagaccaagcccgugcugagcagccuggagagaagcggcguguggcugguggccccccugaucgccaagcugcccaccagcgugcagggccacgugcugaaggccgccggcgaggagcuggagaagggccagcaccugggcagcagcagcagaaaggagagagacagacagaagcagaagagcaugagccugcugagccagcagcccuuccugagccuggugcugaccugccugaagggccaggacgagcagagagagggccugcugaccagccuguacagccaggugcaccagaucgugaacaacuggagagacgaccaguaccuggacgacugcaagcccaagcagcugaugcacgaggcccugaagcugagacugaaccuggugggcggcauguucgacaccgugcagagaagcacccagcagaccaccgagugggccaugcugcugcuggagaucaucaucagcggcaccguggacaugcagagcaacaacgagcuguucaccaccgugcuggacaugcugagcgugcugaucaacggcacccuggccgccgacaugagcagcaucagccagggcagcauggaggagaacaagagagccuacaugaaccuggccaagaagcugcagaaggagcugggcgagagacagagcgacagccuggagaaggugagacagcugcugccccugcccaagcagaccagagacgugaucaccugcgagccccagggcagccugaucgacaccaagggcaacaagaucgccggcuucgacagcaucuucaagaaggagggccugcaggugagcaccaagcagaagaucagccccugggaccuguucgagggccugaagcccagcgccccccugagcuggggcugguucggcaccgugagaguggacagaagaguggccagaggcgaggagcagcagagacugcugcuguaccacacccaccugagacccagacccagagccuacuaccuggagccccugccccugccccccgaggacgaggagccccccgcccccacccugcuggagcccgagaagaaggcccccgagccccccaagaccgacaagcccggcgccgccccccccagcaccgaggagagaaagaagaagagcaccaagggcaagaagagaagccagcccgccaccaagaccgaggacuacggcaugggccccggcagaagcggccccuacggcgugaccgugccccccgaccugcugcaccaccccaaccccggcagcaucacccaccugaacuacagacagggcagcaucggccuguacacccagaaccagccccugcccgccggcggccccagaguggaccccuacagacccgugagacugcccaugcagaagcugcccaccagacccaccuaccccggcgugcugcccaccaccaugaccggcgugaugggccuggagcccagcagcuacaagaccagcguguacagacagcagcagcccgccgugccccagggccagagacugagacagcagcugcagcagagccagggcaugcugggccagagcagcgugcaccagaugacccccagcagcagcuacggccugcagaccagccagggcuacacccccuacgugagccacgugggccugcagcagcacaccggccccgccggcaccauggugccccccagcuacagcagccagcccuaccagagcacccaccccagcaccaaccccacccugguggaccccaccagacaccugcagcagagacccagcggcuacgugcaccagcaggcccccaccuacggccacggccugaccagcacccagagauucagccaccagacccugcagcagacccccaugaucagcaccaugacccccaugagcgcccagggcgugcaggccggcgugagaagcaccgccauccugcccgagcagcagcagcagcagcagcagcagcagcagcagcagcagcagcagcagcagcagcagcagcagcagcagcagcagcaguaccacaucagacagcagcagcagcagcagauccugagacagcagcagcagcagcagcagcagcagcagcagcagcagcagcagcagcagcagcagcagcagcagcagcagcagcagcaccagcagcagcagcagcagcaggccgcccccccccagccccagccccagagccagccccaguuccagagacagggccugcagcagacccagcagcagcagcagaccgccgcccuggugagacagcugcagcagcagcugagcaacacccagccccagcccagcaccaacaucuucggcagauacuaa

SEQ ID NO: 19760 - RNA, 6438 nt, Artificial Sequence
  MED12L__Homo_sapiens__NP_443728
auggccgccuucggccugcugagcuacgagcagagaccccugaagagacccagacugggcccccccgacguguacccccaggaccccaagcagaaggaggacgagcugaccgccgugaacgugaagcagggcuucaacaaccagcccgccuucaccggcgacgagcacggcagcgccagaaacaucgugaucaaccccagcaagaucggcgccuacuucagcagcauccuggccgagaagcugaagcugaacaccuuccaggacaccggcaagaagaagccccaggugaacgccaaggacaacuacuggcuggugaccgccagaagccagagcgccauccacagcugguucagcgaccuggccggcaacaagccccugagcauccuggccaagaaggugcccauccugagcaagaaggaggacguguucgccuaccuggccaaguacagcgugcccauggugagagccaccuggcugaucaagaugaccugcgccuacuacagcgccaucagcgaggccaagaucaagaagagacaggcccccgaccccaaccuggaguggacccagaucagcaccagauaccugagagagcagcuggccaagaucagcgacuucuaccacauggccagcagcaccggcgacggccccgugcccgugccccccgagguggagcaggccaugaagcagugggaguacaacgagaagcuggccuuccacauguuccaggagggcaugcuggagaagcacgaguaccugaccuggauccuggacgugcuggagaagaucagacccauggacgacgaccugcugaagcugcugcugccccugaugcugcaguacagcgacgaguucgugcagagcgccuaccugagcagaagacuggccuacuucugcgccagaagacugagccugcugcugagcgacagccccaaccugcuggccgcccacagcccccacaugaugaucggccccaacaacagcagcaucggcgcccccagccccggcccccccggccccggcaugagccccgugcagcuggccuucagcgacuuccugagcugcgcccagcacggcccccugguguacggccugagcugcaugcugcagaccgugacccugugcugccccagcgcccugguguggaacuacagcaccaacgagaacaagagcgccaaccccggcagcccccuggaccugcugcagguggcccccagcagccugcccaugcccggcggcaacaccgccuucaaccagcaggugagagccagaaucuacgagguggagcagcagaucaagcagagaggcagagccguggaggugagauggagcuucgacaagugccaggagagcaccgccggcgugaccaucagcagagugcugcacacccuggaggugcuggacagacacugcuucgacagaaccgacagcagcaacagcauggagacccuguaccacaagaucuucugggccaaccagaacaaggacaaccaggagguggcccccaacgacgaggccguggugacccugcugugcgagugggccgugagcugcaagagaagcggcaagcacagagccauggccguggccaagcugcuggagaagagacaggccgagaucgaggccgagagaugcggcgagagcgaggugcuggacgagaaggagagcaucagcagcagcagccuggccggcagcagccugcccguguuccagaacgugcugcugagauuccuggacacccaggcccccagccugagcgaccccaacagcgagugcgagaagguggaguucgugaaccuggugcugcuguucugcgaguucaucagacacgacguguucagccacgacgccuacaugugcacccugaucagcagaggcgaccugagcgugaccgccagcaccagacccagaagccccgugggcgagaacgccgacgagcacuacagcaaggaccacgacgugaagauggagaucuucagccccaugcccggcgagagcugcgagaacgccaacaccagccugggcagaagaaugagcgugaacugcgagaagcuggugaagagagagaagcccagagagcugaucuuccccagcaacuacgaccugcugagacaccugcaguacgccacccacuuccccaucccccuggacgagagcagcagccacgagugcaaccagagaaccauccugcuguacggcgugggcaaggagagagacgaggccagacaccagcugaagaagaucaccaaggacauccugaagauccugaacaagaagagcaccaccgagaccggcgugggcgacgagggccagaaggccagaaagaacaagcaggagaccuuccccacccuggagaccguguucaccaagcugcagcugcugagcuacuucgaccagcaccaggugaccagccagaucagcaacaacgugcuggagcagaucaccagcuucgccagcggcaccagcuaccaccugccccuggcccaccacauccagcugaucuucgaccugauggagcccgcccugaacaucaacggccugaucgacuucgccauccagcugcugaacgagcugagcgugguggaggccgagcugcugcugaagagcagcagccuggccggcagcuacaccaccggccugugcgugugcaucguggccgugcugagaagauaccacagcugccugauccugaaccccgaccagaccgcccagguguucgagggccugugcggcguggugaagcacguggugaaccccagcgagugcagcagccccgagagaugcauccuggccuaccuguacgaccuguacgugagcugcagccaccugagaagcaaguucggcgaccuguucagcagcgccugcagcaaggugaagcagaccaucuacaacaacgugaugcccgccaacagcaaccugagaugggaccccgacuucaugauggacuucaucgagaaccccagcgccagaagcaucaacuacagcaugcugggcaagauccugagcgacaacgccgccaacagauacagcuucgugugcaacacccugaugaacgugugcaugggccaccaggacgccggcagaaucaacgacaucgccaacuucagcagcgagcugaccgccugcugcaccgugcugagcagcgaguggcugggcgugcugaaggcccugugcugcagcagcaaccacguguggggcuucaacgacgugcugugcaccguggacgugagcgaccugagcuuccacgacagccuggccaccuucaucgccauccugaucgccagacagugcuucagccuggaggacguggugcagcacguggcccugcccagccugcuggccgccgccugcggcgacgccgacgccgagcccggcgccagaaugaccugcagacugcugcugcaccuguucagagccccccaggccugcuuccugccccaggccaccggcaagcccuuccccggcaucagaagcagcugcgacagacaccugcuggccgccgcccacaacagcaucgaggugggcgccguguucgccgugcugaaggccaucaugaugcugggcgacgccaagaucggcaacaacagcgugagcagccugaagaacgacgacuucaccaugagaggccugagaugcgacggcaacgccgacgacaucuggaccgccagccagaaccccaagagcugcggcaagagcaucagcaucgagaccgccaaccugagagaguacgccagauacgugcugagaaccaucugccagcaggagugggugggcgagcacugccugaaggagcccgagagacugugcaccgacaaggagcugauccuggaccccgugcugagcaacaugcaggcccagaagcugcugcagcugaucugcuacccccacggcaucaaggagugcaccgagggcgacaaccugcagagacagcacaucaagagaauccugcagaaccuggagcaguggacccugagacagagcuggcuggagcugcagcugaugaucaagcagugccugaaggaccccggcagcggcagcguggccgagaugaacaaccugcuggacaacaucgccaaggccaccaucgagguguuccagcagagcgccgaccugaacaacagcagcaacagcggcaugagccuguucaaccccaacagcaucggcagcgccgacaccagcagcaccagacagaacggcaucaagaccuuccugagcagcagcgagagaagaggcguguggcugguggccccccugaucgccagacugcccaccagcgugcagggcagagugcugaaggccgccggcgaggagcuggagaagggccagcaccugggcagcagcagcaagaaggagagagacagacagaagcagaagagcaugagccugcugagccagcagcccuuccugagccuggugcugaccugccugaagggccaggacgagcagagagagggccugcugaccagccugcagaaccaggugaaccagauccugagcaacuggagagaggagagauaccaggacgacaucaaggccagacagaugaugcacgaggcccugcagcugagacugaaccuggugggcggcauguucgacaccgugcagagaagcacccaguggaccaccgacugggcccugcugcugcugcagaucaucaccagcggcaccguggacaugcacaccaacaacgagcuguucaccaccgugcuggacaugcugggcgugcugaucaacggcacccuggccagcgaccugagcaacgccagccccggcggcagcgaggagaacaagagagccuacaugaaccuggugaagaagcugaagaaggagcugggcgacaagagaagcgagagcaucgacaaggugagacagcugcugccccugcccaagcagaccugcgacgugaucaccugcgagcccaugggcagccugaucgacaccaagggcaacaagaucgccggcuucgacagcaucgacaagaagcagggccugcaggugagcaccaagcagaaggugagccccugggaccuguucgagggccagaagaaccccgccccccugagcugggccugguucggcaccgugagaguggacagaagagugaucaaguacgaggagcagcaccaccugcugcuguaccacacccaccccaugcccaagcccagaagcuacuaccugcagccccugccccugccccccgaggaggaggaggaggagcccaccagccccgugagccaggagcccgagagaaagagcgccgagcugagcgaccagggcaagaccaccaccgacgaggagaagaagaccaagggcagaaagagaaagaccaagagcagcagcagaguggacgaguacccccagagcaacaucuacagagugccccccaacuacagccccaucagcagccagaugaugcaccacccccagagcacccuguggggcuacaaccuggugggccagccccagcagcccggcuucuuccugcagaaccagagccugacccccggcggcagcagacuggaccccgccggcagcuucgugcccaccaacaccaagcaggcccugagcaacaugcugcagagaagaagcggcgccaugaugcagccccccagccugcacgccaucaccagccagcagcagcugauccagaugaagcugcugcagcagcagcagcagcagagacugcugagacaggcccagaccagacccuuccagcagggccagcccggcgaccaggccgcccuguucgccgcccaggccagacccagcccccagcugccccaguaccccggccugcagcaggcccagaccaugccccagggcuacaccauguacggcacccagaugccccugcagcagaccagccagcagcaggccggcagcguggugcugagccccagcuacaacagcagagccuaccccgccgcccacagcaaccccgugcugauggagagacugagacagauccagcagcagcccagcggcuacgugcagcagcaggccagccccuaccugcagccccugaccggcagccagagacugaaccaccaggcccugcagcagagcccccuggugggcggcggcaucgacgccgugcugaccagcgcccaccccaaccugcccagcgugccccugccccaggaccccaugagacccagacagccccaggugagacagcagcagagacugcugcagaugcagcagccccagcagccccagccccagcagcccccccagccccagcagagcagccagagccagagccagacccugggccugcaggccaugcagccccagcagccccuguuccccagacagggccugcagcagacccagcagcagcagcagaccgccgcccuggugagacagcugcagaagcagcugagcagcaaccagccccagcagggcgugacccccuacggccaccccagccacuucuaa

SEQ ID NO: 19761 - RNA, 6525 nt, Artificial Sequence
  MED13__Homo_sapiens__NP_005112
augagcgccagcuucgugcccaacggcgccagccuggaggacugccacugcaaccuguucugccuggccgaccugaccggcaucaaguggaagaaguacguguggcagggccccaccagcgcccccauccuguuccccgugaccgaggaggaccccauccugagcagcuucagcagaugccugaaggccgacgugcugggcguguggagaagagaccagagacccggcagaagagagcuguggaucuucugguggggcgaggaccccagcuucgccgaccugauccaccacgaccugagcgaggaggaggacggcgugugggagaacggccugagcuacgagugcagaacccugcuguucaaggccgugcacaaccugcuggagagaugccugaugaacagaaacuucgugagaaucggcaagugguucgugaagcccuacgagaaggacgagaagcccaucaacaagagcgagcaccugagcugcagcuucaccuucuuccugcacggcgacagcaacgugugcaccagcguggagaucaaccagcaccagcccguguaccugcugagcgaggagcacaucacccuggcccagcagagcaacagccccuuccaggugauccugugccccuucggccugaacggcacccugaccggccaggccuucaagaugagcgacagcgccaccaagaagcugaucggcgaguggaagcaguucuaccccaucagcugcugccugaaggagaugagcgaggagaagcaggaggacauggacugggaggacgacagccuggccgccguggaggugcugguggccggcgugagaaugaucuaccccgccugcuucgugcuggugccccagagcgacauccccacccccagccccgugggcagcacccacugcagcagcagcugccugggcgugcaccaggugcccgccagcaccagagaccccgccaugagcagcgugacccugaccccccccaccagccccgaggaggugcagaccguggacccccagagcgugcagaagugggugaaguucagcagcgugagcgacggcuucaacagcgacagcaccagccaccacggcggcaagauccccagaaagcuggccaaccacgugguggacagaguguggcaggagugcaacaugaacagagcccagaacaagagaaaguacagcgccagcagcggcggccugugcgaggaggccaccgccgccaagguggccagcugggacuucguggaggccacccagagaaccaacugcagcugccugagacacaagaaccugaagagcagaaacgccggccagcagggccaggcccccagccugggccagcagcagcagauccugcccaagcacaagaccaacgagaagcaggagaagagcgagaagccccagaagagaccccugacccccuuccaccacagagugagcgugagcgacgacgugggcauggacgccgacagcgccagccagagacuggugaucagcgcccccgacagccaggugagauucagcaacaucagaaccaacgacguggccaagaccccccagaugcacggcaccgagauggccaacagcccccagccccccccccugagcccccaccccugcgacgugguggacgagggcgugaccaagacccccagcaccccccagagccagcacuucuaccagaugcccacccccgacccccuggugcccagcaagcccauggaggacagaaucgacagccugagccagagcuuccccccccaguaccaggaggccguggagcccaccguguacgugggcaccgccgugaaccuggaggaggacgaggccaacaucgccuggaaguacuacaaguuccccaagaagaaggacguggaguuccugcccccccagcugcccagcgacaaguucaaggacgaccccgugggccccuucggccaggagagcgugaccagcgugaccgagcugauggugcagugcaagaagccccugaaggugagcgacgagcuggugcagcaguaccagaucaagaaccagugccugagcgccaucgccagcgacgccgagcaggagcccaagaucgaccccuacgccuucguggagggcgacgaggaguuccuguuccccgacaagaaggacagacagaacagcgagagagaggccggcaagaagcacaagguggaggacggcaccagcagcgugaccgugcugagccacgaggaggacgccaugagccuguucagccccagcaucaagcaggacgcccccagacccaccagccacgccagaccccccagcaccagccugaucuacgacagcgaccuggccgugagcuacaccgaccuggacaaccuguucaacagcgacgaggacgagcugacccccggcagcaagaagagcgccaacggcagcgacgacaaggccagcugcaaggagagcaagaccggcaaccuggacccccugagcugcaucagcaccgccgaccugcacaagauguaccccaccccccccagccuggagcagcacaucaugggcuucagccccaugaacaugaacaacaaggaguacggcagcauggacaccacccccggcggcaccgugcuggagggcaacagcagcagcaucggcgcccaguucaagaucgagguggacgagggcuucugcagccccaagcccagcgagaucaaggacuucagcuacguguacaagcccgagaacugccagauccuggugggcugcagcauguucgccccccugaagacccugcccagccaguaccugccccccaucaagcugcccgaggagugcaucuacagacagagcuggaccgugggcaagcuggagcugcugagcagcggccccagcaugcccuucaucaaggagggcgacggcagcaacauggaccaggaguacggcaccgccuacaccccccagacccacaccagcuucggcaugccccccagcagcgccccccccagcaacagcggcgccggcauccugcccagccccagcacccccagauuccccacccccagaacccccagaacccccagaacccccagaggcgccggcggccccgccagcgcccagggcagcgugaaguacgagaacagcgaccuguacagccccgccagcacccccagcaccugcagaccccugaacagcguggagcccgccaccgugcccagcauccccgaggcccacagccuguacgugaaccugauccugagcgagagcgugaugaaccuguucaaggacugcaacuucgacagcugcugcaucugcgugugcaacaugaacaucaagggcgccgacgugggcguguacauccccgaccccacccaggaggcccaguacagaugcaccugcggcuucagcgccgugaugaacagaaaguucggcaacaacagcggccuguuccuggaggacgagcuggacaucaucggcagaaacaccgacugcggcaaggaggccgagaagagauucgaggcccugagagccaccagcgccgagcacgugaacggcggccugaaggagagcgagaagcugagcgacgaccugauccugcugcugcaggaccagugcaccaaccuguucagccccuucggcgccgccgaccaggaccccuuccccaagagcggcgugaucagcaacugggugagaguggaggagagagacugcugcaacgacugcuaccuggcccuggagcacggcagacaguucauggacaacaugagcggcggcaagguggacgaggcccuggugaagagcagcugccugcaccccuggagcaagagaaacgacgugagcaugcagugcagccaggacauccugagaaugcugcugagccugcagcccgugcugcaggacgccauccagaagaagagaaccgugagacccuggggcgugcagggcccccugaccuggcagcaguuccacaagauggccggcagaggcagcuacggcaccgacgagagccccgagccccugcccauccccaccuuccugcugggcuacgacuacgacuaccuggugcugagccccuucgcccugcccuacugggagagacugaugcuggagcccuacggcagccagagagacaucgccuacguggugcugugccccgagaacgaggcccugcugaacggcgccaagagcuucuucagagaccugaccgccaucuacgagagcugcagacugggccagcacagacccgugagcagacugcugaccgacggcaucaugagagugggcagcaccgccagcaagaagcugagcgagaagcugguggccgagugguucagccaggccgccgacggcaacaacgaggccuucagcaagcugaagcuguacgcccaggugugcagauacgaccugggccccuaccuggccagccugccccuggacagcagccugcugagccagcccaaccugguggcccccaccagccagagccugaucacccccccccagaugaccaacaccggcaacgccaacacccccagcgccacccuggccagcgccgccagcagcaccaugaccgugaccagcggcguggccaucagcaccagcguggccaccgccaacagcacccugaccaccgccagcaccagcagcagcagcagcagcaaccugaacagcggcgugagcagcaacaagcugcccagcuucccccccuucggcagcaugaacagcaacgccgccggcagcaugagcacccaggccaacaccgugcagagcggccagcugggcggccagcagaccagcgcccugcagaccgccggcaucagcggcgagagcagcagccugcccacccagccccaccccgacgugagcgagagcaccauggacagagacaaggugggcauccccaccgacggcgacagccacgccgugaccuacccccccgccaucgugguguacaucaucgaccccuucaccuacgagaacaccgacgagagcaccaacagcagcagcguguggacccugggccugcugagaugcuuccuggagauggugcagacccugcccccccacaucaagagcaccgugagcgugcagaucauccccugccaguaccugcugcagcccgugaagcacgaggacagagagaucuacccccagcaccugaagagccuggccuucagcgccuucacccagugcagaagaccccugcccaccagcaccaacgugaagacccugaccggcuucggccccggccuggccauggagaccgcccugagaagccccgacagacccgagugcaucagacuguacgccccccccuucauccuggcccccgugaaggacaagcagaccgagcugggcgagaccuucggcgaggccggccagaaguacaacgugcuguucgugggcuacugccugagccacgaccagagauggauccuggccagcugcaccgaccuguacggcgagcugcuggagaccugcaucaucaacaucgacgugcccaacagagccagaagaaagaagagcagcgccagaaaguucggccugcagaagcugugggaguggugccugggccuggugcagaugagcagccugcccuggagaguggugaucggcagacugggcagaaucggccacggcgagcugaaggacuggagcugccugcugagcagaagaaaccugcagagccugagcaagagacugaaggacaugugcagaaugugcggcaucagcgccgccgacagccccagcauccugagcgccugccugguggccauggagccccagggcagcuucgugaucaugcccgacagcgugagcaccggcagcguguucggcagaagcaccacccugaacaugcagaccagccagcugaacaccccccaggacaccagcugcacccacauccugguguuccccaccagcgccagcgugcagguggccagcgccaccuacaccaccgagaaccuggaccuggccuucaaccccaacaacgacggcgccgacggcaugggcaucuucgaccugcuggacaccggcgacgaccuggaccccgacaucaucaacauccugcccgccagccccaccggcagccccgugcacagccccggcagccacuacccccacggcggcgacgccggcaagggccagagcaccgacagacugcugagcaccgagccccacgaggaggugcccaacauccugcagcagccccuggcccugggcuacuucgugagcaccgccaaggccggcccccugcccgacugguucuggagcgccugcccccaggcccaguaccagugcccccuguuccugaaggccagccugcaccugcacgugcccagcgugcagagcgacgagcugcugcacagcaagcacagccacccccuggacagcaaccagaccagcgacgugcugagauucgugcuggagcaguacaacgcccugagcuggcugaccugcgaccccgccacccaggacagaagaagcugccugcccauccacuucguggugcugaaccagcuguacaacuucaucaugaacaugcuguaa

SEQ ID NO: 19762 - RNA, 6633 nt, Artificial Sequence
  MED13L__Homo_sapiens__NP_056150
augaccgccgccgccaacuggguggccaacggcgccagccuggaggacugccacagcaaccuguucagccuggccgagcugaccggcaucaaguggagaagauacaacuucggcggccacggcgacugcggccccaucaucagcgcccccgcccaggacgaccccauccugcugagcuucaucagaugccugcaggccaaccugcugugcguguggagaagagacgugaagcccgacugcaaggagcuguggaucuucugguggggcgacgagcccaaccuggugggcgugauccaccacgagcugcaggugguggaggagggccugugggagaacggccugagcuacgagugcagaacccugcuguucaaggccauccacaaccugcuggagagaugccugauggacaagaacuucgugagaaucggcaagugguucgugagacccuacgagaaggacgagaagcccgugaacaagagcgagcaccugagcugcgccuucaccuucuuccugcacggcgagagcaacgugugcaccagcguggagaucgcccagcaccagcccaucuaccugaucaacgaggagcacauccacauggcccagagcagccccgcccccuuccaggugcuggugagccccuacggccugaacggcacccugaccggccaggccuacaagaugagcgaccccgccaccagaaagcugaucgaggaguggcaguacuucuaccccauggugcugaagaagaaggaggagagcaaggaggaggacgagcugggcuacgacgacgacuuccccguggccguggaggugaucgugggcggcgugagaaugguguaccccagcgccuucgugcugaucagccagaacgacauccccgugccccagagcguggccagcgccggcggccacaucgccgugggccagcagggccugggcagcgugaaggaccccagcaacugcggcaugccccugaccccccccaccagccccgagcaggccauccugggcgagagcggcggcaugcagagcgccgccagccaccuggugagccaggacggcggcaugaucaccaugcacagccccaagagaagcggcaagaucccccccaagcugcacaaccacauggugcacagaguguggaaggagugcauccugaacagaacccagagcaagagaagccagaugagcacccccacccuggaggaggagcccgccagcaaccccgccaccugggacuucguggaccccacccagagagugagcugcagcugcagcagacacaagcugcugaagagaugcgccgugggccccaacagaccccccaccgugagccagcccggcuucagcgccggccccagcagcagcagcagccugcccccccccgccagcagcaagcacaagaccgccgagagacaggagaagggcgacaagcugcagaagagaccccugauccccuuccaccacagacccagcguggccgaggagcugugcauggagcaggacacccccggccagaagcugggccuggccggcaucgacagcagccuggaggugagcagcagcagaaaguacgacaagcagauggccgugcccagcagaaacaccagcaagcagaugaaccugaaccccauggacagcccccacagccccaucagcccccugccccccacccugagcccccagcccagaggccaggagaccgagagccuggacccccccagcgugcccgugaaccccgcccuguacggcaacggccuggagcugcagcagcugagcacccuggacgacagaaccgugcuggugggccagagacugccccugauggccgaggugagcgagaccgcccuguacugcggcaucagacccagcaaccccgagagcagcgagaagugguggcacagcuacagacugccccccagcgacgacgccgaguucagaccccccgagcugcagggcgagagaugcgacgccaagauggaggugaacagcgagagcaccgcccugcagagacugcuggcccagcccaacaagagauucaagaucuggcaggacaagcagccccagcugcagccccugcacuuccuggacccccugccccugagccagcagcccggcgacagccugggcgaggugaacgaccccuacaccuucgaggacggcgacaucaaguacaucuucaccgccaacaagaagugcaagcagggcaccgagaaggacagccugaagaagaacaagagcgaggacggcuucggcaccaaggacgugaccacccccggccacagcacccccgugcccgacggcaagaacgccaugagcaucuucagcagcgccaccaagaccgacgugagacaggacaacgccgccggcagagccggcagcagcagccugacccaggugaccgaccuggcccccagccugcacgaccuggacaacaucuucgacaacagcgacgacgacgagcugggcgccgugagccccgcccugagaagcagcaagaugcccgccgugggcaccgaggacagaccccugggcaaggacggcagagccgccgugcccuacccccccaccguggccgaccugcagagaauguuccccaccccccccagccuggagcagcaccccgccuucagccccgugaugaacuacaaggacggcaucagcagcgagaccgugaccgcccugggcaugauggagagccccauggugagcauggugagcacccagcugaccgaguucaagauggagguggaggacggccugggcagccccaagcccgaggagaucaaggacuucagcuacgugcacaaggugcccagcuuccagcccuucgugggcagcagcauguucgccccccugaagaugcugcccagccacugccugcugccccugaagauccccgacgccugccuguucagacccagcugggccaucccccccaagaucgagcagcugcccaugccccccgccgccaccuucaucagagacggcuacaacaacgugcccagcgugggcagccuggccgaccccgacuaccugaacaccccccagaugaacacccccgugacccugaacagcgccgcccccgccagcaacagcggcgccggcgugcugcccagccccgccacccccagauucagcgugcccacccccagaacccccagaacccccagaacccccagaggcggcggcaccgccagcggccagggcagcgugaaguacgacagcaccgaccagggcagccccgccagcacccccagcaccaccagaccccugaacagcguggagcccgccaccaugcagcccauccccgaggcccacagccuguacgugacccugauccugagcgacagcgugaugaacaucuucaaggacagaaacuucgacagcugcugcaucugcgccugcaacaugaacaucaagggcgccgacgugggccuguacauccccgacagcagcaacgaggaccaguacagaugcaccugcggcuucagcgccaucaugaacagaaagcugggcuacaacagcggccuguuccuggaggacgagcuggacaucuucggcaagaacagcgacaucggccaggccgccgagagaagacugaugaugugccagagcaccuuccugccccagguggagggcaccaagaagccccaggagccccccaucagccugcugcugcugcugcagaaccagcacacccagcccuucgccagccugaacuuccuggacuacaucagcagcaacaacagacagacccugcccugcgugagcuggagcuacgacagagugcaggccgacaacaacgacuacuggaccgagugcuucaacgcccuggagcagggcagacaguacguggacaaccccaccggcggcaagguggacgaggcccuggugagaagcgccaccgugcacagcuggccccacagcaacgugcuggacaucagcaugcugagcagccaggacguggugagaaugcugcugagccugcagcccuuccugcaggacgccauccagaagaagagaaccggcagaaccugggagaacauccagcacgugcagggcccccugaccuggcagcaguuccacaagauggccggcagaggcaccuacggcagcgaggagagccccgagccccugcccauccccacccugcuggugggcuacgacaaggacuuccugaccaucagccccuucagccugcccuucugggagagacugcugcuggaccccuacggcggccacagagacguggccuacaucguggugugccccgagaacgaggcccugcuggagggcgccaagaccuucuucagagaccugagcgccguguacgagaugugcagacugggccagcacaagcccaucugcaaggugcugagagacggcaucaugagagugggcaagaccguggcccagaagcugaccgacgagcuggugagcgagugguucaaccagcccuggagcggcgaggagaacgacaaccacagcagacugaagcuguacgcccaggugugcagacaccaccuggcccccuaccuggccacccugcagcuggacagcagccugcugaucccccccaaguaccagaccccccccgccgccgcccagggccaggccacccccggcaacgccggcccccuggcccccaacggcagcgccgccccccccgccggcagcgccuucaaccccaccagcaacagcagcagcaccaaccccgccgccagcagcagcgccagcggcagcagcgugccccccgugagcagcagcgccagcgcccccggcaucagccagaucagcaccaccagcagcagcggcuucagcggcagcgugggcggccagaaccccagcaccggcggcaucagcgccgacagaacccagggcaacaucggcugcggcggcgacaccgaccccggccagagcagcagccagcccagccaggacggccaggagagcgugaccgagagagagagaaucggcauccccaccgagcccgacagcgccgacagccacgcccacccccccgccguggugaucuacaugguggaccccuucaccuacgccgccgaggaggacagcaccagcggcaacuucuggcugcugagccugaugagaugcuacaccgagaugcuggacaaccugcccgagcacaugagaaacagcuucauccugcagaucgugcccugccaguacaugcugcagaccaugaaggacgagcagguguucuacauccaguaccugaagagcauggccuucagcguguacugccagugcagaagaccccugcccacccagauccacaucaagagccugaccggcuucggccccgccgccagcaucgagaugacccugaagaaccccgagagacccagccccauccagcuguacagcccccccuucauccuggcccccaucaaggacaagcagaccgagcugggcgagaccuucggcgaggccagccagaaguacaacgugcuguucgugggcuacugccugagccacgaccagagauggcugcuggccagcugcaccgaccugcacggcgagcugcuggagaccugcguggugaacaucgcccugcccaacagaagcagaagaagcaaggugagcgccagaaagaucggccugcagaagcugugggaguggugcaucggcaucgugcagaugaccagccugcccuggagaguggugaucggcagacugggcagacugggccacggcgagcugaaggacuggagcauccugcugggcgagugcagccugcagaccaucagcaagaagcugaaggacgugugcagaaugugcggcaucagcgccgccgacagccccagcauccugagcgccugccugguggccauggagccccagggcagcuucguggugaugcccgacgccgugaccaugggcagcguguucggcagaagcaccgcccugaacaugcagagcagccagcugaacaccccccaggacgccagcugcacccacauccugguguuccccaccagcagcaccauccagguggcccccgccaacuaccccaacgaggacggcuucagccccaacaacgacgacauguucguggaccugcccuuccccgacgacauggacaacgacaucggcauccugaugaccggcaaccugcacagcagccccaacagcagccccgugcccagccccggcagccccagcggcaucggcgugggcagccacuuccagcacagcagaagccagggcgagagacugcugagcagagaggcccccgaggagcugaagcagcagccccuggcccugggcuacuucgugagcaccgccaaggccgagaaccugccccagugguucuggagcagcugcccccaggcccagaaccagugcccccuguuccugaaggccagccugcaccaccacaucagcguggcccagaccgacgagcugcugcccgccagaaacagccagagagugccccacccccuggacagcaagaccaccagcgacgugcugagauucgugcuggagcaguacaacgcccugagcuggcugaccugcaaccccgccacccaggacagaaccagcugccugcccgugcacuucguggugcugacccagcuguacaacgccaucaugaacauccuguaa

SEQ ID NO: 19763 - RNA, 4365 nt, Artificial Sequence
  MED14__Homo_sapiens__NP_004220
auggcccccgugcagcuggagaaccaccagcuggugccccccggcggcggcggcggcggcagcggcggcccccccagcgcccccgccccccccccccccggcgccgccguggccgccgccgccgccgccgccgccagccccggcuacagacugagcacccugaucgaguuccugcugcacagagccuacagcgagcugauggugcugaccgaccugcugcccagaaagagcgacguggagagaaagaucgagaucgugcaguucgccagcagaaccagacagcuguucgugagacugcuggcccuggugaagugggccaacaacgccggcaagguggagaagugcgccaugaucagcagcuuccuggaccagcaggccauccuguucguggacaccgccgacagacuggccagccuggccagagacgcccuggugcacgccagacugcccagcuucgccauccccuacgccaucgacgugcugaccaccggcagcuaccccagacugcccaccugcaucagagacaagaucaucccccccgaccccaucaccaagaucgagaagcaggccacccugcaccagcugaaccagauccugagacacagacuggugaccaccgaccugcccccccagcuggccaaccugaccguggccaacggcagagugaaguucagaguggagggcgaguucgaggccacccugaccgugaugggcgacgaccccgacgugcccuggagacugcugaagcuggagauccugguggaggacaaggagaccggcgacggcagagcccuggugcacagcaugcagaucagcuucauccaccagcuggugcagagcagacuguucgccgacgagaagccccugcaggacauguacaacugccugcacagcuucugccugagccugcagcuggaggugcugcacagccagacccugaugcugaucagagagagauggggcgaccuggugcagguggagagauaccacgccggcaagugccugagccugagcguguggaaccagcaggugcugggcagaaagaccggcaccgccagcgugcacaaggugaccaucaagaucgacgagaacgacgugagcaagccccugcagaucuuccacgaccccccccugcccgccagcgacagcaagcugguggagagagccaugaagaucgaccaccugagcaucgagaagcugcugaucgacagcgugcacgccagagcccaccagaagcugcaggagcugaaggccauccugagaggcuucaacgccaacgagaacagcagcaucgagaccgcccugcccgcccugguggugcccauccuggagcccugcggcaacagcgagugccugcacaucuucguggaccugcacagcggcauguuccagcugaugcuguacggccuggaccaggccacccuggacgacauggagaagagcgugaacgacgacaugaagagaaucauccccuggauccagcagcugaaguucuggcugggccagcagagaugcaagcagagcaucaagcaccugcccaccaucagcagcgagacccugcagcugagcaacuacagcacccaccccaucggcaaccugagcaagaacaagcuguucaucaagcugaccagacugccccaguacuacaucgugguggagaugcuggaggugcccaacaagcccacccagcugagcuacaaguacuacuucaugagcgugaacgccgccgacagagaggacagccccgccauggcccugcugcugcagcaguucaaggagaacauccaggaccugguguucagaaccaagaccggcaagcagaccagaaccaacgccaagagaaagcugagcgacgaccccugccccguggagagcaagaagaccaagagagccggcgagaugugcgccuucaacaaggugcuggcccacuucguggccaugugcgacaccaacaugcccuucgugggccugagacuggagcugagcaaccuggagaucccccaccagggcgugcagguggagggcgacggcuucagccacgccaucagacugcugaagaucccccccugcaagggcaucaccgaggagacccagaaggcccuggacagaagccugcuggacugcaccuucagacugcagggcagaaacaacagaaccuggguggccgagcugguguucgccaacugcccccugaacggcaccagcaccagagagcagggccccagcagacacguguaccugaccuacgagaaccugcugagcgagcccgugggcggcagaaaggugguggagauguuccugaacgacuggaacagcaucgccagacuguacgagugcgugcuggaguucgccagaagccugcccgacauccccgcccaccugaacaucuucagcgaggugagaguguacaacuacagaaagcugauccugugcuacggcaccaccaagggcagcagcaucagcauccaguggaacagcauccaccagaaguuccacaucagccugggcaccgugggccccaacagcggcugcagcaacugccacaacaccauccugcaccagcugcaggagauguucaacaagacccccaacguggugcagcugcugcaggugcuguucgacacccaggccccccugaacgccaucaacaagcugcccaccgugcccaugcugggccugacccagagaaccaacaccgccuaccagugcuucagcauccugccccagagcagcacccacaucagacuggccuucagaaacauguacugcaucgacaucuacugcagaagcagaggcgugguggccaucagagacggcgccuacagccuguucgacaacagcaagcugguggagggcuucuaccccgcccccggccugaagaccuuccugaacauguucguggacagcaaccaggacgccagaagaagaagcgugaacgaggacgacaacccccccagccccaucggcggcgacaugauggacagccugaucagccagcugcagccccccccccagcagcagcccuuccccaagcagcccggcaccagcggcgccuacccccugaccagcccccccaccagcuaccacagcaccgugaaccagagccccagcaugaugcacacccagagccccggcaaccugcacgccgccagcagccccagcggcgcccugagagcccccagccccgccagcuucgugcccacccccccccccagcagccacggcaucagcaucggccccggcgccagcuucgccagcccccacggcacccuggaccccagcagccccuacaccauggugagccccagcggcagagccggcaacuggcccggcagcccccaggugagcggccccagccccgccgccagaaugcccggcaugagccccgccaaccccagccugcacagccccgugcccgacgccagccacagccccagagccggcaccagcagccagaccaugcccaccaacaugcccccccccagaaagcugccccagagaagcugggccgccagcauccccaccauccugacccacagcgcccugaacauccugcugcugcccagccccacccccggccuggugcccggccuggccggcagcuaccugugcagcccccuggagagauuccugggcagcgugaucaugagaagacaccugcagagaaucauccagcaggagacccugcagcugaucaacagcaacgagcccggcgugaucauguucaagaccgacgcccugaagugcagaguggcccugagccccaagaccaaccagacccugcagcugaaggugacccccgagaacgccggccaguggaagcccgacgagcugcaggugcuggagaaguucuucgagaccagaguggccggcccccccuucaaggccaacacccugaucgccuucaccaagcugcugggcgcccccacccacauccugagagacugcgugcacaucaugaagcuggagcuguuccccgaccaggccacccagcugaaguggaacgugcaguucugccugaccaucccccccagcgccccccccaucgccccccccggcacccccgccguggugcugaagagcaagaugcuguucuuccugcagcugacccagaagaccagcgugcccccccaggagcccgugagcaucaucgugcccaucaucuacgacauggccagcggcaccacccagcaggccgacauccccagacagcagaacagcagcguggccgcccccaugauggugagcaacauccugaagagauucgccgagaugaacccccccagacagggcgagugcaccaucuucgccgccgugagagaccugauggccaaccugacccugccccccggcggcagacccuaa

SEQ ID NO: 19764 - RNA, 2367 nt, Artificial Sequence
  MED15__Homo_sapiens__NP_001003891
auggacgugagcggccaggagaccgacuggagaagcaccgccuucagacagaagcuggugagccagaucgaggacgccaugagaaaggccggcguggcccacagcaagagcagcaaggacauggagagccacguguuccugaaggccaagaccagagacgaguaccugagccugguggccagacugaucauccacuucagagacauccacaacaagaagagccaggccagcgugagcgaccccaugaacgcccugcagagccugaccggcggccccgccgccggcgccgccggcaucggcaugccccccagaggccccggccagagccugggcggcaugggcagccugggcgccaugggccagcccaugagccugagcggccagcccccccccggcaccagcggcauggccccccacagcauggccguggugagcaccgccaccccccagacccagcugcagcugcagcagguggcccugcagcagcagcagcagcagcagcaguuccagcagcagcagcaggccgcccugcagcagcagcagcagcagcagcagcagcagcaguuccaggcccagcagagcgccaugcagcagcaguuccaggccguggugcagcagcagcagcagcugcagcagcagcagcagcagcagcagcaccugaucaagcugcaccaccagaaccagcagcagauccagcagcagcagcagcagcugcagagaaucgcccagcugcagcugcagcagcagcagcagcagcagcagcagcagcagcagcagcagcagcaggcccugcaggcccagccccccauccagcagccccccaugcagcagccccagcccccccccagccaggcccugccccagcagcugcagcagaugcaccacacccagcaccaccagccccccccccagccccagcagccccccguggcccagaaccagcccagccagcugcccccccagagccagacccagccccuggugagccaggcccaggcccugcccggccagaugcuguacacccagcccccccugaaguucgugagagcccccaugguggugcagcagccccccgugcagccccaggugcagcagcagcagaccgccgugcagaccgcccaggccgcccagaugguggcccccggcgugcagaugaucaccgaggcccuggcccagggcggcaugcacaucagagccagauucccccccaccaccgccgugagcgccauccccagcagcagcaucccccugggcagacagcccauggcccaggugagccagagcagccugcccaugcugagcagccccagccccggccagcaggugcagaccccccagagcaugcccccccccccccagcccagcccccagcccggccagcccagcagccagcccaacagcaacgugagcagcggccccgcccccagccccagcagcuuccugcccagccccagcccccagcccagccagagccccgugaccgccagaaccccccagaacuucagcgugcccagccccggcccccugaacacccccgugaaccccagcagcgugaugagccccgccggcagcagccaggccgaggagcagcaguaccuggacaagcugaagcagcugagcaaguacaucgagccccugagaagaaugaucaacaagaucgacaagaacgaggacagaaagaaggaccugagcaagaugaagagccugcuggacauccugaccgaccccagcaagagaugcccccugaagacccugcagaagugcgagaucgcccuggagaagcugaagaacgacauggccgugcccacccccccccccccccccgugccccccaccaagcagcaguaccugugccagccccugcuggacgccgugcuggccaacaucagaagccccguguucaaccacagccuguacagaaccuucgugcccgccaugaccgccauccacggcccccccaucaccgcccccguggugugcaccagaaagagaagacuggaggacgacgagagacagagcauccccagcgugcugcagggcgagguggccagacuggaccccaaguuccuggugaaccuggaccccagccacugcagcaacaacggcaccgugcaccugaucugcaagcuggacgacaaggaccugcccagcgugcccccccuggagcugagcgugcccgccgacuaccccgcccagagcccccuguggaucgacagacaguggcaguacgacgccaaccccuuccugcagagcgugcacagaugcaugaccagcagacugcugcagcugcccgacaagcacagcgugaccgcccugcugaacaccugggcccagagcgugcaccaggccugccugagcgccgccuaa

SEQ ID NO: 19765 - RNA, 2634 nt, Artificial Sequence
  MED16__Homo_sapiens__NP_005472
augugcgaccugagaagacccgccgccggcggcaugauggaccuggccuacgugugcgagugggagaaguggagcaagagcacccacugccccagcgugccccuggccugcgccuggagcugcagaaaccugaucgccuucaccauggaccugagaagcgacgaccaggaccugaccagaaugauccacauccuggacaccgagcaccccugggaccugcacagcauccccagcgagcaccacgaggccaucaccugccuggagugggaccagagcggcagcagacugcugagcgccgacgccgacggccagaucaagugcuggagcauggccgaccaccuggccaacagcugggagagcagcgugggcagccugguggagggcgaccccaucguggcccugagcuggcugcacaacggcgugaagcuggcccugcacguggagaagagcggcgccagcagcuucggcgagaaguucagcagagugaaguucagccccagccugacccuguucggcggcaagcccauggagggcuggaucgccgugaccgugagcggccuggugaccgugagccugcugaagcccagcggccaggugcugaccagcaccgagagccugugcagacugagaggcagaguggcccuggccgacaucgccuucaccggcggcggcaacaucgugguggccaccgccgacggcagcagcgccagccccgugcaguucuacaaggugugcgugagcguggugagcgagaagugcagaaucgacaccgagauccugcccagccuguucaugagaugcaccaccgaccugaacagaaaggacaaguuccccgccaucacccaccugaaguuccuggccagagacaugagcgagcaggugcugcugugcgccagcagccagaccagcagcaucguggagugcuggagccugagaaaggagggccugcccgugaacaacaucuuccagcagaucagccccguggugggcgacaagcagcccaccauccugaaguggagaauccugagcgccaccaacgaccuggacagagugagcgccguggcccugcccaagcugcccaucagccugaccaacaccgaccugaagguggccagcgacacccaguucuaccccggccugggccuggcccuggccuuccacgacggcagcgugcacaucgugcacagacugagccugcagaccauggccguguucuacagcagcgccgcccccagacccguggacgagcccgccaugaagagacccagaaccgccggccccgccgugcaccugaaggccaugcagcugagcuggaccagccuggcccuggugggcaucgacagccacggcaagcugagcgugcugagacugagccccagcaugggccacccccuggaggugggccuggcccugagacaccugcuguuccugcuggaguacugcauggugaccggcuacgacuggugggacauccugcugcacgugcagcccagcauggugcagagccugguggagaagcugcacgaggaguacaccagacagaccgccgcccugcagcaggugcugagcaccagaauccuggccaugaaggccagccugugcaagcugagccccugcaccgugaccagagugugcgacuaccacaccaagcuguuccugaucgccaucagcagcacccugaagagccugcugagaccccacuuccugaacacccccgacaagagccccggcgacagacugaccgagaucugcaccaagaucaccgacguggacaucgacaaggugaugaucaaccugaagaccgaggaguucgugcuggacaugaacacccugcaggcccugcagcagcugcugcagugggugggcgacuucgugcuguaccugcuggccagccugcccaaccagggcagccugcugagacccggccacagcuuccugagagacggcaccagccugggcaugcugagagagcugaugguggugaucagaaucuggggccugcugaagcccagcugccugcccguguacaccgccaccagcgacacccaggacagcaugagccugcuguucagacugcugaccaagcuguggaucugcugcagagacgagggccccgccagcgagcccgacgaggcccugguggacgagugcugccugcugcccagccagcugcugauccccagccuggacuggcugcccgccagcgacggccuggugagcagacugcagcccaagcagccccugagacugcaguucggcagagcccccacccugcccggcagcgccgccacccugcagcuggacggccuggccagagcccccggccagcccaagaucgaccaccugagaagacugcaccugggcgccugccccaccgaggagugcaaggccugcaccagaugcggcugcgugaccaugcugaagagccccaacagaaccaccgccgugaagcagugggagcagagauggaucaagaacugccuggccguggagggcagaggccccgacgccugcgugaccagcagagccagcgaggaggcccccgccuucgugcagcugggcccccagagcacccaccacagccccagaacccccagaagccuggaccaccugcaccccgaggacagacccuaa

SEQ ID NO: 19766 - RNA, 1956 nt, Artificial Sequence
  MED17__Homo_sapiens__NP_004259
augagcggcgugagagccgugagaaucagcaucgagagcgccugcgagaagcaggugcacgaggugggccuggacggcaccgagaccuaccugcccccccugagcaugagccagaaccuggccagacuggcccagagaaucgacuucagccagggcagcggcagcgaggaggaggaggccgccggcaccgagggcgacgcccaggaguggcccggcgccggcagcagcgccgaccaggacgacgaggagggcguggugaaguuccagcccagccuguggcccugggacagcgugagaaacaaccugagaagcgcccugaccgagaugugcgugcuguacgacgugcugagcaucgugagagacaagaaguucaugacccuggaccccgugagccaggacgcccugccccccaagcagaacccccagacccugcagcugaucagcaagaagaagagccuggccggcgccgcccagauccugcugaagggcgccgagagacugaccaagagcgugaccgagaaccaggagaacaagcugcagagagacuucaacagcgagcugcugagacugagacagcacuggaagcugagaaaggugggcgacaagauccugggcgaccugagcuacagaagcgccggcagccuguucccccaccacggcaccuucgaggugaucaagaacaccgaccuggaccuggacaagaagauccccgaggacuacugcccccuggacgugcagauccccagcgaccuggagggcagcgccuacaucaaggugagcauccagaagcaggcccccgacaucggcgaccugggcaccgugaaccuguucaagagaccccugcccaagagcaagcccggcagcccccacuggcagaccaagcuggaggccgcccagaacgugcugcugugcaaggagaucuucgcccagcugagcagagaggccgugcagaucaagagccaggugccccacaucguggugaagaaccagaucaucagccagcccuuccccagccugcagcugagcaucagccugugccacagcagcaacgacaagaagagccagaaguucgccaccgagaagcagugccccgaggaccaccuguacgugcuggagcacaaccugcaccugcugaucagagaguuccacaagcagacccugagcagcaucaugaugccccaccccgccagcgcccccuucggccacaagagaaugagacugagcggcccccaggccuucgacaagaacgagaucaacagccugcagagcagcgagggccugcuggagaagaucaucaagcaggccaagcacaucuuccugagaagcagagccgccgccaccaucgacagccuggccagcagaaucgaggacccccagauccaggcccacuggagcaacaucaacgacguguacgagagcagcgugaaggugcugaucaccagccagggcuacgagcagaucugcaagagcauccagcugcagcugaacaucggcguggagcagaucagaguggugcacagagacggcagagugaucacccugagcuaccaggagcaggagcugcaggacuuccugcugagccagaugagccagcaccaggugcacgccgugcagcagcuggccaaggugaugggcuggcaggugcugagcuucagcaaccacgugggccugggccccaucgagagcaucggcaacgccagcgccaucaccguggccagccccagcggcgacuacgccaucagcgugagaaacggccccgagagcggcagcaagaucauggugcaguuccccagaaaccagugcaaggaccugcccaagagcgacgugcugcaggacaacaaguggagccaccugagaggccccuucaaggaggugcaguggaacaagauggagggcagaaacuucguguacaagauggagcugcugaugagcgcccugagccccugccugcuguaa

SEQ ID NO: 19767 - RNA, 636 nt, Artificial Sequence
  MED19__Homo_sapiens__NP_703151
augaagaucaccaacggcagacacggcgacagcgccggcgccgagggcaccauggagaacuucaccgcccuguucggcgcccaggccgaccccccccccccccccaccgcccugggcuucggccccggcaagccccccccccccccccccccccccgccggcggcggccccggcaccgcccccccccccaccgccgccaccgccccccccggcgccgacaagagcggcgccggcugcggccccuucuaccugaugagagagcugcccggcagcaccgagcugaccggcagcaccaaccugaucacccacuacaaccuggagcaggccuacaacaaguucugcggcaagaaggugaaggagaagcugagcaacuuccugcccgaccugcccggcaugaucgaccugcccggcagccacgacaacagcagccugagaagccugaucgagaagccccccauccugagcagcagcuucaaccccaucaccggcaccaugcuggccggcuucagacugcacaccggcccccugcccgagcagugcagacugaugcacauccagccccccaagaagaagaacaagcacaagcacaagcagagcagaacccaggaccccgugccccccggcaagcccagcuaa

SEQ ID NO: 19768 - RNA, 4746 nt, Artificial Sequence
  MED1__Homo_sapiens__NP_004765
augaaggcccagggcgagaccgaggagagcgagaagcugagcaagaugagcagccugcuggagagacugcacgccaaguucaaccagaacagacccuggagcgagaccaucaagcuggugagacaggugauggagaagagaguggugaugagcagcggcggccaccagcaccuggugagcugccuggagacccugcagaaggcccugaaggugaccagccugcccgccaugaccgacagacuggagagcaucgccagacagaacggccugggcagccaccugagcgccagcggcaccgagugcuacaucaccagcgacauguucuacguggaggugcagcuggaccccgccggccagcugugcgacgugaagguggcccaccacggcgagaaccccgugagcugccccgagcuggugcagcagcugagagagaagaacuucgacgaguucagcaagcaccugaagggccuggugaaccuguacaaccugcccggcgacaacaagcugaagaccaagauguaccuggcccugcagagccuggagcaggaccugagcaagauggccaucauguacuggaaggccaccaacgccggcccccuggacaagauccugcacggcagcgugggcuaccugacccccagaagcggcggccaccugaugaaccugaaguacuacgugagccccagcgaccugcuggacgacaagaccgccagccccaucauccugcacgagaacaacgugagcagaagccugggcaugaacgccagcgugaccaucgagggcaccagcgccguguacaagcugcccaucgccccccugaucaugggcagccaccccguggacaacaaguggacccccagcuucagcagcaucaccagcgccaacagcguggaccugcccgccugcuucuuccugaaguucccccagcccauccccgugagcagagccuucgugcagaagcugcagaacugcaccggcaucccccuguucgagacccagcccaccuacgccccccuguacgagcugaucacccaguucgagcugagcaaggaccccgaccccaucccccugaaccacaacaugagauucuacgccgcccugcccggccagcagcacugcuacuuccugaacaaggacgccccccugcccgacggcagaagccugcagggcacccuggugagcaagaucaccuuccagcaccccggcagagugccccugauccugaaccugaucagacaccagguggccuacaacacccugaucggcagcugcgugaagagaaccauccugaaggaggacagccccggccugcugcaguucgaggugugcccccugagcgagagcagauucagcgugagcuuccagcaccccgugaacgacagccuggugugcguggugauggacgugcaggacagcacccacgugagcugcaagcuguacaagggccugagcgacgcccugaucugcaccgacgacuucaucgccaagguggugcagagaugcaugagcauccccgugaccaugagagccaucagaagaaaggccgagaccauccaggccgacacccccgcccugagccugaucgccgagaccguggaggacauggugaagaagaaccugccccccgccagcagccccggcuacggcaugaccaccggcaacaaccccaugagcggcaccaccacccccaccaacaccuuccccggcggccccaucaccacccuguucaacaugagcaugagcaucaaggacagacacgagagcgugggccacggcgaggacuucagcaaggugagccagaaccccauccugaccagccugcugcagaucaccggcaacggcggcagcaccaucggcagcagccccacccccccccaccacacccccccccccgugagcagcauggccggcaacaccaagaaccaccccaugcugaugaaccugcugaaggacaaccccgcccaggacuucagcacccuguacggcagcagcccccuggagagacagaacagcagcagcggcagccccagaauggagaucugcagcggcagcaacaagaccaagaagaagaagagcagcagacugccccccgagaagcccaagcaccagaccgaggacgacuuccagagagagcuguucagcauggacguggacagccagaaccccaucuucgacgugaacaugaccgccgacacccuggacaccccccacaucacccccgcccccagccagugcagcaccccccccaccaccuacccccagcccgugccccacccccagcccagcauccagagaauggugagacugagcagcagcgacagcaucggccccgacgugaccgacauccugagcgacaucgccgaggaggccagcaagcugcccagcaccagcgacgacugccccgccaucggcaccccccugagagacagcagcagcagcggccacagccagagcacccuguucgacagcgacguguuccagaccaacaacaacgagaaccccuacaccgaccccgccgaccugaucgccgacgccgccggcagccccagcagcgacagccccaccaaccacuucuuccacgacggcguggacuucaaccccgaccugcugaacagccagagccagagcggcuucggcgaggaguacuucgacgagagcagccagagcggcgacaacgacgacuucaagggcuucgccagccaggcccugaacacccugggcgugcccaugcugggcggcgacaacggcgagaccaaguucaagggcaacaaccaggccgacaccguggacuucagcaucaucagcguggccggcaaggcccuggcccccgccgaccugauggagcaccacagcggcagccagggcccccugcugaccaccggcgaccugggcaaggagaagacccagaagagagugaaggagggcaacggcaccagcaacagcacccugagcggccccggccuggacagcaagcccggcaagagaagcagaacccccagcaacgacggcaagagcaaggacaagccccccaagagaaagaaggccgacaccgagggcaagagccccagccacagcagcagcaacagacccuucaccccccccaccagcaccggcggcagcaagagccccggcagcgccggcagaagccagaccccccccggcguggccaccccccccauccccaagaucaccauccagauccccaagggcaccgugauggugggcaagcccagcagccacagccaguacaccagcagcggcagcgugagcagcagcggcagcaagagccaccacagccacagcagcagcagcagcagcagcgccagcaccagcggcaagaugaagagcagcaagagcgagggcagcagcagcagcaagcugagcagcagcauguacagcagccagggcagcagcggcagcagccagagcaagaacagcagccagagcggcggcaagcccggcagcagccccaucaccaagcacggccugagcagcggcagcagcagcaccaagaugaagccccagggcaagcccagcagccugaugaaccccagccugagcaagcccaacaucagccccagccacagcagaccccccggcggcagcgacaagcuggccagccccaugaagcccgugcccggcaccccccccagcagcaaggccaagagccccaucagcagcggcagcggcggcagccacaugagcggcaccagcagcagcagcggcaugaagagcagcagcggccugggcagcagcggcagccugagccagaagaccccccccagcagcaacagcugcaccgccagcagcagcagcuucagcagcagcggcagcagcaugagcagcagccagaaccagcacggcagcagcaagggcaagagccccagcagaaacaagaagcccagccugaccgccgugaucgacaagcugaagcacggcguggugaccagcggccccggcggcgaggacccccuggacggccagaugggcgugagcaccaacagcagcagccaccccaugagcagcaagcacaacaugagcggcggcgaguuccagggcaagagagagaagagcgacaaggacaagagcaaggugagcaccagcggcagcagcguggacagcagcaagaagaccagcgagagcaagaacgugggcagcaccggcguggccaagaucaucaucagcaagcacgacggcggcagccccagcaucaaggccaaggugacccugcagaagcccggcgagagcagcggcgagggccugagaccccagauggccagcagcaagaacuacggcagcccccugaucagcggcagcacccccaagcacgagagaggcagccccagccacagcaagagccccgccuacaccccccagaaccuggacagcgagagcgagagcggcagcagcaucgccgagaagagcuaccagaacagccccagcagcgacgacggcaucagaccccugcccgaguacagcaccgagaagcacaagaagcacaagaaggagaagaagaaggugaaggacaaggacagagacagagacagagacaaggacagagacaagaagaagagccacagcaucaagcccgagagcuggagcaagagccccaucagcagcgaccagagccugagcaugaccagcaacaccauccugagcgccgacagacccagcagacugagccccgacuucaugaucggcgaggaggacgacgaccugauggacguggcccugaucggcaacuaa

SEQ ID NO: 19769 - RNA, 603 nt, Artificial Sequence
  MED22__Homo_sapiens__NP_598395
auggcccagcagagagcccugccccagagcaaggagacccugcugcagagcuacaacaagagacugaaggacgacaucaagagcaucauggacaacuucaccgagaucaucaagaccgccaagaucgaggacgagacccaggugagcagagccacccagggcgagcaggacaacuacgagaugcacgugagagccgccaacaucgugagagccggcgagagccugaugaagcuggugagcgaccugaagcaguuccugauccugaacgacuuccccagcgugaacgaggccaucgaccagagaaaccagcagcugagaacccugcaggaggagugcgacagaaagcugaucacccugagagacgagaucagcaucgaccuguacgagcuggaggaggaguacuacagcagcagcagcagccugugcgaggccaacgaccugccccugugcgaggccuacggcagacuggaccuggacaccgacagcgccgacggccugagcgccccccugcuggccagccccgagcccagcgccggcccccugcagguggccgcccccgcccacagccacgccggcggccccggccccaccgagcacgccuaa

SEQ ID NO: 19770 - RNA, 4095 nt, Artificial Sequence
  MED23__Homo_sapiens__NP_001257451
auggagacccagcugcagagcaucuucgaggagguggugaagaccgaggugaucgaggaggccuuccccggcauguucauggacacccccgaggacgagaagaccaagcugaucagcugccugggcgccuucagacaguucuggggcggccugagccaggagagccacgagcagugcauccaguggaucgugaaguucauccacggccagcacagccccaagagaaucagcuuccuguacgacugccuggccauggccguggagaccggccugcugccccccagacuggugugcgagagccugaucaacagcgacacccuggagugggagagaacccagcugugggcccugaccuucaagcuggugagaaagaucaucggcggcguggacuacaagggcgugagagaccugcugaaggugauccuggagaagauccugaccauccccaacaccgugagcagcgccguggugcagcagcugcuggccgccagagaggugaucgccuacauccuggagagaaacgccugccugcugcccgccuacuucgccgugaccgagaucagaaagcuguaccccgagggcaagcugccccacuggcugcugggcaaccuggugagcgacuucguggacaccuucagacccaccgccagaaucaacagcaucugcggcagaugcagccugcugcccguggugaacaacagcggcgccaucugcaacagcuggaagcuggaccccgccacccugagauucccccugaagggccugcugcccuacgacaaggaccuguucgagccccagaccgcccugcugagauacgugcuggagcagcccuacagcagagacauggugugcaacaugcugggccugaacaagcagcacaagcagagaugccccgugcuggaggaccagcugguggaccuggugguguacgccauggagagaagcgagaccgaggagaaguucgacgacggcggcaccagccagcugcuguggcagcaccugagcagccagcugaucuucuucgugcuguuccaguucgccagcuucccccacauggugcugagccugcaccagaagcuggccggcagaggccugaucaagggcagagaccaccugaugugggugcugcugcaguucaucagcggcagcauccagaagaacgcccuggccgacuuccugcccgugaugaagcuguucgaccugcuguaccccgagaaggaguacauccccgugcccgacaucaacaagccccagagcacccacgccuucgccaugaccugcaucuggauccaccugaacagaaaggcccagaacgacaacagcaagcugcagauccccaucccccacagccugagacugcaccacgaguuccugcagcagagccugagaaacaagagccugcagaugaacgacuacaagaucgcccugcugugcaacgccuacagcaccaacagcgagugcuucacccugcccaugggcgcccugguggagaccaucuacggcaacggcaucaugagaaucccccugcccggcaccaacugcauggccagcggcagcaucaccccccugcccaugaaccugcuggacagccugaccgugcacgccaagaugagccugauccacagcaucgccaccagagugaucaagcuggcccacgccaagagcagcguggcccuggcccccgcccugguggagaccuacagcagacugcugguguacauggagaucgagagccugggcaucaagggcuucaucagccagcugcugcccaccguguucaagagccacgccuggggcauccugcacacccugcuggagauguucagcuacagaaugcaccacauccagccccacuacagagugcagcugcugagccaccugcacacccuggccgccguggcccagaccaaccagaaccagcugcaccugugcguggagagcaccgcccugagacugaucaccgcccugggcagcagcgaggugcagccccaguucaccagauuccugagcgaccccaagaccgugcugagcgccgagagcgaggagcugaacagagcccugauccugacccuggccagagccacccacgugaccgacuucuucaccggcagcgacagcauccagggcaccuggugcaaggacauccugcagaccaucaugagcuucaccccccacaacugggccagccacacccugagcugcuuccccggcccccugcaggccuucuucaagcagaacaacgugccccaggagagcagauucaaccugaagaagaacguggaggaggaguacagaaaguggaagagcaugagcaacgagaacgacaucaucacccacuucagcaugcagggcagccccccccuguuccugugccugcuguggaagaugcugcuggagaccgaccacaucaaccagaucggcuacagagugcuggagagaaucggcgccagagcccugguggcccacgugagaaccuucgccgacuuccugguguacgaguucagcaccagcgccggcggccagcagcugaacaagugcaucgagauccugaacgacaugguguggaaguacaacaucgugacccuggacagacugauccugugccuggccaugagaagccacgagggcaacgaggcccaggugugcuacuucaucauccagcugcugcugcugaagcccaacgacuucagaaacagagugagcgacuucgugaaggagaacagccccgagcacuggcugcagaacgacuggcacaccaagcacaugaacuaccacaagaaguaccccgagaagcuguacuucgagggccuggccgagcagguggacccccccgugcagauccagagccccuaccugcccaucuacuucggcaacgugugccugagauuccugcccguguucgacaucgugauccacagauuccuggagcugcugcccgugagcaagagccuggagacccugcuggaccaccugggcggccuguacaaguuccacgacagacccgugaccuaccuguacaacacccugcacuacuacgagaugcaccugagagacagagccuuccugaagagaaagcuggugcacgccaucaucggcagccugaaggacaacagaccccagggcuggugccugagcgacaccuaccugaagugcgccaugaacgccagagaggagaaccccugggugcccgacgacaccuacuacugcagacugaucggcagacugguggacaccauggccggcaagagccccggccccuuccccaacugcgacuggagauucaacgaguuccccaaccccgccgcccacgcccugcacgugaccugcguggagcugauggcccuggccgugagcggcaaggaggugggcaacgcccugcugaacguggugcugaagagccagccccuggugcccagagagaacaucaccgccuggaugaacgccaucggccugaucaucaccgcccugcccgagcccuacuggaucgugcugcacgacagaaucgugagcgugaucagcagccccagccugaccagcgagaccgagugggugggcuaccccuucagacuguucgacuucaccgccugccaccagagcuacagcgagaugagcugcagcuacacccuggcccuggcccacgccguguggcaccacagcagcaucggccagcugagccugauccccaaguuccugaccgaggugcugcugcccaucgugaagaccgaguuccagcugcuguacguguaccaccuggugggccccuuccugcagagauuccagcaggagagaaccagaugcaugaucgagaucggcguggccuucuacgacaugcugcugaacguggaccagugcagcacccaccugaacuacauggaccccaucugcgacuuccuguaccacaugaaguacauguucaccggcgacagcgugaaggagcagguggagaagaucaucugcaaccugaagcccgcccugaagcugagacugagauucaucacccacaucagcaagauggagcccgccgccgugcccccccaggccaugaacagcggcagccccgccccccagagcaaccagguggacacccugaccuaa

SEQ ID NO: 19771 - RNA, 2931 nt, Artificial Sequence
  MED24__Homo_sapiens__NP_001072986
augaagguggugaaccugaagcaggccauccugcaggccuggaaggagagauggagcgacuaccagugggccaucaacaugaagaaguucuuccccaagggcgccaccugggacauccugaaccuggccgacgcccugcuggagcaggccaugaucggccccagccccaacccccugauccugagcuaccugaaguacgccaucagcagccaguucgacgacuucagcagagaccugugcgugcaggcccugcuggacaucauggacauguucugcgacagacugagcugccacggcaaggccgaggagugcaucggccugugcagagcccugcugagcgcccugcacuggcugcugagaugcaccgccgccagcgccgagagacugagagagggccuggaggccggcacccccgccgccggcgagaagcagcuggccaugugccugcagagacuggagaagacccugagcagcaccaagaacagagcccugcugcacaucgccaagcuggaggaggccagcagcuggaccgccaucgagcacagccugcugaagcugggcgagauccuggccaaccugagcaacccccagcugagaagccaggccgagcagugcggcacccugaucagaagcauccccaccaugcugagcgugcacgccgagcagaugcacaagaccggcuuccccaccgugcacgccgugauccugcuggagggcaccaugaaccugaccggcgagacccagagccugguggagcagcugaccauggugaagagaaugcagcacauccccaccccccuguucgugcuggagaucuggaaggccugcuucgugggccugaucgagagccccgagggcaccgaggagcugaaguggaccgccuucaccuuccugaagaucccccaggugcuggugaagcugaagaaguacagccacggcgacaaggacuucaccgaggacgugaacugcgccuucgaguuccugcugaagcugaccccccugcuggacaaggccgaccagagaugcaacugcgacugcaccaacuuccugcugcaggagugcggcaagcagggccugcugagcgaggccagcgugaacaaccugauggccaagagaaaggccgacagagagcacgccccccagcagaagagcggcgagaacgccaacauccagcccaacauccagcugauccugagagccgagcccaccgugaccaacauccugaagaccauggacgccgaccacagcaagagccccgagggccugcugggcgugcugggccacaugcugagcggcaagagccuggaccugcugcuggccgccgccgccgccaccggcaagcugaagagcuucgccagaaaguucaucaaccugaacgaguucaccaccuacggcagcgaggagagcaccaagcccgccagcgugagagcccugcuguucgacaucagcuuccugaugcugugccacguggcccagaccuacggcagcgaggugauccugagcgagagcagaaccggcgccgaggugcccuucuucgagaccuggaugcagaccugcaugcccgaggagggcaagauccugaaccccgaccaccccugcuucagacccgacagcaccaagguggagagccugguggcccugcugaacaacagcagcgagaugaagcuggugcagaugaaguggcacgaggccugccugagcaucagcgccgccauccuggagauccugaacgccugggagaacggcgugcuggccuucgagagcauccagaagaucaccgacaacaucaagggcaaggugugcagccuggccgugugcgccguggccuggcugguggcccacgugagaaugcugggccuggacgagagagagaagagccugcagaugaucagacagcuggccggcccccuguucagcgagaacacccugcaguucuacaacgagagaguggugaucaugaacagcauccuggagagaaugugcgccgacgugcugcagcagaccgccacccagaucaaguuccccagcaccggcguggacaccaugcccuacuggaaccugcugccccccaagagacccaucaaggaggugcugaccgacaucuucgccaaggugcuggagaagggcuggguggacagcagaagcauccacaucuucgacacccugcugcacaugggcggcguguacugguucugcaacaaccugaucaaggagcugcugaaggagaccagaaaggagcacacccugagagccguggagcugcuguacagcaucuucugccuggacaugcagcaggugacccuggugcugcugggccacauccugcccggccugcugaccgacagcagcaaguggcacagccugauggacccccccggcaccgcccuggccaagcuggccguguggugcgcccugagcagcuacagcagccacaagggccaggccagcaccagacagaagaagagacacagagaggacaucgaggacuacaucagccuguucccccuggacgacgugcagcccagcaagcugaugagacugcugagcagcaacgaggacgacgccaacauccugagcagccccaccgacagaagcaugagcagcagccugagcgccagccagcugcacaccgugaacaugagagacccccugaacagagugcuggccaaccuguuccugcugaucagcagcauccugggcagcagaaccgccggcccccacacccaguucgugcagugguucauggaggagugcguggacugccuggagcagggcggcagaggcagcgugcugcaguucaugcccuucaccaccgugagcgagcuggugaaggugagcgccaugagcagccccaagguggugcuggccaucaccgaccugagccugccccugggcagacagguggccgccaaggccaucgccgcccuguaa

SEQ ID NO: 19772 - RNA, 2244 nt, Artificial Sequence
  MED25__Homo_sapiens__NP_112235
auggugcccggcagcgagggccccgccagagccggcagcgugguggccgacgugguguucgugaucgagggcaccgccaaccugggccccuacuucgagggccugagaaagcacuaccugcugcccgccaucgaguacuucaacggcggcccccccgccgagaccgacuucggcggcgacuacggcggcacccaguacagccuggugguguucaacaccguggacugcgcccccgagagcuacgugcagugccacgcccccaccagcagcgccuacgaguucgugaccuggcuggacggcaucaaguucaugggcggcggcggcgagagcugcagccugaucgccgagggccugagcaccgcccugcagcuguucgacgacuucaagaagaugagagagcagaucggccagacccacagagugugccugcugaucugcaacagcccccccuaccugcugcccgccguggagagcaccaccuacagcggcugcaccaccgagaaccuggugcagcagaucggcgagagaggcauccacuucagcaucgugagccccagaaagcugcccgcccugagacugcuguucgagaaggccgccccccccgcccugcuggagccccugcagccccccaccgacgugagccaggaccccagacacauggugcuggugagaggccuggugcugcccgugggcggcggcagcgcccccggcccccugcagagcaagcagcccgugccccugccccccgccgcccccagcggcgccacccugagcgccgccccccagcagccccugccccccgugcccccccaguaccaggugcccggcaaccugagcgccgcccagguggccgcccagaacgccguggaggccgccaagaaccagaaggccggccugggccccagauucagccccaucaccccccugcagcaggccgcccccggcgugggcccccccuucagccaggcccccgccccccagcugccccccggcccccccggcgcccccaagcccccccccgccagccagcccagccuggugagcaccguggcccccggcagcggccuggcccccaccgcccagcccggcgcccccagcauggccggcaccguggcccccggcggcgugagcggccccagccccgcccagcugggcgcccccgcccugggcggccagcagagcgugagcaacaagcugcuggccuggagcggcgugcuggaguggcaggagaagcccaagcccgccagcguggacgccaacaccaagcugaccagaagccugcccugccagguguacgugaaccacggcgagaaccugaagaccgagcaguggccccagaagcugaucaugcagcugaucccccagcagcugcugaccacccugggcccccuguucagaaacagcagaauggugcaguuccacuucaccaacaaggaccuggagagccugaagggccuguacagaaucaugggcaacggcuucgccggcugcgugcacuucccccacaccgcccccugcgaggugagagugcugaugcugcuguacagcagcaagaagaagaucuucaugggccugauccccuacgaccagagcggcuucgugaacggcaucagacaggugaucaccaaccacaagcaggugcagcagcagaagcuggagcagcagcagagaggcaugggcggccagcaggccccccccggccugggccccauccuggaggaccaggccagacccagccagaaccugcugcagcugagacccccccagccccagccccagggcaccgugggcgccagcggcgccaccggccagccccagccccagggcaccgcccagcccccccccggcgccccccagggcccccccggcgccgccagcggcccccccccccccggccccauccugagaccccagaaccccggcgccaacccccagcugagaagccugcugcugaaccccccccccccccagaccggcgugccccccccccaggccagccugcaccaccugcagccccccggcgcccccgcccugcugccccccccccaccagggccugggccagccccagcugggccccccccugcugcaccccccccccgcccagagcuggcccgcccagcugccccccagagccccccugcccggccagaugcugcugagcggcggccccagaggccccgugccccagcccggccugcagcccagcgugauggaggacgacauccugauggaccugaucuaa

SEQ ID NO: 19773 - RNA, 537 nt, Artificial Sequence
  MED28__Homo_sapiens__NP_079481
auggccgccccccugggcggcauguucagcggccagccccccggccccccccaggccccccccggccugcccggccaggccagccugcugcaggccgcccccggcgcccccagacccagcagcagcacccugguggacgagcuggagagcagcuucgaggccugcuucgccagccuggugagccaggacuacgugaacggcaccgaccaggaggagaucagaaccggcguggaccagugcauccagaaguuccuggacaucgccagacagaccgagugcuucuuccugcagaagagacugcagcugagcgugcagaagcccgagcaggugaucaaggaggacgugagcgagcugagaaacgagcugcagagaaaggacgcccuggugcagaagcaccugaccaagcugagacacuggcagcaggugcuggaggacaucaacgugcagcacaagaagcccgccgacaucccccagggcagccuggccuaccuggagcaggccagcgccaacauccccgccccccugaagcccaccuaa

SEQ ID NO: 19774 - RNA, 666 nt, Artificial Sequence
  MED29__Homo_sapiens__NP_060062
augcugaagagcaacggcgagagaagaagcagaaacgcccugcccgccguguacgccagaaagauggccgccagccagcagcaggccagcgccgccagcagcgccgccggcgugagcggccccagcagcgccggcggccccggcccccagcagcagccccagccccccgcccagcuggugggccccgcccagagcggccugcugcagcagcagcagcaggacuucgaccccgugcagagauacaagaugcugaucccccagcugaaggagagccugcagacccugaugaagguggccgcccagaaccugauccagaacaccaacaucgacaacggccagaagagcagcgacggccccauccagagauucgacaagugccuggaggaguucuacgcccugugcgaccagcuggagcugugccugagacuggcccacgagugccugagccagagcugcgacagcgccaagcacagccccacccuggugcccaccgccaccaagcccgacgccgugcagcccgacagccugcccuacccccaguaccuggccgugaucaaggcccagaucagcugcgccaaggacauccacaccgcccugcuggacugcgccaacaaggugaccggcaagacccccgccccccccgccggccccggcggcacccuguaa

SEQ ID NO: 19775 - RNA, 537 nt, Artificial Sequence
  MED30__Homo_sapiens__NP_542382
augagcacccccccccuggccgccagcggcauggcccccggccccuucgccggcccccaggcccagcaggccgccagagaggugaacaccgccagccugugcagaaucggccaggagaccgugcaggacaucguguacagaaccauggagaucuuccagcugcugagaaacaugcagcugcccaacggcgugaccuaccacaccggcaccuaccaggacagacugaccaagcugcaggacaaccugagacagcugagcgugcuguucagaaagcugagacugguguacgacaagugcaacgagaacugcggcggcauggaccccauccccguggagcagcugauccccuacguggaggaggacggcagcaagaacgacgacagagccggcccccccagauucgccagcgaggagagaagagagaucgccgaggugaacaagaagcugaagcagaagaaccagcagcugaagcagaucauggaccagcugagaaaccugaucugggacaucaacgccaugcuggccaugagaaacuaa

SEQ ID NO: 19776 - RNA, 675 nt, Artificial Sequence
  MED4__Homo_sapiens__NP_001257558
augcuggccaucagcagaaaccagaagcugcugcaggccggcgaggagaaccaggugcuggagcugcugauccacagagacggcgaguuccaggagcugaugaagcuggcccugaaccagggcaagauccaccacgagaugcaggugcuggagaaggagguggagaagagagacagcgacauccagcagcugcagaagcagcugaaggaggccgagcagauccuggccaccgccguguaccaggccaaggagaagcugaagagcaucgagaaggccagaaagggcgccaucagcagcgaggagaucaucaaguacgcccacagaaucagcgccagcaacgccgugugcgccccccugaccugggugcccggcgaccccagaagacccuaccccaccgaccuggagaugagaagcggccugcugggccagaugaacaaccccagcaccaacggcgugaacggccaccugcccggcgacgcccuggccgccggcagacugcccgacgugcuggccccccaguaccccuggcagagcaacgacaugagcaugaacaugcugccccccaaccacagcagcgacuuccugcuggagccccccggccacaacaaggagaacgaggacgacguggagaucaugagcaccgacagcagcagcagcagcagcgagagcgacuaa

SEQ ID NO: 19777 - RNA, 762 nt, Artificial Sequence
  MED6__Homo_sapiens__NP_001271138
auggccgccguggacaucagagacaaccugcugggcaucagcuggguggacagcagcuggauccccauccugaacagcggcagcgugcuggacuacuucagcgagagaagcaaccccuucuacgacagaaccugcaacaacgagguggugaagaugcagagacugacccuggagcaccugaaccagauggugggcaucgaguacauccugcugcacgcccaggagcccauccuguucaucaucagaaagcagcagagacagagccccgcccaggugaucccccuggccgacuacuacaucaucgccggcgugaucuaccaggcccccgaccugggcagcgugaucaacagcagagugagccuguucagcuucuacaagcugaccgccgugcacggcauccagagcgccuucgacgaggccaugagcuacugcagauaccaccccagcaagggcuacugguggcacuucaaggaccacgaggagcaggacaaggugagacccaaggccaagagaaaggaggagcccagcagcaucuuccagagacagagaguggacgcccugcugcuggaccugagacagaaguucccccccaaguucgugcagcugaagcccggcgagaagcccgugcccguggaccagaccaagaaggaggccgagcccauccccgagaccgugaagcccgaggagaaggagaccaccaagaacgugcagcagaccgugagcgccaagggcccccccgagaagagaaugagacugcaguaa

SEQ ID NO: 19778 - RNA, 441 nt, Artificial Sequence
  MED9__Homo_sapiens__NP_060489
auggccagcgccggcguggccgccggcagacaggccgaggacgugcugccccccaccagcgaccagccccugcccgacaccaagccccugccccccccccagcccccccccgugcccgccccccagccccagcagagccccgcccccagaccccagagccccgccagagccagagaggaggagaacuacagcuuccugccccuggugcacaacaucaucaagugcauggacaaggacagccccgaggugcaccaggaccugaacgcccugaagagcaaguuccaggagaugagaaagcugaucagcaccaugcccggcauccaccugagccccgagcagcagcagcagcagcugcagagccugagagagcaggugagaaccaagaacgagcugcugcagaaguacaagagccugugcauguucgagauccccaaggaguaa

SEQ ID NO: 19779 - RNA, 1500 nt, Artificial Sequence
  MEF2A__Homo_sapiens__NP_005578
augggcagaaagaagauccagaucaccagaaucauggacgagagaaacagacaggugaccuucaccaagagaaaguucggccugaugaagaaggccuacgagcugagcgugcugugcgacugcgagaucgcccugaucaucuucaacagcagcaacaagcuguuccaguacgccagcaccgacauggacaaggugcugcugaaguacaccgaguacaacgagccccacgagagcagaaccaacagcgacaucguggaggcccugaacaagaaggagcacagaggcugcgacagccccgaccccgacaccagcuacgugcugaccccccacaccgaggagaaguacaagaagaucaacgaggaguucgacaacaugaugagaaaccacaagaucgcccccggccugcccccccagaacuucagcaugagcgugaccgugcccgugaccagccccaacgcccugagcuacaccaaccccggcagcagccuggugagccccagccuggccgccagcagcacccugaccgacagcagcaugcugagccccccccagaccacccugcacagaaacgugagccccggcgccccccagagaccccccagcaccggcaacgccggcggcaugcugagcaccaccgaccugaccgugcccaacggcgccggcagcagccccgugggcaacggcuucgugaacagcagagccagccccaaccugaucggcgccaccggcgccaacagccugggcaaggugaugcccaccaagagcccccccccccccggcggcggcaaccugggcaugaacagcagaaagcccgaccugagaguggugaucccccccagcagcaagggcaugaugcccccccugaacacccagagaaucagcagcagccaggccacccagccccuggccacccccguggugagcgugaccacccccagccugcccccccagggccugguguacagcgccaugcccaccgccuacaacaccgacuacagccugaccagcgccgaccugagcgcccugcagggcuucaacagccccggcaugcugagccugggccaggugagcgccuggcagcagcaccaccugggccaggccgcccugagcagccugguggccggcggccagcugagccagggcagcaaccugagcaucaacaccaaccagaacaucagcaucaagagcgagcccaucagcccccccagagacagaaugacccccagcggcuuccagcagcagcagcagcagcagcagcagcagcagccccccccccccccccagccccagccccagcccccccagccccagcccagacaggagaugggcagaagccccguggacagccugagcagcagcagcagcagcuacgacggcagcgacagagaggaccccagaggcgacuuccacagccccaucgugcugggcagaccccccaacaccgaggacagagagagccccagcgugaagagaaugagaauggacgccugggugaccuaa

SEQ ID NO: 19780 - RNA, 1107 nt, Artificial Sequence
  MEF2B__Homo_sapiens__NP_001139257
augggcagaaagaagauccagaucagcagaauccuggaccagagaaacagacaggugaccuucaccaagagaaaguucggccugaugaagaaggccuacgagcugagcgugcugugcgacugcgagaucgcccugaucaucuucaacagcgccaacagacuguuccaguacgccagcaccgacauggacagagugcugcugaaguacaccgaguacagcgagccccacgagagcagaaccaacaccgacauccuggagacccugaagagaagaggcaucggccuggacggccccgagcuggagcccgacgagggccccgaggagcccggcgagaaguucagaagacuggccggcgagggcggcgaccccgcccugcccagacccagacuguaccccgccgcccccgccaugcccagccccgacgugguguacggcgcccugcccccccccggcugcgaccccagcggccugggcgaggcccugcccgcccagagcagacccagccccuucagacccgccgcccccaaggccggcccccccggccuggugcacccccuguucagccccagccaccugaccagcaagaccccccccccccuguaccugcccaccgagggcagaagaagcgaccugcccggcggccuggccggccccagaggcggccugaacaccagcagaagccuguacagcggccugcagaaccccugcagcaccgccacccccggccccccccugggcagcuuccccuuccugcccggcggcccccccgaguacggccugggcgaccccccccccccccccggccugcugcagccccccacccuggcccccuggcagcccagcagaggcgacggcccccccgccgugagcagccagcccagcggcggcagaagccugggcgaggagggcccccccaccagaggcgccagcccccccaccccccccgugagcaucaagagcgagagacugagccccgcccccggcggccccggcgacuuccccaagaccuuccccuacccccugcugcuggccagaagccuggccgagccccugagacccggccccgcccugagaagacugccccuggccgacggcuggcccagauaa

SEQ ID NO: 19781 - RNA, 1098 nt, Artificial Sequence
  MEF2BNB-MEF2B__Homo_sapiens__NP_005910
augggcagaaagaagauccagaucagcagaauccuggaccagagaaacagacaggugaccuucaccaagagaaaguucggccugaugaagaaggccuacgagcugagcgugcugugcgacugcgagaucgcccugaucaucuucaacagcgccaacagacuguuccaguacgccagcaccgacauggacagagugcugcugaaguacaccgaguacagcgagccccacgagagcagaaccaacaccgacauccuggagacccugaagagaagaggcaucggccuggacggccccgagcuggagcccgacgagggccccgaggagcccggcgagaaguucagaagacuggccggcgagggcggcgaccccgcccugcccagacccagacuguaccccgccgcccccgccaugcccagccccgacgugguguacggcgcccugcccccccccggcugcgaccccagcggccugggcgaggcccugcccgcccagagcagacccagccccuucagacccgccgcccccaaggccggcccccccggccuggugcacccccuguucagccccagccaccugaccagcaagaccccccccccccuguaccugcccaccgagggcagaagaagcgaccugcccggcggccuggccggccccagaggcggccugaacaccagcagaagccuguacagcggccugcagaaccccugcagcaccgccacccccggccccccccugggcagcuuccccuuccugcccggcggcccccccgugggcgccgaggccugggccagaagagugccccagcccgccgccccccccagaagacccccccagagcgccagcagccugagcgccagccugagaccccccggcgcccccgccaccuuccugagacccagccccauccccugcagcagccccggccccuggcagagccugugcggccugggcccccccugcgccggcugccccuggcccaccgccggccccggcagaagaagccccggcggcaccagccccgagagaagccccggcaccgccagagccagaggcgaccccaccagccugcaggccagcagcgagaagacccagcaguaa

SEQ ID NO: 19782 - RNA, 1392 nt, Artificial Sequence
  MEF2C__Homo_sapiens__NP_001124477
augggcagaaagaagauccagaucaccagaaucauggacgagagaaacagacaggugaccuucaccaagagaaaguucggccugaugaagaaggccuacgagcugagcgugcugugcgacugcgagaucgcccugaucaucuucaacagcaccaacaagcuguuccaguacgccagcaccgacauggacaaggugcugcugaaguacaccgaguacaacgagccccacgagagcagaaccaacagcgacaucguggaggcccugaacaagaaggagaacaagggcugcgagagccccgaccccgacagcagcuacgcccugacccccagaaccgaggagaaguacaagaagaucaacgaggaguucgacaacaugaucaagagccacaagauccccgccgugcccccccccaacuucgagaugcccgugagcauccccgugagcagccacaacagccugguguacagcaaccccgugagcagccugggcaaccccaaccugcugccccuggcccaccccagccugcagagaaacagcaugagccccggcgugacccacagaccccccagcgccggcaacaccggcggccugaugggcggcgaccugaccagcggcgccggcaccagcgccggcaacggcuacggcaaccccagaaacagccccggccugcuggugagccccggcaaccugaacaagaacaugcaggccaagagccccccccccaugaaccugggcaugaacaacagaaagcccgaccugagagugcugaucccccccggcagcaagaacaccaugcccagcgugaaccagagaaucaacaacagccagagcgcccagagccuggccacccccguggugagcguggccacccccacccugcccggccagggcaugggcggcuaccccagcgccaucagcaccaccuacggcaccgaguacagccugagcagcgccgaccugagcagccugagcggcuucaacaccgccagcgcccugcaccugggcagcgugaccggcuggcagcagcagcaccugcacaacaugccccccagcgcccugagccagcugggcgccugcaccagcacccaccugagccagagcagcaaccugagccugcccagcacccagagccugaacaucaagagcgagcccgugagcccccccagagacagaaccaccacccccagcagauacccccagcacaccagacacgaggccggcagaagccccguggacagccugagcagcugcagcagcagcuacgacggcagcgacagagaggaccacagaaacgaguuccacagccccaucggccugaccagacccagccccgacgagagagagagccccagcgugaagagaaugagacugagcgagggcugggccaccuaa

SEQ ID NO: 19783 - RNA, 1566 nt, Artificial Sequence
  MEF2D__Homo_sapiens__XP_005245226
augggcagaaagaagauccagauccagagaaucaccgacgagagaaacagacaggugaccuucaccaagagaaaguucggccugaugaagaaggccuacgagcugagcgugcugugcgacugcgagaucgcccugaucaucuucaaccacagcaacaagcuguuccaguacgccagcaccgacauggacaaggugcugcugaaguacaccgaguacaacgagccccacgagagcagaaccaacgccgacaucaucgagacccugagaaagaagggcuucaacggcugcgacagccccgagcccgacggcgaggacagccuggagcagagcccccugcuggaggacaaguacagaagagccagcgaggagcuggacggccuguucagaagauacggcagcaccgugcccgcccccaacuucgccaugcccgugaccgugcccgugagcaaccagagcagccugcaguucagcaaccccagcggcagccuggugacccccagccuggugaccagcagccugaccgaccccagacugcugagcccccagcagcccgcccugcagagaaacagcgugagccccggccugccccagagacccgccagcgccggcgccaugcugggcggcgaccugaacagcgccaacggcgccugccccagccccgugggcaacggcuacgugagcgccagagccagccccggccugcugcccguggccaacggcaacagccugaacaaggugauccccgccaagagcccccccccccccacccacagcacccagcugggcgcccccagcagaaagcccgaccugagagugaucaccagccaggccggcaagggccugaugcaccaccugaccgaggaccaccuggaccugaacaacgcccagagacugggcgugagccagagcacccacagccugaccacccccguggugagcguggccacccccagccugcugagccagggccugcccuucagcagcaugcccaccgccuacaacaccgacuaccagcugaccagcgccgagcugagcagccugcccgccuucagcagccccggcggccugagccugggcaacgugaccgccuggcagcagccccagcagccccagcagccccagcagccccagcccccccagcagcagcccccccagccccagcagccccagccccagcagccccagcagccccagcagcccccccagcagcagagccaccuggugcccgugagccugagcaaccugauccccggcagcccccugccccacgugggcgccgcccugaccgugaccacccacccccacaucagcaucaagagcgagcccgugagccccagcagagagagaagccccgccccccccccccccgccguguuccccgccgccagacccgagcccggcgacggccugagcagccccgccggcggcagcuacgagaccggcgacagagacgacggcagaggcgacuucggccccacccugggccugcugagacccgcccccgagcccgaggccgagggcagcgccgugaagagaaugagacuggacaccuggacccugaaguaa

SEQ ID NO: 19784 - RNA, 2346 nt, Artificial Sequence
  MEFV__Homo_sapiens__NP_000234
auggccaagacccccagcgaccaccugcugagcacccuggaggagcuggugcccuacgacuucgagaaguucaaguucaagcugcagaacaccagcgugcagaaggagcacagcagaauccccagaagccagauccagagagccagacccgugaagauggccacccugcuggugaccuacuacggcgaggaguacgccgugcagcugacccugcaggugcugagagccaucaaccagagacugcuggccgaggagcugcacagagccgccauccaggaguacagcacccaggagaacggcaccgacgacagcgccgccagcagcagccugggcgagaacaagcccagaagccugaagacccccgaccaccccgagggcaacgagggcaacggccccagacccuacggcggcggcgccgccagccugagaugcagccagcccgaggccggcagaggccugagcagaaagccccugagcaagagaagagagaaggccagcgagggccuggacgcccagggcaagcccagaaccagaagccccgcccugcccggcggcagaagccccggccccugcagagcccuggagggcggccaggccgaggugagacugagaagaaacgccagcagcgccggcagacugcagggccuggccggcggcgcccccggccagaaggagugcagacccuucgagguguaccugcccagcggcaagaugagacccagaagccuggaggugaccaucagcaccggcgagaaggcccccgccaaccccgagauccugcugacccuggaggagaagaccgccgccaaccuggacagcgccaccgagcccagagccagacccacccccgacggcggcgccagcgccgaccugaaggagggccccggcaaccccgagcacagcgugaccggcagaccccccgacaccgccgccagccccagaugccacgcccaggagggcgaccccguggacggcaccugcgugagagacagcugcagcuuccccgaggccgugagcggccacccccaggccagcggcagcagaagccccggcugccccagaugccaggacagccacgagagaaagagccccggcagccugagcccccagccccugccccagugcaagagacaccugaagcaggugcagcugcuguucugcgaggaccacgacgagcccaucugccugaucugcagccugagccaggagcaccagggccacagagugagacccaucgaggagguggcccuggagcacaagaagaagauccagaagcagcuggagcaccugaagaagcugagaaagagcggcgaggagcagagaagcuacggcgaggagaaggccgugagcuuccugaagcagaccgaggcccugaagcagagagugcagagaaagcuggagcagguguacuacuuccuggagcagcaggagcacuucuucguggccagccuggaggacgugggccagauggugggccagaucagaaaggccuacgacaccagagugagccaggacaucgcccugcuggacgcccugaucggcgagcuggaggccaaggagugccagagcgagugggagcugcugcaggacaucggcgacauccugcacagagccaagaccgugcccgugcccgagaaguggaccaccccccaggagaucaagcagaagauccagcugcugcaccagaagagcgaguucguggagaagagcaccaaguacuucagcgagacccugagaagcgagauggagauguucaacgugcccgagcugaucggcgcccaggcccacgccgugaacgugauccuggacgccgagaccgccuaccccaaccugaucuucagcgacgaccugaagagcgugagacugggcaacaagugggagagacugcccgacggcccccagagauucgacagcugcaucaucgugcugggcagccccagcuuccugagcggcagaagauacugggagguggaggugggcgacaagaccgccuggauccugggcgccugcaagaccagcaucagcagaaagggcaacaugacccugagccccgagaacggcuacuggguggugaucaugaugaaggagaacgaguaccaggccagcagcgugccccccaccagacugcugaucaaggagccccccaagagagugggcaucuucguggacuacagagugggcagcaucagcuucuacaacgugaccgccagaagccacaucuacaccuucgccagcugcagcuucagcggcccccugcagcccaucuucagccccggcaccagagacggcggcaagaacaccgccccccugaccaucugccccgugggcggccagggccccgacuaa

SEQ ID NO: 19785 - RNA, 3423 nt, Artificial Sequence
  MEGF10__Homo_sapiens__NP_115822
auggugaucagccugaacagcugccugagcuucaucugccugcugcugugccacuggaucggcaccgccagcccccugaaccuggaggaccccaacgugugcagccacugggagagcuacagcgugaccgugcaggagagcuacccccaccccuucgaccagaucuacuacaccagcugcaccgacauccugaacugguucaagugcaccagacacagagugagcuacagaaccgccuacagacacggcgagaagaccauguacagaagaaagagccagugcugccccggcuucuacgagagcggcgagaugugcgugccccacugcgccgacaagugcgugcacggcagaugcaucgcccccaacaccugccagugcgagcccggcuggggcggcaccaacugcagcagcgccugcgacggcgaccacuggggcccccacugcaccagcagaugccagugcaagaacggcgcccugugcaaccccaucaccggcgccugccacugcgccgccggcuucagaggcuggagaugcgaggacagaugcgagcagggcaccuacggcaacgacugccaccagagaugccagugccagaacggcgccaccugcgaccacgugaccggcgagugcagaugcccccccggcuacaccggcgccuucugcgaggaccugugcccccccggcaagcacggcccccagugcgagcagagaugccccugccagaacggcggcgugugccaccacgugaccggcgagugcagcugccccagcggcuggaugggcaccgugugcggccagcccugccccgagggcagauucggcaagaacugcagccaggagugccagugccacaacggcggcaccugcgacgccgccaccggccagugccacugcagccccggcuacaccggcgagagaugccaggacgagugccccgugggcaccuacggcgugcugugcgccgagaccugccagugcgugaacggcggcaagugcuaccacgugagcggcgccugccugugcgaggccggcuucgccggcgagagaugcgaggccagacugugccccgagggccuguacggcaucaagugcgacaagagaugccccugccaccuggagaacacccacagcugccaccccaugagcggcgagugcgccugcaagcccggcuggagcggccuguacugcaacgagaccugcagccccggcuucuacggcgaggccugccagcagaucugcagcugccagaacggcgccgacugcgacagcgugaccggcaagugcaccugcgcccccggcuucaagggcaucgacugcagcacccccugcccccugggcaccuacggcaucaacugcagcagcagaugcggcugcaagaacgacgccgugugcagccccguggacggcagcugcaccugcaaggccggcuggcacggcguggacugcagcaucagaugccccagcggcaccuggggcuucggcugcaaccugaccugccagugccugaacggcggcgccugcaacacccuggacggcaccugcaccugcgcccccggcuggagaggcgagaagugcgagcugcccugccaggacggcaccuacggccugaacugcgccgagagaugcgacugcagccacgccgacggcugccaccccaccaccggccacugcagaugccugcccggcuggagcggcgugcacugcgacagcgugugcgccgagggcagauggggccccaacugcagccugcccugcuacugcaagaacggcgccagcugcagccccgacgacggcaucugcgagugcgcccccggcuucagaggcaccaccugccagagaaucugcagccccggcuucuacggccacagaugcagccagaccugcccccagugcgugcacagcagcggccccugccaccacaucaccggccugugcgacugccugcccggcuucaccggcgcccugugcaacgaggugugccccagcggcagauucggcaagaacugcgccggcaucugcaccugcaccaacaacggcaccugcaaccccaucgacagaagcugccagugcuaccccggcuggaucggcagcgacugcagccagcccugcccccccgcccacuggggccccaacugcauccacaccugcaacugccacaacggcgccuucugcagcgccuacgacggcgagugcaagugcacccccggcuggaccggccuguacugcacccagagaugcccccugggcuucuacggcaaggacugcgcccugaucugccagugccagaacggcgccgacugcgaccacaucagcggccagugcaccugcagaaccggcuucaugggcagacacugcgagcagaagugccccagcggcaccuacggcuacggcugcagacagaucugcgacugccugaacaacagcaccugcgaccacaucaccggcaccugcuacugcagccccggcuggaagggcgccagaugcgaccaggccggcgugaucaucgugggcaaccugaacagccugagcagaaccagcaccgcccugcccgccgacagcuaccagaucggcgccaucgccggcaucaucauccuggugcugguggugcuguuccugcuggcccuguucaucaucuacagacacaagcagaagggcaaggagagcagcaugcccgccgugaccuacacccccgccaugagaguggugaacgccgacuacaccaucagcggcacccugccccacagcaacggcggcaacgccaacagccacuacuucaccaaccccagcuaccacacccugacccagugcgccaccagcccccacgugaacaacagagacagaaugaccgugaccaagagcaagaacaaccagcuguucgugaaccugaagaacgugaaccccggcaagagaggccccgugggcgacugcaccggcacccugcccgccgacuggaagcacggcggcuaccugaacgagcugggcgccuucggccuggacagaagcuacaugggcaagagccugaaggaccugggcaagaacagcgaguacaacagcagcaacugcagccugagcagcagcgagaaccccuacgccaccaucaaggacccccccgugcugauccccaagagcagcgagugcggcuacguggagaugaagagccccgccagaagagacagccccuacgccgagaucaacaacagcaccagcgccaacagaaacguguacgagguggagcccaccgugagcguggugcagggcguguucagcaacaacggcagacugagccaggaccccuacgaccugcccaagaacagccacauccccugccacuacgaccugcugcccgugagagacagcagcagcagccccaagcaggaggacagcggcggcagcagcagcaacagcagcagcagcagcgaguaa

SEQ ID NO: 19786 - RNA, 3135 nt, Artificial Sequence
  MEGF11__Homo_sapiens__NP_115821
auggugcugagccugaccggccugaucgccuucagcuuccugcaggccacccuggcccugaaccccgaggaccccaacgugugcagccacugggagagcuacgccgugaccgugcaggagagcuacgcccaccccuucgaccagaucuacuacaccagaugcaccgacauccugaacugguucaagugcaccagacacagaaucagcuacaagaccgccuacagaagaggccugagaaccauguacagaagaagaagccagugcugccccggcuacuacgagagcggcgacuucugcaucccccugugcaccgaggagugcgugcacggcagaugcgugagccccgacaccugccacugcgagcccggcuggggcggccccgacugcagcagcggcugcgacagcgaccacuggggcccccacugcagcaacagaugccagugccagaacggcgcccugugcaaccccaucaccggcgccugcgugugcgccgccggcuucagaggcuggagaugcgaggagcugugcgcccccggcacccacggcaagggcugccagcugcccugccagugcagacacggcgccagcugcgaccccagagccggcgagugccugugcgcccccggcuacaccggcguguacugcgaggagcugugcccccccggcagccacggcgcccacugcgagcugagaugccccugccagaacggcggcaccugccaccacaucaccggcgagugcgccugcccccccggcuggaccggcgccgugugcgcccagcccugcccccccggcaccuucggccagaacugcagccaggacugccccugccaccacggcggccagugcgaccacgugaccggccagugccacugcaccgccggcuacaugggcgacagaugccaggaggagugccccuucggcagcuucggcuuccagugcagccagcacugcgacugccacaacggcggccagugcagccccaccaccggcgccugcgagugcgagcccggcuacaagggccccagaugccaggagagacugugccccgagggccugcacggccccggcugcacccugcccugccccugcgacgccgacaacaccaucagcugccaccccgugaccggcgccugcaccugccagcccggcuggagcggccaccacugcaacgagagcugccccgugggcuacuacggcgacggcugccagcugcccugcaccugccagaacggcgccgacugccacagcaucaccggcggcugcaccugcgcccccggcuucaugggcgaggugugcgccgugagcugcgccgccggcaccuacggccccaacugcagcagcaucugcagcugcaacaacggcggcaccugcagccccguggacggcagcugcaccugcaaggagggcuggcagggccuggacugcacccugcccugccccagcggcaccuggggccugaacugcaacgagagcugcaccugcgccaacggcgccgccugcagccccaucgacggcagcugcagcugcacccccggcuggcugggcgacaccugcgagcugcccugccccgacggcaccuucggccugaacugcagcgagcacugcgacugcagccacgccgacggcugcgaccccgugaccggccacugcugcugccuggccggcuggaccggcaucagaugcgacagcaccugcccccccggcagauggggccccaacugcagcgugagcugcagcugcgagaacggcggcagcugcagccccgaggacggcagcugcgagugcgcccccggcuucagaggcccccugugccagagaaucugcccccccggcuucuacggccacggcugcgcccagcccugcccccugugcgugcacagcagcagacccugccaccacaucagcggcaucugcgagugccugcccggcuucagcggcgcccugugcaaccaggugugcgccggcggcuacuucggccaggacugcgcccagcugugcagcugcgccaacaacggcaccugcagccccaucgacggcagcugccagugcuuccccggcuggaucggcaaggacugcagccaggccugcccccccggcuucuggggccccgccugcuuccacgccugcagcugccacaacggcgccagcugcagcgccgaggacggcgccugccacugcacccccggcuggaccggccuguucugcacccagagaugccccgccgccuucuucggcaaggacugcggcagagugugccagugccagaacggcgccagcugcgaccacaucagcggcaagugcaccugcagaaccggcuucaccggccagcacugcgagcagagaugcgcccccggcaccuucggcuacggcugccagcagcugugcgagugcaugaacaacagcaccugcgaccacgugaccggcaccugcuacugcagccccggcuucaagggcaucagaugcgaccaggccgcccugaugauggaggagcugaaccccuacaccaagaucagccccgcccugggcgccgagagacacagcgugggcgccgugaccggcaucaugcugcugcuguuccugaucguggugcugcugggccuguucgccuggcacagaagaagacagaaggagaagggcagagaccuggcccccagagugagcuacacccccgccaugagaaugaccagcaccgacuacagccugagcggcgccugcggcauggacagaagacagaacaccuacaucauggacaagggcuucaaggacuacaugaaggagagcgugugcagcagcagcaccugcagccugaacagcagcgagaaccccuacgccaccaucaaggacccccccauccugaccugcaagcugcccgagagcagcuacguggagaugaagagccccgugcacaugggcagccccuacaccgacgugcccagccugagcaccagcaacaagaacaucuacgagguggagcccaccgugagcguggugcaggagggcugcggccacaacagcagcuacauccagaacgccuacgaccugcccagaaacagccacauccccggccacuacgaccugcugcccgugagacagagccccgccaacggccccagccaggacaagcagagcuaa

SEQ ID NO: 19787 - RNA, 8538 nt, Artificial Sequence
  MEGF8__Homo_sapiens__NP_001258867
auggcccugggcaaggugcuggccauggcccuggugcuggcccuggccgugcugggcagccugagccccggcgccagagccggcgacugcaagggccagagacaggugcugagagaggcccccggcuucgugaccgacggcgccggcaacuacagcgugaacggcaacugcgaguggcugaucgaggcccccagcccccagcacagaauccugcuggacuuccuguuccuggacaccgagugcaccuacgacuaccuguucguguacgacggcgacagccccagaggcccccugcuggccagccugagcggcagcaccagacccccccccaucgaggccagcagcggcaagaugcugcugcaccuguucagcgacgccaacuacaaccugcugggcuucaacgccagcuucagauucagccugugccccggcggcugccagagccacggccagugccagccccccggcgugugcgccugcgagcccggcuggggcggccccgacugcggccugcaggagugcagcgccuacugcggcagccacggcaccugcgccagcccccugggccccugcagaugcgagcccggcuuccugggcagagccugcgaccugcaccugugggagaaccagggcgccggcugguggcacaacgugagcgccagagaccccgccuucagcgccagaaucggcgccgccggcgccuuccugagcccccccggccugcuggccguguucggcggccaggaccugaacaacgcccugggcgaccuggugcuguacaacuucagcgccaacaccugggagagcugggaccugagccccgcccccgccgccagacacagccacguggccguggccugggccggcagccuggugcugaugggcggcgagcuggccgacggcagccugaccaacgacgugugggccuucagcccccugggcagaggccacugggagcugcuggccccccccgccagcagcagcagcggcccccccggccuggccggccacgccgccgcccugguggacgacguguggcuguacgugagcggcggcagaaccccccacgaccuguucagcagcggccuguucagauucagacuggacagcaccagcggcggcuacugggagcaggugauccccgccggcggcagaccccccgccgccaccggccacagcaugguguuccacgcccccagcagagcccugcuggugcacggcggccacagacccagcaccgccagauucagcgugagagugaacagcaccgagcuguuccacguggacagacacguguggaccacccugaagggcagagacggccugcagggccccagagagagagccuuccacaccgccagcgugcugggcaacuacauggugguguacggcggcaacgugcacacccacuaccaggaggagaagugcuacgaggacggcaucuucuucuaccaccugggcugccaccagugggugagcggcgccgagcuggccccccccggcacccccgagggcagagccgccccccccagcggcagauacagccacguggccgccgugcugggcggcagcgugcugcugguggccggcggcuacagcggcagacccagaggcgaccugauggccuacaaggugccccccuucguguuccaggcccccgcccccgacuaccaccuggacuacugcagcauguacaccgaccacagcgugugcagcagagaccccgagugcagcuggugccagggcgccugccaggccgcccccccccccggcaccccccugggcgccugccccgccgccagcugccugggccugggcagacugcugggcgacugccaggccugccuggccuucagcagccccaccgccccccccagaggccccggcacccugggcuggugcgugcacaacgagagcugccugcccagacccgagcaggccagaugcagaggcgagcagaucagcggcaccgugggcugguggggccccgcccccguguucgugaccagccuggaggccugcgugacccagagcuuccugcccggccugcaccugcugaccuuccagcagccccccaacaccagccagcccgacaaggugagcaucgugagaagcaccaccaucacccugacccccagcgccgagaccgacgugagccugguguacagaggcuucaucuaccccaugcugcccggcggccccggcggccccggcgccgaggacguggccguguggaccagagcccagagacugcacgugcuggccagaauggccagaggccccgacaccgagaacauggaggaggugggcagauggguggcccaccaggagaaggagaccagaagacugcagagacccggcagcgccagacuguucccccugcccggcagagaccacaaguacgccguggagauccagggccagcugaacggcagcgccggccccggccacagcgagcugacccugcugugggacagaaccggcgugcccggcggcagcgagaucagcuucuucuuccuggagcccuacagaagcagcagcugcaccagcuacagcagcugccugggcugccuggccgaccagggcugcggcuggugccugaccagcgccaccugccaccugagacagggcggcgcccacugcggcgacgacggcgccggcggcagccugcuggugcuggugcccacccugugcccccugugcgaggagcacagagacugccacgccugcacccaggaccccuucugcgaguggcaccagagcaccagcagaaagggcgacgccgccugcagcagaagaggcagaggcagaggcgcccugaagagccccgaggagugccccccccugugcagccagagacugaccugcgaggacugccuggccaacagcagccagugcgccuggugccagagcacccacaccugcuuccuguucgccgccuaccuggccagauacccccacggcggcugcagaggcugggacgacagcgugcacagcgagcccagaugcagaagcugcgacggcuuccugaccugccacgagugccugcagagccacgagugcggcuggugcggcaacgaggacaaccccacccugggcagaugccugcagggcgacuucagcggcccccugggcggcggcaacugcagccugugggugggcgagggccugggccugcccguggcccugcccgccagaugggccuacgccagaugccccgacguggacgagugcagacugggccuggccagaugccaccccagagccaccugccugaacaccccccugagcuacgagugccacugccagagaggcuaccagggcgacggcaucagccacugcaacagaaccugccuggaggacugcggccacggcgugugcagcggcccccccgacuucaccugcgugugcgaccugggcuggaccagcgaccugcccccccccacccccgcccccggcccccccgcccccagaugcagcagagacugcggcugcagcuuccacagccacugcagaaagagaggccccggcuucugcgacgagugccaggacuggaccuggggcgagcacugcgagagaugcagacccggcagcuucggcaacgccaccggcagcagaggcugcagacccugccagugcaacggccacggcgaccccagaagaggccacugcgacaaccugagcggccugugcuucugccaggaccacaccgagggcgcccacugccagcugugcagccccggcuacuacggcgaccccagagccggcggcagcugcuucagagagugcggcggcagagcccugcugaccaacgugagcagcguggcccugggcagcagaagagugggcggccugcugccccccggcggcggcgccgccagagccggccccggccugagcuacugcguguggguggugagcgccaccgaggagcugcagcccugcgcccccggcacccugugccccccccugacccugaccuucagccccgacagcagcacccccugcacccugagcuacgugcuggccuucgacggcuuccccagauuccuggacaccggcguggugcagagcgacagaagccugaucgccgccuucugcggccagagaagagacagaccccugaccgugcaggcccugagcggccugcuggugcugcacugggaggccaacggcagcagcagcuggggcuucaacgccagcgugggcagcgccagaugcggcagcggcggccccggcagcugccccgugccccaggagugcgugccccaggacggcgccgccggcgccggccugugcagaugcccccagggcugggccggcccccacugcagaauggcccugugccccgagaacugcaacgcccacaccggcgccggcaccugcaaccagagccugggcgugugcaucugcgccgagggcuucggcggccccgacugcgccaccaagcuggacggcggccagcuggugugggagacccugauggacagcagacugagcgccgacaccgccagcagauuccugcacagacugggccacaccaugguggacggccccgacgccacccuguggauguucggcggccugggccugccccagggccugcugggcaaccuguacagauacagcgugagcgagagaagauggacccagaugcuggccggcgccgaggacggcggccccggccccagccccagaagcuuccacgccgccgccuacgugcccgccggcagaggcgccauguaccugcugggcggccugaccgccggcggcgugaccagagacuucugggugcugaaccugaccacccugcaguggagacaggagaaggccccccagaccguggagcugcccgccguggccggccacacccugaccgccagaagaggccugagccugcugcuggugggcggcuacagccccgagaacggcuucaaccagcagcugcuggaguaccagcuggccaccggcaccugggugagcggcgcccagagcggcaccccccccaccggccuguacggccacagcgccguguaccacgaggccaccgacagccuguacguguucggcggcuucagauuccacguggagcuggccgcccccagccccgagcuguacagccugcacugccccgacagaaccuggagccugcuggcccccagccagggcgccaagagagacagaaugagaaacgugagaggcagcagcagaggccugggccaggugcccggcgagcagcccggcagcuggggcuucagagaggugagaaagaagauggcccugugggccgcccuggccggcaccggcggcuuccuggaggagaucagcccccaccugaaggagcccagacccagacuguuccacgccagcgcccugcugggcgacaccaugguggugcugggcggcagaagcgaccccgacgaguucagcagcgacgugcugcuguaccaggugaacugcaacgccuggcugcugcccgaccugaccagaagcgccagcgugggcccccccauggaggagagcguggcccacgccguggccgccgugggcagcagacuguacaucagcggcggcuucggcggcguggcccugggcagacugcuggcccugacccugccccccgaccccugcagacugcugagcagccccgaggccugcaaccagagcggcgccugcaccuggugccacggcgccugccugagcggcgaccaggcccacagacugggcugcggcggcagccccugcagccccaugcccagaagccccgaggagugcagaagacugagaaccugcagcgagugccuggccagacaccccagaacccugcagcccggcgacggcgaggccagcacccccagaugcaaguggugcaccaacugccccgagggcgccugcaucggcagaaacggcagcugcaccagcgagaacgacugcagaaucaaccagagagagguguucugggccggcaacugcagcgaggccgccugcggcgccgccgacugcgagcagugcaccagagagggcaagugcauguggaccagacaguucaagagaaccggcgagaccagaagaauccugagcgugcagcccaccuacgacuggaccugcuucagccacagccugcugaacgugagccccaugcccguggagagcagccccccccugcccugccccacccccugccaccugcugcccaacugcaccagcugccuggacagcaagggcgccgacggcggcuggcagcacugcguguggagcagcagccugcagcagugccugagccccagcuaccugccccugagaugcauggccggcggcugcggcagacugcugagaggccccgagagcugcagccugggcugcgcccaggccacccagugcgcccugugccugagaagaccccacugcggcuggugcgccuggggcggccaggacggcggcggcagaugcauggagggcggccugagcggccccagagacggccugaccugcggcagacccggcgccagcugggccuuccugagcugcccccccgaggacgagugcgccaacggccaccacgacugcaacgagacccagaacugccacgaccagccccacggcuacgagugcagcugcaagaccggcuacaccauggacaacaugaccggccugugcagacccgugugcgcccagggcugcgugaacggcagcugcguggagcccgaccacugcagaugccacuucggcuucgugggcagaaacugcagcaccgagugcagaugcaacagacacagcgagugcgccggcgugggcgccagagaccacugccugcugugcagaaaccacaccaagggcagccacugcgagcagugccugccccuguucgugggcagcgccgugggcggcggcaccugcagacccugccacgccuucugcagaggcaacagccacaucugcaucagcagaaaggagcugcagaugagcaagggcgagcccaagaaguacagccuggaccccgaggagaucgagaacugggugaccgagggccccagcgaggacgaggccgugugcgugaacugccagaacaacagcuacggcgagaagugcgagagcugccugcagggcuacuuccugcuggacggcaagugcaccaagugccagugcaacggccacgccgacaccugcaacgagcaggacggcaccggcugccccugccagaacaacaccgagaccggcaccugccagggcagcagccccagcgacagaagagacugcuacaaguaccagugcgccaagugcagagagagcuuccacggcagcccccugggcggccagcagugcuacagacugaucagcguggagcaggagugcugccuggaccccaccagccagaccaacugcuuccacgagcccaagagaagagcccugggccccggcagaaccgugcuguucggcgugcagcccaaguucaccaacguggacaucagacugacccuggacgugaccuucggcgccguggaccuguacgugagcaccagcuacgacaccuucguggugagaguggcccccgacaccggcgugcacaccgugcacauccagcccccccccgcccccccccccccccccccccccgccgacggcggccccagaggcgccggcgaccccggcggcgccggcgccagcagcggccccggcgcccccgccgagcccagagugagagagguguggcccagaggccugaucaccuacgugaccgugaccgagcccagcgccgugcugguggugagaggcgugagagacagacuggugaucaccuacccccacgagcaccacgcccugaagagcagcagauucuaccugcugcugcugggcgugggcgaccccagcggccccggcgccaacggcagcgccgacagccagggccugcuguucuucagacaggaccaggcccacaucgaccuguucguguucuucagcguguucuucagcugcuucuuccuguuccugagccugugcgugcugcuguggaaggccaagcaggcccuggaccagagacaggagcagagaagacaccugcaggagaugaccaagauggccagcagacccuucgccaaggugaccgugugcuucccccccgaccccaccgcccccgccagcgccuggaagcccgccggccugcccccccccgccuucagaagaagcgagcccuuccuggccccccugcugcugaccggcgccggcggccccuggggccccaugggcggcggcugcugcccccccgccauccccgccaccaccgccggccugagagccggccccaucacccuggagcccaccgaggacggcauggccggcguggccacccugcugcugcagcugcccggcggcccccacgcccccaacggcgccugccugggcagcgcccuggugacccugagacacagacugcacgaguacugcggcggcggcggcggcgccggcggcagcggccacggcaccggcgccggcagaaagggccugcugagccaggacaaccugaccagcaugagccuguaa

SEQ ID NO: 19788 - RNA, 1809 nt, Artificial Sequence
  MEGF9__Homo_sapiens__NP_001073966
augaacggcggcgccgagagagccaugagaagccugcccagccugggcggccuggcccugcugugcugcgccgccgccgccgccgccgccgccguggccagcgccgccagcgccggcaacgugaccggcggcggcggcgccgccggccagguggacgccagccccggccccggccugagaggcgagcccagccaccccuuccccagagccaccgcccccaccgcccaggcccccagaaccggcccccccagagccaccgugcacagaccccuggccgccaccagccccgcccagagccccgagaccaccccccugugggccaccgccggccccagcagcaccaccuuccaggccccccugggccccagccccaccaccccccccgccgccgagagaaccagcaccaccagccaggcccccaccagacccgcccccaccacccugagcaccaccaccggccccgcccccaccacccccguggccaccaccgugcccgcccccaccacccccagaacccccacccccgaccugcccagcagcagcaacagcagcgugcugcccaccccccccgccaccgaggcccccagcagccccccccccgaguacgugugcaacugcagcguggugggcagccugaacgugaacagaugcaaccagaccaccggccagugcgagugcagacccggcuaccagggccugcacugcgagaccugcaaggagggcuucuaccugaacuacaccagcggccugugccagcccugcgacugcagcccccacggcgcccugagcauccccugcaacagcagcggcaagugccagugcaaggugggcgugaucggcagcaucugcgacagaugccaggacggcuacuacggcuucagcaagaacggcugccugcccugccagugcaacaacagaagcgccagcugcgacgcccugaccggcgccugccugaacugccaggagaacagcaagggcaaccacugcgaggagugcaaggagggcuucuaccagagccccgacgccaccaaggagugccugagaugccccugcagcgccgugaccagcaccggcagcugcagcaucaagagcagcgagcuggagcccgagugcgaccagugcaaggacggcuacaucggccccaacugcaacaagugcgagaacggcuacuacaacuucgacagcaucugcagaaagugccagugccacggccacguggaccccgugaagacccccaagaucugcaagcccgagagcggcgagugcaucaacugccugcacaacaccaccggcuucuggugcgagaacugccuggagggcuacgugcacgaccuggagggcaacugcaucaagaaggaggugauccugcccacccccgagggcagcaccauccuggugagcaacgccagccugaccaccagcgugcccacccccgugaucaacagcaccuucacccccaccacccugcagaccaucuucagcgugagcaccagcgagaacagcaccagcgcccuggccgacgugagcuggacccaguucaacaucaucauccugaccgugaucaucaucgugguggugcugcugaugggcuucgugggcgccguguacauguacagagaguaccagaacagaaagcugaacgcccccuucuggaccaucgagcugaaggaggacaacaucagcuucagcagcuaccacgacagcauccccaacgccgacgugagcggccugcuggaggacgacggcaacgagguggcccccaacggccagcugacccugaccacccccauccacaacuacaaggccuaa

SEQ ID NO: 19789 - RNA, 3825 nt, Artificial Sequence
  MEI1__Homo_sapiens__NP_689726
auggccgugagacaggccgccaccgccggcacccccggccccagaagagaggaggaggccgcccugcuguucgagagagcccacuacagacacgaccccagauggcugcugcccgugacccccagacugugccuggccugcgcccuggagcugcugcccgaccccggcgugagccuggugagaaagaagcacaugcugagcugcuuccaggacgcccuggugagacacaccagccuggugacccagcuggugagccaggaccagagagugugcauccacuucaucagcgugcuguucggccugcugugcagcauggaggacggcagcgugaccgaccugugcaucgaggugcugauccagaucaccacccagcugaagcuggagcagaccaucagaugccugcuggacgagugccacaaggagcugugcaacaugcccagcaugagaggcagccuggccacccugacccugcugggcaagcugguggacgccauccccgcccuggccgacgagcuggugauggagcacggcaaccugauggagcaccugcugagaggccugguguaccccagcgagggcauccaggccagcgugugcuaccuguacggcaagcuguacagcagccccguggccgccgagaugcugagcggccacuucagagagaagcuguucccccuguuccugagcauccuggacggcgcccagaccaaggagcugcagaucaacugccugggccugcugagacagcugcugaaguacgaccuguucgugagcaugaucaugaaccaggacggccugggcgagagcgccaagaacaucgagggcagcagcggcaacaccagccugccccuggugcugaagaagcugcugcugagcagagacgagacccugcagguggccagcgcccacugcaucaccgccgugcuggugcacagccccgccaagcacgccagcgccuucauccacgccgacauccccgaguuccuguucgagcaccugagcagcagcagcgaggugcugguguggagcagcugcaacugccugacccugcugguggaggagccccuguucuucagcaagugccacaccguguacggcaucgaggccguggugagaagccugcagggcagccugaagaugaacaacaucgagcugcacaagcagggccugcugcuguucgccgagauccugaccagacagcccgaggagaucaagcuguucaccagcagcgccaugugcagagacgccggcagagcccugcaggaggccgugagcagccccgugcuggagguggccgccgaggcccugaaggccaccagcgccuuccugagaaaggaccaccagagcaccccccccgugcaguacggcgagcugcaggcccugcuggaggccaugcugaacagaugcgccgaguucagccagacccugcugagcagaagaccccugggccacgccagcagcagagacagcgagaaggccauccugcagagaggcaaguuccugcugagcacccuggagggcuucagaagcgccugcagacuggccaucgaguuccagagcgagcccagcgcccaggagaaccccuucaccgcccccagcgccaagaaggaggacacccuggaggccuucagcgaguuccugcugagcgccugcgacagccugugcauccccauggugaugagacaccuggagcagaccacccaccccgcccugauggagguguuccugagcauccugcacaaccuguucgugaucgugccccacaugaaggagaaguucagcaagaagcuggccagcagcagcuucaucagacugacccuggagcugaaggccagauucugcagcggccugagccacagcgcccugaaccaggugugcagcaacuuccuguacuacaugugccugaaccugcugagcgcccccgagaagaccggcccccccagcaaggaggagcugagcgccgugagcgagcugcugcagcacggccugccccagaucagcagcagaagccccgagagccuggccuuccugagcgacagacaguacauggagggcgccgccagacagagacaguacugcauccugcugcuguucuaccuggccuacauccacgaggacagauucgugagcgaggccgagcuguucgaggccgugcagagcuuccugcugagccugcaggaccagggcgagagacccccccuggugguguucaaggccagcaucuaccugcuggccaucugccaggacaaggacaacacccugagagagaccauggugagcgccaucagaaaguuccuggagggcauccccgaccugcagcugguguacacccaccacccccugcugcugagauucuuccugcuguaccccgagcugaugagcagauacggccacagagugcuggagcugugguucuucugggaggagagcagcuacgaggagcuggacgacgugaccagcgccggccagcccgcccugcccgccagccugguggugcuguuccagcugcugagaagcauccccagcauccugcugauccugcuggaccugaucuacagcagccccguggacaccgcccacaaggugcugaucagccugagaaccuuccugagaagaaacgaggacauccaggugggcggccugaucagaggccacuuccugcugauccugcagagacugcugguggagcacggcgccagccccagcggcgccagcggcaaccugccccugcugcugagccugcugagccugaugcagcugagaaacgugagcgagcaggagcuggacagcguggccaugaagcugcugcaccaggugagcaagcugugcggcaagugcagccccaccgacguggacauccugcagcccagcuucaacuuccuguacuggagccugcaccagaccacccccagcagccagaagagagccgccgccgugcugcugagcagcaccggccugauggagcugcuggagaagaugcuggcccugacccuggccaaggccgacagccccagaaccgcccugcugugcagcgccuggcugcugaccgccagcuucagcgcccagcagcacaagggcagccugcaggugcaccagacccugagcguggagauggaccaggugcugaaggcccugagcuuccccaagaagaaggccgcccugcugagcgccgccauccugugcuuccugagaaccgcccugagacagagcuucagcagcgcccugguggcccuggugcccagcggcgcccagccccugcccgccaccaaggacaccgugcuggccccccugagaaugagccaggugagaagccuggugaucggccugcagaaccugcuggugcagaaggacccccugcugagccaggccugcgugggcugccuggaggcccugcuggacuaccuggacgccagaagccccgacaucgcccugcacguggccagccagcccuggaacagauuccugcuguucacccugcuggacgccggcgagaacagcuuccugagacccgagauccugagacugaugacccuguucaugagauacagaagcagcagcgugcugagccacgaggaggugggcgacgugcugcagggcguggcccuggccgaccugagcacccugagcaacaccacccugcaggcccugcacggcuucuuccagcagcugcagagcaugggccaccuggccgaccacagcauggcccagacccugcaggccagccuggagggccugccccccagcaccagcagcggccagcccccccugcaggacaugcugugccugggcggcguggccgugagccugagccacaucagaaacuaa

SEQ ID NO: 19790 - RNA, 1173 nt, Artificial Sequence
  MEIS1__Homo_sapiens__NP_002389
auggcccagagauacgacgaccugccccacuacggcggcauggacggcgugggcauccccagcaccauguacggcgacccccacgccgccagaagcaugcagcccgugcaccaccugaaccacggccccccccugcacagccaccaguacccccacaccgcccacaccaacgccauggcccccagcaugggcagcagcgugaacgacgcccugaagagagacaaggacgccaucuacggccacccccuguucccccugcuggcccugaucuucgagaagugcgagcuggccaccugcacccccagagagcccggcguggccggcggcgacgugugcagcagcgagagcuucaacgaggacaucgccguguucgccaagcagaucagagccgagaagccccuguucagcagcaaccccgagcuggacaaccugaugauccaggccauccaggugcugagauuccaccugcuggagcuggagaaggugcacgagcugugcgacaacuucugccacagauacaucagcugccugaagggcaagaugcccaucgaccuggugaucgacgacagagagggcggcagcaagagcgacagcgaggacaucaccagaagcgccaaccugaccgaccagcccagcuggaacagagaccacgacgacaccgccagcaccagaagcggcggcacccccggccccagcagcggcggccacaccagccacagcggcgacaacagcagcgagcagggcgacggccuggacaacagcguggccagccccagcaccggcgacgacgacgaccccgacaaggacaagaagagacacaagaagagaggcaucuuccccaagguggccaccaacaucaugagagccuggcuguuccagcaccugacccaccccuaccccagcgaggagcagaagaagcagcuggcccaggacaccggccugaccauccugcaggugaacaacugguucaucaacgccagaagaagaaucgugcagcccaugaucgaccagagcaacagagccgugagccagggcacccccuacaaccccgacggccagcccaugggcggcuucgugauggacggccagcagcacaugggcaucagagcccccggccccaugagcggcaugggcaugaacaugggcauggagggccaguggcacuacauguaa

SEQ ID NO: 19791 - RNA, 1146 nt, Artificial Sequence
  MEIS2__Homo_sapiens__NP_002390
auggacggcgugggcgugcccgccagcauguacggcgacccccacgcccccagacccaucccccccgugcaccaccugaaccacggccccccccugcacgccacccagcacuacggcgcccacgccccccaccccaacgugaugcccgccagcaugggcagcgccgugaacgacgcccugaagagagacaaggacgccaucuacggccacccccuguucccccugcuggcccugguguucgagaagugcgagcuggccaccugcacccccagagagcccggcguggccggcggcgacgugugcagcagcgacagcuucaacgaggacaucgccguguucgccaagcaggugagagccgagaagccccuguucagcagcaaccccgagcuggacaaccugaugauccaggccauccaggugcugagauuccaccugcuggagcuggagaaggugcacgagcugugcgacaacuucugccacagauacaucagcugccugaagggcaagaugcccaucgaccuggugaucgacgagagagacggcagcagcaagagcgaccacgaggagcugagcggcagcagcaccaaccuggccgaccacaaccccagcagcuggagagaccacgacgacgccaccagcacccacagcgccggcacccccggccccagcagcggcggccacgccagccagagcggcgacaacagcagcgagcagggcgacggccuggacaacagcguggccagccccggcaccggcgacgacgacgaccccgacaaggacaagaagagacagaagaagagaggcaucuuccccaagguggccaccaacaucaugagagccuggcuguuccagcaccugacccaccccuaccccagcgaggagcagaagaagcagcuggcccaggacaccggccugaccauccugcaggugaacaacugguucaucaacgccagaagaagaaucgugcagcccaugaucgaccagagcaacagagccgugagccagggcgccgccuacagccccgagggccagcccaugggcagcuucgugcuggacggccagcagcacaugggcaucagacccgccggccccaugagcggcaugggcaugaacaugggcauggacggccaguggcacuacauguaa

SEQ ID NO: 19792 - RNA, 1833 nt, Artificial Sequence
  MELK__Homo_sapiens__NP_001243614
augaaggacuacgacgagcugcugaaguacuacgagcugcacgagaccaucggcaccggcggcuucgccaaggugaagcuggccugccacauccugaccggcgagaugguggccaucaagaucauggacaagaacacccugggcagcgaccugcccagaaucaagaccgagaucgaggcccugaagaaccugagacaccagcacaucugccagcuguaccacgugcuggagaccgccaacaagaucuucauggugcuggaguacugccccggcggcgagcuguucgacuacaucaucagccaggacagacugagcgaggaggagaccagagugguguucagacagaucgugagcgccguggccuacgugcacagccagggcuacgcccacagagaccugaagcccgagaaccugcuguucgacgaguaccacaagcugaagcugaucgacuucggccugugcgccaagcccaagggcaacaaggacuaccaccugcagaccugcugcggcagccuggccuacgccgcccccgagcugauccagggcaagagcuaccugggcagcgaggccgacguguggagcaugggcauccugcuguacgugcugaugugcggcuuccugcccuucgacgacgacaacgugauggcccuguacaagaagaucaugagaggcaaguacgacgugcccaaguggcugagccccagcagcauccugcugcugcagcagaugcugcagguggaccccaagaagagaaucagcaugaagaaccugcugaaccaccccuggaucaugcaggacuacaacuaccccguggaguggcagagcaagaaccccuucauccaccuggacgacgacugcgugaccgagcugagcgugcaccacagaaacaacagacagaccauggaggaccugaucagccuguggcaguacgaccaccugaccgccaccuaccugcugcugcuggccaagaaggccagaggcaagcccgugagacugagacugagcagcuucagcugcggccaggccagcgccacccccuucaccgacaucaaguucaccaaguacuggaccgagagcaacggcguggagagcaagagccugacccccgcccugugcagaacccccgccaacaagcugaagaacaaggagaacguguacacccccaagagcgccgugaagaacgaggaguacuucauguuccccgagcccaagacccccgugaacaagaaccagcacaagagagagauccugaccacccccaacagauacaccacccccagcaaggccagaaaccagugccugaaggagacccccaucaagauccccgugaacagcaccggcaccgacaagcugaugaccggcgugaucagccccgagagaagaugcagaagcguggagcuggaccugaaccaggcccacauggaggagacccccaagagaaagggcgccaagguguucggcagccuggagagaggccuggacaaggugaucaccgugcugaccagaagcaagagaaagggcagcgccagagacggccccagaagacugaagcugcacuacaacgugaccaccaccagacuggugaaccccgaccagcugcugaacgagaucaugagcauccugcccaagaagcacguggacuucgugcagaagggcuacacccugaagugccagacccagagcgacuucggcaaggugaccaugcaguucgagcuggaggugugccagcugcagaagcccgacguggugggcaucagaagacagagacugaagggcgacgccuggguguacaagagacugguggaggacauccugagcagcugcaagguguaa

SEQ ID NO: 19793 - RNA, 825 nt, Artificial Sequence
  MEMO1__Homo_sapiens__NP_001131074
augagcaacagaguggugugcagagaggccagccacgccggcagcugguacaccgccagcggcccccagcugaacgcccagcuggagggcuggcugagccaggugcagagcaccaagagacccgccagagccaucaucgcccccagaagaaucuucauccugggccccagccaccacgugccccugagcagaugcgcccugagcagcguggacaucuacagaaccccccuguacgaccugagaaucgaccagaagaucuacggcgagcuguggaagaccggcauguucgagagaaugagccugcagaccgacgaggacgagcacagcaucgagaugcaccugcccuacaccgccaaggccauggagagccacaaggacgaguucaccaucauccccgugcuggugggcgcccugagcgagagcaaggagcaggaguucggcaagcuguucagcaaguaccuggccgaccccagcaaccuguucguggugagcagcgacuucugccacuggggccagagauucagauacagcuacuacgacgagagccagggcgagaucuacagaagcaucgagcaccuggacaagaugggcaugagcaucaucgagcagcuggaccccgugagcuucagcaacuaccugaagaaguaccacaacaccaucugcggcagacaccccaucggcgugcugcugaacgccaucaccgagcugcagaagaacggcaugaacaugagcuucagcuuccugaacuacgcccagagcagccagugcagaaacuggcaggacagcagcgugagcuacgccgccggcgcccugaccgugcacuaa

SEQ ID NO: 19794 - RNA, 1833 nt, Artificial Sequence
  MEN1__Homo_sapiens__NP_570711
augggccugaaggccgcccagaagacccuguucccccugagaagcaucgacgacguggugagacuguucgccgccgagcugggcagagaggagcccgaccuggugcugcugagccuggugcugggcuucguggagcacuuccuggccgugaacagagugauccccaccaacgugcccgagcugaccuuccagcccagccccgcccccgacccccccggcggccugaccuacuuccccguggccgaccugagcaucaucgccgcccuguacgccagauucaccgcccagaucagaggcgccguggaccugagccuguaccccagagagggcggcgugagcagcagagagcuggugaagaaggugagcgacgugaucuggaacagccugagcagaagcuacuucaaggacagagcccacauccagagccuguucagcuucaucaccggcaccaagcuggacagcagcggcguggccuucgccguggugggcgccugccaggcccugggccugagagacgugcaccuggcccugagcgaggaccacgccugggugguguucggccccaacggcgagcagaccgccgaggugaccuggcacggcaagggcaacgaggacagaagaggccagaccgugaacgccggcguggccgagagaagcuggcuguaccugaagggcagcuacaugagaugcgacagaaagauggagguggccuucauggugugcgccaucaaccccagcaucgaccugcacaccgacagccuggagcugcugcagcugcagcagaagcugcuguggcugcuguacgaccugggccaccuggagagauaccccauggcccugggcaaccuggccgaccuggaggagcuggagcccacccccggcagacccgacccccugacccuguaccacaagggcaucgccagcgccaagaccuacuacagagacgagcacaucuaccccuacauguaccuggccggcuaccacugcagaaacagaaacgugagagaggcccugcaggccugggccgacaccgccaccgugauccaggacuacaacuacugcagagaggacgaggagaucuacaaggaguucuucgagguggccaacgacgugauccccaaccugcugaaggaggccgccagccugcuggaggccggcgaggagagacccggcgagcagagccagggcacccagagccagggcagcgcccugcaggaccccgagugcuucgcccaccugcugagauucuacgacggcaucugcaagugggaggagggcagccccacccccgugcugcacgugggcugggccaccuuccuggugcagagccugggcagauucgagggccaggugagacagaaggugagaaucgugagcagagaggccgaggccgccgaggccgaggagcccuggggcgaggaggccagagagggcagaagaagaggccccagaagagagagcaagcccgaggagccccccccccccaagaagcccgcccuggacaagggccugggcaccggccagggcgccgugagcggcccccccagaaagccccccggcaccguggccggcaccgccagaggccccgagggcggcagcaccgcccaggugcccgcccccgccgccagccccccccccgagggccccgugcugaccuuccagagcgagaagaugaagggcaugaaggagcugcugguggccaccaagaucaacagcagcgccaucaagcugcagcugaccgcccagagccaggugcagaugaagaagcagaaggugagcacccccagcgacuacacccugagcuuccugaagagacagagaaagggccuguaa

SEQ ID NO: 19795 - RNA, 420 nt, Artificial Sequence
  MEOX1__Homo_sapiens__NP_001035091
augggcaccagcagccugggccugguggacaccaccggcggccccggcgacgacuacggcgugcugggcagcaccgccaacgagaccgagaagaagagcagcagaagaagaaaggagagcagcgacaaccaggagaacagaggcaagcccgagggcagcagcaaggccagaaaggagagaaccgccuucaccaaggagcagcugagagagcuggaggccgaguucgcccaccacaacuaccugaccagacugagaagauacgagaucgccgugaaccuggaccugagcgagagacaggugaaggugugguuccagaacagaagaaugaaguggaagagagugaagggcggccagcccaucagccccaacggccaggaccccgaggacggcgacagcaccgccagccccagcagcgaguaa

SEQ ID NO: 19796 - RNA, 915 nt, Artificial Sequence
  MEOX2__Homo_sapiens__NP_005915
auggagcacccccuguucggcugccugagaagcccccacgccaccgcccagggccugcaccccuucagccagagcagccuggcccugcacggcagaagcgaccacaugagcuaccccgagcugagcaccagcagcagcagcugcaucaucgccggcuaccccaacgaggagggcauguucgccagccagcaccacagaggccaccaccaccaccaccaccaccaccaccaccaccaccaccagcagcagcagcaccaggcccugcagaccaacuggcaccugccccagaugagcagcccccccagcgccgccagacacagccugugccugcagcccgacagcggcggcccccccgagcugggcagcagcccccccgugcugugcagcaacagcagcagccugggcagcagcacccccaccggcgccgccugcgcccccggcgacuacggcagacaggcccugagccccgccgaggccgagaagagaagcggcggcaagagaaagagcgacagcagcgacagccaggagggcaacuacaagagcgaggugaacagcaagcccagaaaggagagaaccgccuucaccaaggagcagaucagagagcuggaggccgaguucgcccaccacaacuaccugaccagacugagaagauacgagaucgccgugaaccuggaccugaccgagagacaggugaaggugugguuccagaacagaagaaugaaguggaagagagugaagggcggccagcagggcgccgccgccagagagaaggagcuggugaacgugaagaagggcacccugcugcccagcgagcugagcggcaucggcgccgccacccugcagcagaccggcgacagcaucgccaacgaggacagccacgacagcgaccacagcagcgagcacgcccaccuguaa

SEQ ID NO: 19797 - RNA, 2241 nt, Artificial Sequence
  MEP1A__Homo_sapiens__NP_005579
auggccuggaucagaagcaccugcauccuguucuucacccugcuguucgcccacaucgccgccgugcccaucaaguaccugcccgaggagaacgugcacgacgccgacuucggcgagcagaaggacaucagcgagaucaaccuggccgccggccuggaccuguuccagggcgacauccugcugcagaagagcagaaacggccugagagaccccaacaccagauggaccuuccccauccccuacauccuggccgacaaccugggccugaacgccaagggcgccauccuguacgccuucgagauguucagacugaagagcugcguggacuucaagcccuacgagggcgagagcagcuacaucaucuuccagcaguucgacggcugcuggagcgaggugggcgaccagcacgugggccagaacaucagcaucggccagggcugcgccuacaaggccaucaucgagcacgagauccugcacgcccugggcuucuaccacgagcagagcagaaccgacagagacgacuacgugaacaucuggugggaccagauccugagcggcuaccagcacaacuucgacaccuacgacgacagccugaucaccgaccugaacacccccuacgacuacgagagccugaugcacuaccagcccuucagcuucaacaagaacgccagcgugcccaccaucaccgccaagauccccgaguucaacagcaucaucggccagagacuggacuucagcgccaucgaccuggagagacugaacagaauguacaacugcaccaccacccacacccugcuggaccacugcaccuucgagaaggccaacaucugcggcaugauccagggcaccagagacgacaccgacugggcccaccaggacagcgcccaggccggcgagguggaccacacccugcugggccagugcaccggcgccggcuacuucaugcaguucagcaccagcagcggcagcgccgaggaggccgcccugcuggagagcagaauccuguaccccaagagaaagcagcagugccugcaguucuucuacaagaugaccggcagccccagcgacagacugguggugugggugagaagagacgacagcaccggcaacgugagaaagcuggugaaggugcagaccuuccagggcgacgacgaccacaacuggaagaucgcccacguggugcugaaggaggagcagaaguucagauaccuguuccagggcaccaagggcgacccccagaacagcaccggcggcaucuaccuggacgacaucacccugaccgagacccccugccccaccggcguguggaccgugagaaacuucagccaggugcuggagaacaccagcaagggcgacaagcugcagagccccagauucuacaacagcgagggcuacggcuucggcgugacccuguaccccaacagcagagagagcagcggcuaccugagacuggccuuccacgugugcagcggcgagaacgacgccauccuggaguggcccguggagaacagacaggugaucaucaccauccuggaccaggagcccgacgugagaaacagaaugagcagcagcaugguguucaccaccagcaagagccacaccagccccgccaucaacgacaccgugaucugggacagacccagcagagugggcaccuaccacaccgacugcaacugcuucagaagcaucgaccugggcuggagcggcuucaucagccaccagaugcugaagagaagaagcuuccugaagaacgacgaccugaucaucuucguggacuucgaggacaucacccaccugagccagaccgaggugcccaccaagggcaagagacugagcccccagggccugauccugcagggccaggagcagcaggugagcgaggagggcagcggcaaggccaugcuggaggaggcccugcccgugagccugagccagggccagcccagcagacagaagagaagcguggagaacaccggcccccuggaggaccacaacuggccccaguacuucagagaccccugcgaccccaaccccugccagaacgacggcaucugcgugaacgugaagggcauggccagcugcagaugcaucagcggccacgccuucuucuacaccggcgagagaugccaggccgugcaggugcacggcagcgugcugggcauggugaucggcggcaccgccggcgugaucuuccugaccuucagcaucaucgccauccugagccagagacccagaaaguaa

SEQ ID NO: 19798 - RNA, 1578 nt, Artificial Sequence
  MEPE__Homo_sapiens__NP_001171623
augagaguguucugcgugggccugcugcuguucagcgugaccugggccgcccccaccuuccagccccagaccgagaagaccaagcagagcugcguggaggagcagagacaggaggagaagaacaaggacaacaucggcuuccaccaccugggcaagagaaucaaccaggagcugagcagcaaggagaacaucgugcaggagagaaagaaggaccugagccugagcgaggccagcgagaacaagggcagcagcaagagccagaacuacuucaccaacagacagagacugaacaaggaguacagcaucagcaacaaggagaacacccacaacggccugagaaugagcaucuaccccaagagcaccggcaacaagggcuucgaggacggcgacgacgccaucagcaagcugcacgaccaggaggaguacggcgccgcccugaucagaaacaacaugcagcacaucaugggccccgugaccgccaucaagcugcugggcgaggagaacaaggagaacacccccagaaacgugcugaacaucauccccgccagcaugaacuacgccaaggcccacagcaaggacaagaagaagccccagagagacagccaggcccagaagagccccgugaagagcaagagcacccacagaauccagcacaacaucgacuaccugaagcaccugagcaaggugaagaagauccccagcgacuucgagggcagcggcuacaccgaccugcaggagagaggcgacaacgacaucagccccuucagcggcgacggccagcccuucaaggacauccccggcaagggcgaggccaccggccccgaccuggagggcaaggacauccagaccggcuucgccggccccagcgaggccgagagcacccaccuggacaccaagaagcccggcuacaacgagauccccgagagagaggagaacggcggcaacaccaucggcaccagagacgagaccgccaaggaggccgacgccguggacgugagccugguggagggcagcaacgacaucaugggcagcaccaacuucaaggagcugcccggcagagagggcaacagaguggacgccggcagccagaacgcccaccagggcaagguggaguuccacuacccccccgcccccagcaaggagaagagaaaggagggcagcagcgacgccgccgagagcaccaacuacaacgagauccccaagaacggcaagggcagcaccagaaagggcguggaccacagcaacagaaaccaggccacccugaacgagaagcagagauuccccagcaagggcaagagccagggccugcccauccccagcagaggccuggacaacgagaucaagaacgagauggacagcuucaacggccccagccacgagaacaucaucacccacggcagaaaguaccacuacgugccccacagacagaacaacagcaccagaaacaagggcaugccccagggcaagggcagcuggggcagacagccccacagcaacagaagauucagcagcagaagaagagacgacagcagcgagagcagcgacagcggcagcagcagcgagagcgacggcgacuaa

SEQ ID NO: 19799 - RNA, 3000 nt, Artificial Sequence
  MERTK__Homo_sapiens__NP_006334
augggccccgccccccugccccugcugcugggccuguuccugcccgcccuguggagaagagccaucaccgaggccagagaggaggccaagcccuacccccuguuccccggccccuuccccggcagccugcagaccgaccacaccccccugcugagccugccccacgccagcggcuaccagcccgcccugauguucagccccacccagcccggcagaccccacaccggcaacguggccaucccccaggugaccagcguggagagcaagccccugcccccccuggccuucaagcacaccgugggccacaucauccugagcgagcacaagggcgugaaguucaacugcagcaucagcgugcccaacaucuaccaggacaccaccaucagcugguggaaggacggcaaggagcugcugggcgcccaccacgccaucacccaguucuaccccgacgacgaggugaccgccaucaucgccagcuucagcaucaccagcgugcagagaagcgacaacggcagcuacaucugcaagaugaagaucaacaacgaggagaucgugagcgaccccaucuacaucgaggugcagggccugccccacuucaccaagcagcccgagagcaugaacgugaccagaaacaccgccuucaaccugaccugccaggccgugggcccccccgagcccgugaacaucuucugggugcagaacagcagcagagugaacgagcagcccgagaagagccccagcgugcugaccgugcccggccugaccgagauggccguguucagcugcgaggcccacaacgacaagggccugaccgugagcaagggcgugcagaucaacaucaaggccauccccagcccccccaccgaggugagcaucagaaacagcaccgcccacagcauccugaucagcugggugcccggcuucgacggcuacagccccuucagaaacugcagcauccaggugaaggaggccgacccccugagcaacggcagcgugaugaucuucaacaccagcgcccugccccaccuguaccagaucaagcagcugcaggcccuggccaacuacagcaucggcgugagcugcaugaacgagaucggcuggagcgccgugagccccuggauccuggccagcaccaccgagggcgcccccagcguggccccccugaacgugaccguguuccugaacgagagcagcgacaacguggacaucagauggaugaagccccccaccaagcagcaggacggcgagcuggugggcuacagaaucagccacguguggcagagcgccggcaucagcaaggagcugcuggaggaggugggccagaacggcagcagagccagaaucagcgugcaggugcacaacgccaccugcaccgugagaaucgccgccgugaccagaggcggcgugggccccuucagcgaccccgugaagaucuucauccccgcccacggcuggguggacuacgcccccagcagcacccccgcccccggcaacgccgaccccgugcugaucaucuucggcugcuucugcggcuucauccugaucggccugauccuguacaucagccuggccaucagaaagagagugcaggagaccaaguucggcaacgccuucaccgaggaggacagcgagcugguggugaacuacaucgccaagaagagcuucugcagaagagccaucgagcugacccugcacagccugggcgugagcgaggagcugcagaacaagcuggaggacguggugaucgacagaaaccugcugauccugggcaagauccugggcgagggcgaguucggcagcgugauggagggcaaccugaagcaggaggacggcaccagccugaagguggccgugaagaccaugaagcuggacaacagcagccagagagagaucgaggaguuccugagcgaggccgccugcaugaaggacuucagccaccccaacgugaucagacugcugggcgugugcaucgagaugagcagccagggcauccccaagcccauggugauccugcccuucaugaaguacggcgaccugcacaccuaccugcuguacagcagacuggagaccggccccaagcacaucccccugcagacccugcugaaguucaugguggacaucgcccugggcauggaguaccugagcaacagaaacuuccugcacagagaccuggccgccagaaacugcaugcugagagacgacaugaccgugugcguggccgacuucggccugagcaagaagaucuacagcggcgacuacuacagacagggcagaaucgccaagaugcccgugaaguggaucgccaucgagagccuggccgacagaguguacaccagcaagagcgacgugugggccuucggcgugaccaugugggagaucgccaccagaggcaugacccccuaccccggcgugcagaaccacgagauguacgacuaccugcugcacggccacagacugaagcagcccgaggacugccuggacgagcuguacgagaucauguacagcugcuggagaaccgacccccuggacagacccaccuucagcgugcugagacugcagcuggagaagcugcuggagagccugcccgacgugagaaaccaggccgacgugaucuacgugaacacccagcugcuggagagcagcgagggccuggcccagggcagcacccuggccccccuggaccugaacaucgaccccgacagcaucaucgccagcugcacccccagagccgccaucagcguggugaccgccgaggugcacgacagcaagccccacgagggcagauacauccugaacggcggcagcgaggagugggaggaccugaccagcgcccccagcgccgccgugaccgccgagaagaacagcgugcugcccggcgagagacuggugagaaacggcgugagcuggagccacagcagcaugcugccccugggcagcagccugcccgacgagcugcuguucgccgacgacagcagcgagggcagcgaggugcugauguaa

SEQ ID NO: 19800 - RNA, 1089 nt, Artificial Sequence
  MESDC1__Homo_sapiens__NP_072088
auggccagcggcagcgccggcaagcccaccggcgaggccgccagccccgcccccgccagcgccaucggcggcgccagcagccagcccagaaagagacuggugagcgugugcgaccacugcaagggcaagaugcagcugguggccgaccugcugcugcugagcagcgaggccagacccgugcuguucgagggccccgccagcagcggcgccggcgccgagagcuucgagcagugcagagacaccaucaucgccagaaccaagggccugagcauccugacccacgacgugcagagccagcugaacaugggcagauucggcgaggccggcgacagccugguggagcugggcgaccugguggugagccugaccgagugcagcgcccacgccgccuaccuggccgccguggccacccccggcgcccagcccgcccagcccggccugguggacagauacagagugaccagaugcagacacgagguggagcagggcugcgccgugcugagagccaccccccuggccgacaugaccccccagcugcugcuggaggugagccagggccugagcagaaaccugaaguuccugaccgacgccugcgcccuggccagcgacaagagcagagacagauucagcagagagcaguucaagcugggcgugaagugcaugagcaccagcgccagcgcccugcuggccugcgugagagaggugaagguggcccccagcgagcuggccagaagcagaugcgcccuguucagcggcccccuggugcaggccgugagcgcccuggugggcuucgccaccgagccccaguuccugggcagagccgccgccgugagcgccgagggcaaggccgugcagaccgccauccugggcggcgccaugagcguggugagcgccugcgugcugcugacccagugccugagagaccuggcccagcaccccgacggcggcgccaagaugagcgaccacagagagagacugagaaacagcgccugcgccgugagcgagggcugcacccugcugagccaggcccugagagagagaagcagccccagaacccugccccccgugaacagcaacagcgugaacuaa

SEQ ID NO: 19801 - RNA, 705 nt, Artificial Sequence
  MESDC2__Homo_sapiens__NP_055969
auggccgccagcagaugggccagaaaggccguggugcugcugugcgccagcgaccugcugcugcugcugcugcugcugcccccccccggcagcugcgccgccgagggcagccccggcacccccgacgagagcacccccccccccagaaagaagaagaaggacaucagagacuacaacgacgccgacauggccagacugcuggagcagugggagaaggacgacgacaucgaggagggcgaccugcccgagcacaagagacccagcgcccccguggacuucagcaagaucgaccccagcaagcccgagagcauccugaagaugaccaagaagggcaagacccugaugauguucgugaccgugagcggcagccccaccgagaaggagaccgaggagaucaccagccuguggcagggcagccuguucaacgccaacuacgacgugcagagauucaucgugggcagcgacagagccaucuucaugcugagagacggcagcuacgccugggagaucaaggacuuccuggugggccaggacagaugcgccgacgugacccuggagggccagguguaccccggcaagggcggcggcagcaaggagaagaacaagaccaagcaggacaagggcaagaagaagaaggagggcgaccugaagagcagaagcagcaaggaggagaacagagccggcaacaagagagaggaccuguaa

SEQ ID NO: 19802 - RNA, 1194 nt, Artificial Sequence
  MESP2__Homo_sapiens__NP_001035047
auggcccagagcccccccccccagagccugcugggccacgaccacuggaucuucgcccagggcuggggcugggccggccacugggacagcaccagccccgccagcagcagcgacagcagcggcagcugccccugcgacggcgccagaggccugccccagccccagccccccagcugcagcagcagagccgccgaggccgccgccaccacccccagaagagccagaaccggccccgccggcggccagagacagagcgccagcgagagagagaagcugagaaugagaacccuggccagagcccugcacgagcugagaagauuccugccccccagccuggcccccgccggccagagccugaccaagaucgagacccugagacuggccaucagauacaucggccaccugagcgccgugcugggccugagcgaggagagccugcagugcagaagaagacagagaggcgacgccggcagccccuggggcugcccccugugccccgacagaggccccgccgaggcccagacccaggccgagggccagggccagggccagggccagggccagggccagggccagggccagggccagggccagggccagggccagggccagggcagaagacccggccuggugagcgccgugcuggccgaggccagcuggggcagccccagcgccugccccggcgcccaggccgcccccgagagacugggcagaggcgugcacgacaccgaccccugggccaccccccccuacugccccaagauccagagcccccccuacagcagccagggcaccaccagcgacgccagccuguggacccccccccagggcugccccuggacccagagcagccccgagcccagaaacccccccgugcccuggaccgccgcccccgccacccuggagcuggccgccguguaccagggccugagcgugagccccgagcccugccugagccugggcgcccccagccugcugccccaccccagcugccagagacugcagccccagacccccggcagaugcuggagccacagcgccgagguggugcccaacagcgaggaccagggccccggcgccgccuuccagcugagcgaggccagccccccccagagcagcggccugagauucagcggcugccccgagcuguggcaggaggaccuggagggcgccagacugggcaucuucuacuaa

SEQ ID NO: 19803 - RNA, 879 nt, Artificial Sequence
  MEST__Homo_sapiens__NP_001240831
augagagaguggugggugcaggugggccugcuggccgugccccugcuggccgccuaccugcacaucccccccccccagcugagccccgcccugcacagcuggaagagcagcggcaaguucuucaccuacaagggccugagaaucuucuaccaggacagcgugggcguggugggcagccccgagaucguggugcugcugcacggcuuccccaccagcagcuacgacugguacaagaucugggagggccugacccugagauuccacagagugaucgcccuggacuuccugggcuucggcuucagcgacaagcccagaccccaccacuacagcaucuucgagcaggccagcaucguggaggcccugcugagacaccugggccugcagaacagaagaaucaaccugcugagccacgacuacggcgacaucguggcccaggagcugcuguacagauacaagcagaacagaagcggcagacugaccaucaagagccugugccugagcaacggcggcaucuuccccgagacccacagaccccugcugcugcagaagcugcugaaggacggcggcgugcugagccccauccugaccagacugaugaacuucuucguguucagcagaggccugcugcaguacaucaaccagagaaagaaguucagaagaagaugggugggcgcccuggccagcgugaccauccccauccacuucaucuacggcccccuggaccccgugaaccccuaccccgaguuccuggagcuguacagaaagacccugcccagaagcaccgugagcauccuggacgaccacaucagccacuacccccagcuggaggaccccaugggcuuccugaacgccuacaugggcuucaucaacagcuucuaa

SEQ ID NO: 19804 - RNA, 1008 nt, Artificial Sequence
  METAP1D__Homo_sapiens__NP_954697
auggccgcccccagcggcgugcaccugcuggugagaagaggcagccacagaaucuucagcagcccccugaaccacaucuaccugcacaagcagagcagcagccagcagagaagaaacuucuucuucagaagacagagagacaucagccacagcaucgugcugcccgccgccgugagcagcgcccaccccgugcccaagcacaucaagaagcccgacuacgugaccaccggcaucgugcccgacuggggcgacagcaucgaggugaagaacgaggaccagauccagggccugcaccaggccugccagcuggccagacacgugcugcugcuggccggcaagagccugaagguggacaugaccaccgaggagaucgacgcccuggugcacagagagaucaucagccacaacgccuaccccagcccccugggcuacggcggcuuccccaagagcgugugcaccagcgugaacaacgugcugugccacggcauccccgacagcagaccccugcaggacggcgacaucaucaacaucgacgugaccguguacuacaacggcuaccacggcgacaccagcgagaccuuccuggugggcaacguggacgagugcggcaagaagcugguggagguggccagaagaugcagagacgaggccaucgccgccugcagagccggcgcccccuucagcgugaucggcaacaccaucagccacaucacccaccagaacggcuuccaggugugcccccacuucgugggccacggcaucggcagcuacuuccacggccaccccgagaucuggcaccacgccaacgacagcgaccugcccauggaggagggcauggccuucaccaucgagcccaucaucaccgagggcagccccgaguucaaggugcuggaggacgccuggaccguggugagccuggacaaccagagaagcgcccaguucgagcacaccgugcugaucaccagcagaggcgcccagauccugaccaagcugccccacgaggccuaa

SEQ ID NO: 19805 - RNA, 1161 nt, Artificial Sequence
  METAP1__Homo_sapiens__NP_055958
auggccgccguggagaccagagugugcgagaccgacggcugcagcagcgaggccaagcugcagugccccaccugcaucaagcugggcauccagggcagcuacuucugcagccaggagugcuucaagggcagcugggccacccacaagcugcugcacaagaaggccaaggacgagaaggccaagagagaggugagcagcuggaccguggagggcgacaucaacaccgaccccugggccggcuacagauacaccggcaagcugagaccccacuacccccugaugcccaccagacccgugcccagcuacauccagagacccgacuacgccgaccacccccugggcaugagcgagagcgagcaggcccugaagggcaccagccagaucaagcugcugagcagcgaggacaucgagggcaugagacuggugugcagacuggccagagaggugcuggacguggccgccggcaugaucaagcccggcgugaccaccgaggagaucgaccacgccgugcaccuggccugcaucgccagaaacugcuaccccagcccccugaacuacuacaacuuccccaagagcugcugcaccagcgugaacgaggugaucugccacggcauccccgacagaagaccccugcaggagggcgacaucgugaacguggacaucacccuguacagaaacggcuaccacggcgaccugaacgagaccuucuucgugggcgagguggacgacggcgccagaaagcuggugcagaccaccuacgagugccugaugcaggccaucgacgccgugaagcccggcgugagauacagagagcugggcaacaucauccagaagcacgcccaggccaacggcuucagcguggugagaagcuacugcggccacggcauccacaagcuguuccacaccgcccccaacgugccccacuacgccaagaacaaggccgugggcgugaugaagagcggccacguguucaccaucgagcccaugaucugcgagggcggcuggcaggacgagaccuggcccgacggcuggaccgccgugaccagagacggcaagagaagcgcccaguucgagcacacccugcuggugaccgacaccggcugcgagauccugaccagaagacuggacagcgccagaccccacuucaugagccaguucuaa

SEQ ID NO: 19806 - RNA, 1437 nt, Artificial Sequence
  METAP2__Homo_sapiens__NP_006829
auggccggcguggaggagguggccgccagcggcagccaccugaacggcgaccuggaccccgacgacagagaggagggcgccgccagcaccgccgaggaggccgccaagaagaagagaagaaagaagaagaagagcaagggccccagcgccgccggcgagcaggagcccgacaaggagagcggcgccagcguggacgagguggccagacagcuggagagaagcgcccuggaggacaaggagagagacgaggacgacgaggacggcgacggcgacggcgacggcgccaccggcaagaagaagaagaagaagaagaagaagagaggccccaaggugcagaccgacccccccagcgugcccaucugcgaccuguaccccaacggcguguuccccaagggccaggagugcgaguacccccccacccaggacggcagaaccgccgccuggagaaccaccagcgaggagaagaaggcccuggaccaggccagcgaggagaucuggaacgacuucagagaggccgccgaggcccacagacaggugagaaaguacgugaugagcuggaucaagcccggcaugaccaugaucgagaucugcgagaagcuggaggacugcagcagaaagcugaucaaggagaacggccugaacgccggccuggccuuccccaccggcugcagccugaacaacugcgccgcccacuacacccccaacgccggcgacaccaccgugcugcaguacgacgacaucugcaagaucgacuucggcacccacaucagcggcagaaucaucgacugcgccuucaccgugaccuucaaccccaaguacgacacccugcugaaggccgugaaggacgccaccaacaccggcaucaagugcgccggcaucgacgugagacugugcgacgugggcgaggccauccaggaggugauggagagcuacgagguggagaucgacggcaagaccuaccaggugaagcccaucagaaaccugaacggccacagcaucggccaguacagaauccacgccggcaagaccgugcccaucgugaagggcggcgaggccaccagaauggaggagggcgagguguacgccaucgagaccuucggcagcaccggcaagggcguggugcacgacgacauggagugcagccacuacaugaagaacuucgacgugggccacgugcccaucagacugcccagaaccaagcaccugcugaacgugaucaacgagaacuucggcacccuggccuucugcagaagauggcuggacagacugggcgagagcaaguaccugauggcccugaagaaccugugcgaccugggcaucguggaccccuaccccccccugugcgacaucaagggcagcuacaccgcccaguucgagcacaccauccugcugagacccaccugcaaggagguggugagcagaggcgacgacuacuaa

SEQ ID NO: 19807 - RNA, 4173 nt, Artificial Sequence
  MET__Homo_sapiens__NP_000236
augaaggcccccgccgugcuggcccccggcauccuggugcugcuguucacccuggugcagagaagcaacggcgagugcaaggaggcccuggccaagagcgagaugaacgugaacaugaaguaccagcugcccaacuucaccgccgagacccccauccagaacgugauccugcacgagcaccacaucuuccugggcgccaccaacuacaucuacgugcugaacgaggaggaccugcagaagguggccgaguacaagaccggccccgugcuggagcaccccgacugcuuccccugccaggacugcagcagcaaggccaaccugagcggcggcguguggaaggacaacaucaacauggcccuggugguggacaccuacuacgacgaccagcugaucagcugcggcagcgugaacagaggcaccugccagagacacguguucccccacaaccacaccgccgacauccagagcgaggugcacugcaucuucagcccccagaucgaggagcccagccagugccccgacugcguggugagcgcccugggcgccaaggugcugagcagcgugaaggacagauucaucaacuucuucgugggcaacaccaucaacagcagcuacuuccccgaccacccccugcacagcaucagcgugagaagacugaaggagaccaaggacggcuucauguuccugaccgaccagagcuacaucgacgugcugcccgaguucagagacagcuaccccaucaaguacgugcacgccuucgagagcaacaacuucaucuacuuccugaccgugcagagagagacccuggacgcccagaccuuccacaccagaaucaucagauucugcagcaucaacagcggccugcacagcuacauggagaugccccuggagugcauccugaccgagaagagaaagaagagaagcaccaagaaggagguguucaacauccugcaggccgccuacgugagcaagcccggcgcccagcuggccagacagaucggcgccagccugaacgacgacauccuguucggcguguucgcccagagcaagcccgacagcgccgagcccauggacagaagcgccaugugcgccuuccccaucaaguacgugaacgacuucuucaacaagaucgugaacaagaacaacgugagaugccugcagcacuucuacggccccaaccacgagcacugcuucaacagaacccugcugagaaacagcagcggcugcgaggccagaagagacgaguacagaaccgaguucaccaccgcccugcagagaguggaccuguucaugggccaguucagcgaggugcugcugaccagcaucagcaccuucaucaagggcgaccugaccaucgccaaccugggcaccagcgagggcagauucaugcaggugguggugagcagaagcggccccagcaccccccacgugaacuuccugcuggacagccaccccgugagccccgaggugaucguggagcacacccugaaccagaacggcuacacccuggugaucaccggcaagaagaucaccaagaucccccugaacggccugggcugcagacacuuccagagcugcagccagugccugagcgccccccccuucgugcagugcggcuggugccacgacaagugcgugagaagcgaggagugccugagcggcaccuggacccagcagaucugccugcccgccaucuacaagguguuccccaacagcgccccccuggagggcggcaccagacugaccaucugcggcugggacuucggcuucagaagaaacaacaaguucgaccugaagaagaccagagugcugcugggcaacgagagcugcacccugacccugagcgagagcaccaugaacacccugaagugcaccgugggccccgccaugaacaagcacuucaacaugagcaucaucaucagcaacggccacggcaccacccaguacagcaccuucagcuacguggaccccgugaucaccagcaucagccccaaguacggccccauggccggcggcacccugcugacccugaccggcaacuaccugaacagcggcaacagcagacacaucagcaucggcggcaagaccugcacccugaagagcgugagcaacagcauccuggagugcuacacccccgcccagaccaucagcaccgaguucgccgugaagcugaagaucgaccuggccaacagagagaccagcaucuucagcuacagagaggaccccaucguguacgagauccaccccaccaagagcuucaucagcggcggcagcaccaucaccggcgugggcaagaaccugaacagcgugagcgugcccagaauggugaucaacgugcacgaggccggcagaaacuucaccguggccugccagcacagaagcaacagcgagaucaucugcugcaccacccccagccugcagcagcugaaccugcagcugccccugaagaccaaggccuucuucaugcuggacggcauccugagcaaguacuucgaccugaucuacgugcacaaccccguguucaagcccuucgagaagcccgugaugaucagcaugggcaacgagaacgugcuggagaucaagggcaacgacaucgaccccgaggccgugaagggcgaggugcugaaggugggcaacaagagcugcgagaacauccaccugcacagcgaggccgugcugugcaccgugcccaacgaccugcugaagcugaacagcgagcugaacaucgaguggaagcaggccaucagcagcaccgugcugggcaaggugaucgugcagcccgaccagaacuucaccggccugaucgccggcguggugagcaucagcaccgcccugcugcugcugcugggcuucuuccuguggcugaagaagagaaagcagaucaaggaccugggcagcgagcuggugagauacgacgccagagugcacaccccccaccuggacagacuggugagcgccagaagcgugagccccaccaccgagauggugagcaacgagagcguggacuacagagccaccuuccccgaggaccaguuccccaacagcagccagaacggcagcugcagacaggugcaguacccccugaccgacaugagccccauccugaccagcggcgacagcgacaucagcagcccccugcugcagaacaccgugcacaucgaccugagcgcccugaaccccgagcuggugcaggccgugcagcacguggugaucggccccagcagccugaucgugcacuucaacgaggugaucggcagaggccacuucggcugcguguaccacggcacccugcuggacaacgacggcaagaagauccacugcgccgugaagagccugaacagaaucaccgacaucggcgaggugagccaguuccugaccgagggcaucaucaugaaggacuucagccaccccaacgugcugagccugcugggcaucugccugagaagcgagggcagcccccugguggugcugcccuacaugaagcacggcgaccugagaaacuucaucagaaacgagacccacaaccccaccgugaaggaccugaucggcuucggccugcagguggccaagggcaugaaguaccuggccagcaagaaguucgugcacagagaccuggccgccagaaacugcaugcuggacgagaaguucaccgugaagguggccgacuucggccuggccagagacauguacgacaaggaguacuacagcgugcacaacaagaccggcgccaagcugcccgugaaguggauggcccuggagagccugcagacccagaaguucaccaccaagagcgacguguggagcuucggcgugcugcugugggagcugaugaccagaggcgccccccccuaccccgacgugaacaccuucgacaucaccguguaccugcugcagggcagaagacugcugcagcccgaguacugccccgacccccuguacgaggugaugcugaagugcuggcaccccaaggccgagaugagacccagcuucagcgagcuggugagcagaaucagcgccaucuucagcaccuucaucggcgagcacuacgugcacgugaacgccaccuacgugaacgugaagugcguggcccccuaccccagccugcugagcagcgaggacaacgccgacgacgagguggacaccagacccgccagcuucugggagaccagcuaa

SEQ ID NO: 19808 - RNA, 882 nt, Artificial Sequence
  METRN__Homo_sapiens__NP_076947
augggcuuccccgccgccgcccugcugugcgcccugugcugcggccugcuggcccccgccgccagagccggcuacagcgaggagagaugcagcuggagaggcagcggccugacccaggagcccggcagcgugggccagcuggcccuggccugcgccgagggcgccguggaguggcuguaccccgccggcgcccugagacugacccugggcggccccgaccccagagccagacccggcaucgccugccugagacccgugagacccuucgccggcgcccagguguucgccgagagagccggcggcgcccuggagcugcugcuggccgagggccccggccccgccggcggcagaugcgugagauggggccccagagagagaagagcccuguuccugcaggccaccccccaccaggacaucagcagaagaguggccgccuucagauucgagcugagagaggacggcagacccgagcugcccccccaggcccacggccugggcguggacggcgccugcagacccugcagcgacgccgagcugcugcuggccgccugcaccagcgacuucgugauccacggcaucauccacggcgugacccacgacguggagcugcaggagagcgugaucaccgugguggccgccagagugcugagacagacccccccccuguuccaggccggcagaagcggcgaccagggccugaccagcaucagaaccccccugagaugcggcgugcaccccggccccggcaccuuccuguucaugggcuggagcagauucggcgaggccagacugggcugcgcccccagauuccaggaguucagaagagccuacgaggccgccagagccgcccaccugcaccccugcgagguggcccugcacuaa

SEQ ID NO: 19809 - RNA, 1632 nt, Artificial Sequence
  METTL13__Homo_sapiens__NP_001007240
augaaccugcugcccaagagcagcagagaguucggcagcguggacuacugggagaaguucuuccagcagagaggcaagaaggccuucgagugguacggcaccuaccuggagcugugcggcgugcugcacaaguacaucaagcccagagagaaggugcuggugaucggcugcggcaacagcgagcugagcgagcagcuguacgacgugggcuacagagacaucgugaacaucgacaucagcgagguggugaucaagcagaugaaggagugcaacgccaccagaagaccccagaugagcuuccugaagauggacaugacccagauggaguuccccgacgccagcuuccagguggugcuggacaagggcacccuggacgccgugcugaccgacgaggaggagaagacccugcagcagguggacagaaugcuggccgaggugggcagagugcugcagggcagagagaccgaguggcuguucggcauggacgagggcagaaagcagcuggccgccagcgccggcuucagaagacugaucaccguggcccugcacagaggccagcaguacgagagcauggaccacauccaggccgagcugagcgccagagugauggagcuggcccccgccggcaugcccacccagcagcaggugcccuuccugagcgugggcggcgacaucggcgugagaaccgugcagcaccaggacugcagcccccugagcggcgacuacgugaucgaggacgugcagggcgacgacaagagauacuucagaagacugaucuuccugagcaacagaaacguggugcagagcgaggccagacugcugaaggacgugagccacaaggcccagaagaagagaaagaaggacagaaagaagcagagacccgccgacgccgaggaccugcccgccgcccccggccagagcaucgacaagagcuaccugugcugcgagcaccacaaggccaugaucgccggccuggcccugcugagaaaccccgagcugcugcuggagaucccccuggcccugcugguggugggccugggcggcggcagccugccccuguucgugcacgaccacuuccccaagagcugcaucgacgccguggagaucgaccccagcaugcuggagguggccacccagugguucggcuucagccagagcgacagaaugaaggugcacaucgccgacggccuggacuacaucgccagccuggccggcggcggcgaggccagacccugcuacgacgugaucauguucgacguggacagcaaggaccccacccugggcaugagcugccccccccccgccuucguggagcagagcuuccugcagaaggugaagagcauccugacccccgagggcguguucauccugaaccuggugugcagagaccugggccugaaggacagcgugcuggccggccugaaggccguguucccccugcuguacgugagaagaaucgagggcgaggugaacgagauccuguucugccagcugcaccccgagcagaagcuggccacccccgagcugcuggagaccgcccaggcccuggagagaacccugagaaagcccggcagaggcugggacgacaccuacgugcugagcgacaugcugaagaccgugaagaucguguaa

SEQ ID NO: 19810 - RNA, 1689 nt, Artificial Sequence
  METTL16__Homo_sapiens__NP_076991
auggcccugagcaagagcaugcacgccagaaacagauacaaggacaagccccccgacuucgccuaccuggccagcaaguaccccgacuucaagcagcacgugcagaucaaccugaacggcagagugagccugaacuucaaggaccccgaggccgugagagcccugaccugcacccugcugagagaggacuucggccugagcaucgacaucccccuggagagacugauccccaccgugccccugagacugaacuacauccacuggguggaggaccugaucggccaccaggacagcgacaagagcacccugagaagaggcaucgacaucggcaccggcgccagcugcaucuacccccugcugggcgccacccugaacggcugguacuuccuggccaccgagguggacgacaugugcuucaacuacgccaagaagaacguggagcagaacaaccugagcgaccugaucaagguggugaaggugccccagaagacccugcugauggacgcccugaaggaggagagcgagaucaucuacgacuucugcaugugcaacccccccuucuucgccaaccagcuggaggccaagggcgugaacagcagaaaccccagaagacccccccccagcagcgugaacaccggcggcaucaccgagaucauggccgagggcggcgagcuggaguucgugaagagaaucauccacgacagccugcagcugaagaagagacugagaugguacagcugcaugcugggcaagaagugcagccuggccccccugaaggaggagcugagaauccagggcgugcccaaggugaccuacaccgaguucugccagggcagaaccaugagaugggcccuggccuggagcuucuacgacgacgugaccgugcccagcccccccagcaagagaagaaagcuggagaagcccagaaagcccaucaccuucguggugcuggccagcgugaugaaggagcugagccugaaggccagcccccugagaagcgagaccgccgagggcaucgugguggugaccaccuggaucgagaagauccugaccgaccugaaggugcagcacaagagagugcccugcggcaaggaggaggugagccuguuccugaccgccaucgagaacagcuggauccaccugagaagaaagaagagagagagagugagacagcugagagaggugcccagagcccccgaggacgugauccaggcccuggaggagaagaagcccacccccaaggagagcggcaacagccaggagcuggccagaggcccccaggagagaacccccugcggccccgcccugagagagggcgaggccgccgccguggagggccccugccccagccaggagagccugagccaggaggagaaccccgagcccaccgaggacgagagaagcgaggagaagggcggcguggaggugcuggagagcugccagggcagcagcaacggcgcccaggaccaggaggccagcgagcaguucggcagccccguggccgagagaggcaagagacugcccggcguggccggccaguaccuguucaagugccugaucaacgugaagaaggagguggacgacgcccugguggagaugcacuggguggagggccagaacagagaccugaugaaccagcugugcaccuacaucagaaaccagaucuucagacugguggccgugaacuaa

SEQ ID NO: 19811 - RNA, 1437 nt, Artificial Sequence
  METTL17__Homo_sapiens__NP_001025162
auggccgccgcccugaagugccugcugacccugggcagauggugccccggccugggcguggccccccaggccagagcccuggccgcccuggugcccggcgugacccagguggacaacaagagcggcuuccugcagaagagaccccacagacagcaccccggcauccugaagcugccccacgugagacugccccaggcccuggccaacggcgcccagcugcugcugcugggcagcgccggccccaccauggagaaccaggugcagacccugaccagcuaccuguggagcagacaccugcccguggagcccgaggagcugcagagaagagccagacaccuggagaagaaguuccuggagaaccccgaccugagccagaccgaggagaagcugagaggcgccgugcugcacgcccugagaaagaccaccuaccacuggcaggagcugagcuacaccgagggccugagccugguguacauggccgccagacuggacggcggcuucgccgccgugagcagagccuuccacgagaucagagccagaaaccccgccuuccagccccagacccugauggacuucggcagcggcaccggcagcgugaccugggccgcccacagcaucuggggccagagccugagagaguacaugugcguggacagaagcgccgccaugcuggugcuggccgagaagcugcugaagggcggcagcgagagcggcgagcccuacauccccggcguguucuucagacaguuccugcccgugagccccaaggugcaguucgacgugguggugagcgccuucagccugagcgagcugcccagcaaggccgacagaaccgagguggugcagacccuguggagaaagaccggccacuuccuggugcugguggagaacggcaccaaggccggccacagccugcugauggacgccagagaccuggugcugaagggcaaggagaagagcccccuggaccccagacccggcuucguguucgcccccugcccccacgagcugcccugcccccagcugaccaaccuggccugcagcuucagccaggccuaccaccccauccccuucagcuggaacaagaagcccaaggaggagaaguucagcauggugauccuggccagaggcagccccgaggaggcccacagauggcccagaaucacccagcccgugcugaagagacccagacacgugcacugccaccugugcugccccgacggccacaugcagcacgccgugcugaccgccagaagacacggcagauacggcggcugcgaccagaaccagugggacguggccggcagcugcagccccagacagcaccuguucccccagggcuucgugagccugugccccugccagcugcugggcagaagcuucaccugcgccuacagcgugugcgugagcagcaucuacggcagcggcagccuguaa

SEQ ID NO: 19812 - RNA, 1119 nt, Artificial Sequence
  METTL18__Homo_sapiens__NP_001307130
augaccuuccaguucaacuucaccaucgaggaccaccuggagaacgagcugacccccaucagagacggcgcccugacccuggacagcagcaaggagcugagcgugagcgagagccagaagggcgaggagagagacagaaagugcagcgccgagcaguucgaccugccccaggaccaccugugggagcacaagagcauggagaacgccgcccccagccaggacaccgacagcccccugagcgccgccagcagcagcagaaaccuggagccccacggcaagcagcccagccugagagccgccaaggagcacgccaugcccaaggaccugaagaagaugcuggagaacaaggugaucgagacccugcccggcuuccagcacgugaagcugagcguggugaagaccauccugcugaaggagaacuuccccggcgagaacaucgugagcaagagcuucagcagccacagcgaccugaucaccggcguguacgagggcggccugaagaucugggagugcaccuucgaccugcuggccuacuucaccaaggccaaggugaaguucgccggcaagaaggugcuggaccugggcugcggcagcggccugcugggcaucaccgccuucaagggcggcagcaaggagauccacuuccaggacuacaacagcauggugaucgacgaggugacccugcccaacgugguggccaacagcacccuggaggacgaggagaacgacgugaacgagcccgacgugaagagaugcagaaagcccaaggugacccagcuguacaagugcagauucuucagcggcgaguggagcgaguucugcaagcuggugcugagcagcgagaagcuguucgugaaguacgaccugauccugaccagcgagaccaucuacaaccccgacuacuacagcaaccugcaccagaccuuccugagacugcugagcaagaacggcagagugcugcuggccagcaaggcccacuacuucggcgugggcggcggcgugcaccuguuccagaaguucguggaggagagagacguguucaagaccagaauccugaagaucaucgacgagggccugaagagauucaucaucgagaucaccuucaaguuccccggcuaa

SEQ ID NO: 19813 - RNA, 831 nt, Artificial Sequence
  METTL1__Homo_sapiens__NP_005362
auggccgccgagaccagaaacguggccggcgccgaggccccccccccccagaagagauacuacagacagagagcccacagcaaccccauggccgaccacacccugagauaccccgugaagcccgaggagauggacuggagcgagcuguaccccgaguucuucgccccccugacccagaaccagagccacgacgaccccaaggacaagaaggagaagagagcccaggcccagguggaguucgccgacaucggcugcggcuacggcggccugcugguggagcugagcccccuguuccccgacacccugauccugggccuggagaucagagugaaggugagcgacuacgugcaggacagaaucagagcccugagagccgcccccgccggcggcuuccagaacaucgccugccugagaagcaacgccaugaagcaccugcccaacuucuucuacaagggccagcugaccaagauguucuuccuguuccccgacccccacuucaagagaaccaagcacaaguggagaaucaucagccccacccugcuggccgaguacgccuacgugcugagagugggcggccugguguacaccaucaccgacgugcuggagcugcacgacuggaugugcacccacuucgaggagcacccccuguucgagagagugccccuggaggaccugagcgaggaccccguggugggccaccugggcaccagcaccgaggagggcaagaaggugcugagaaacggcggcaagaacuuccccgccaucuucagaagaauccaggaccccgugcugcaggccgugaccagccagaccagccugcccggccacuaa

SEQ ID NO: 19814 - RNA, 657 nt, Artificial Sequence
  METTL21A__Homo_sapiens__NP_660323
auggcccuggugcccuacgaggagaccaccgaguucggccugcagaaguuccacaagccccuggccaccuucagcuucgccaaccacaccauccagaucagacaggacuggagacaccugggcguggccgccguggugugggacgccgccaucgugcugagcaccuaccuggagaugggcgccguggagcugagaggcagaagcgccguggagcugggcgccggcaccggccuggugggcaucguggccgcccugcugggcgcccacgugaccaucaccgacagaaagguggcccuggaguuccugaagagcaacgugcaggccaaccugcccccccacauccagaccaagaccguggugaaggagcugaccuggggccagaaccugggcagcuucagccccggcgaguucgaccugauccugggcgccgacaucaucuaccuggaggagaccuucaccgaccugcugcagacccuggagcaccugugcagcaaccacagcgugauccugcuggccugcagaaucagauacgagagagacaacaacuuccuggccaugcuggagagacaguucaccgugagaaaggugcacuacgaccccgagaaggacgugcacaucuacgaggcccagaagagaaaccagaaggaggaccuguaa

SEQ ID NO: 19815 - RNA, 681 nt, Artificial Sequence
  METTL21B__Homo_sapiens__NP_056248
auggccgaccccggccccgaccccgagagcgagagcgagagcguguuccccagagaggugggccuguucgccgacagcuacagcgagaagagccaguucugcuucugcggccacgugcugaccaucacccagaacuucggcagcagacugggcguggccgccagagugugggacgccgcccugagccugugcaacuacuucgagagccagaacguggacuucagaggcaagaaggugaucgagcugggcgccggcaccggcaucgugggcauccuggccgcccugcagggcggcgacgugaccaucaccgaccugccccuggcccuggagcagauccagggcaacgugcaggccaacgugcccgccggcggccaggcccaggugagagcccugagcuggggcaucgaccaccacguguuccccgccaacuacgaccuggugcugggcgccgacaucguguaccuggagcccaccuucccccugcugcugggcacccugcagcaccugugcagaccccacggcaccaucuaccuggccagcaagaugagaaaggagcacggcaccgagagcuucuuccagcaccugcugccccagcacuuccagcuggagcuggcccagagagacgaggacgagaacgugaacaucuacagagccagacacagagagcccagacccgccuaa

SEQ ID NO: 19816 - RNA, 795 nt, Artificial Sequence
  METTL21C__Homo_sapiens__NP_001010977
auggacgugugccugagcagcgcccagcagcccggcagaagaggcgagggccugagcagccccggcggcuggcuggaggccgagaagaagggcgccccccagaaggacagcaccggcggcgugcuggaggagagcaacaagaucgagcccagccugcacagccugcagaaguucgugcccaccgacuacgccagcuacacccaggagcacuacagauucgccggcaaggagaucgugauccaggagagcaucgagagcuacggcgccgugguguggcccggcgccauggcccugugccaguaccuggaggagcacgccgaggagcugaacuuccaggacgccaagauccuggagaucggcgccggccccggccuggugagcaucguggccagcauccugggcgcccaggugaccgccaccgaccugcccgacgugcugggcaaccugcaguacaaccugcugaagaacacccugcagugcaccgcccaccugcccgaggugaaggagcugguguggggcgaggaccuggacaagaacuuccccaagagcgccuucuacuacgacuacgugcuggccagcgacgugguguaccaccacuacuuccuggacaagcugcugaccaccaugguguaccugagccagcccggcaccgugcugcugugggccaacaaguucagauucagcaccgacuacgaguuccuggacaaguucaagcagguguucgacaccacccugcuggccgaguaccccgagagcagcgugaagcuguucaagggcauccugaagugggacuaa

SEQ ID NO: 19817 - RNA, 1101 nt, Artificial Sequence
  METTL24__Homo_sapiens__NP_001116836
auggccagagagagaccccccggcagaggcugcggcgugcugagaagaugccugcugggcgccgugcugcuguucggccugagacugugcgccgagcugagaagagccggccccggcagccccaccagaagcgccccccccggccccgccuggagaccccccggcccccaccugccccccgcccccggccagcccagaggcgccagcagaagacaggugaccuacgugagaagcggcagaagagccccccccggcggcggcggcagcggcacccccgagcccggcugcugcgcccccagaggcagacccagaagaaagggccccagauggcacaucgaccugcagcccugggccggcagcgcccagagccuggacgaggaggccuggagauuccugagauacaucagcaccacccagaucgccugcaaccacaugaacaccgacagccuggccaccgacagcagccccacccacaagcccuggagcgugugccuggacgacagauucaaccuggcccaccagaucagaaacaagcagugcagacuguacagccugggccugggcagcgacgacacccacuucgaggugagcauggccaacaacggcugcgaggugcacagauucgaccccagcgugaagagcgcccacauccuggagagccagcaccugugguaccacagacugagcaucgacuggagagacccccaccccgccguggccgcccagaagccccacagcaacaccagaaagcugggcagcauccugaacgaguucggccaccacaagaucgacgugcugaaggccgaccuggagagcgccgaguggaaggugcuggagaaccugauccuggaggacgugcuggagcagaucggccagcugaucuucgagauccaccugcacuggcccggcuucgaggugagcggcagcgacagcagcguggugagauucugguacagccugcugaaggagcuggagcagaaggacuucagacuguuccacagcuacaaggaccugagcaagccccagcuguuccugaagaaggacaucuucaacgccagcagcugcuacacccugagcugggugaacaccagauggaaguaa

SEQ ID NO: 19818 - RNA, 723 nt, Artificial Sequence
  METTL6__Homo_sapiens__XP_005264927
auggccagccugcagagaaagggccugcaggccagaauccugaccagcgaggaggaggagaagcugaagagagaccagacccuggugagcgacuucaagcagcagaagcuggagcaggaggcccagaagaacugggaccuguucuacaagagaaacagcaccaacuucuucaaggacagacacuggaccaccagagaguucgaggagcugagaagcugcagagaguucgaggaccagaagcugaccaugcuggaggccggcugcggcgugggcaacugccuguucccccugcuggaggaggaccccaacaucuucgccuacgccugcgacuucagccccagagccaucgaguacgugaagcagaacccccuguacgacaccgagagaugcaagguguuccagugcgaccugaccaaggacgaccugcuggaccacgugccccccgagagcguggacguggugaugcugaucuucgugcugagcgccgugcaccccgacaagaugcaccuggugcugcagaacaucuacaagugccacggcugcagcagcgagcugagacagcccugggacaaggacgacuucgccgugaccugggaccccuggagccccgccaucagagugcugcugugccacagcggcuggagcgccguggccuggaccuggcugaccgccgccagcaccagcugggcccaggccgugcugcccccccagccccugaaguaa

SEQ ID NO: 19819 - RNA, 735 nt, Artificial Sequence
  METTL7A__Homo_sapiens__NP_054752
auggagcugaccaucuucauccugagacuggccaucuacauccugaccuucccccuguaccugcugaacuuccugggccuguggagcuggaucugcaagaagugguuccccuacuuccuggugagauucaccgugaucuacaacgagcagauggccagcaagaagagagagcuguucagcaaccugcaggaguucgccggccccagcggcaagcugagccugcuggaggugggcugcggcaccggcgccaacuucaaguucuacccccccggcugcagagugaccugcaucgaccccaaccccaacuucgagaaguuccugaucaagagcaucgccgagaacagacaccugcaguucgagagauucgugguggccgccggcgagaacaugcaccagguggccgacggcagcguggacgugguggugugcacccuggugcugugcagcgugaagaaccaggagagaauccugagagaggugugcagagugcugagacccggcggcgccuucuacuucauggagcacguggccgccgagugcagcaccuggaacuacuucuggcagcaggugcuggaccccgccuggcaccugcuguucgacggcugcaaccugaccagagagagcuggaaggcccuggagagagccagcuucagcaagcugaagcugcagcacauccaggccccccugagcugggagcuggugagaccccacaucuacggcuacgccgugaaguaa

SEQ ID NO: 19820 - RNA, 954 nt, Artificial Sequence
  METTL9__Homo_sapiens__NP_001070648
augagacugcuggccggcuggcugugccugagccuggccagcguguggcuggccagaagaauguggacccugagaagcccccugaccagaagccuguacgugaacaugaccagcggccccggcggccccgccgccgccgccggcggcagaaaggagaaccaccagugguacgugugcaacagagagaagcugugcgagagccugcaggccguguucgugcagagcuaccuggaccagggcacccagaucuuccugaacaacagcaucgagaagagcggcuggcuguucauccagcuguaccacagcuucgugagcagcguguucagccuguucaugagcagaaccagcaucaacggccugcugggcagaggcagcauguucguguucagccccgaccaguuccagagacugcugaagaucaaccccgacuggaagacccacagacugcuggaccugggcgccggcgacggcgaggugaccaagaucaugagcccccacuucgaggagaucuacgccaccgagcugagcgagaccaugaucuggcagcugcagaagaagaaguacagagugcugggcaucaacgaguggcagaacaccggcuuccaguacgacgugaucagcugccugaaccugcuggacagaugcgaccagccccugacccugcugaaggacaucagaagcgugcuggagcccaccagaggcagagugauccuggcccuggugcugcccuuccaccccuacguggagaacggcggcaagugggagaagcccagcgagauccuggagaucaagggccagaacugggaggagcaggugaacagccugcccgagguguucagaaaggccggcuucgugaucgaggccuucaccagacugcccuaccugugcgagggcgacauguacaacgacuacuacgugcuggacgacgccguguucgugcugaagcccguguaa

SEQ ID NO: 19821 - RNA, 1710 nt, Artificial Sequence
  MEX3B__Homo_sapiens__NP_115622
augcccagcagccuguucgccgaccuggagagaaacggcagcggcggcggcggcggcggcagcagcggcggcggcgagacccuggacgaccagagagcccugcagcuggcccuggaccagcugagccugcugggccuggacagcgacgagggcgccagccuguacgacagcgagcccagaaagaagagcgugaacaugaccgagugcgugcccgugcccagcagcgagcacguggccgagaucgugggcagacagggcugcaagaucaaggcccugagagccaagaccaacaccuacaucaagacccccgugagaggcgaggagcccguguucguggugaccggcagaaaggaggacguggccauggccagaagagagaucaucagcgccgccgagcacuucagcaugaucagagccagcagaaacaagaacaccgcccugaacggcgccgugcccggcccccccaaccugcccggccagaccaccauccaggugagagugcccuacagaguggugggccugguggugggccccaagggcgccaccaucaagagaauccagcagcagacccacaccuacaucgugacccccagcagagacaaggagcccguguucgaggugaccggcaugcccgagaacguggacagagccagagaggagaucgaggcccacaucgcccugagaaccggcggcaucaucgagcugaccgacgagaacgacuuccacgccaacggcaccgacgugggcuucgaccugcaccacggcagcggcggcagcggccccggcagccuguggagcaagcccacccccagcaucacccccacccccggcagaaagcccuucagcagcuacagaaacgacagcagcagcagccugggcagcgccagcaccgacagcuacuucggcggcggcaccagcagcagcgccgccgccacccagagacuggccgacuacagcccccccagccccgcccugagcuucgcccacaacggcaacaacaacaacaacggcaacggcuacaccuacaccgccggcggcgaggccagcgugcccagccccgacggcugccccgagcugcagcccaccuucgaccccgcccccgcccccccccccggcgccccccugaucugggcccaguucgagagaagccccggcggcggccccgccgcccccgugagcagcagcugcagcagcagcgccagcagcagcgccagcagcagcagcgugguguuccccggcggcggcgccagcgcccccagcaacgccaaccugggccugcuggugcacagaagacugcaccccggcaccagcugccccagacugagccccccccugcacauggcccccggcgccggcgagcaccaccuggccagaagagugagaagcgaccccggcggcggcggccuggccuacgccgccuacgccaacggccugggcgcccagcugcccggccugcagcccagcgacaccagcggcagcagcagcagcagcagcagcagcagcagcagcagcagcagcagcagcggccugagaagaaagggcagcagagacugcagcgugugcuucgagagcgaggugaucgccgcccuggugcccugcggccacaaccuguucugcauggagugcgccaacagaaucugcgagaagagcgagcccgagugccccgugugccacaccgccgugacccaggccaucagaaucuucagcuaa

SEQ ID NO: 19822 - RNA, 1980 nt, Artificial Sequence
  MEX3C__Homo_sapiens__NP_057710
augcccagcggcagcagcgccgcccuggcccuggccgccgcccccgccccccugccccagccccccccccccccccccccccccccccccccccugcccccccccagcggcggccccgagcuggagggcgacggccugcugcugagagagagacuggccgcccugggccuggacgaccccagccccgccgagcccggcgcccccgcccugagagcccccgccgccgccgcccagggccaggccagaagagccgccgagcugagccccgaggagagagccccccccggcagacccggcgcccccgaggccgccgagcuggagcuggaggaggacgaggaggagggcgaggaggccgagcuggacggcgaccugcuggaggaggaggagcuggaggaggccgaggaggaggacagaagcagccugcugcugcugagcccccccgccgccaccgccagccagacccagcagauccccggcggcagccugggcagcgugcugcugcccgccgccagauucgacgccagagaggccgccgccgccgccgccgccgccggcgugcuguacggcggcgacgacgcccagggcaugauggccgccaugcugagccacgccuacggccccggcggcugcggcgccgccgccgccgcccugaacggcgagcaggccgcccugcugagaagaaagagcgugaacaccaccgagugcgugcccgugcccagcagcgagcacguggccgagaucgugggcagacagggcugcaagaucaaggcccugagagccaagaccaacaccuacaucaagacccccgugagaggcgaggagcccaucuucguggugaccggcagaaaggaggacguggccauggccaagagagagauccugagcgccgccgagcacuucagcaugaucagagccagcagaaacaagaacggccccgcccugggcggccugagcugcagccccaaccugcccggccagaccaccgugcaggugagagugcccuacagaguggugggccugguggugggccccaagggcgccaccaucaagagaauccagcagcagacccacaccuacaucgugacccccagcagagacaaggagcccguguucgaggugaccggcaugcccgagaacguggacagagccagagaggagaucgagaugcacaucgccaugagaaccggcaacuacaucgagcugaacgaggagaacgacuuccacuacaacggcaccgacgugagcuucgagggcggcacccugggcagcgccuggcugagcagcaaccccgugccccccagcagagccagaaugaucagcaacuacagaaacgacagcagcagcagccugggcagcggcagcaccgacagcuacuucggcagcaacagacuggccgacuucagccccaccagccccuucagcaccggcaacuucugguucggcgacacccugcccagcgugggcagcgaggaccuggccguggacagccccgccuucgacagccugcccaccagcgcccagaccaucuggacccccuucgagcccgugaacccccugagcggcuucggcagcgaccccagcggcaacaugaagacccagagaagaggcagccagcccagcacccccagacugagccccaccuuccccgagagcaucgagcacccccuggccagaagagugagaagcgacccccccagcaccggcaaccacgugggccugcccaucuacauccccgccuucagcaacggcaccaacagcuacagcagcagcaacggcggcagcaccagcagcagcccccccgagagcagaagaaagcacgacugcgugaucugcuucgagaacgaggugaucgccgcccuggugcccugcggccacaaccuguucugcauggagugcgccaacaagaucugcgagaagagaacccccagcugccccgugugccagaccgccgugacccaggccauccagauccacagcuaa

SEQ ID NO: 19823 - RNA, 2001 nt, Artificial Sequence
  MEX3D__Homo_sapiens__NP_001167589
augcccagcagccugggccagcccgacggcggcggcggcggcggcggcggcggcggcggcgugggcgccgccggcgaggaccccggccccggccccgcccccccccccgagggcgcccaggaggccgcccccgcccccagacccccccccgagcccgacgacgccgccgccgcccugagacuggcccuggaccagcugagcgcccugggccugggcggcgccggcgacaccgacgaggagggcgccgccggcgacggcgccgccgccgccggcggcgccgacggcggcgccgcccccgagcccgugccccccgacggccccgaggccggcgccccccccacccuggcccccgccguggcccccggcagccugccccugcuggaccccaacgccagccccccccccccccccccccccagacccagcccccccgacguguucgccggcuucgccccccaccccgccgcccugggcccccccacccugcuggccgaccagaugagcgugaucggcagcagaaagaagagcgugaacaugaccgagugcgugcccgugcccagcagcgagcacguggccgagaucgugggcagacagggcugcaagaucaaggcccugagagccaagaccaacaccuacaucaagacccccgugagaggcgaggagcccguguucaucgugaccggcagaaaggaggacguggagauggccaagagagagauccugagcgccgccgagcacuucagcaucaucagagccaccagaagcaaggccggcggccugcccggcgccgcccagggcccccccaaccugcccggccagaccaccauccaggugagagugcccuacagaguggugggccugguggugggccccaagggcgccaccaucaagagaauccagcagagaacccacaccuacaucgugacccccggcagagacaaggagcccguguucgccgugaccggcaugcccgagaacguggacagagccagagaggagaucgaggcccacaucacccugagaaccggcgccuucaccgacgccggccccgacagcgacuuccacgccaacggcaccgacgugugccuggaccugcugggcgccgccgccagccugugggccaagacccccaaccagggcagaagaccccccaccgccaccgccggccugagaggcgacaccgcccugggcgcccccagcgcccccgaggccuucuacgccggcagcagaggcggccccagcgugcccgaccccggccccgccagccccuacagcggcagcggcaacggcggcuucgccuucggcgccgagggccccggcgcccccgugggcaccgccgcccccgacgacugcgacuucggcuucgacuucgacuuccuggcccuggaccugaccgugcccgccgccgccaccaucugggcccccuucgagagagccgccccccugcccgccuucagcggcugcagcaccgugaacggcgcccccggcccccccgccgccggcgccagaagaagcagcggcgccggcacccccagacacagccccacccugcccgagcccggcggccugagacuggagcugccccugagcagaagaggcgcccccgaccccgugggcgcccugagcuggagacccccccagggccccgugagcuuccccggcggcgccgccuucagcaccgccaccagccugcccagcagccccgccgccgccgccugcgccccccuggacagcggcgccagcgagaacagcagaaagccccccagcgccagcagcgcccccgcccuggccagagagugcguggugugcgccgagggcgaggugauggccgcccuggugcccugcggccacaaccuguucugcauggacugcgccgugagaaucugcggcaagagcgagcccgagugccccgccugcagaacccccgccacccaggccaucagaguggagaccgagaccccccagcccggcggcgccagcgcccugcagagacaguacuaa

SEQ ID NO: 19824 - RNA, 651 nt, Artificial Sequence
  MFAP3__Homo_sapiens__NP_001128509
augagcguguacuacaugaucgugugccugaucgccuucaccaucacccugauccugaacgugaccagacugugcaugaugagcagccaccugagaaagaccgagaaggccaucaacgaguucuucagaaccgagggcgccgagaagcugcagaaggccuucgagaucgccaagagaauccccaucaucaccagcgccaagacccuggagcuggccaaggugacccaguucaagaccauggaguucgccagauacaucgaggagcuggccagaagcgugccccugcccccccugauccugaacugcagagccuucguggaggagauguucgaggccgugagaguggacgaccccgacgaccugggcgagagaaucaaggagagacccgcccugaacgcccagggcggcaucuacgugaucaaccccgagaugggcagaagcaacagccccggcggcgacagcgacgacggcagccugaacgagcagggccaggagaucgccgugcaggugagcgugcaccugcagagcgagaccaagagcaucgacaccgagagccagggcagcagccacuucagcccccccgacgacaucggcagcgccgagagcaacugcaacuacaaggacggcgccuacgagaacugccagcuguaa

SEQ ID NO: 19825 - RNA, 840 nt, Artificial Sequence
  MFAP4__Homo_sapiens__NP_001185624
augggcgagcugagcccccugcagagaccccuggccaccgagggcaccaugaaggcccagggcgugcugcugaagcuggcccugcuggcccugccccugcugcugcugcugagcaccccccccugcgccccccaggugagcggcaucagaggcgacgcccuggagagauucugccugcagcagccccuggacugcgacgacaucuacgcccagggcuaccagagcgacggcguguaccugaucuaccccagcggccccagcgugcccgugcccguguucugcgacaugaccaccgagggcggcaaguggaccguguuccagaagagauucaacggcagcgugagcuucuucagaggcuggaacgacuacaagcugggcuucggcagagccgacggcgaguacuggcugggccugcagaacaugcaccugcugacccugaagcagaaguacgagcugagaguggaccuggaggacuucgagaacaacaccgccuacgccaaguacgccgacuucagcaucagccccaacgccgugagcgccgaggaggacggcuacacccuguucguggccggcuucgaggacggcggcgccggcgacagccugagcuaccacagcggccagaaguucagcaccuucgacagagaccaggaccuguucgugcagaacugcgccgcccugagcagcggcgccuucugguucagaagcugccacuucgccaaccugaacggcuucuaccugggcggcagccaccugagcuacgccaacggcaucaacugggcccaguggaagggcuucuacuacagccugaagagaaccgagaugaagaucagaagagccuaa

SEQ ID NO: 19826 - RNA, 492 nt, Artificial Sequence
  MFAP5__Homo_sapiens__NP_001284638
augagccugcugggccccaaggugcugcuguuccuggccgccuucaucaucaccagcgacuggaucccccugggcgugaacagccagagaggcgacgacgugacccaggccacccccgagaccuucaccgaggaccccaaccuggugaacgaccccgccaccgacgagaccgugcuggccgugcuggccgacaucgcccccagcaccgacgaccuggagugcugggacgagaaguucaccugcaccagacuguacagcgugcacagacccgugaagcagugcauccaccagcugugcuucaccagccugagaagaauguacaucgugaacaaggagaucugcagcagacuggugugcaaggagcacgaggccaugaaggacgagcugugcagacagauggccggccugccccccagaagacugagaagaagcaacuacuucagacugccccccugcgagaacguggaccugcagagacccaacggccuguaa

SEQ ID NO: 19827 - RNA, 1008 nt, Artificial Sequence
  MFGE8__Homo_sapiens__NP_001108086
augcccagacccagacugcuggccgcccugugcggcgcccugcugugcgcccccagccugcugguggcccuggacaucugcagcaagaaccccugccacaacggcggccugugcgaggagaucagccaggaggugagaggcgacguguuccccagcuacaccugcaccugccugaagggcuacgccggcaaccacugcgagaccaagugcguggagccccugggccuggagaacggcaacaucgccaacagccagaucgccgccagcagcgugagagugaccuuccugggccugcagcacugggugcccgagcuggccagacugaacagagccggcauggugaacgccuggacccccagcagcaacgacgacaaccccuggauccaggugaaccugcugagaagaaugugggugaccggcguggugacccagggcgccagcagacuggccagccacgaguaccugaaggccuucaagguggccuacagccugaacggccacgaguucgacuucauccacgacgugaacaagaagcacaaggaguucgugggcaacuggaacaagaacgccgugcacgugaaccuguucgagacccccguggaggcccaguacgugagacuguaccccaccagcugccacaccgccugcacccugagauucgagcugcugggcugcgagcugaacggcugcgccaacccccugggccugaagaacaacagcauccccgacaagcagaucaccgccagcagcagcuacaagaccuggggccugcaccuguucagcuggaaccccagcuacgccagacuggacaagcagggcaacuucaacgccuggguggccggcagcuacggcaacgaccaguggcugcagaucuuccccggcaacugggacaaccacagccacaagaagaaccuguucgagacccccauccuggccagauacgugagaauccugcccguggccuggcacaacagaaucgcccugagacuggagcugcugggcugcuaa

SEQ ID NO: 19828 - RNA, 3159 nt, Artificial Sequence
  MFHAS1__Homo_sapiens__NP_004216
auggccggcauggacagcggcaaccugaagaccgccagacuguggagagacgccgcccugagagccagaaagcugagaagcaaccugagacagcugacccugaccgccgccggcgccugccccggcgccggcgccgacgcccuggagagccccgccagcccccagcuggugcugcccgccaaccugggcgacaucgaggcccugaaccugggcaacaacggccuggaggaggugcccgagggccugggcagcgcccugggcagccugagagugcuggugcugagaagaaacagauucgccagacugccccccgccguggccgagcugggccaccaccugaccgagcuggacgugagccacaacagacugaccgcccugggcgccgagguggugagcgcccugagagagcugagaaagcugaaccugagccacaaccagcugcccgcccugcccgcccagcugggcgcccuggcccaccuggaggagcuggacgugagcuucaacagacuggcccaccugcccgacagccugagcugccugagcagacugagaacccuggacguggaccacaaccagcugaccgccuuccccagacagcugcugcagcugguggcccuggaggagcuggacgugagcagcaacagacugagaggccugcccgaggacaucagcgcccugagagcccugaagauccuguggcugagcggcgccgagcugggcacccugcccgccggcuucugcgagcuggccagccuggagagccugaugcuggacaacaacggccugcaggcccugcccgcccaguucagcugccugcagagacugaagaugcugaaccugagcagcaaccuguucgaggaguuccccgccgcccugcugccccuggccggccuggaggagcuguaccugagcagaaaccagcugaccagcgugcccagccugaucagcggccugggcagacugcugacccuguggcuggacaacaacagaaucagauaccugcccgacagcaucguggagcugaccggccuggaggagcuggugcugcagggcaaccagaucgccgugcugcccgaccacuucggccagcugagcagagugggccuguggaagaucaaggacaacccccugauccagccccccuacgaggugugcaugaagggcauccccuacaucgccgccuaccagaaggagcuggcccacagccagcccgccgugcagcccagacugaagcugcugcugaugggccacaaggccgccggcaagacccugcugagacacugccugaccgaggagagaguggagggcugccccggcggcggcgacaaggagaagugcuacccccccagccccccccccgugagcaagggcaucgaggugaccagcuggaccgccgacgccagcagaggccugagauucaucguguacgaccuggccggcgacgagagcuacgaggugauccagcccuucuuccugagccccggcgcccuguacgugcugguggugaaccuggccaccuacgagcccagacacuuccccaccaccgugggcagcuuccugcacagagugggcgccagagugccccacgccguggugugcaucgugggcacccacgccgaccugugcggcgagagagagcuggaggagaagugccuggacauccacagacagaucgcccugcaggagaagcacgacgccgagggccugagcagacuggccaaggugguggacgaggcccuggccagagacuucgagcugagaagcgccagcccccacgccgccuacuacggcgugagcgacaagaaccugagaagaagaaaggcccacuuccaguaccugcugaaccacagacugcagauccugagccccgugcugcccgugagcugcagagaccccagacaccugagaagacugagagacaagcugcugagcguggccgagcacagagagaucuuccccaaccugcacagagugcugcccagaagcuggcaggugcuggaggagcugcacuuccagcccccccaggcccagagacuguggcugagcuggugggacagcgccagacugggccugcaggccggccugaccgaggacagacugcagagcgcccugagcuaccugcacgagagcggcaagcugcuguacuucgaggacagccccgcccugaaggagcacguguuccacaaccugaccagacugaucgacauccugaacguguucuuccagagagaccccagccugcugcugcacaagcugcugcugggcaccagcggcgagggcaaggccgagggcgagagcagcccccccauggccagaagcacccccagccaggagcugcugagagccacccagcugcaccaguacguggagggcuuccugcugcacggccugcugcccgcccacgugaucagacugcugcugaagccccacgugcaggcccagcaggaccugcagcugcugcuggagcugcuggagaagaugggccugugcuacugccugaacaagcccaagggcaagccccugaacggcagcaccgccugguacaaguuccccugcuacgugcagaacgaggugccccacgccgaggccuggaucaacggcaccaaccuggccggccagagcuucguggccgagcagcugcagaucgaguacagcuuccccuucaccuucccccugggccuguucgccagauacagcgugcagaucaacagccacguggugcacagaagcgacggcaaguuccagaucuucgccuacagaggcaaggugcccgugguggugagcuacagacccgccagaggcgugcugcagcccgacacccugagcaucgccagccacgccagccugcccaacaucuggaccgccuggcaggccaucaccccccugguggaggagcugaacgugcugcugcaggaguggcccggccugcacuacaccgugcacauccugugcagcaagugccugaagagaggcagccccaacccccacgccuuccccggcgagcugcugagccagcccagacccgagggcguggccgagaucaucugccccaagaacggcagcgagagagugaacguggcccugguguacccccccacccccaccgugaucagccccugcagcaagaagaacgugggcgagaagcacagaaaccaguaa

SEQ ID NO: 19829 - RNA, 2217 nt, Artificial Sequence
  MFI2__Homo_sapiens__NP_005920
augagaggccccagcggcgcccuguggcugcugcuggcccugagaaccgugcugggcggcauggaggugagauggugcgccaccagcgaccccgagcagcacaagugcggcaacaugagcgaggccuucagagaggccggcauccagcccagccugcugugcgugagaggcaccagcgccgaccacugcgugcagcugaucgccgcccaggaggccgacgccaucacccuggacggcggcgccaucuacgaggccggcaaggagcacggccugaagcccguggugggcgagguguacgaccaggaggugggcaccagcuacuacgccguggccguggugagaagaagcagccacgugaccaucgacacccugaagggcgugaagagcugccacaccggcaucaacagaaccgugggcuggaacgugcccgugggcuaccugguggagagcggcagacugagcgugaugggcugcgacgugcugaaggccgugagcgacuacuucggcggcagcugcgugcccggcgccggcgagaccagcuacagcgagagccugugcagacugugcagaggcgacagcagcggcgagggcgugugcgacaagagcccccuggagagauacuacgacuacagcggcgccuucagaugccuggccgagggcgccggcgacguggccuucgugaagcacagcaccgugcuggagaacaccgacggcaagacccugcccagcuggggccaggcccugcugagccaggacuucgagcugcugugcagagacggcagcagagccgacgugaccgaguggagacagugccaccuggccagagugcccgcccacgccgugguggugagagccgacaccgacggcggccugaucuucagacugcugaacgagggccagagacuguucagccacgagggcagcagcuuccagauguucagcagcgaggccuacggccagaaggaccugcuguucaaggacagcaccagcgagcuggugcccaucgccacccagaccuacgaggccuggcugggccacgaguaccugcacgccaugaagggccugcugugcgaccccaacagacugccccccuaccugagauggugcgugcugagcacccccgagauccagaagugcggcgacauggccguggccuucagaagacagagacugaagcccgagauccagugcgugagcgccaagagcccccagcacugcauggagagaauccaggccgagcagguggacgccgugacccugagcggcgaggacaucuacaccgccggcaagaccuacggccuggugcccgccgccggcgagcacuacgcccccgaggacagcagcaacagcuacuacgugguggccguggugagaagagacagcagccacgccuucacccuggacgagcugagaggcaagagaagcugccacgccggcuucggcagccccgccggcugggacgugcccgugggcgcccugauccagagaggcuucaucagacccaaggacugcgacgugcugaccgccgugagcgaguucuucaacgccagcugcgugcccgugaacaaccccaagaacuaccccagcagccugugcgcccugugcgugggcgacgagcagggcagaaacaagugcgugggcaacagccaggagagauacuacggcuacagaggcgccuucagaugccugguggagaacgccggcgacguggccuucgugagacacaccaccguguucgacaacaccaacggccacaacagcgagcccugggccgccgagcugagaagcgaggacuacgagcugcugugccccaacggcgccagagccgaggugagccaguucgccgccugcaaccuggcccagauccccccccacgccgugauggugagacccgacaccaacaucuucaccguguacggccugcuggacaaggcccaggaccuguucggcgacgaccacaacaagaacggcuucaagauguucgacagcagcaacuaccacggccaggaccugcuguucaaggacgccaccgugagagccgugcccgugggcgagaagaccaccuacagaggcuggcugggccuggacuacguggccgcccuggagggcaugagcagccagcagugcagcggcgccgccgcccccgcccccggcgccccccugcugccccugcugcugcccgcccuggccgccagacugcugccccccgcccuguaa

SEQ ID NO: 19830 - RNA, 2226 nt, Artificial Sequence
  MFN1__Homo_sapiens__XP_005247653
auggccgagcccgugagcccccugaagcacuucgugcuggccaagaaggccaucaccgccaucuucgaccagcugcuggaguucgugaccgagggcagccacuucguggaggccaccuacaagaaccccgagcuggacagaaucgccaccgaggacgaccugguggagaugcagggcuacaaggacaagcugagcaucaucggcgaggugcugagcagaagacacaugaagguggccuucuucggcagaaccagcagcggcaagagcagcgugaucaacgccaugcugugggacaaggugcugcccagcggcaucggccacaucaccaacugcuuccugagcguggagggcaccgacggcgacaaggccuaccugaugaccgagggcagcgacgagaagaagagcgugaagaccgugaaccagcuggcccacgcccugcacauggacaaggaccugaaggccggcugccuggugagaguguucuggcccaaggccaagugcgcccugcugagagacgaccuggugcugguggacagccccggcaccgacgugaccaccgagcuggacagcuggaucgacaaguucugccuggacgccgacguguucgugcugguggccaacagcgagagcacccugaugaacaccgagaagcacuucuuccacaaggugaacgagagacugagcaagcccaacaucuucauccugaacaacagaugggacgccagcgccagcgagcccgaguacauggaggacgugagaagacagcacauggagagaugccugcacuuccugguggaggagcugaagguggugaacgcccuggaggcccagaacagaaucuucuucgugagcgccaaggaggugcugagcgccagaaagcagaaggcccagggcaugcccgagagcggcguggcccuggccgagggcuuccacgccagacugcaggaguuccagaacuucgagcagaucuucgaggagugcaucagccagagcgccgugaagaccaaguucgagcagcacaccaucagagccaagcagauccuggccaccgugaagaacaucauggacagcgugaaccuggccgccgaggacaagagacacuacagcguggaggagagagaggaccagaucgacagacuggacuucaucagaaaccagaugaaccugcugacccuggacgugaagaagaagaucaaggaggugaccgaggagguggccaacaaggugagcugcgccaugaccgacgagaucugcagacugagcgugcugguggacgaguucugcagcgaguuccaccccaaccccgacgugcugaagaucuacaagagcgagcugaacaagcacaucgaggacggcaugggcagaaaccuggccgacagaugcaccgacgaggugaacgcccuggugcugcagacccagcaggagaucaucgagaaccugaagccccugcugcccgccggcauccaggacaagcugcacacccugauccccugcaagaaguucgaccugagcuacaaccugaacuaccacaagcugugcagcgacuuccaggaggacaucguguucagauucagccugggcuggagcagccuggugcacagauuccugggccccagaaacgcccagagagugcugcugggccugagcgagcccaucuuccagcugcccagaagccuggccagcacccccaccgcccccaccacccccgccacccccgacaacgccagccaggaggagcugaugaucacccuggugaccggccuggccagcgugaccagcagaaccagcaugggcaucaucaucgugggcggcgugaucuggaagaccaucggcuggaagcugcugagcgugagccugaccauguacggcgcccuguaccuguacgagagacugagcuggaccacccacgccaaggagagagccuucaagcagcaguucgugaacuacgccaccgagaagcugagaaugaucgugagcagcaccagcgccaacugcagccaccaggugaagcagcagaucgccaccaccuucgccagacugugccagcagguggacaucacccagaagcagcuggaggaggagaucgccagacugcccaaggagaucgaccagcuggagaagauccagaacaacagcaagcugcugagaaacaaggccgugcagcuggagaacgagcuggagaacuucaccaagcaguuccugcccagcagcaacgaggagagcuaa

SEQ ID NO: 19831 - RNA, 1740 nt, Artificial Sequence
  MFRP__Homo_sapiens__NP_113621
augaaggacuucagcgacgugauccugugcauggaggccaccgagagcagcaagaccgaguucugcaaccccgccuucgagcccgagagcggcccccccugccccccccccguguuccccgaggacgccagcuacagcgugcccgcccccuggcacggcagaagacccagaggccugagacccgacugcagauucagcuggcugugcgugcugcugcugagcagccugcugcugcugcugcugggccugcugguggccaucauccuggcccagcugcaggccgccccccccagcggcgccagccacagcccccugcccgccggcggccugaccaccaccaccaccacccccaccaucaccaccagccaggccgccggcacccccaagggccagcaggagagcggcgugagccccagcccccagagcaccugcggcggccugcugagcggccccagaggcuucuucagcagccccaacuaccccgaccccuacccccccaacacccacugcguguggcacauccagguggccaccgaccacgccauccagcugaagaucgaggcccugagcaucgagagcguggccagcugccuguucgacagacuggagcugagccccgagcccgagggcccccugcugagagugugcggcagagugcccccccccacccugaacaccaacgccagccaccugcuggugguguucgugagcgacagcagcguggagggcuucggcuuccacgccugguaccaggccauggcccccggcagaggcagcugcgcccacgacgaguucagaugcgaccagcugaucugccugcugcccgacagcgugugcgacggcuucgccaacugcgccgacggcagcgacgagaccaacugcagcgccaaguucagcggcugcggcggcaaccugaccggccugcagggcaccuucagcacccccagcuaccugcagcaguacccccaccagcugcugugcaccuggcacaucagcgugcccgccggccacagcaucgagcugcaguuccacaacuucagccuggaggcccaggacgagugcaaguucgacuacguggagguguacgagaccagcagcagcggcgccuucagccugcugggcagauucugcggcgccgagccccccccccaccuggugagcagccaccacgagcuggccgugcuguucagaaccgaccacggcaucagcagcggcggcuucagcgccaccuaccuggccuucaacgccaccgagaaccccugcggccccagcgagcugagcugccaggccggcggcugcaagggcgugcaguggaugugcgacauguggagagacugcaccgacggcagcgacgacaacugcagcggcccccuguuccccccccccgagcuggccugcgagcccgugcagguggagaugugccugggccugagcuacaacaccaccgccuuccccaacaucugggugggcaugaucacccaggaggaggugguggaggugcugagcggcuacaagagccugaccagccugcccugcuaccagcacuucagaagacugcugugcggccugcuggugcccagaugcaccccccugggcagcgugcugccccccugcagaagcgugugccaggaggccgagcaccagugccagagcggccuggcccugcugggcacccccuggcccuucaacugcaacagacugcccgaggccgccgaccuggaggccugcgcccagcccuaa

SEQ ID NO: 19832 - RNA, 1194 nt, Artificial Sequence
  MFSD11__Homo_sapiens__NP_001229466
augagccccgagagcaagaagcuguucaacaucaucauccugggcguggccuucauguucauguucaccgccuuccagaccugcggcaacguggcccagaccgugaucagaagccugaacagaaccgacuuccacggcagcggcuacaccagcauggccaucaucuacggcguguucagcgccagcaaccugaucacccccagcgugguggccaucgugggcccccagcugagcauguucgccagcggccuguucuacagcauguacaucgccguguucauccagcccuuccccuggagcuucuacaccgccagcguguucaucggcaucgccgccgccgagagcgacagaagaaccguguucaucgcccugaccgugaucagccuggugggcaccgugcuguucuuccugaucagaaagcccgacagcgagaacgugcugggcgaggacgagagcagcgacgaccaggacauggaggugaacgagagcgcccagaacaaccugaccaaggccguggacgccuucaagaagagcuucaagcugugcgugaccaaggagaugcugcugcugagcaucaccaccgccuacaccggccuggagcugaccuucuucagcggcguguacggcaccugcaucggcgccaccaacaaguucggcgccgaggagaagagccugaucggccugagcggcaucuucaucggcaucggcgagauccugggcggcagccuguucggccugcugagcaagaacaacagauucggcagaaaccccguggugcugcugggcauccuggugcacuucaucgccuucuaccugaucuuccugaacaugcccggcgacgcccccaucgcccccgugaagggcaccgacagcagcgccuacaucaagagcagcaaggagguggccauccugugcagcuuccugcugggccugggcgacagcugcuucaacacccagcugcugagcauccugggcuuccuguacagcgaggacagcgcccccgccuucgccaucuucaaguucgugcagagcaucugcgccgccguggccuucuucuacagcaacuaccugcugcugcacuggcagcugcuggugauggugaucuucggcuucuucggcaccaucagcuucuucaccguggagugggaggccgccgccuucguggccagaggcagcgacuacagaagcaucuaa

SEQ ID NO: 19833 - RNA, 1443 nt, Artificial Sequence
  MFSD12__Homo_sapiens__NP_778148
augggccccggcccccccgccgccggcgccgcccccagccccagaccccugagccugguggccagacugagcuacgccgugggccacuuccugaacgaccugugcgccagcaugugguucaccuaccugcugcuguaccugcacagcgugagagccuacagcagcagaggcgccggccugcugcugcugcugggccagguggccgacggccugugcaccccccuggugggcuacgaggccgacagagccgccagcugcugcgccagauacggccccagaaaggccuggcaccuggugggcaccgugugcgugcugcugagcuuccccuucaucuucagccccugccugggcugcggcgccgccacccccgagugggccgcccugcuguacuacggccccuucaucgugaucuuccaguucggcugggccagcacccagaucagccaccugagccugauccccgagcuggugaccaacgaccacgagaagguggagcugaccgcccugagauacgccuucaccgugguggccaacaucaccguguacggcgccgccuggcugcugcugcaccugcagggcagcagcagaguggagcccacccaggacaucagcaucagcgaccagcugggcggccaggacgugcccguguucagaaaccugagccugcugguggugggcgugggcgccguguucagccugcuguuccaccugggcaccagagagagaagaagaccccacgccgaggagcccggcgagcacaccccccugcuggcccccgccaccgcccagccccugcugcuguggaagcacuggcugagagagcccgccuucuaccaggugggcauccuguacaugaccaccagacugaucgugaaccugagccagaccuacauggccauguaccugaccuacagccugcaccugcccaagaaguucaucgccaccaucccccuggugauguaccugagcggcuuccugagcagcuuccugaugaagcccaucaacaagugcaucggcagaaacaugaccuacuucagcggccugcuggugauccuggccuucgccgccuggguggcccuggccgagggccugggcguggccguguacgccgccgccgugcugcugggcgccggcugcgccaccauccuggugaccagccuggccaugaccgccgaccugaucggcccccacaccaacagcggcgccuucguguacggcagcaugagcuuccuggacaagguggccaacggccuggccgugauggccauccagagccugcaccccugccccagcgagcugugcugcagagccugcgugagcuucuaccacugggccaugguggccgugaccggcggcgugggcguggccgccgcccugugccugugcagccugcugcuguggcccaccagacugagaagaugggacagagacgccagacccuaa

SEQ ID NO: 19834 - RNA, 1545 nt, Artificial Sequence
  MFSD1__Homo_sapiens__NP_073573
augggcguggcccugagagaccugcccggcagacacgugagcagcagaagccacgugaccgccgugcugaccguguuccacggcagaugcuuccugcccggcuucggcguggugaccaccuuccccagccccagccccgccggcgccauggaggaggaggacgaggaggccagagcccugcuggccggcggccccgacgaggccgacagaggcgcccccgccgcccccggcgcccugcccgcccugugcgaccccagcagacuggcccacagacugcuggugcugcugcugaugugcuuccugggcuucggcagcuacuucugcuacgacaaccccgccgcccugcagacccaggugaagagagacaugcaggugaacaccaccaaguucaugcugcuguacgccugguacagcuggcccaacguggugcugugcuucuucggcggcuuccugaucgacagaguguucggcaucagauggggcaccaucaucuucagcugcuucgugugcaucggccaggugguguucgcccugggcggcaucuucaacgccuucuggcugauggaguucggcagauucguguucggcaucggcggcgagagccuggccguggcccagaacaccuacgccgugagcugguucaagggcaaggagcugaaccugguguucggccugcagcugagcauggccagaaucggcagcaccgugaacaugaaccugaugggcuggcuguacagcaagaucgaggcccugcugggcagcgccggccacaccacccugggcaucacccugaugaucggcggcaucaccugcauccugagccugaucugcgcccuggcccuggccuaccuggaccagagagccgagagaauccugcacaaggagcagggcaagaccggcgaggugaucaagcugaccgacgugaaggacuucagccugccccuguggcugaucuucaucaucugcgugugcuacuacguggccguguuccccuucaucggccugggcaagguguucuucaccgagaaguucggcuucagcagccaggccgccagcgccaucaacagcgugguguacgugaucagcgcccccaugagccccguguucggccugcugguggacaagaccggcaagaacaucaucugggugcugugcgccguggccgccacccuggugagccacaugaugcuggccuucaccauguggaaccccuggaucgccaugugccugcugggccugagcuacagccugcuggccugcgcccuguggcccaugguggccuucguggugcccgagcaccagcugggcaccgccuacggcuucaugcagagcauccagaaccugggccuggccaucaucagcaucaucgccggcaugauccuggacagcagaggcuaccuguuccuggagguguucuucaucgccugcgugagccugagccugcugagcguggugcugcuguaccuggugaacagagcccagggcggcaaccugaacuacagcgccagacagagagaggagaucaaguucagccacaccgaguaa

SEQ ID NO: 19835 - RNA, 2376 nt, Artificial Sequence
  MFSD6__Homo_sapiens__NP_060164
auggccgacgacaagguggccauccugaccgacgacgaggaggagcagaagagaaaguacgugcuggccgaccccuucaacggcaucagcagagagcccgagccccccagcaacgagacccccagcagcaccgagaccagcgccauccccgaggaggagaucgacuggaucgagaagcacugcgugaagaucaacaacgaccugcugaucagcaagguguucuacuucuucuucuacagcgccuacggcagccuguacccccugcugcccguguacuacaagcagcugggcaugagccccagccagagcggccugcuggugggcaucagauacuucaucgaguucugcagcgcccccuucuggggcgugguggccgacagauucaagaagggcaagaucgugcugcuguucagccugcugugcugggugcuguucaaccugggcaucggcuucgugaagcccgccacccugagaugcgugcccaagaucagacccaccacccaccccaccaacgccagccaccagcugaccauccugcccaccaacagcagcuucaccagcuuccugaccaucagccccaagaugagagagaagagaaaccugcuggagaccagacugaacgugagcgacaccgugacccugcccaccgcccccaacaugaacagcgagcccacccugcagccccagaccggcgagaucaccaacagaaugauggaccugacccugaacagcagcaccgccacccccgugagccccggcagcgugaccaaggagaccaccaccgugaucgugaccaccaccaagagccugcccagcgaccaggugaugcugguguacgaccagcaggagguggaggccaucuuccuggugauccuggugguggugaucaucggcgaguucuucagcgccagcagcgugaccaucguggacaccgugacccugcaguaccugggcaagcacagagacagauacggccugcagagaauguggggcagccugggcuggggccuggccaugcugagcgugggcaucggcaucgacuacacccacaucgaggugcugaucgacggcaagggcugcaagccccccgaguacagaaacuaccagaucguguucaucguguucggcgugcugaugaccauggcccugaucguggccacccaguucagauucagauacaaccacuucaagaacgacgacagcaagggcaaggagguggagaucccccagguggagagaaacaacagcaccgagagcagcgaggagacccccaccaccaccagccacagccaggccuucaacuucugggaccugaucaagcugcugugcagcgugcaguacggcagcgugcuguucguggccugguucaugggcuucggcuacggcuucguguucaccuuccuguacuggcaccuggaggaccugaacggcaccaccacccuguucggcgugugcagcgugcugagccacgugagcgagcugaccgccuacuucuucagccacaagcugaucgagcugaucggccacaucagagugcuguacaucggccuggccugcaacaccgccagauacaucuacaucagcuaccuggagaacgccuggaccgugcugcccauggaggugcugcagggcgugacccacgccgccaucugggccgccugcaucagcuaccugagcgccgccgugccccccgagcugagaaccagcgcccagggcauccugcagggccugcaccugggccugggcagaggcugcggcgccaugaucggcggcgugcuggugaacuacuucggcgccgccgccaccuucagaggcaucggcauggccugccuggugauccugcugcuguucgcccugauccaguggcuggccgugcccgacgaggaggaggacaagaccaugcuggccgagagaauccccgugcccagcagccccgugcccaucgccaccaucgaccuggugcagcagcagaccgaggacgugaugcccagaaucgagcccagacugccccccaagaagaccaagcaccaggaggagcaggaggacgugaacaagcccgccuggggcgugagcagcagccccugggugaccuucguguacgcccuguaccagaucaaggagaugaugcagcugaccagagacaacagagccagcgagauccagccccugcagggcaccaacgagaacagagagaacagccccgccggcagagcccagcccgugcccugcgagacccacagcgaccccagcagaaaccagcccagccccgacgccgccgccagccagacccagaccagccccgcccaccccagcguggaccccugcaccgaggagagcgaggagcagcaggcccagcuggccgccggcggccacuaa

SEQ ID NO: 19836 - RNA, 1683 nt, Artificial Sequence
  MFSD7__Homo_sapiens__NP_001281270
auggccggccccaccgaggccgagaccggccuggccgagcccagagcccugugcgcccagagaggccacagaaccuacgccagaagauggguguuccugcuggccaucagccugcugaacugcagcaacgccacccuguggcugagcuucgcccccguggccgacgugaucgccgaggaccuggugcugagcauggagcagaucaacuggcugagccugguguaccugguggugagcacccccuucggcguggccgccaucuggauccuggacagcgugggccugagagccgccaccauccugggcgccuggcugaacuucgccggcagcgugcugagaauggugcccugcaugguggugggcacccagaaccccuucgccuuccugaugggcggccagagccugugcgcccuggcccagagccuggugaucuucagccccgccaagcuggccgcccugugguuccccgagcaccagagagccaccgccaacaugcuggccaccaugagcaacccccugggcgugcugguggccaacgugcugagccccgugcuggugaagaagggcgaggacaucccccugaugcugggcguguacaccauccccgccggcguggugugccugcugagcaccaucugccugugggagagcgugccccccaccccccccagcgccggcgccgccagcagcaccagcgagaaguuccuggacggccugaagcugcagcugauguggaacaaggccuacgugauccuggccgugugccugggcggcaugaucggcaucagcgccagcuucagcgcccugcuggagcagauccugugcgccagcggccacagcagcggcuucagcggccugugcggcgcccuguucaucaccuucggcauccugggcgcccuggcccugggccccuacguggacagaaccaagcacuucaccgaggccaccaagaucggccugugccuguucagccuggccugcgugcccuucgcccuggugagccagcugcagggccagacccuggcccuggccgccaccugcagccugcugggccuguucggcuucagcgugggccccguggccauggagcuggccguggagugcagcuuccccgugggcgagggcgccgccaccggcaugaucuucgugcugggccaggccgagggcauccugaucaugcuggccaugaccgcccugaccgugagaagaagcgagcccagccugagcaccugccagcagggcgaggacccccuggacuggaccgugagccugcugcugauggccggccugugcaccuucuucagcugcauccuggccguguucuuccacacccccuacagaagacugcaggccgagagcggcgagccccccagcaccagaaacgccgugggcggcgccgacagcggccccggcguggacagaggcggcgccggcagagccggcgugcugggccccagcaccgccacccccgagugcaccgccagaggcgccagccuggaggaccccagaggccccggcagcccccaccccgccugccacagagccacccccagagcccagggccccgccgccaccgacgcccccagcagacccggcagacuggccggcagagugcaggccagcagauucaucgaccccgccggcagccacagcagcuucagcagccccugggugaucaccuaa

SEQ ID NO: 19837 - RNA, 1557 nt, Artificial Sequence
  MFSD8__Homo_sapiens__NP_689991
auggccggccugagaaacgagagcgagcaggagccccugcugggcgacacccccggcagcagagagugggacauccuggagaccgaggagcacuacaagagcagauggagaagcaucagaauccuguaccugaccauguuccugagcagcgugggcuucagcguggugaugaugagcaucuggcccuaccugcagaagaucgaccccaccgccgacaccagcuuccugggcugggugaucgccagcuacagccugggccagaugguggccagccccaucuucggccuguggagcaacuacagacccagaaaggagccccugaucgugagcauccugaucagcguggccgccaacugccuguacgccuaccugcacauccccgccagccacaacaaguacuacaugcugguggccagaggccugcugggcaucggcgccggcaacguggccguggugagaagcuacaccgccggcgccaccagccugcaggagagaaccagcagcauggccaacaucagcaugugccaggcccugggcuucauccugggccccguguuccagaccugcuucaccuuccugggcgagaagggcgugaccugggacgugaucaagcugcagaucaacauguacaccacccccgugcugcugagcgccuuccugggcauccugaacaucauccugauccuggccauccugagagagcacagaguggacgacagcggcagacagugcaagagcaucaacuucgaggaggccagcaccgacgaggcccaggugccccagggcaacaucgaccagguggccgugguggccaucaacgugcuguucuucgugacccuguucaucuucgcccuguucgagaccaucaucaccccccugaccauggacauguacgccuggacccaggagcaggccgugcuguacaacggcaucauccuggccgcccugggcguggaggccguggugaucuuccugggcgugaagcugcugagcaagaagaucggcgagagagccauccugcugggcggccugaucguggugugggugggcuucuucauccugcugcccuggggcaaccaguuccccaagauccagugggaggaccugcacaacaacagcauccccaacaccaccuucggcgagaucaucaucggccuguggaagagccccauggaggacgacaacgagagacccaccggcugcagcaucgagcaggccuggugccuguacacccccgugauccaccuggcccaguuccugaccagcgccgugcugaucggccugggcuaccccgugugcaaccugaugagcuacacccuguacagcaagauccugggccccaagccccagggcguguacaugggcuggcugaccgccagcggcagcggcgccagaauccugggccccauguucaucagccagguguacgcccacuggggccccagaugggccuucagccuggugugcggcaucaucgugcugaccaucacccugcugggcgugguguacaagagacugaucgcccugagcgugagauacggcagaauccaggaguaa

SEQ ID NO: 19838 - RNA, 8571 nt, Artificial Sequence
  MGA__Homo_sapiens__NP_001074010
auggaggagaagcagcagaucauccuggccaaccaggacggcggcaccguggccggcgccgcccccaccuucuucgugauccugaagcagcccggcaacggcaagaccgaccagggcauccuggugaccaaccaggacgccugcgcccuggccagcagcgugagcagccccgugaagagcaagggcaagaucugccugcccgccgacugcaccgugggcggcaucaccgugacccuggacaacaacagcauguggaacgaguucuaccacagaagcaccgagaugauccugaccaagcagggcagaagaauguuccccuacugcagauacuggaucaccggccuggacagcaaccugaaguacauccuggugauggacaucagccccguggacaaccacagauacaaguggaacggcagauggugggagcccagcggcaaggccgagccccacgugcugggcagaguguucauccaccccgagagccccagcaccggccacuacuggaugcaccagcccgugagcuucuacaagcugaagcugaccaacaacacccuggaccaggagggccacaucauccugcacagcaugcacagauaccugcccagacugcaccuggugcccgccgagaaggccguggaggugauccagcugaacggccccggcgugcacaccuucaccuucccccagaccgaguucuucgccgugaccgccuaccagaacauccagaucacccagcugaagaucgacuacaaccccuucgccaagggcuucagagacgacggccugaacaacaagccccagagagacggcaagcagaagaacagcagcgaccaggagggcaacaacaucagcagcagcagcggccacagagugagacugaccgagggccagggcagcgagauccagcccggcgaccuggacccccugagcagaggccacgagaccagcggcaagggccuggagaagaccagccugaacaucaagagagacuuccugggcuucauggacaccgacagcgcccugagcgaggugccccagcugaagcaggagaucagcgagugccugaucgccagcagcuucgaggacgacagcagaguggccagcccccuggaccagaacggcagcuucaacguggugaucaaggaggagccccuggacgacuacgacuacgagcugggcgagugccccgagggcgugaccgugaagcaggaggagaccgacgaggagaccgacguguacagcaacagcgacgacgaccccauccuggagaagcagcugaagagacacaacaagguggacaaccccgaggccgaccaccugagcagcaaguggcugcccagcagccccagcggcguggccaaggccaagauguucaagcuggacaccggcaagaugcccgugguguaccuggagcccugcgccgugaccagaagcaccgugaagaucagcgagcugcccgacaacaugcugagcaccagcagaaaggacaagagcagcaugcuggccgagcuggaguaccugcccaccuacaucgagaacagcaacgagaccgccuucugccugggcaaggagagcgagaacggccugagaaagcacagccccgaccugagaguggugcagaaguacccccugcugaaggagccccaguggaaguaccccgacaucagcgacagcaucagcaccgagagaauccuggacgacagcaaggacagcgugggcgacagccugagcggcaaggaggaccugggcagaaagagaaccaccaugcugaagaucgccaccgccgccaagguggugaacgccaaccagaacgccagccccaacgugcccggcaagagaggcagacccagaaagcugaagcugugcaaggccggcagaccccccaagaacaccggcaagagccugaucagcaccaagaacacccccgugagccccggcagcaccuuccccgacgugaagcccgaccuggaggacguggacggcgugcuguucgugagcuucgagagcaaggaggcccuggacauccacgccguggacggcaccaccgaggagagcagcagccugcaggccagcaccaccaacgacagcggcuacagagccagaaucagccagcuggagaaggagcugaucgaggaccugaagacccugagacacaagcaggugauccaccccggccugcaggaggugggccugaagcugaacagcguggaccccaccaugagcaucgaccugaaguaccugggcgugcagcugccccuggcccccgccaccagcuuccccuucuggaaccugaccggcaccaaccccgccagccccgacgccggcuuccccuucgugagcagaaccggcaagaccaacgacuucaccaagaucaagggcuggagaggcaaguuccacagcgccagcgccagcagaaacgagggcggcaacagcgagagcagccugaagaacagaagcgccuucugcagcgacaagcuggacgaguaccuggagaacgagggcaagcugauggagaccagcaugggcuucagcagcaacgcccccaccagccccgugguguaccagcugcccaccaagagcaccagcuacgugagaacccuggacagcgugcugaagaagcagagcaccaucagccccagcaccagcuacagccugaagccccacagcgugccccccgugagcagaaaggccaagagccagaacagacaggccaccuucagcggcagaaccaagagcagcuacaagagcauccugcccuaccccgugagccccaagcagaaguacagccacgugauccugggcgacaaggugaccaagaacagcagcggcaucaucagcgagaaccaggccaacaacuucguggugcccacccuggacgagaacaucuuccccaagcagaucagccugagacaggcccagcagcagcagcagcagcagcagggcagcagaccccccggccugagcaagagccaggugaagcugauggaccuggaggacugcgcccugugggagggcaagcccagaaccuacaucaccgaggagagagccgacgugagccugaccacccugcugaccgcccaggccagccugaagaccaagcccauccacaccaucaucagaaagagagccccccccugcaacaacgacuucugcagacugggcugcgugugcagcagccuggcccuggagaagagacagcccgcccacugcagaagacccgacugcauguucggcugcaccugccugaagagaaagguggugcuggugaagggcggcagcaagaccaagcacuuccagagaaaggccgcccacagagaccccguguucuacgacacccugggcgaggaggccagagaggaggaggagggcaucagagaggaggaggagcagcugaaggagaagaagaagagaaagaagcuggaguacaccaucugcgagaccgagcccgagcagcccgugagacacuacccccugugggugaagguggagggcgagguggaccccgagcccguguacauccccacccccagcgugaucgagcccaugaagccccugcugcugccccagcccgaggugcugagccccaccgugaagggcaagcugcugaccggcaucaagagccccagaagcuacacccccaagcccaaccccgugaucagagaggaggacaaggaccccguguaccuguacuucgagagcaugaugaccugcgccagagugagaguguacgagagaaagaaggaggaccagagacagcccagcagcagcagcagccccagccccagcuuccagcagcagaccagcugccacagcagccccgagaaccacaacaacgccaaggagcccgacagcgagcagcagccccugaagcagcugaccugcgaccuggaggacgacagcgacaagcugcaggagaagagcuggaagagcagcugcaacgagggcgagagcagcagcaccagcuacaugcaccagagaagccccggcggccccaccaagcugaucgagaucaucagcgacugcaacugggaggaggacagaaacaagauccugagcauccugagccagcacaucaacagcaacaugccccagagccugaaggugggcagcuucaucaucgagcuggccagccagagaaagagcagaggcgagaagaacccccccguguacagcagcagagugaagaucagcaugcccagcugccaggaccaggacgacauggccgagaagagcggcagcgagacccccgacggcccccugagccccggcaagauggaggacaucagccccgugcagaccgacgcccuggacagcgugagagagagacugcacggcggcaagggccugcccuucuacgccggccugagccccgccggcaagcugguggccuacaagagaaagcccagcagcagcaccagcggccugauccagguggccagcaacgccaagguggccgccagcagaaagcccagaacccugcugcccagcaccagcaacagcaagauggccagcagcagcggcaccgccaccaacagacccggcaagaaccugaaggccuucgugcccgccaagagacccaucgagaacgccgcccagauccccguggccaccccccaggugagccccaacaccgugaagagagccggccccagacugcugcugauccccgugcagcagggcagccccacccugagacccgugagcaacacccagcugcagggccacagaauggugcugcagcccgugagaagccccagcggcaugaaccuguucagacaccccaacggccagaucgugcagcugcugccccugcaccagcugagaggcagcaacacccagcccaaccugcagcccgugauguucagaaaccccggcagcgugaugggcaucagacugcccgcccccagcaagcccagcgagaccccccccagcagcaccagcagcagcgccuucagcgugaugaaccccgugauccaggccgugggcagcagcagcgccgugaacgugaucacccaggcccccagccugcugagcagcggcgccagcuucgugagccaggccggcacccugacccugagaaucagcccccccgagccccagagcuucgccagcaagaccggcagcgagaccaagaucaccuacagcagcggcggccagcccgugggcaccgccagccugaucccccugcagagcggcagcuucgcccugcugcagcugcccggccagaagcccgugcccagcagcauccugcagcacguggccagccugcagaugaagagagagagccagaaccccgaccagaaggacgagaccaacagcaucaagagagagcaggagaccaagaaggugcugcagagcgagggcgaggccguggaccccgaggccaacgugaucaagcagaacagcggcgccgccaccagcgaggagacccugaacgacagccuggaggacagaggcgaccaccuggacgaggagugccugcccgaggagggcugcgccaccgugaagcccagcgagcacagcugcaucaccggcagccacaccgaccaggacuacaaggacgugaacgaggaguacggcgccagaaacagaaagagcagcaaggagaagguggccgugcuggaggugagaaccaucagcgagaaggccagcaacaagaccgugcagaaccugagcaaggugcagcaccagaagcugggcgacgugaagguggagcagcagaagggcuucgacaaccccgaggagaacagcagcgaguuccccgugaccuucaaggaggagagcaaguucgagcugagcggcagcaaggugauggagcagcagagcaaccugcagcccgaggccaaggagaaggagugcggcgacagccuggagaaggacagagagagauggagaaagcaccugaagggcccccugaccagaaagugcgugggcgccagccaggagugcaagaaggaggccgacgagcagcugaucaaggagaccaagaccugccaggagaacagcgacguguuccagcaggagcagggcaucagcgaccugcugggcaagagcggcaucaccgaggacgccagagugcugaagaccgagugcgacagcuggagcagaaucagcaaccccagcgccuucagcaucgugcccagaagagccgccaagagcagcagaggcaacggccacuuccagggccaccugcugcugcccggcgagcagauccagcccaagcaggagaagaagggcggcagaagcagcgccgacuucaccgugcuggaccuggaggaggacgacgaggacgacaacgagaagaccgacgacagcaucgacgagaucguggacguggugagcgacuaccagagcgaggagguggacgacguggagaagaacaacugcguggaguacaucgaggacgacgaggagcacguggacaucgagaccguggaggagcugagcgaggagaucaacguggcccaccugaagaccaccgccgcccacacccagagcuucaagcagcccagcugcacccacaucagcgccgacgagaaggccgccgagagaagcagaaaggccccccccaucccccugaagcugaagcccgacuacuggagcgacaagcugcagaaggaggccgaggccuucgccuacuacagaagaacccacaccgccaacgagagaagaagaagaggcgagaugagagaccuguucgagaagcugaagaucacccugggccugcugcacagcagcaaggugagcaagagccugauccugaccagagccuucagcgagauccagggccugaccgaccaggccgacaagcugaucggccagaagaaccugcugaccagaaagagaaacauccugaucagaaaggugagcagccugagcggcaagaccgaggagguggugcugaagaagcuggaguacaucuacgccaagcagcaggcccuggaggcccagaagagaaagaagaagaugggcagcgacgaguucgacaucagccccagaaucagcaagcagcaggagggcagcagcgccagcagcguggaccugggccagauguucaucaacaacagaagaggcaagccccugauccugagcagaaagaaggaccaggccaccgagaacaccagcccccugaacaccccccacaccagcgccaaccuggugaugaccccccagggccagcugcugacccugaagggcccccuguucagcggccccgugguggccgugagccccgaccugcuggagagcgaccugaagccccagguggccggcagcgccguggcccugcccgagaacgacgaccuguucaugaugcccagaaucgugaacgugaccagccuggccaccgagggcggccugguggacaugggcggcagcaaguacccccacgaggugcccgacagcaagcccagcgaccaccugaaggacaccgugagaaacgaggacaacagccuggaggacaagggcagaaucagcagcagaggcaacagagacggcagagugacccugggccccacccagguguuccuggccaacaaggacagcggcuacccccagaucguggacgugagcaacaugcagaaggcccaggaguuccugcccaagaagaucagcggcgacaugagaggcauccaguacaaguggaaggagagcgagagcagaggcgagagagugaagagcaaggacagcagcuuccacaagcugaagaugaaggaccugaaggacagcagcaucgagauggagcugagaaaggugaccagcgccaucgaggaggccgcccuggacagcagcgagcugcugaccaacauggaggacgaggacgacaccgacgagacccugaccagccugcugaacgagaucgccuuccugaaccagcagcugaacgacgacagcgugggccuggccgagcugcccagcagcauggacaccgaguuccccggcgacgccagaagagccuucaucagcaaggugccccccggcagcagagccaccuuccagguggagcaccugggcaccggccugaaggagcugcccgacgugcagggcgagagcgacagcaucagcccccugcugcugcaccuggaggacgacgacuucagcgagaacgagaagcagcuggccgagcccgccagcgagcccgacgugcugaagaucgugaucgacagcgagaucaaggacagccugcugagcaacaagaaggccaucgacggcggcaagaacaccagcggccugcccgccgagcccgagagcgugagcagcccccccacccugcacaugaagaccggccuggagaacagcaacagcaccgacacccuguggagacccaugcccaagcuggccccccugggccugaagguggccaaccccagcagcgacgccgacggccagagccugaaggugaugcccugccuggcccccaucgccgccaaggugggcagcgugggccacaagaugaaccugaccggcaacgaccaggagggcagagagagcaaggugaugcccacccuggcccccgugguggccaagcugggcaacagcggcgccagccccagcagcgccggcaaguaa

SEQ ID NO: 19839 - RNA, 5574 nt, Artificial Sequence
  MGAM__Homo_sapiens__NP_004659
auggccagaaagaagcugaagaaguucaccacccuggagaucgugcugagcgugcugcugcuggugcuguucaucaucagcaucgugcugaucgugcugcuggccaaggagagccugaagagcaccgcccccgaccccggcaccaccggcacccccgaccccggcaccaccggcacccccgaccccggcaccaccggcaccacccacgccagaaccaccggcccccccgaccccggcaccaccggcaccacccccgugagcgccgagugccccguggugaacgagcuggagagaaucaacugcauccccgaccagccccccaccaaggccaccugcgaccagagaggcugcugcuggaacccccagggcgccgugagcgugcccuggugcuacuacagcaagaaccacagcuaccacguggagggcaaccuggugaacaccaacgccggcuucaccgccagacugaagaaccugcccagcagccccguguucggcagcaacguggacaacgugcugcugaccgccgaguaccagaccagcaacagauuccacuucaagcugaccgaccagaccaacaacagauucgaggugccccacgagcacgugcagagcuucagcggcaacgccgccgccagccugaccuaccagguggagaucagcagacagcccuucagcaucaaggugaccagaagaagcaacaacagagugcuguucgacagcagcaucggcccccugcuguucgccgaccaguuccugcagcugagcaccagacugcccagcaccaacguguacggccugggcgagcacgugcaccagcaguacagacacgacaugaacuggaagaccuggcccaucuucaacagagacaccacccccaacggcaacggcaccaaccuguacggcgcccagaccuucuuccugugccuggaggacgccagcggccugagcuucggcguguuccugaugaacagcaacgccauggagguggugcugcagcccgcccccgccaucaccuacagaaccaucggcggcauccuggacuucuacguguuccugggcaacacccccgagcagguggugcaggaguaccuggagcugaucggcagacccgcccugcccagcuacugggcccugggcuuccaccugagcagauacgaguacggcacccuggacaacaugagagaggugguggagagaaacagagccgcccagcugcccuacgacgugcagcacgccgacaucgacuacauggacgagagaagagacuucaccuacgacagcguggacuucaagggcuuccccgaguucgugaacgagcugcacaacaacggccagaagcuggugaucaucguggaccccgccaucagcaacaacagcagcagcagcaagcccuacggccccuacgacagaggcagcgacaugaagaucugggugaacagcagcgacggcgugaccccccugaucggcgagguguggcccggccagaccguguuccccgacuacaccaaccccaacugcgccgugugguggaccaaggaguucgagcuguuccacaaccagguggaguucgacggcaucuggaucgacaugaacgaggugagcaacuucguggacggcagcgugagcggcugcagcaccaacaaccugaacaacccccccuucacccccagaauccuggacggcuaccuguucugcaagacccugugcauggacgccgugcagcacuggggcaagcaguacgacauccacaaccuguacggcuacagcauggccguggccaccgccgaggccgccaagaccguguuccccaacaagagaagcuucauccugaccagaagcaccuucgccggcagcggcaaguucgccgcccacuggcugggcgacaacaccgccaccugggacgaccugagauggagcauccccggcgugcuggaguucaaccuguucggcauccccauggugggccccgacaucugcggcuucgcccuggacacccccgaggagcugugcagaagauggaugcagcugggcgccuucuaccccuucagcagaaaccacaacggccagggcuacaaggaccaggaccccgccagcuucggcgccgacagccugcugcugaacagcagcagacacuaccugaacaucagauacacccugcugcccuaccuguacacccuguucuucagagcccacagcagaggcgacaccguggccagaccccugcugcacgaguucuacgaggacaacagcaccugggacgugcaccagcaguuccuguggggccccggccugcugaucacccccgugcuggacgagggcgccgagaaggugauggccuacgugcccgacgccgugugguacgacuacgagaccggcagccaggugagauggagaaagcagaagguggagauggagcugcccggcgacaagaucggccugcaccugagaggcggcuacaucuuccccacccagcagcccaacaccaccacccuggccagcagaaagaacccccugggccugaucaucgcccuggacgagaacaaggaggccaagggcgagcuguucugggacaacggcgagaccaaggacaccguggccaacaagguguaccugcugugcgaguucagcgugacccagaacagacuggaggugaacaucagccagagcaccuacaaggaccccaacaaccuggccuucaacgagaucaagauccugggcaccgaggagcccagcaacgugaccgugaagcacaacggcgugcccagccagaccagccccaccgugaccuacgacagcaaccugaagguggccaucaucaccgacaucgaccugcugcugggcgaggccuacaccguggaguggagcaucaagaucagagacgaggagaagaucgacugcuaccccgacgagaacggcgccagcgccgagaacugcaccgccagaggcugcaucugggaggccagcaacagcagcggcgugcccuucugcuacuucgugaacgaccuguacagcgugagcgacgugcaguacaacagccacggcgccaccgccgacaucagccugaagagcagcguguacgccaacgccuuccccagcacccccgugaacccccugagacuggacgugaccuaccacaagaacgagaugcugcaguucaagaucuacgaccccaacaagaacagauacgaggugcccgugccccugaacauccccagcaugcccagcagcacccccgagggccagcuguacgacgugcugaucaagaagaaccccuucggcaucgagaucagaagaaagagcaccggcaccaucaucugggacagccagcugcugggcuucaccuucagcgacauguucaucagaaucagcaccagacugcccagcaaguaccuguacggcuucggcgagaccgagcacagaagcuacagaagagaccuggaguggcacaccuggggcauguucagcagagaccagccccccggcuacaagaagaacagcuacggcgugcaccccuacuacaugggccuggaggaggacggcagcgcccacggcgugcugcugcugaacagcaacgccauggacgugaccuuccagccccugcccgcccugaccuacagaaccaccggcggcgugcuggacuucuacguguuccugggccccacccccgagcuggugacccagcaguacaccgagcugaucggcagacccgugauggugcccuacuggagccugggcuuccagcugugcagauacggcuaccagaacgacagcgagaucgccagccuguacgacgagaugguggccgcccagauccccuacgacgugcaguacagcgacaucgacuacauggagagacagcuggacuucacccugagccccaaguucgccggcuuccccgcccugaucaacagaaugaaggccgacggcaugagagugauccugauccuggaccccgccaucagcggcaacgagacccagcccuaccccgccuucaccagaggcguggaggacgacguguucaucaaguaccccaacgacggcgacaucguguggggcaagguguggcccgacuuccccgacgugguggugaacggcagccuggacugggacagccagguggagcuguacagagccuacguggccuuccccgacuucuucagaaacagcaccgccaagugguggaagagagagaucgaggagcuguacaacaacccccagaaccccgagagaagccugaaguucgacggcauguggaucgacaugaacgagcccagcagcuucgugaacggcgccgugagccccggcugcagagacgccagccugaaccacccccccuacaugccccaccuggagagcagagacagaggccugagcagcaagacccugugcauggagagccagcagauccugcccgacggcagccuggugcagcacuacaacgugcacaaccuguacggcuggagccagaccagacccaccuacgaggccgugcaggaggugaccggccagagaggcguggugaucaccagaagcaccuuccccagcagcggcagaugggccggccacuggcugggcgacaacaccgccgccugggaccagcugaagaagagcaucaucggcaugauggaguucagccuguucggcaucagcuacaccggcgccgacaucugcggcuucuuccaggacgccgaguacgagaugugcgugagauggaugcagcugggcgccuucuaccccuucagcagaaaccacaacaccaucggcaccagaagacaggaccccgugagcugggacguggccuucgugaacaucagcagaaccgugcugcagaccagauacacccugcugcccuaccuguacacccugaugcacaaggcccacaccgagggcgugaccguggugagaccccugcugcacgaguucgugagcgaccaggugaccugggacaucgacagccaguuccugcugggccccgccuuccuggugagccccgugcuggagagaaacgccagaaacgugaccgccuacuuccccagagccagaugguacgacuacuacaccggcguggacaucaacgccagaggcgaguggaagacccugcccgccccccuggaccacaucaaccugcacgugagaggcggcuacauccugcccuggcaggagcccgcccugaacacccaccugagcagacagaaguucaugggcuucaagaucgcccuggacgacgagggcaccgccggcggcuggcuguucugggacgacggccagagcaucgacaccuacggcaagggccuguacuaccuggccagcuucagcgccagccagaacaccaugcagagccacaucaucuucaacaacuacaucaccggcaccaacccccugaagcugggcuacaucgagaucuggggcgugggcagcgugcccgugaccagcgugagcaucagcgugagcggcauggugaucacccccagcuucaacaacgaccccaccacccaggugcugagcaucgacgugaccgacagaaacaucagccugcacaacuucaccagccugaccuggaucagcacccuguaa

SEQ ID NO: 19840 - RNA, 723 nt, Artificial Sequence
  MGARP__Homo_sapiens__NP_116012
auguaccugagaagagccgugagcaagacccuggcccugccccugagagccccccccaaccccgccccccugggcaaggacgccagccugagaagaaugagcagcaacagauuccccggcagcagcggcagcaacaugaucuacuaccugguggugggcgugaccgugagcgccggcggcuacuacgccuacaagaccgugaccagcgaccaggccaagcacaccgagcacaagaccaaccugaaggagaagaccaaggccgagauccaccccuuccagggcgagaaggagaacguggccgagaccgagaaggccagcagcgaggcccccgaggagcugaucguggaggccgaggugguggacgccgaggagagccccagcgccaccgugguggugaucaaggaggccagcgccugccccggccacguggaggccgcccccgagaccaccgccgugagcgccgagaccggccccgaggugaccgacgccgccgccagagagaccaccgaggugaaccccgagaccacccccgaggugaccaacgccgcccuggacgaggccgugaccaucgacaacgacaaggacaccaccaagaacgagaccagcgacgaguacgccgagcuggaggaggagaacagccccgccgagagcgagagcagcgccggcgacgaccugcaggaggaggccagcgugggcagcgaggccgccagcgcccagggcuaa

SEQ ID NO: 19841 - RNA, 1338 nt, Artificial Sequence
  MGAT1__Homo_sapiens__XP_011532865
augcugaagaagcagagcgccggccuggugcuguggggcgccauccuguucguggccuggaacgcccugcugcugcuguucuucuggaccagacccgcccccggcagaccccccagcgugagcgcccuggacggcgaccccgccagccugaccagagaggugaucagacuggcccaggacgccgagguggagcuggagagacagagaggccugcugcagcagaucggcgacgcccugagcagccagagaggcagagugcccaccgccgccccccccgcccagcccagagugcccgugacccccgcccccgccgugauccccauccuggugaucgccugcgacagaagcaccgugagaagaugccuggacaagcugcugcacuacagacccagcgccgagcuguuccccaucaucgugagccaggacugcggccacgaggagaccgcccaggccaucgccagcuacggcagcgccgugacccacaucagacagcccgaccugagcagcaucgccgugccccccgaccacagaaaguuccagggcuacuacaagaucgccagacacuacagaugggcccugggccagguguucagacaguucagauuccccgccgccguggugguggaggacgaccuggagguggcccccgacuucuucgaguacuucagagccaccuacccccugcugaaggccgaccccagccuguggugcgugagcgccuggaacgacaacggcaaggagcagaugguggacgccagcagacccgagcugcuguacagaaccgacuucuuccccggccugggcuggcugcugcuggccgagcugugggccgagcuggagcccaaguggcccaaggccuucugggacgacuggaugagaagacccgagcagagacagggcagagccugcaucagacccgagaucagcagaaccaugaccuucggcagaaagggcgugagccacggccaguucuucgaccagcaccugaaguucaucaagcugaaccagcaguucgugcacuucacccagcuggaccugagcuaccugcagagagaggccuacgacagagacuuccuggccagaguguacggcgccccccagcugcagguggagaaggugagaaccaacgacagaaaggagcugggcgaggugagagugcaguacaccggcagagacagcuucaaggccuucgccaaggcccugggcgugauggacgaccugaagagcggcgugcccagagccggcuacagaggcaucgugaccuuccaguucagaggcagaagagugcaccuggcccccccccugaccugggagggcuacgaccccagcuggaacuaa

SEQ ID NO: 19842 - RNA, 1344 nt, Artificial Sequence
  MGAT2__Homo_sapiens__NP_002399
augagauucagaaucuacaagagaaaggugcugauccugacccuggugguggccgccugcggcuucgugcuguggagcagcaacggcagacagagaaagaacgaggcccuggcccccccccugcuggacgccgagcccgccagaggcgccggcggcagaggcggcgaccaccccagcguggccgugggcaucagaagagugagcaacgugagcgccgccagccuggugcccgccgugccccagcccgaggccgacaaccugacccugagauacagaagccugguguaccagcugaacuucgaccagacccugagaaacguggacaaggccggcaccugggcccccagagagcuggugcugguggugcaggugcacaacagacccgaguaccugagacugcugcuggacagccugagaaaggcccagggcaucgacaacgugcuggugaucuucagccacgacuucuggagcaccgagaucaaccagcugaucgccggcgugaacuucugccccgugcugcagguguucuuccccuucagcauccagcuguaccccaacgaguuccccggcagcgaccccagagacugccccagagaccugcccaagaacgccgcccugaagcugggcugcaucaacgccgaguaccccgacagcuucggccacuacagagaggccaaguucagccagaccaagcaccacuggugguggaagcugcacuucgugugggagagagugaagauccugagagacuacgccggccugauccuguuccuggaggaggaccacuaccuggcccccgacuucuaccacguguucaagaagauguggaagcugaagcagcaggagugccccgagugcgacgugcugagccugggcaccuacagcgccagcagaagcuucuacggcauggccgacaagguggacgugaagaccuggaagagcaccgagcacaacaugggccuggcccugaccagaaacgccuaccagaagcugaucgagugcaccgacaccuucugcaccuacgacgacuacaacugggacuggacccugcaguaccugaccgugagcugccugcccaaguucuggaaggugcuggugccccagauccccagaaucuuccacgccggcgacugcggcaugcaccacaagaagaccugcagacccagcacccagagcgcccagaucgagagccugcugaacaacaacaagcaguacauguuccccgagacccugaccaucagcgagaaguucaccgugguggccaucagcccccccagaaagaacggcggcuggggcgacaucagagaccacgagcugugcaagagcuacagaagacugcaguaa

SEQ ID NO: 19843 - RNA, 1602 nt, Artificial Sequence
  MGAT3__Homo_sapiens__NP_001091740
augaagaugagaagauacaagcuguuccugauguucugcauggccggccugugccugaucagcuuccugcacuucuucaagacccugagcuacgugaccuuccccagagagcuggccagccugagccccaaccuggugagcagcuucuucuggaacaacgcccccgugaccccccaggccagccccgagcccggcggccccgaccugcugagaaccccccuguacagccacagcccccugcugcagccccugccccccagcaaggccgccgaggagcugcacagaguggaccuggugcugcccgaggacaccaccgaguacuucgugagaaccaaggccggcggcgugugcuucaagcccggcaccaagaugcuggagagacccccccccggcagacccgaggagaagcccgagggcgccaacggcagcagcgccagaagaccccccagauaccugcugagcgccagagagagaaccggcggcagaggcgccagaagaaaguggguggagugcgugugccugcccggcuggcacggccccagcugcggcgugcccaccguggugcaguacagcaaccugcccaccaaggagagacuggugcccagagaggugcccagaagagugaucaacgccaucaacgugaaccacgaguucgaccugcuggacgugagauuccacgagcugggcgacgugguggacgccuucguggugugcgagagcaacuucaccgccuacggcgagcccagaccccugaaguucagagagaugcugaccaacggcaccuucgaguacaucagacacaaggugcuguacguguuccuggaccacuucccccccggcggcagacaggacggcuggaucgccgacgacuaccugagaaccuuccugacccaggacggcgugagcagacugagaaaccugagacccgacgacguguucaucaucgacgacgccgacgagauccccgccagagacggcgugcuguuccugaagcuguacgacggcuggaccgagcccuucgccuuccacaugagaaagagccuguacggcuucuucuggaagcagcccggcacccuggagguggugagcggcugcaccguggacaugcugcaggccguguacggccuggacggcaucagacugagaagaagacaguacuacaccaugcccaacuucagacaguacgagaacagaaccggccacauccuggugcaguggagccugggcagcccccugcacuucgccggcuggcacugcagcuggugcuucacccccgagggcaucuacuucaagcuggugagcgcccagaacggcgacuuccccagauggggcgacuacgaggacaagagagaccugaacuacaucagaggccugaucagaaccggcggcugguucgacggcacccagcaggaguacccccccgccgaccccagcgagcacauguacgcccccaaguaccugcugaagaacuacgacagauuccacuaccugcuggacaaccccuaccaggagcccagaagcaccgccgccggcggcuggagacacagaggccccgagggcagaccccccgccagaggcaagcuggacgaggccgagguguaa

SEQ ID NO: 19844 - RNA, 1272 nt, Artificial Sequence
  MGAT4A__Homo_sapiens__NP_001153626
augaacuacagcaucaccgugagcaucgugaugggcauccccaccgugaagagagaggugaagagcuaccugaucgagacccugcacagccugaucgacaaccuguaccccgaggagaagcuggacugcgugaucgugguguucaucggcgagaccgacaucgacuacgugcacggcgugguggccaaccuggagaaggaguucagcaaggagaucagcagcggccugguggaggugaucagcccccccgagagcuacuaccccgaccugaccaaccugaaggagaccuucggcgacagcaaggagagagugagauggagaaccaagcagaaccuggacuacugcuuccugaugauguacgcccaggagaagggcaucuacuacauccagcuggaggacgacaucaucgugaagcagaacuacuucaacaccaucaagaacuucgcccugcagcugagcagcgaggaguggaugauccuggaguucagccagcugggcuucaucggcaagauguuccaggcccccgaccugacccugaucguggaguucaucuucauguucuacaaggagaagcccaucgacuggcugcuggaccacauccugugggugaaggugugcaaccccgagaaggacgccaagcacugcgacagacagaaggccaaccugagaaucagauucagacccagccuguuccagcacgugggccugcacagcagccugagcggcaagauccagaagcugaccgacaaggacuacaugaagccccugcugcugaagauccacgugaacccccccgccgaggugagcaccagccugaagguguaccagggccacacccuggagaagaccuacaugggcgaggacuucuucugggccaucacccccaucgccggcgacuacauccuguucaaguucgacaagcccgugaacguggagagcuaccuguuccacagcggcaaccaggagcaccccggcgacauccugcugaacaccaccguggaggugcugcccuucaagagcgagggccuggagaucagcaaggagaccaaggacaagagacuggaggacggcuacuucagaaucggcaaguucgagaacggcguggccgagggcaugguggaccccagccugaaccccaucagcgccuucagacugagcgugauccagaacagcgccgugugggccauccugaacgagcagagaguguucagcggcugguggcagaagagcagagacaaggccgagggcccccaggccccccugcuguucuaa

SEQ ID NO: 19845 - RNA, 1647 nt, Artificial Sequence
  MGAT4B__Homo_sapiens__NP_055090
augagacugagaaacggcaccuuccugacccugcugcuguucugccugugcgccuuccugagccugagcugguacgccgcccugagcggccagaagggcgacgugguggacguguaccagagagaguuccuggcccugagagacagacugcacgccgccgagcaggagagccugaagagaagcaaggagcugaaccuggugcuggacgagaucaagagagccgugagcgagagacaggcccugagagacggcgacggcaacagaaccuggggcagacugaccgaggaccccagacugaagcccuggaacggcagccacagacacgugcugcaccugcccaccguguuccaccaccugccccaccugcuggccaaggagagcagccugcagcccgccgugagagugggccagggcagaaccggcgugagcguggugaugggcauccccagcgugagaagagaggugcacagcuaccugaccgacacccugcacagccugaucagcgagcugagcccccaggagaaggaggacagcgugaucguggugcugaucgccgagaccgacagccaguacaccagcgccgugaccgagaacaucaaggcccuguuccccaccgagauccacagcggccugcuggaggugaucagccccagcccccacuucuaccccgacuucagcagacugagagagagcuucggcgaccccaaggagagagugagauggagaaccaagcagaaccuggacuacugcuuccugaugauguacgcccagagcaagggcaucuacuacgugcagcuggaggacgacaucguggccaagcccaacuaccugagcaccaugaagaacuucgcccugcagcagcccagcgaggacuggaugauccuggaguucagccagcugggcuucaucggcaagauguucaagagccuggaccugagccugaucguggaguucauccugauguucuacagagacaagcccaucgacuggcugcuggaccacauccugugggugaaggugugcaaccccgagaaggacgccaagcacugcgacagacagaaggccaaccugagaaucagauucaagcccagccuguuccagcacgugggcacccacagcagccuggccggcaagauccagaagcugaaggacaaggacuucggcaagcaggcccugagaaaggagcacgugaacccccccgccgaggugagcaccagccugaagaccuaccagcacuucacccuggagaaggccuaccugagagaggacuucuucugggccuucacccccgccgccggcgacuucaucagauucagauucuuccagccccugagacuggagagauucuucuucagaagcggcaacaucgagcaccccgaggacaagcuguucaacaccagcguggaggugcugcccuucgacaacccccagagcgacaaggaggcccugcaggagggcagaaccgccacccugagauaccccagaagccccgacggcuaccugcagaucggcagcuucuacaagggcguggccgagggcgagguggaccccgccuucggcccccuggaggcccugagacugagcauccagaccgacagccccgugugggugauccugagcgagaucuuccugaagaaggccgacuaa

SEQ ID NO: 19846 - RNA, 1437 nt, Artificial Sequence
  MGAT4C__Homo_sapiens__NP_037376
auguucaaguuccaccagaugaagcacaucuucgagauccuggacaagaugagaugccugagaaagagaagcaccgugagcuuccugggcgugcuggugaucuuccugcuguucaugaaccuguacaucgaggacagcuacgugcuggagggcgacaagcagcugaucagagagaccagcacccaccagcugaacagcgagagauacgugcacaccuucaaggaccugagcaacuucagcggcgccaucaacgugaccuacagauaccuggccgccaccccccugcagagaaagagauaccugaccaucggccugagcagcgugaagagaaagaagggcaacuaccugcuggagaccaucaagagcaucuucgagcagagcagcuacgaggagcugaaggagaucagcgugguggugcaccuggccgacuucaacagcagcuggagagacgccauggugcaggacaucacccagaaguucgcccaccacaucaucgccggcagacugauggugauccacgcccccgaggaguacuaccccauccuggacggccugaagagaaacuacaacgaccccgaggacagagugaaguucagaagcaagcagaacguggacuacgccuuccugcugaacuucugcgccaacaccagcgacuacuacgugaugcuggaggacgacgugagaugcagcaagaacuuccugaccgccaucaagaaggugaucgccagccuggagggcaccuacugggugacccuggaguucagcaagcugggcuacaucggcaagcuguaccacagccacgaccugcccagacuggcccacuuccugcugauguucuaccaggagaugcccugcgacuggcugcugacccacuucagaggccugcuggcccagaagaacgugaucagauucaagcccagccuguuccagcacaugggcuacuacagcagcuacaagggcaccgagaacaagcugaaggacgacgacuucgaggaggagagcuucgacauccccgacaacccccccgccagccuguacaccaacaugaacguguucgagaacuacgaggccagcaaggccuacagcagcguggacgaguacuucuggggcaagccccccagcaccggcgacguguucgugaucguguucgagaaccccaucaucaucaagaagaucaaggugaacaccggcaccgaggacagacagaacgacauccugcaccacggcgcccuggacgugggcgagaacgugaugcccagcaagcagagaagacagugcagcaccuaccugagacugggcgaguucaagaacggcaacuucgagaugagcggcgugaaccagaagauccccuucgacauccacugcaugagaaucuacgugaccaagacccagaaggaguggcugaucaucagaagcaucagcaucuggaccagcuaa

SEQ ID NO: 19847 - RNA, 2379 nt, Artificial Sequence
  MGAT5B__Homo_sapiens__NP_001186101
augaucaccgugaaccccgacggcaagaucauggugagaagaugccuggugacccugagacccuucagacuguucgugcugggcaucggcuucuucacccugugcuuccugaugaccagccugggcggccaguucagcgccagaagacugggcgacagccccuucaccaucagaaccgaggugaugggcggccccgagagcagaggcgugcugagaaagaugagcgaccugcuggagcugauggugaagagaauggacgcccuggccagacuggagaacagcagcgagcugcacagagccggcggcgaccugcacuuccccgccgacagaaugccccccggcgccggccugauggagagaauccaggccaucgcccagaacgugagcgacaucgccgugaagguggaccagauccugagacacagccugcugcugcacagcaaggugagcgagggcagaagagaccagugcgaggcccccagcgaccccaaguuccccgacugcagcggcaagguggaguggaugagagccagauggaccagcgaccccugcuacgccuucuucggcguggacggcaccgagugcagcuuccugaucuaccugagcgagguggagugguucugccccccccugcccuggagaaaccagaccgccgcccagagagcccccaagccccugcccaaggugcaggccguguucagaagcaaccugagccaccugcuggaccugaugggcagcggcaaggagagccugaucuucaugaagaagagaaccaagagacugaccgcccagugggcccuggccgcccagagacuggcccagaagcugggcgccacccagagagaccagaagcagauccuggugcacaucggcuuccugaccgaggagagcggcgacguguucagccccagagugcugaagggcggcccccugggcgagauggugcagugggccgacauccugaccgcccuguacgugcugggccacggccugagagugaccgugagccugaaggagcugcagagcaaccugggcgugccccccggcagaggcagcugcccccugaccaugccccugcccuucgaccugaucuacaccgacuaccacggccugcagcagaugaagagacacaugggccugagcuucaagaaguacagaugcagaaucagagugaucgacaccuucggcaccgagcccgccuacaaccacgaggaguacgccacccugcacggcuacagaaccaacuggggcuacuggaaccugaaccccaagcaguucaugaccauguucccccacacccccgacaacagcuucaugggcuucgugagcgaggagcugaacgagaccgagaagagacugaucaagggcggcaaggccagcaacauggccgugguguacggcaaggaggccagcaucuggaagcugcagggcaaggagaaguuccugggcauccugaacaaguacauggagauccacggcaccguguacuacgagagccagagaccccccgaggugcccgccuucgugaagaaccacggccugcugccccagcccgaguuccagcagcugcugagaaaggccaagcuguucaucggcuucggcuuccccuacgagggccccgccccccuggaggccaucgccaacggcugcaucuuccugcagagcagauucagccccccccacagcagccugaaccacgaguucuucagaggcaagcccaccagcagagagguguucagccagcaccccuacgccgagaacuucaucggcaagccccacguguggaccguggacuacaacaacagcgaggaguucgaggccgccaucaaggccaucaugagaacccagguggaccccuaccugcccuacgaguacaccugcgagggcaugcuggagagaauccacgccuacauccagcaccaggacuucugcagagcccccgaccccgcccugcccgaggcccacgccccccagagccccuucgugcuggcccccaacgccacccaccuggagugggccagaaacaccagccuggcccccggcgccuggccccccgcccacgcccugagagccuggcuggccgugcccggcagagccugcaccgacaccugccuggaccacggccugaucugcgagcccagcuucuuccccuuccugaacagccaggacgccuuccugaagcugcaggugcccugcgacagcaccgagagcgagaugaaccaccuguaccccgccuucgcccagcccggccaggagugcuaccugcagaaggagccccugcuguucagcugcgccggcagcaacaccaaguacagaagacugugccccugcagagacuucagaaagggccagguggcccugugccagggcugccuguaa

SEQ ID NO: 19848 - RNA, 2226 nt, Artificial Sequence
  MGAT5__Homo_sapiens__XP_011509505
auggcccuguucacccccuggaagcugagcagccagaagcugggcuucuuccuggugaccuucggcuucaucuggggcaugaugcugcugcacuucaccauccagcagagaacccagcccgagagcagcagcaugcugagagagcagauccuggaccugagcaagagauacaucaaggcccuggccgaggagaacagaaacgugguggacggccccuacgccggcgugaugaccgccuacgaccugaagaagacccuggccgugcugcuggacaacauccugcagagaaucggcaagcuggagagcaagguggacaaccugguggugaacggcaccggcaccaacagcaccaacagcaccaccgccgugcccagccugguggcccuggagaagaucaacguggccgacaucaucaacggcgcccaggagaagugcgugcugccccccauggacggcuacccccacugcgagggcaagaucaaguggaugaaggacauguggagaagcgaccccugcuacgccgacuacggcguggacggcagcaccugcagcuucuucaucuaccugagcgagguggagaacuggugcccccaccugcccuggagagccaagaaccccuacgaggaggccgaccacaacagccuggccgagaucagaaccgacuucaacauccuguacagcaugaugaagaagcacgaggaguucagauggaugagacugagaaucagaagaauggccgacgccuggauccaggccaucaagagccuggccgagaagcagaaccuggagaagagaaagagaaagaaggugcuggugcaccugggccugcugaccaaggagagcggcuucaagaucgccgagaccgccuucagcggcggcccccugggcgagcuggugcaguggagcgaccugaucaccagccuguaccugcugggccacgacaucagaaucagcgccagccuggccgagcugaaggagaucaugaagaagguggugggcaacagaagcggcugccccaccgugggcgacagaaucguggagcugaucuacaucgacaucgugggccuggcccaguucaagaagacccugggccccagcugggugcacuaccagugcaugcugagagugcuggacagcuucggcaccgagcccgaguucaaccacgccaacuacgcccagagcaagggccacaagacccccuggggcaaguggaaccugaacccccagcaguucuacaccauguucccccacacccccgacaacagcuuccugggcuucgugguggagcagcaccugaacagcagcgacauccaccacaucaacgagaucaagagacagaaccagagccugguguacggcaagguggacagcuucuggaagaacaagaagaucuaccuggacaucauccacaccuacauggaggugcacgccaccguguacggcagcagcaccaagaacauccccagcuacgugaagaaccacggcauccugagcggcagagaccugcaguuccugcugagagagaccaagcuguucgugggccugggcuuccccuacgagggccccgccccccuggaggccaucgccaacggcugcgccuuccugaaccccaaguucaacccccccaagagcagcaagaacaccgacuucuucaucggcaagcccacccugagagagcugaccagccagcaccccuacgccgagguguucaucggcagaccccacguguggaccguggaccugaacaaccaggaggagguggaggacgccgugaaggccauccugaaccagaagaucgagcccuacaugcccuacgaguucaccugcgagggcaugcugcagagaaucaacgccuucaucgagaagcaggacuucugccacggccaggugauguggcccccccugagcgcccugcaggugaagcuggccgagcccggccagagcugcaagcaggugugccaggagagccagcugaucugcgagcccagcuucuuccagcaccugaacaaggacaaggacaugcugaaguacaaggugaccugccagagcagcgagcuggccaaggacauccuggugcccagcuucgaccccaagaacaagcacugcguguuccagggcgaccugcugcuguucagcugcgccggcgcccaccccagacaccagagagugugccccugcagagacuucaucaagggccagguggcccugugcaaggacugccuguaa

SEQ ID NO: 19849 - RNA, 2592 nt, Artificial Sequence
  MGEA5__Homo_sapiens__NP_001135906
auggugcagaaggagagccaggccacccuggaggagagagagagcgagcugagcagcaaccccgccgccagcgccggcgccagccuggagccccccgccgcccccgcccccggcgaggacaaccccgccggcgccggcggcgccgccguggccggcgccgccggcggcgccagaagauuccugugcggcgugguggagggcuucuacggcagacccugggugauggagcagagaaaggagcuguucagaagacugcagaagugggagcugaacaccuaccuguacgcccccaaggacgacuacaagcacagaauguucuggagagagauguacagcguggaggaggccgagcagcugaugacccugaucagcgccgccagagaguacgagaucgaguucaucuacgccaucagccccggccuggacaucaccuucagcaaccccaaggaggugagcacccugaagagaaagcuggaccaggugagccaguucggcugcagaagcuucgcccugcuguucgacgacaucgaccacaacaugugcgccgccgacaaggagguguucagcagcuucgcccacgcccaggugagcaucaccaacgagaucuaccaguaccugggcgagcccgagaccuuccuguucugccccaccgaguacugcggcaccuucugcuaccccaacgugagccagagccccuaccugagaaccgugggcgagaagcugcugcccggcaucgaggugcuguggaccggccccaagguggugagcaaggagauccccguggagagcaucgaggaggugagcaagaucaucaagagagcccccgugaucugggacaacauccacgccaacgacuacgaccagaagagacuguuccugggccccuacaagggcagaagcaccgagcugauccccagacugaagggcgugcugaccaaccccaacugcgaguucgaggccaacuacguggccauccacacccuggccaccugguacaagagcaacaugaacggcgugagaaaggacguggugaugagcagacagguggcccacagcggcgccaaggccagcgugguggacggcaccccccugguggccgcccccagccugaacgccaccaccguggugaccaccguguaccaggagcccaucaugagccagggcgccgcccugagcggcgagcccaccacccugaccaaggaggaggagaagaagcagcccgacgaggagcccauggacauggugguggagaagcaggaggagaccgaccacaagaacgacaaccagauccugagcgagaucguggaggccaagauggccgaggagcugaagcccauggacaccgacaaggagagcaucgccgagagcaagagccccgagaugagcaugcaggaggacugcaucagcgacaucgcccccaugcagaccgacgagcagaccaacaaggagcaguucgugcccggccccaacgagaagccccuguacaccgccgagcccgugacccuggaggaccugcagcugcuggccgaccuguucuaccugcccuacgagcacggccccaagggcgcccagaugcugagagaguuccaguggcugagagccaacagcagcguggugagcgugaacugcaagggcaaggacagcgagaagaucgaggaguggagaagcagagccgccaaguucgaggagaugugcggccuggugaugggcauguucaccagacugagcaacugcgccaacagaaccauccuguacgacauguacagcuacgugugggacaucaagagcaucaugagcauggugaagagcuucgugcaguggcugggcugcagaagccacagcagcgcccaguuccugaucggcgaccaggagcccugggccuucagaggcggccuggccggcgaguuccagagacugcugcccaucgacggcgccaacgaccuguucuuccagccccccccccugacccccaccagcaagguguacaccaucagacccuacuuccccaaggacgaggccagcguguacaagaucugcagagagauguacgacgacggcgugggccugcccuuccagagccagcccgaccugaucggcgacaagcuggugggcggccugcugagccugagccuggacuacugcuucgugcuggaggacgaggacggcaucugcggcuacgcccugggcaccguggacgugacccccuucaucaagaagugcaagaucagcuggauccccuucaugcaggagaaguacaccaagcccaacggcgacaaggagcugagcgaggccgagaagaucaugcugagcuuccacgaggagcaggaggugcugcccgagaccuuccuggccaacuuccccagccugaucaagauggacauccacaagaaggugaccgaccccagcguggccaagagcaugauggccugccugcugagcagccugaaggccaacggcagcagaggcgccuucugcgaggugagacccgacgacaagagaauccuggaguucuacagcaagcugggcugcuucgagaucgccaagauggagggcuuccccaaggacguggugauccugggcagaagccuguaa

SEQ ID NO: 19850 - RNA, 912 nt, Artificial Sequence
  MGLL__Homo_sapiens__NP_001003794
augcccgaggagagcagccccagaagaaccccccagagcauccccuaccaggaccugccccaccuggugaacgccgacggccaguaccuguucugcagauacuggaagcccaccggcacccccaaggcccugaucuucgugagccacggcgccggcgagcacagcggcagauacgaggagcuggccagaaugcugaugggccuggaccugcugguguucgcccacgaccacgugggccacggccagagcgagggcgagagaaugguggugagcgacuuccacguguucgugagagacgugcugcagcacguggacagcaugcagaaggacuaccccggccugcccguguuccugcugggccacagcaugggcggcgccaucgccauccugaccgccgccgagagacccggccacuucgccggcauggugcugaucagcccccuggugcuggccaaccccgagagcgccaccaccuucaaggugcuggccgccaaggugcugaaccuggugcugcccaaccugagccugggccccaucgacagcagcgugcugagcagaaacaagaccgagguggacaucuacaacagcgacccccugaucugcagagccggccugaaggugugcuucggcauccagcugcugaacgccgugagcagaguggagagagcccugcccaagcugaccgugcccuuccugcugcugcagggcagcgccgacagacugugcgacagcaagggcgccuaccugcugauggagcuggccaagagccaggacaagacccugaagaucuacgagggcgccuaccacgugcugcacaaggagcugcccgaggugaccaacagcguguuccacgagaucaacaugugggugagccagagaaccgccaccgccggcaccgccagcccccccuaa

SEQ ID NO: 19851 - RNA, 1035 nt, Artificial Sequence
  MGME1__Homo_sapiens__NP_443097
augaagaugaagcuguuccagaccaucugcagacagcugagaagcagcaaguucagcguggagagcgccgcccugguggccuucagcaccagcagcuacagcugcggcagaaagaagaaggugaaccccuacgaggagguggaccaggagaaguacagcaaccuggugcagagcgugcugagcagcagaggcguggcccagacccccggcagcguggaggaggacgcccugcugugcggccccgugagcaagcacaagcugcccaaccagggcgaggacagaagagugccccagaacugguuccccaucuucaaccccgagagaagcgacaagcccaacgccagcgaccccagcgugccccugaagaucccccugcagagaaacgugauccccagcgugaccagagugcugcagcagaccaugaccaagcagcagguguuccugcuggagagauggaagcagagaaugauccuggagcugggcgaggacggcuucaaggaguacaccagcaacguguuccugcagggcaagagauuccacgaggcccuggagagcauccugagcccccaggagacccugaaggagagagacgagaaccugcugaagagcggcuacaucgagagcgugcagcacauccugaaggacgugagcggcgugagagcccuggagagcgccgugcagcacgagacccugaacuacaucggccugcuggacugcguggccgaguaccagggcaagcugugcgugaucgacuggaagaccagcgagaagcccaagcccuucauccagagcaccuucgacaacccccugcaggugguggccuacaugggcgccaugaaccacgacaccaacuacagcuuccaggugcagugcggccugaucgugguggccuacaaggacggcagccccgcccacccccacuucauggacgccgagcugugcagccaguacuggaccaaguggcugcugagacuggaggaguacaccgagaagaagaagaaccagaacauccagaagcccgaguacagcgaguaa

SEQ ID NO: 19852 - RNA, 717 nt, Artificial Sequence
  MGMT__Homo_sapiens__NP_002403
augcugggccagcccgccccccuggagagauucgccagcagaagaccccaggugcuggccgugagaaccgugugcgaccuggugcugggcaagauggacaaggacugcgagaugaagagaaccacccuggacagcccccugggcaagcuggagcugagcggcugcgagcagggccugcacgagaucaagcugcugggcaagggcaccagcgccgccgacgccguggaggugcccgcccccgccgccgugcugggcggccccgagccccugaugcagugcaccgccuggcugaacgccuacuuccaccagcccgaggccaucgaggaguuccccgugcccgcccugcaccaccccguguuccagcaggagagcuucaccagacaggugcuguggaagcugcugaagguggugaaguucggcgaggugaucagcuaccagcagcuggccgcccuggccggcaaccccaaggccgccagagccgugggcggcgccaugagaggcaaccccgugcccauccugauccccugccacagaguggugugcagcagcggcgccgugggcaacuacagcggcggccuggccgugaaggaguggcugcuggcccacgagggccacagacugggcaagcccggccugggcggcagcagcggccuggccggcgccuggcugaagggcgccggcgccaccagcggcagcccccccgccggcagaaacuaa

SEQ ID NO: 19853 - RNA, 312 nt, Artificial Sequence
  MGP__Homo_sapiens__NP_000891
augaagagccugauccugcuggccauccuggccgcccuggccguggugacccugugcuacgagagccacgagagcauggagagcuacgagcugaaccccuucaucaacagaagaaacgccaacaccuucaucagcccccagcagagauggagagccaaggugcaggagagaaucagagagagaagcaagcccgugcacgagcugaacagagaggccugcgacgacuacagacugugcgagagauacgccaugguguacggcuacaacgccgccuacaacagauacuucagaaagagaagaggcaccaaguaa

SEQ ID NO: 19854 - RNA, 1665 nt, Artificial Sequence
  MGRN1__Homo_sapiens__NP_001135761
augggcagcauccugagcagaagaaucgccggcguggaggacaucgacauccaggccaacagcgccuacagauacccccccaagagcggcaacuacuucgccagccacuucuucaugggcggcgagaaguucgacaccccccaccccgagggcuaccuguucggcgagaacauggaccugaacuuccugggcagcagacccgugcaguuccccuacgugacccccgccccccacgagcccgugaagacccugagaagccuggugaacaucagaaaggacagccugagacuggugagauacaaggacgacgccgacagccccaccgaggacggcgacaagcccagagugcuguacagccuggaguucaccuucgacgccgacgccagaguggccaucaccaucuacugccaggccagcgaggaguuccugaacggcagagccguguacagccccaagagccccagccugcagagcgagaccgugcacuacaagagaggcgugagccagcaguucagccugcccagcuucaagaucgacuucagcgaguggaaggacgacgagcugaacuucgaccuggacagaggcguguuccccguggugauccaggccgugguggacgagggcgacgugguggaggugaccggccacgcccacgugcugcuggccgccuucgagaagcacauggacggcagcuucagcgugaagccccugaagcagaagcagaucguggacagagugagcuaccugcugcaggagaucuacggcaucgagaacaagaacaaccaggagaccaagcccagcgacgacgagaacagcgacaacagcaacgagugcguggugugccugagcgaccugagagacacccugauccugcccugcagacaccugugccugugcaccagcugcgccgacacccugagauaccaggccaacaacugccccaucugcagacugcccuucagagcccugcugcagaucagagccgugagaaagaagcccggcgcccugagccccgugagcuucagccccgugcuggcccagagccuggagcacgacgagcacagcaacagcgacagcgugccccccggcuacgagcccaucagccugcuggaggcccugaacggccugagagccgugagccccgccauccccagcgccccccuguacgaggagaucaccuacagcggcaucagcgacggccugagccaggccagcugcccccuggccgccaucgaccacauccuggacagcagcagacagaagggcagaccccagagcaaggcccccgacagcacccugagaagccccagcagccccauccacgaggaggacgaggagaagcugagcgaggacguggacgccccccccccccugggcggcgccgagcuggcccugagagagagcagcagccccgagagcuucaucaccgaggagguggacgagagcagcagcccccagcagggcaccagagccgccagcaucgagaacgugcugcaggacagcagccccgagcacugcggcagaggcccccccgccgacaucuaccugcccggcagacccaccagcauggagaccgcccacggccuggccaccaccagccccaccuggcccccccugggcggccccagccccgaccccagcgccgccgagcugaccccccuguaa

SEQ ID NO: 19855 - RNA, 468 nt, Artificial Sequence
  MGST1__Homo_sapiens__NP_001247440
augguggaccugacccaggugauggacgacgagguguucauggccuucgccagcuacgccaccaucauccugagcaagaugaugcugaugagcaccgccaccgccuucuacagacugaccagaaagguguucgccaaccccgaggacugcguggccuucggcaagggcgagaacgccaagaaguaccugagaaccgacgacagaguggagagagugagaagagcccaccugaacgaccuggagaacaucauccccuuccugggcaucggccugcuguacagccugagcggccccgaccccagcaccgccauccugcacuucagacuguucgugggcgccagaaucuaccacaccaucgccuaccugaccccccugccccagcccaacagagcccugagcuucuucgugggcuacggcgugacccugagcauggccuacagacugcugaagagcaagcuguaccuguaa

SEQ ID NO: 19856 - RNA, 444 nt, Artificial Sequence
  MGST2__Homo_sapiens__NP_001191295
auggccggcaacagcauccugcuggccgccgugagcauccugagcgccugccagcagagcuacuucgcccugcaggugggcaaggccagacugaaguacaaggugaccccccccgccgugaccggcagccccgaguucgagagaguguucagagcccagcagaacugcguggaguucuaccccaucuucaucaucacccuguggauggccggcugguacuucaaccagguguucgccaccugccugggccugguguacaucuacggcagacaccuguacuucuggggcuacagcgaggccgccaagaagagaaucaccggcuucagacugagccugggcauccuggcccugcugacccugcugggcgcccugggcaucgccaacagcuuccuggacgaguaccuggaccugaacaucgccaagaagcugagaagacaguucuaa

SEQ ID NO: 19857 - RNA, 459 nt, Artificial Sequence
  MGST3__Homo_sapiens__NP_004519
auggccgugcugagcaaggaguacggcuucgugcugcugaccggcgccgccagcuucaucaugguggcccaccuggccaucaacgugagcaaggccagaaagaaguacaagguggaguaccccaucauguacagcaccgaccccgagaacggccacaucuucaacugcauccagagagcccaccagaacacccuggagguguacccccccuuccuguucuuccuggccgugggcggcguguaccaccccagaaucgccagcggccugggccuggccuggaucgugggcagagugcuguacgccuacggcuacuacaccggcgagcccagcaagagaagcagaggcgcccugggcagcaucgcccugcugggccuggugggcaccaccgugugcagcgccuuccagcaccugggcugggugaagagcggccugggcagcggccccaagugcugccacuaa

SEQ ID NO: 19858 - RNA, 1965 nt, Artificial Sequence
  MIA2__Homo_sapiens__NP_473365
auggccaaguucggcgugcacagaauccugcugcuggccaucagccugaccaagugccuggagagcaccaagcugcuggccgaccugaagaagugcggcgaccuggagugcgaggcccugaucaacagagugagcgccaugagagacuacagaggccccgacugcagauaccugaacuucaccaagggcgaggagaucagcguguacgugaagcuggccggcgagagagaggaccugugggccggcagcaagggcaaggaguucggcuacuuccccagagacgccgugcagaucgaggagguguucaucagcgaggagauccagaugagcaccaaggagagcgacuuccugugccugcugggcgugagcuacaccuucgacaacgaggacagcgagcugaacggcgacuacggcgagaacaucuaccccuacgaggaggacaaggacgagaagagcagcaucuacgagagcgacuuccagaucgagcccggcuucuacgccaccuacgagagcacccuguucgaggaccaggugcccgcccuggaggcccccgaggacaucggcagcaccagcgagagcaaggacugggaggagguggugguggagagcauggagcaggacagaauccccgaggugcacgugccccccagcagcgccgugagcggcgugaaggagugguucggccugggcggcgagcaggccgaggagaaggccuucgagagcgugaucgagcccgugcaggagagcagcuucagaagcagaaagaucgccguggaggacgagaacgaccuggaggagcugaacaacggcgagccccagaccgagcaccagcaggagagcgagagcgagaucgacagcgugcccaagacccagagcgagcuggccagcgagagcgagcacauccccaagccccagagcaccggcugguucggcggcggcuucaccagcuaccugggcuucggcgacgaggacaccggccuggagcugaucgccgaggagagcaaccccccccugcaggacuuccccaacagcaucagcagcgacaaggaggccaccgugcccugcaccgagauccugaccgagaagaaggacaccaucaccaacgacagccugagccugaagcccagcugguucgacuucggcuucgccauccugggcuucgccuacgccaaggaggacaagaucaugcuggacgacagaaagaacgaggaggacggcggcgccgacgagcacgagcacccccugaccagcgagcuggaccccgagaaggagcaggagaucgagaccaucaagaucaucgagaccgaggaccagaucgacaagaagcccgugagcgagaagaccgacgagagcgacaccauccccuaccugaagaaguuccuguacaacuucgacaaccccuggaacuuccagaacauccccaaggagaccgagcugcccuuccccaagcagauccuggaccagaacaacgugaucgagaacgaggagaccggcgaguucagcaucgacaacuaccccaccgacaacaccaaggugaugaucuucaagagcagcuacagccugagcgacauggugagcaacaucgagcugcccaccagaauccacgaggagguguacuucgagcccagcagcagcaaggacagcgacgagaacagcaagcccagcguggacaccgagggccccgcccugguggagaucgacagaagcguggagaacacccugcugaacagccagauggugagcaccgacaacagccugagcagccagaacuacaucagccagaaggaggacgccagcgaguuccagauccugaaguaccuguuccagaucgacguguacgacuucaugaacagcgccuucagccccaucgugauccugaccgagagagugagccugcccuucaagcccuucgccaucauccugcccauccugcugaacaucagaguggccaccaaguacguguaa

SEQ ID NO: 19859 - RNA, 2358 nt, Artificial Sequence
  MIA3__Homo_sapiens__NP_001287796
auggacagcgugcccgccaccgugcccagcaucgccgccacccccggcgaccccgagcuggugggcccccugagcgugcuguacgccgccuucaucgccaagcugcuggagcugguggccacccugcccgacgacgugcagcccggccccgacuucuacggccugcccuggaagcccguguucaucaccgccuuccugggcaucgccagcuucgccaucuuccuguggagaaccgugcugguggugaaggacagaguguaccaggugaccgagcagcagaucagcgagaagcugaagaccaucaugaaggagaacaccgagcuggugcagaagcugagcaacuacgagcagaagaucaaggagagcaagaagcacgugcaggagaccagaaagcagaacaugauccugagcgacgaggccaucaaguacaaggacaagaucaagacccuggagaagaaccaggagauccuggacgacaccgccaagaaccugagagugaugcuggagagcgagagagagcagaacgugaagaaccaggaccugaucagcgagaacaagaagagcaucgagaagcugaaggacgugaucagcaugaacgccagcgaguucagcgaggugcagaucgcccugaacgaggccaagcugagcgaggagaaggugaagagcgagugccacagagugcaggaggagaacgccagacugaagaagaagaaggagcagcugcagcaggagaucgaggacuggagcaagcugcacgccgagcugagcgagcagaucaagagcuucgagaagagccagaaggaccuggagguggcccugacccacaaggacgacaacaucaacgcccugaccaacugcaucacccagcugaaccugcuggagugcgagagcgagagcgagggccagaacaagggcggcaacgacagcgacgagcuggccaacggcgaggugggcggcgacagaaacgagaagaugaagaaccagaucaagcagaugauggacgugagcagaacccagaccgccaucagcgugguggaggaggaccugaagcugcugcagcugaagcugagagccagcgugagcaccaagugcaaccuggaggaccaggugaagaagcuggaggacgacagaaacagccugcaggccgccaaggccggccuggaggacgagugcaagacccugagacagaagguggagauccugaacgagcuguaccagcagaaggagauggcccugcagaagaagcugagccaggaggaguacgagagacaggagagagagcacagacugagcgccgccgacgagaaggccgugagcgccgccgaggaggugaagaccuacaagagaagaaucgaggagauggaggacgagcugcagaagaccgagagaagcuucaagaaccagaucgccacccacgagaagaaggcccacgagaacuggcugaaggccagagccgccgagagagccaucgccgaggagaagagagaggccgccaaccugagacacaagcugcuggagcugacccagaagauggccaugcugcaggaggagcccgugaucgugaagcccaugcccggcaagcccaacacccagaacccccccagaagaggcccccugagccagaacggcagcuucggccccagccccgugagcggcggcgagugcagccccccccugaccguggagccccccgugagaccccugagcgccacccugaacagaagagacaugcccagaagcgaguucggcagcguggacggcccccugccccaccccagauggagcgccgaggccagcggcaagcccagccccagcgaccccggcagcggcaccgccaccaugaugaacagcagcagcagaggcagcagccccaccagagugcuggacgagggcaaggugaacauggcccccaagggccccccccccuuccccggcgugccccugaugagcacccccaugggcggccccgugcccccccccaucagauacggcccccccccccagcugugcggccccuucggccccagaccccugcccccccccuucggccccggcaugagacccccccugggccugagagaguucgcccccggcgugccccccggcagaagagaccugccccugcaccccagaggcuuccugcccggccacgcccccuucagaccccugggcagccugggccccagagaguacuucauccccggcaccagacugcccccccccacccacggcccccaggaguacccccccccccccgccgugagagaccugcugcccagcggcagcagagacgagcccccccccgccagccagagcaccagccaggacugcagccaggcccugaagcagagccccuaa

SEQ ID NO: 19860 - RNA, 396 nt, Artificial Sequence
  MIA__Homo_sapiens__NP_001189482
auggccagaagccuggugugccugggcgugaucauccugcugagcgccuucagcggccccggcgugagaggcggccccaugcccaagcuggccgacagaaagcugugcgccgaccaggagugcagccaccccaucagcauggccguggcccugcaggacuacauggcccccgacugcagauuccugaccauccacagaggccaggugguguacguguucagcaagcugaagggcagaggcagacuguucuggggcggcagcgugcagggcgacuacuacggcgaccuggccgccagacugggcuacuuccccagcagcaucgugagagaggaccagacccugaagcccggcaagguggacgugaagaccgacaagugggacuucuacugccaguaa

SEQ ID NO: 19861 - RNA, 3021 nt, Artificial Sequence
  MIB1__Homo_sapiens__NP_065825
augagcaacagcagaaacaacagagugaugguggagggcgugggcgccagaguggugagaggccccgacuggaaguggggcaagcaggacggcggcgagggccacgugggcaccgugagaagcuucgagagccccgaggagguggugguggugugggacaacggcaccgccgccaacuacagaugcagcggcgccuacgaccugagaauccuggacagcgcccccaccggcaucaagcacgacggcaccaugugcgacaccugcagacagcagcccaucaucggcaucagauggaagugcgccgagugcaccaacuacgaccugugcaccgugugcuaccacggcgacaagcaccaccugagacacagauucuacagaaucaccacccccggcagcgagagagugcugcuggagagcagaagaaagagcaagaagaucaccgccagaggcaucuucgccggcgccagaguggugagaggcguggacuggcagugggaggaccaggacggcggcaacggcagaagaggcaaggugaccgagauccaggacuggagcgccagcagcccccacagcgccgccuacgugcugugggacaacggcgccaagaaccuguacagagugggcuucgagggcaugagcgaccugaagugcgugcaggacgccaagggcggcagcuucuacagagaccacugccccgugcugggcgagcagaacggcaacagaaaccccggcggccugcagaucggcgaccuggugaacaucgaccuggaccuggagaucgugcagagccugcagcacggccacggcggcuggaccgacggcauguucgagacccugaccaccaccggcaccgugugcggcaucgacgaggaccacgacaucguggugcaguaccccagcggcaacagauggaccuucaaccccgccgugcugaccaaggccaacaucgugagaagcggcgacgccgcccagggcgccgagggcggcaccagccaguuccaggugggcgaccuggugcaggugugcuacgaccuggagagaaucaagcugcugcagagaggccacggcgagugggccgaggccaugcugcccacccugggcaaggugggcagagugcagcagaucuacagcgacagcgaccugaagguggaggugugcggcaccagcuggaccuacaaccccgccgccgugagcaagguggccagcgccggcagcgccaucagcaacgccagcggcgagagacugagccagcugcugaagaagcuguucgagacccaggagagcggcgaccugaacgaggagcuggugaaggccgccgccaacggcgacguggccaagguggaggaccugcugaagagacccgacguggacgugaacggccagugcgccggccacaccgccaugcaggccgccagccagaacggccacguggacauccugaagcugcugcugaagcagaacguggacguggaggccgaggacaaggacggcgacagagccgugcaccacgccgccuucggcgacgagggcgccgugaucgaggugcugcacagaggcagcgccgaccugaacgccagaaacaagagaagacagaccccccugcacaucgccgugaacaagggccaccugcagguggugaagacccugcuggacuucggcugccaccccagccugcaggacagcgagggcgacaccccccugcacgacgccaucagcaagaagagagacgacauccuggccgugcugcuggaggccggcgccgacgugaccaucaccaacaacaacggcuucaacgcccugcaccacgccgcccugagaggcaaccccagcgccaugagagugcugcugagcaagcugcccagacccuggaucguggacgagaagaaggacgacggcuacaccgcccugcaccuggccgcccugaacaaccacguggagguggccgagcugcuggugcaccagggcaacgccaaccuggacauccagaacgugaaccagcagaccgcccugcaccuggccguggagagacagcacacccagaucgugagacugcuggugagagccggcgccaagcuggacauccaggacaaggacggcgacaccccccugcacgaggcccugagacaccacacccugagccagcugagacagcugcaggacaugcaggacgugggcaagguggacgccgccugggagcccagcaagaacacccugaucaugggccugggcacccagggcgccgagaagaagagcgccgccagcaucgccugcuuccuggccgccaacggcgccgaccugagcaucagaaacaagaagggccagagcccccuggaccugugccccgaccccaaccugugcaaggcccuggccaagugccacaaggagaaggugagcggccaggugggcagcagaagccccagcaugaucagcaacgacagcgagacccuggaggagugcauggugugcagcgacaugaagagagacacccuguucggccccugcggccacaucgccaccugcagccugugcagccccagagugaagaagugccugaucugcaaggagcaggugcagagcagaaccaagaucgaggagugcguggugugcagcgacaagaaggccgccgugcuguuccagcccugcggccacaugugcgccugcgagaacugcgccaaccugaugaagaagugcgugcagugcagagccgugguggagagaagagugcccuucaucaugugcugcggcggcaagagcagcgaggacgccaccgacgacaucagcagcggcaacauccccgugcugcagaaggacaaggacaacaccaacgugaacgccgacgugcagaagcugcagcagcagcugcaggacaucaaggagcagaccaugugccccgugugccuggacagacugaagaacaugaucuuccugugcggccacggcaccugccagcugugcggcgacagaaugagcgagugccccaucugcagaaaggccaucgagagaagaauccugcuguacuaa

SEQ ID NO: 19862 - RNA, 3804 nt, Artificial Sequence
  MIB2__Homo_sapiens__XP_011539035
auggccggcgcccugagaagaggcagagcccugggcagcagacccagcggccccaccgugagcagcagaagaagcccccagugccccguggcccaggagggccugggcgccagaagcagacccagaguggcccccagaagccuggccagaugcggccccagcagcagacugauggugagagccggcgccgaccugcugcccuggagcagcgcccccagccccagcagaagcccccuguggcagaacgccagcgccgugagauucccccugccccuggcccagcagcccagagccggccugggcgugggcagcgccagagacggccugggccugagagcccagagaagaagaggcgccagcugggagcuguggagcggccaccccagaggcacccccgcccccggcagacccagagccgccagaggccagagaagauggggcagaagauggggcagaagacccggcagagugggcugcggcgccagacaggcccuguggcccggccuggccgccgccgagcagagcggccccgugggcggccuggagagaagagacagacccaccgacggccuggccggcggccccgccccccccagcggcgccggcggcaccgagaccagcggcgugggcagccccgccagacuggaggccagccccaaggugagcagacaccagggcugcagccccggcgccagcagaagacccggcggcagacuggacggcagaaccggccccgagcagcccggcccccccuggaccccccugcccaccggccccgagcagcccagacccaccuggacccagacccccagaagagccugcagaugggccugcggcuggugcgccgccuggaccggcagcggcgccagcagaaccgccgccagagccgccugggccagaugguggagccuggccgccaccgccgcccccagacaccccaccgcccaguggagcugcagcggcaccagagccagagcccccaccaccgcccccgccaccagagccagaaccaccugcugcugcgugagacaccccaacaucaucugcgacugcugcaagaagcacggccugagaggcaugagauggaagugcagagugugccuggacuacgaccugugcacccagugcuacaugcacaacaagcacgagcuggcccacgccuucgacagauacgagaccgcccacagcagacccgugacccugagccccagacagggccugcccagaaucccccugagaggcaucuuccagggcgccaagguggugagaggccccgacugggaguggggcagccaggacggcggcgagggcaagcccggcagagugguggacaucagaggcugggacguggagaccggcagaagcguggccagcgugaccugggccgacggcaccaccaacguguacagagugggccacaagggcaagguggaccugaagugcgugggcgaggccgccggcggcuucuacuacaaggaccaccugcccagacugggcaagcccgccgagcugcagagaagagugagcgccgacagccagcccuuccagcacggcgacaaggugaagugccugcuggacaccgacgugcugagagagaugcaggagggccacggcggcuggaaccccagaauggccgaguucaucggccagaccggcaccgugcacagaaucaccgacagaggcgacgugagagugcaguucaaccacgagaccagauggaccuuccaccccggcgcccugaccaaggacaccagaaaggccggccagcugagaggcagagagggcggcggcugggccaagaugcugcugcaccacagcuucugggugggcgacguggugagagugaucggcgaccuggacaccgugaagagacugcaggccggccacggcgaguggaccgacgacauggcccccgcccugggcagagugggcaagguggugaagguguucggcgacggcaaccugagaguggccguggccggccagagauggaccuucagccccagcugccugguggccuacagacccgaggaggacgccaaccuggacguggccgagagagccagagagaacaagagcagccugagcguggcccuggacaagcugagagcccagaagagcgaccccgagcaccccggcagacuggugguggagguggcccugggcaacgccgccagagcccuggaccugcugagaagaagacccgagcagguggacaccaagaaccagggcagaaccgcccugcagguggccgccuaccugggccagguggagcugaucagacugcugcugcaggccagagccggcguggaccugcccgacgacgagggcaacaccgcccugcacuacgccgcccugggcaaccagcccgaggccaccagagugcugcugagcgccggcugcagagccgacgccaucaacagcacccagagcaccgcccugcacguggccgugcagagaggcuuccuggagguggugagagcccugugcgagagaggcugcgacgugaaccugcccgacgcccacagcgacaccccccugcacagcgccaucagcgccggcaccggcgccagcggcaucguggaggugcugaccgaggugcccaacaucgacgugaccgccaccaacagccagggcuucacccugcugcaccacgccagccugaagggccacgcccuggccgugagaaagauccuggccagagccagacagcugguggacgccaagaaggaggacggcuucaccgcccugcaccuggccgcccugaacaaccacagagagguggcccagauccugaucagagagggcagaugcgacgugaacgugagaaacagaaagcugcagagcccccugcaccuggccgugcagcaggcccacgugggccuggugccccugcugguggacgccggcugcagcgugaacgccgaggacgaggagggcgacaccgcccugcacguggcccugcagagacaccagcugcugccccugguggccgacggcgccggcggcgaccccggcccccugcagcugcugagcagaaccuggggcgccggcugcuggggcugccaggugcccggcgacgccagccugggccccgcccccgcccccgcccugaccggcgugugccccgccgcccagcugcaggccagcggccugcccggcagcgccgagcugaccgugggcgccgccguggccugcuuccuggcccuggagggcgccgacgugagcuacaccaaccacagaggcagaagcccccuggaccuggccgccgagggcagagugcugaaggcccugcagggcugcgcccagagauucagagagagacaggccggcggcggcgccgcccccggccccagacagacccugggcacccccaacaccgugaccaaccugcacgugggcgccgcccccggccccgaggccgccgagugccuggugugcagcgagcuggcccugcuggugcuguucagccccugccagcacagaaccgugugcgaggagugcgccagaagaaugaagaagugcaucagaugccaggugguggugagcaagaagcugagacccgacggcagcgagguggccagcgccgcccccgcccccggcccccccagacagcugguggaggagcugcagagcagauacagacagauggaggagagaaucaccugccccaucugcaucgacagccacaucagacugguguuccagugcggccacggcgccugcgcccccugcggcagcgcccugagcgccugccccaucugcagacagcccaucagagacagaauccagaucuucguguaa

SEQ ID NO: 19863 - RNA, 1152 nt, Artificial Sequence
  MICA__Homo_sapiens__NP_000238
augggccugggccccguguuccugcugcuggccggcaucuuccccuucgccccccccggcgccgccgccgagccccacagccugagauacaaccugaccgugcugagcugggacggcagcgugcagagcggcuuccugaccgaggugcaccuggacggccagcccuuccugagaugcgacagacagaagugcagagccaagccccagggccagugggccgaggacgugcugggcaacaagaccugggacagagagaccagagaccugaccggcaacggcaaggaccugagaaugacccuggcccacaucaaggaccagaaggagggccugcacagccugcaggagaucagagugugcgagauccacgaggacaacagcaccagaagcagccagcacuucuacuacgacggcgagcuguuccugagccagaaccuggagaccaaggaguggaccaugccccagagcagcagagcccagacccuggccaugaacgugagaaacuuccugaaggaggacgccaugaagaccaagacccacuaccacgccaugcacgccgacugccugcaggagcugagaagauaccugaagagcggcguggugcugagaagaaccgugccccccauggugaacgugaccagaagcgaggccagcgagggcaacaucaccgugaccugcagagccagcggcuucuaccccuggaacaucacccugagcuggagacaggacggcgugagccugagccacgacacccagcaguggggcgacgugcugcccgacggcaacggcaccuaccagaccuggguggccaccagaaucugccagggcgaggagcagagauucaccugcuacauggagcacagcggcaaccacagcacccaccccgugcccagcggcaaggugcuggugcugcagagccacuggcagaccuuccacgugagcgccguggccgccgccgccaucuucgugaucaucaucuucuacgugagaugcugcaagaagaagaccagcgccgccgagggccccgagcuggugagccugcaggugcuggaccagcaccccgugggcaccagcgaccacagagacgccacccagcugggcuuccagccccugaugagcgaccugggcagcaccggcagcaccgagggcgccuaa

SEQ ID NO: 19864 - RNA, 3375 nt, Artificial Sequence
  MICAL2__Homo_sapiens__NP_001269592
augggcgagaacgaggacgagaagcaggcccaggccggccagguguucgagaacuucgugcaggccagcaccugcaagggcacccugcaggccuucaacauccugaccagacaccuggaccuggacccccuggaccacagaaacuucuacagcaagcugaagagcaaggugaccaccuggaaggccaaggcccugugguacaagcuggacaagagaggcagccacaaggaguacaagagaggcaagagcugcaccaacaccaagugccugaucgugggcggcggccccugcggccugagaaccgccaucgagcuggccuaccugggcgccaaggugguggugguggagaagagagacagcuucagcagaaacaacgugcugcaccuguggcccuucaccauccacgaccugagaggccugggcgccaagaaguucuacggcaaguucugcgccggcagcaucgaccacaucagcaucagacagcugcagcugauccuguucaagguggcccugaugcugggcguggagauccacgugaacguggaguucgugaaggugcuggagccccccgaggaccaggagaaccagaagaucggcuggagagccgaguuccugcccaccgaccacagccugagcgaguucgaguucgacgugaucaucggcgccgacggcagaagaaacacccuggagggcuucagaagaaaggaguucagaggcaagcuggccaucgccaucaccgccaacuucaucaacagaaacagcaccgccgaggccaagguggaggagaucagcggcguggccuucaucuucaaccagaaguucuuccaggaccugaaggaggagaccggcaucgaccuggagaacaucguguacuacaaggacugcacccacuacuucgugaugaccgccaagaagcagagccugcuggacaagggcgugaucaucaacgacuacaucgacaccgagaugcugcugugcgccgagaacgugaaccaggacaaccugcugagcuacgccagagaggccgccgacuucgccaccaacuaccagcugcccagccuggacuucgccaugaaccacuacggccagcccgacguggccauguucgacuucaccugcauguacgccagcgagaacgccgcccuggugagagagagacaggcccaccagcugcugguggcccuggugggcgacagccugcuggagcccuucuggcccaugggcaccggcugcgccagaggcuuccuggccgccuucgacaccgccuggauggugaagagcuggaaccagggcacccccccccuggagcugcuggccgagagagagagccuguacagacugcugccccagaccacccccgagaacaucaacaagaacuucgagcaguacacccuggaccccggcaccagauaccccaaccugaacagccacugcgugagaccccaccaggugaagcaccuguacaucaccaaggagcuggagcacuacccccuggagagacugggcagcgugagaagaagcgugaaccugagcagaaaggagagcgacaucagacccagcaagcugcugaccuggugccagcagcagaccgagggcuaccagcacgugaacgugaccgaccugaccaccagcuggagaagcggccuggcccugugcgccaucauccacagauucagacccgagcugaucaacuucgacagccugaacgaggacgacgccguggagaacaaccagcuggccuucgacguggccgagagagaguucggcaucccccccgugaccaccggcaaggagauggccagcgcccaggagcccgacaagcugagcauggugauguaccugagcaaguucuacgagcuguucagaggcaccccccugagacccguggacagcuggagaaagaacuacggcgagaacgccgaccugagccuggccaagagcagcaucagcaacaacuaccugaaccugaccuuccccagaaagagaacccccagaguggacggccagaccggcgagaacgacaugaacaagagaagaagaaagggcuucaccaaccuggacgagcccagcaacuucagcagcagaagccugggcagcaaccaggagugcggcagcagcaaggagggcggcaaccagaacaaggugaagagcauggccaaccagcugcuggccaaguucgaggagagcaccagaaaccccagccugaugaagcaggagagaagagugagcggcaucggcaagcccgugcugugcagcagcagcggcccccccgugcacagcugcugccccaagcccgaggaggccacccccagccccagccccccccugaagagacaguuccccagcgugguggugaccggccacgugcugagagagcugaagcaggugagcgccggcagcgagugccugagcagacccuggagagccagagccaagagcgaccugcagcugggcggcaccgagaacuucgccacccugcccagcaccagacccagagcccaggcccugagcggcgugcuguggagacugcagcagguggaggagaagauccugcagaagagagcccagaaccuggccaacagagaguuccacaccaagaacaucaaggagaaggccgcccaccuggccagcauguucggccacggcgacuucccccagaacaagcugcugagcaagggccugagccacacccacccccccagcccccccagcagacugcccagccccgaccccgccgccagcagcagccccagcaccguggacagcgccagccccgccagaaaggagaagaagagccccagcggcuuccacuuccaccccagccaccugagaaccgugcacccccagcugaccgugggcaaggugagcagcggcaucggcgccgccgccgaggugcuggugaaccuguacaugaacgaccacagacccaaggcccaggccaccagccccgaccuggagagcaugagaaagagcuucccccugaaccugggcggcagcgacaccugcuacuucugcaagaagagaguguacgugauggagagacugagcgccgagggccacuucuuccacagagagugcuucagaugcagcaucugcgccaccacccugagacuggccgccuacaccuucgacugcgacgagggcaaguucuacugcaagccccacuucauccacugcaagaccaacagcaagcagagaaagagaagagccgagcugaagcagcagagagaggaggaggccaccuggcaggagcaggaggcccccagaagagacacccccaccgagagcagcugcgccguggccgccaucggcacccuggagggcagcccccccgugcacuucagccugcccgugcugcacccccugcugggcuaa

SEQ ID NO: 19865 - RNA, 2088 nt, Artificial Sequence
  MICALCL__Homo_sapiens__NP_116256
augagcccccccaaggaccccagccccagccugccccugcccagcagcagcagccacagcagcagcccccccagcagcagcagcaccagcgugagcggcaacgcccccgacggcagcagccccccccagaugaccgccagcgagccccugagccaggugagcagaggccaccccagcccccccacccccaacuucagaagaagagccguggcccagggcgcccccagagagaucccccuguaccugccccaccaccccaagcccgagugggccgaguacugccuggugagccccggcgaggacggccugagcgaccccgccgagaugaccagcgacgagugccagcccgccgaggccccccugggcgacaucggcagcaaccacagagacccccaccccaucuggggcaaggacagaagcuggaccggccaggagcugagcccccuggccggcgaggacagagagaagggcagcaccggcgccagaaaggaggaggagggcggccccgugcuggugaaggagaagcugggccugaagaagcuggugcugacccaggagcagaagaccaugcugcuggacuggaacgacagcauccccgagagcgugcaccugaaggccggcgagagaaucagccagaagagcgccgagaacggcagaggcggcagagugcugaagcccgugagaccccugcugcugcccagagccgccggcgagccccugcccacccagagaggcgcccaggagaagaugggcacccccgccgagcaggcccagggcgagagaaacgugcccccccccaagagcccccugagacugaucgccaacgccaucagaagaagccuggagccccugcugagcaacagcgagggcggcaagaaggccugggccaagcaggagagcaagacccugcccgcccaggccugcaccagaagcuucagccugagaaagaccaacagcaacaaggacggcgaccagcacagccccggcagaaaccagagcagcgccuucagcccccccgaccccgcccugagaacccacagccugcccaacagacccagcaagguguuccccgcccugagaagcccccccugcagcaagaucgaggacgugcccacccugcuggagaaggugagccugcaggagaacuuccccgacgccagcaagccccccaagaagagaaucagccuguucagcagccugagacugaaggacaagagcuucgagagcuuccugcaggagagcagacagagaaaggacaucagagaccuguucggcagccccaagagaaaggugcugcccgaggacagcgcccaggcccuggagaagcugcugcagcccuucaagagcaccagccugagacaggccgccccccccccccccccccccccccccccccccccccccccccccaccgccggcggcgccgacagcaagaacuucccccugagagcccaggugaccgaggccagcagcagcgccagcagcaccagcagcagcagcgccgacgaggaguucgacccccagcugagccugcagcugaaggagaagaagacccugagaagaagaaagaagcuggagaaggccaugaagcagcuggugaagcaggaggagcugaagagacuguacaaggcccaggccauccagagacagcuggaggagguggaggagagacagagagccagcgagauccagggcgugagacuggagaaggcccugagaggcgaggccgacagcggcacccaggacgaggcccagcugcugcaggagugguucaagcuggugcuggagaagaacaagcugaugagauacgagagcgagcugcugaucauggcccaggagcuggagcuggaggaccaccagagcagacuggagcagaagcugagagagaagaugcugaaggaggagagccagaaggacgagaaggaccugaacgaggagcaggagguguucaccgagcugaugcaggugaucgagcagagagacaagcugguggacagccuggaggagcagagaaucagagagaaggccgaggaccagcacuucgagagcuucguguucagcagaggcugccagcugagcagaaccuaa

SEQ ID NO: 19866 - RNA, 1023 nt, Artificial Sequence
  MICB__Homo_sapiens__NP_001276090
augggccugggcagagugcugcuguuccuggccguggccuuccccuucgccccccccgccgccgccgccgagccccacagccugagauacaaccugauggugcugagccaggacggcagcgugcagagcggcuuccuggccgagggccaccuggacggccagcccuuccugagauacgacagacagaagagaagagccaagccccagggccagugggccgagaacgugcugggcgccaagaccugggacaccgagaccgaggaccugaccgagaacggccaggaccugagaagaacccugacccacaucaaggaccagaagggcgugccccagagcagcagagcccagacccuggccaugaacgugaccaacuucuggaaggaggacgccaugaagaccaagacccacuacagagccaugcaggccgacugccugcagaagcugcagagauaccugaagagcggcguggccaucagaagaaccgugccccccauggugaacgugaccugcagcgaggugagcgagggcaacaucaccgugaccugcagagccagcagcuucuaccccagaaacaucacccugaccuggagacaggacggcgugagccugagccacaacacccagcaguggggcgacgugcugcccgacggcaacggcaccuaccagaccuggguggccaccagaaucagacagggcgaggagcagagauucaccugcuacauggagcacagcggcaaccacggcacccaccccgugcccagcggcaaggcccuggugcugcagagccagagaaccgacuuccccuacgugagcgccgccaugcccugcuucgugaucaucaucauccugugcgugcccugcugcaagaagaagaccagcgccgccgagggccccgagcuggugagccugcaggugcuggaccagcaccccgugggcaccggcgaccacagagacgccgcccagcugggcuuccagccccugaugagcgccaccggcagcaccggcagcaccgagggcaccuaa

SEQ ID NO: 19867 - RNA, 1431 nt, Artificial Sequence
  MICU1__Homo_sapiens__NP_001182447
auguucagacugaacagccugagcgcccuggccgagcuggccgugggcagcagaugguaccacggcggcagccagcccauccagaucagaagaagacugaugaugguggccuuccugggcgccagcgccgugaccgccagcaccggccugcuguggaagagagcccacgccgagagcccccccugcguggacaaccugaagagcgacaucggcgacaagggcaagaacaaggacgagggcgacgugugcaaccacgagaagaagaccgccgaccuggccccccaccccgaggagaagaagaagaagagaagcggcuucagagacagaaaggugauggaguacgagaacagaaucagagccuacagcacccccgacaagaucuucagauacuucgccacccugaaggugaucagcgagcccggcgaggccgagguguucaugacccccgaggacuucgugagaagcaucacccccaacgagaagcagcccgagcaccugggccuggaccaguacaucaucaagagauucgacggcaagaagaucagccaggagagagagaaguucgccgacgagggcagcaucuucuacacccugggcgagugcggccugaucagcuucagcgacuacaucuuccugaccaccgugcugagcaccccccagagaaacuucgagaucgccuucaagauguucgaccugaacggcgacggcgagguggacauggaggaguucgagcaggugcagagcaucaucagaagccagaccagcaugggcaugagacacagagacagacccaccaccggcaacacccugaagagcggccugugcagcgcccugaccaccuacuucuucggcgccgaccugaagggcaagcugaccaucaagaacuuccuggaguuccagagaaagcugcagcacgacgugcugaagcuggaguucgagagacacgaccccguggacggcagaaucaccgagagacaguucggcggcaugcugcuggccuacagcggcgugcagagcaagaagcugaccgccaugcagagacagcugaagaagcacuucaaggagggcaagggccugaccuuccaggagguggagaacuucuucaccuuccugaagaacaucaacgacguggacaccgcccugagcuucuaccacauggccggcgccagccuggacaaggugaccaugcagcagguggccagaaccguggccaagguggagcugagcgaccacgugugcgacgugguguucgcccuguucgacugcgacggcaacggcgagcugagcaacaaggaguucgugagcaucaugaagcagagacugaugagaggccuggagaagcccaaggacaugggcuucaccagacugaugcaggccauguggaagugcgcccaggagaccgccugggacuucgcccugcccaagcaguaa

SEQ ID NO: 19868 - RNA, 1593 nt, Artificial Sequence
  MICU3__Homo_sapiens__NP_859074
auggccgcccugagaagacugcuguggcccccccccagagugagccccccccugugcgcccaccagccccugcugggccccuggggcagacccgccgugaccacccugggccugcccggcagacccuucagcagcagagaggacgaggagagagccguggccgaggccgccuggagaagaagaagaagauggggcgagcugagcguggccgccgccgccggcggcggccuggugggccuggugugcuaccagcuguacggcgaccccagagccggcagccccgccaccggcagacccagcaagagcgccgccaccgagcccgaggacccccccagaggcagaggcaugcugcccauccccguggccgccgccaaggagaccguggccaucggcagaaccgacaucgaggaccuggaccuguacgccaccagcagagagagaagauucagacuguucgccagcaucgagugcgagggccagcuguucaugacccccuacgacuucauccuggccgugaccaccgacgagcccaagguggccaagaccuggaagagccugagcaagcaggagcugaaccagaugcuggccgagaccccccccguguggaagggcagcagcaagcuguucagaaaccugaaggagaagggcgugaucagcuacaccgaguaccuguuccugcugugcauccugaccaagccccacgccggcuucagaaucgccuucaacauguucgacaccgacggcaacgagaugguggacaagaaggaguuccuggugcugcaggagaucuucagaaagaagaacgagaagagagagaucaagggcgacgaggagaagagagccaugcugagacugcagcuguacggcuaccacagccccaccaacagcgugcugaagaccgacgccgaggagcuggugagcagaagcuacugggacacccugagaagaaacaccagccaggcccuguucagcgaccuggccgagagagccgacgacaucaccagccuggugaccgacaccacccugcuggugcacuucuucggcaagaagggcaaggccgagcugaacuucgaggacuucuacagauucauggacaaccugcagaccgaggugcuggagaucgaguuccugagcuacagcaacggcaugaacaccaucagcgaggaggacuucgcccacauccugcugagauacaccaacguggagaacaccagcguguuccuggagaacgugagauacagcauccccgaggagaagggcaucaccuucgacgaguucagaagcuucuuccaguuccugaacaaccuggaggacuucgccaucgcccugaacauguacaacuucgccagcagaagcaucggccaggacgaguucaagagagccguguacguggccaccggccugaaguucagcccccaccuggugaacaccguguucaagaucuucgacguggacaaggacgaccagcugagcuacaaggaguucaucggcaucaugaaggacagacugcacagaggcuucagaggcuacaagaccgugcagaaguaccccaccuucaagagcugccugaagaaggagcugcacagcagauaa

SEQ ID NO: 19869 - RNA, 2004 nt, Artificial Sequence
  MID1__Homo_sapiens__NP_001180206
auggagacccuggagagcgagcugaccugccccaucugccuggagcuguucgaggacccccugcugcugcccugcgcccacagccugugcuucaacugcgcccacagaauccuggugagccacugcgccaccaacgagagcguggagagcaucaccgccuuccagugccccaccugcagacacgugaucacccugagccagagaggccuggacggccugaagagaaacgugacccugcagaacaucaucgacagauuccagaaggccagcgugagcggccccaacagccccagcgagaccagaagagagagagccuucgacgccaacaccaugaccagcgccgagaaggugcugugccaguucugcgaccaggaccccgcccaggacgccgugaagaccugcgugaccugcgaggugagcuacugcgacgagugccugaaggccacccaccccaacaagaagcccuucaccggccacagacugaucgagcccauccccgacagccacaucagaggccugaugugccuggagcacgaggacgagaaggugaacauguacugcgugaccgacgaccagcugaucugcgcccugugcaagcuggugggcagacacagagaccaccagguggccgcccugagcgagagauacgacaagcugaagcagaaccuggagagcaaccugaccaaccugaucaagagaaacaccgagcuggagacccugcuggccaagcugauccagaccugccagcacguggaggugaacgccagcagacaggaggccaagcugaccgaggagugcgaccugcugaucgagaucauccagcagagaagacagaucaucggcaccaagaucaaggagggcaaggugaugagacugagaaagcuggcccagcagaucgccaacugcaagcagugcaucgagagaagcgccagccugaucagccaggccgagcacagccugaaggagaacgaccacgccagauuccugcagaccgccaagaacaucaccgagagagugagcauggccaccgccagcagccaggugcugauccccgagaucaaccugaacgacaccuucgacaccuucgcccuggacuucagcagagagaagaagcugcuggagugccuggacuaccugaccgcccccaacccccccaccaucagagaggagcugugcaccgccagcuacgacaccaucaccgugcacuggaccagcgacgacgaguucagcguggugagcuacgagcugcaguacaccaucuucaccggccaggccaacguggugagccugugcaacagcgccgacagcuggaugaucgugcccaacaucaagcagaaccacuacaccgugcacggccugcagagcggcaccaaguacaucuucauggugaaggccaucaaccaggccggcagcagaagcagcgagcccggcaagcugaagaccaacagccagcccuucaagcuggaccccaagagcgcccacagaaagcugaaggugagccacgacaaccugaccguggagagagacgagagcagcagcaagaagagccacacccccgagagauucaccagccagggcagcuacggcguggccggcaacguguucaucgacagcggcagacacuacugggagguggugaucagcggcagcaccugguacgccaucggccuggccuacaagagcgcccccaagcacgaguggaucggcaagaacagcgccagcugggcccugugcagaugcaacaacaacuggguggugagacacaacagcaaggagauccccaucgagcccgccccccaccugagaagagugggcauccugcuggacuacgacaacggcagcaucgccuucuacgacgcccugaacagcauccaccuguacaccuucgacguggccuucgcccagcccgugugccccaccuucaccguguggaacaagugccugaccaucaucaccggccugcccauccccgaccaccuggacugcaccgagcagcugcccuaa

SEQ ID NO: 19870 - RNA, 2208 nt, Artificial Sequence
  MID2__Homo_sapiens__NP_036348
augggcgagagccccgccagcguggugcugaacgccagcggcggccuguucagccugaagauggagacccuggagagcgagcugaccugccccaucugccuggagcuguucgaggacccccugcugcugcccugcgcccacagccugugcuucagcugcgcccacagaauccuggugagcagcugcagcagcggcgagagcaucgagcccaucaccgccuuccagugccccaccugcagauacgugaucagccugaaccacagaggccuggacggccugaagagaaacgugacccugcagaacaucaucgacagauuccagaaggccagcgugagcggccccaacagccccagcgagagcagaagagagagaaccuacagacccaccaccgccaugagcagcgagagaaucgccugccaguucugcgagcaggacccccccagagacgccgugaagaccugcaucaccugcgaggugagcuacugcgacagaugccugagagccacccaccccaacaagaagcccuucaccagccacagacugguggagcccgugcccgacacccaccugagaggcaucaccugccuggaccacgagaacgagaaggugaacauguacugcgugagcgacgaccagcugaucugcgcccugugcaagcuggugggcagacacagagaccaccagguggccagccugaacgacagauucgagaagcugaagcagacccuggagaugaaccugaccaaccuggugaagagaaacagcgagcuggagaaccagauggccaagcugauccagaucugccagcagguggaggugaacaccgccaugcacgaggccaagcugauggaggagugcgacgagcugguggagaucauccagcagagaaagcagaugaucgccgugaagaucaaggagaccaaggugaugaagcugagaaagcuggcccagcagguggccaacugcagacagugccuggagagaagcaccgugcugaucaaccaggccgagcacauccugaaggagaacgaccaggccagauuccugcagagcgccaagaacaucgccgagagaguggccauggccaccgccagcagccaggugcugauccccgacaucaacuucaacgacgccuucgagaacuucgcccuggacuucagcagagagaagaagcugcuggagggccuggacuaccugaccgcccccaacccccccagcaucagagaggagcugugcaccgccagccacgacaccaucaccgugcacuggaucagcgacgacgaguucagcaucagcagcuacgagcugcaguacaccaucuucaccggccaggccaacuucaucagcaagagcuggugcagcuggggccuguggcccgagaucagaaagugcaaggaggccgugagcugcagcagacuggccggcgcccccagaggccuguacaacagcguggacagcuggaugaucgugcccaacaucaagcagaaccacuacaccgugcacggccugcagagcggcaccagauacaucuucaucgugaaggccaucaaccaggccggcagcagaaacagcgagcccaccagacugaagaccaacagccagcccuucaagcuggaccccaagaugacccacaagaagcugaagaucagcaacgacggccugcagauggagaaggacgagagcagccugaagaagagccacacccccgagagauucagcggcaccggcugcuacggcgccgccggcaacaucuucaucgacagcggcugccacuacugggagguggugaugggcagcagcaccugguacgccaucggcaucgccuacaagagcgcccccaagaacgaguggaucggcaagaacgccagcagcuggguguucagcagaugcaacagcaacuucguggugagacacaacaacaaggagaugcugguggacgugcccccccaccugaagagacugggcgugcugcuggacuacgacaacaacaugcugagcuucuacgaccccgccaacagccugcaccugcacaccuucgacgugaccuucauccugcccgugugccccaccuucaccaucuggaacaagagccugaugauccugagcggccugcccgcccccgacuucaucgacuaccccgagagacaggagugcaacugcagaccccaggagagccccuacgugagcggcaugaagaccugccacuaa

SEQ ID NO: 19871 - RNA, 348 nt, Artificial Sequence
  MIEN1__Homo_sapiens__NP_115715
augagcggcgagcccggccagaccagcguggcccccccccccgaggagguggagcccggcagcggcgugagaaucgugguggaguacugcgagcccugcggcuucgaggccaccuaccuggagcuggccagcgccgugaaggagcaguaccccggcaucgagaucgagagcagacugggcggcaccggcgccuucgagaucgagaucaacggccagcugguguucagcaagcuggagaacggcggcuuccccuacgagaaggaccugaucgaggccaucagaagagccagcaacggcgagacccuggagaagaucaccaacagcagaccccccugcgugauccuguaa

SEQ ID NO: 19872 - RNA, 1638 nt, Artificial Sequence
  MIER2__Homo_sapiens__NP_060020
auggccgaggccagcagccugggcagacagagccccagaguggugagcugccuggagcacagccugugccccggcgagcccggccugcagaccaccgccguggugagcaugggcagcggcgaccaccaguucaaccuggccgagauccugagccagaacuacagcgugagaggcgagugcgaggaggccagcagaugccccgacaagcccaaggaggagcuggagaaggacuucaucagccagagcaacgacaugcccuucgacgagcugcuggcccuguacggcuacgaggccagcgaccccaucagcgacagagagagcgagggcggcgacguggcccccaaccugcccgacaugacccuggacaaggagcagaucgccaaggaccugcugagcggcgaggaggaggaggagacccagagcagcgccgacgaccugacccccagcgugaccagccacgaggccagcgaccuguuccccaacagaagcggcagcagauuccuggccgacgaggacagagagcccggcagcagcgccagcagcgacaccgaggaggacagccugcccgccaacaagugcaagaaggagaucauggugggcccccaguuccaggccgaccugagcaaccugcaccugaacagacacugcgagaagaucuacgagaacgaggaccagcugcugugggaccccagcgugcugcccgagagagagguggaggaguuccuguacagagccgugaagagaagauggcacgagauggccggcccccagcugcccgagggcgaggccgugaaggacagcgagcaggcccuguacgagcuggugaagugcaacuucaacguggaggaggcccugagaagacugagauucaacgugaaggugaucagagacggccugugcgccuggagcgaggaggagugcagaaacuucgagcacggcuucagagugcacggcaagaacuuccaccugauccaggccaacaaggugagaaccagaagcgugggcgagugcguggaguacuacuaccuguggaagaagagcgagagauacgacuacuucgcccagcagaccagacugggcagaagaaaguacgugcccagcggcaccaccgacgccgaccaggaccuggacggcagcgaccccgacggccccggcagacccagacccgagcaggacacccugaccggcaugagaaccgacccccugagcguggacggcaccgccggcggccuggacgagcccggcguggccagcgacggccugcccagcagcgagcccggccccugcagcuuccagcagcuggacgagagccccgccgugccccugagccacagaccccccgcccuggccgaccccgccagcuaccagcccgccgugaccgcccccgagcccgacgccagccccagacuggccguggacuucgcccugcccaaggagcugccccugaucagcagccacguggaccugagcggcgaccccgaggagaccguggcccccgcccagguggcccugagcgugaccgaguucggccugaucggcaucggcgacgugaaccccuuccuggccgcccaccccaccugccccgcccccggccugcacagcgagccccugagccacugcaacgugaugaccugcuaa

SEQ ID NO: 19873 - RNA, 1653 nt, Artificial Sequence
  MIER3__Homo_sapiens__NP_001284528
auggccgaggccagcuucggcagcagcagccccgugggcagccugagcagcgaggaccacgacuucgaccccaccgccgagaugcuggugcacgacuacgacgacgagagaacccuggaggaggaggagaugauggacgagggcaagaacuucagcagcgagaucgaggaccuggagaaggagggcaccaugccccuggaggaccugcuggccuucuacggcuacgagcccaccauccccgccguggccaacagcagcgccaacagcagccccagcgagcuggccgacgagcugcccgacaugacccuggacaaggaggagaucgccaaggaccugcugagcggcgacgacgaggagacccagagcagcgccgacgaccugacccccagcgugaccagccacgagaccagcgacuucuuccccagaccccugagaagcaacaccgccugcgacggcgacaaggagagcgagguggaggacguggagaccgacagcggcaacagccccgaggaccugagaaaggagaucaugaucggccugcaguaccaggccgagaucccccccuaccugggcgaguacgacggcaacgagaagguguacgagaacgaggaccagcugcuguggugccccgacguggugcuggagagcaaggugaaggaguaccugguggagaccagccugagaaccggcagcgagaagaucauggacagaaucagcgccggcacccacaccagagacaacgagcaggcccuguacgagcugcugaagugcaaccacaacaucaaggaggccaucgagagauacugcugcaacggcaaggccagccaggagggcaugaccgccuggaccgaggaggagugcagaagcuucgagcacgcccugaugcuguucggcaaggacuuccaccugauccagaagaacaaggugagaaccagaaccguggccgagugcguggccuucuacuacauguggaagaagagcgagagauacgacuacuucgcccagcagaccagauucggcaagaagagauacaaccaccaccccggcgugaccgacuacauggacagacugguggacgagaccgaggcccugggcggcaccgugaacgccagcgcccugaccagcaacagacccgagcccauccccgaccagcagcugaacauccugaacagcuucaccgccagcgaccugaccgcccugaccaacagcguggccaccgugugcgaccccaccgacgugaacugccuggacgacagcuuccccccccugggcaacacccccagaggccaggugaaccacgugcccguggugaccgaggagcugcugacccugcccagcaacggcgagagcgacugcuucaaccuguucgagaccggcuucuaccacagcgagcugaaccccaugaacaugugcagcgaggagagcgagagacccgccaagagacugaagaugggcaucgccgugcccgagagcuucaugaacgaggugagcgugaacaaccugggcguggacuucgagaaccacacccaccacaucaccagcgccaagauggccgugagcguggccgacuucggcagccugagcgccaacgagaccaacggcuucaucagcgcccacgcccugcaccagcacgccgcccugcacagcgaguaa

SEQ ID NO: 19874 - RNA, 348 nt, Artificial Sequence
  MIF__Homo_sapiens__NP_002406
augcccauguucaucgugaacaccaacgugcccagagccagcgugcccgacggcuuccugagcgagcugacccagcagcuggcccaggccaccggcaagcccccccaguacaucgccgugcacguggugcccgaccagcugauggccuucggcggcagcagcgagcccugcgcccugugcagccugcacagcaucggcaagaucggcggcgcccagaacagaagcuacagcaagcugcugugcggccugcuggccgagagacugagaaucagccccgacagaguguacaucaacuacuacgacaugaacgccgccaacgugggcuggaacaacagcaccuucgccuaa

SEQ ID NO: 19875 - RNA, 1158 nt, Artificial Sequence
  MILR1__Homo_sapiens__XP_011522929
augcagaccagcagcaagcccagcgacuuccugaaccuggccaagaagaagagaaaguucagcgagcugcugaccaccguggugcugcugugccugcugacccccagcuggaccagcaccggcagaauguggagccaccugaacagacugcuguucuggagcaucuucagcagcgugaccugcagaaaggccgugcuggacugcgaggccaugaagaccaacgaguuccccagccccugccuggacagcaagaccaagguggugaugaagggccagaacgugagcauguucugcagccacaagaacaagagccugcagaucaccuacagccuguucagaagaaagacccaccugggcacccaggacggcaagggcgagcccgccaucuucaaccugagcaucaccgaggcccacgagagcggccccuacaagugcaaggcccaggugaccagcugcagcaaguacagcagagacuucagcuucaccaucguggaccccgugaccagccccgugcugaacaucauggugauccagaccgagaccgacagacacaucacccugcacugccugagcgugaacggcagccugcccaucaacuacaccuucuucgagaaccacguggccaucagccccgccaucagcaaguacgacagagagcccgccgaguucaaccugaccaagaagaaccccggcgaggaggaggaguacagaugcgaggccaagaacagacugcccaacuacgccaccuacagccaccccgugaccaugcccagcaccggcggcgacagcugccccuucugccugaagcugcugcugcccggccugcugcugcugcugguggugaucauccugauccuggccuucugggugcugcccaaguacaagaccagaaaggccaugagaaacaacgugcccagagacagaggcgacaccgccauggaggugggcaucuacgccaacauccuggagaagcaggccaaggaggagagcgugcccgaggugggcagcagacccugcgugagcaccgcccaggacgaggccaagcacagccaggagcugcaguacgccacccccguguuccaggagguggcccccagagagcaggaggccugcgacagcuacaagagcggcuacguguacagcgagcugaacuucuaa

SEQ ID NO: 19876 - RNA, 1395 nt, Artificial Sequence
  MINA__Homo_sapiens__NP_116167
augcccaagaaggccaagcccaccggcagcggcaaggaggagggccccgcccccugcaagcagaugaagcuggaggccgccggcggccccagcgcccugaacuucgacagccccagcagccuguucgagagccugaucagccccaucaagaccgagaccuucuucaaggaguucugggagcagaagccccugcugauccagagagacgaccccgcccuggccaccuacuacggcagccuguucaagcugaccgaccugaagagccugugcagcagaggcauguacuacggcagagacgugaacgugugcagaugcgugaacggcaagaagaaggugcugaacaaggacggcaaggcccacuuccugcagcugagaaaggacuucgaccagaagagagccaccauccaguuccaccagccccagagauucaaggacgagcuguggagaauccaggagaagcuggagugcuacuucggcagccuggugggcagcaacguguacaucacccccgccggcagccagggccugcccccccacuacgacgacguggagguguucauccugcagcuggagggcgagaagcacuggagacuguaccaccccaccgugccccuggccagagaguacagcguggaggccgaggagagaaucggcagacccgugcacgaguucaugcugaagcccggcgaccugcuguacuuccccagaggcaccauccaccaggccgacacccccgccggccuggcccacagcacccacgugaccaucagcaccuaccagaacaacagcuggggcgacuuccugcuggacaccaucagcggccugguguucgacaccgccaaggaggacguggagcugagaaccggcauccccagacagcugcugcugguggagagcaccaccguggccaccagaagacugagcggcuuccugagaacccuggccgacagacuggagggcaccaaggagcugcugagcagcgacaugaagaaggacuucaucaugcacagacugccccccuacagcgccggcgacggcgccgagcugagcacccccggcggcaagcugcccagacuggacagcguggugagacugcaguucaaggaccacaucgugcugaccgugcugcccgaccaggaccagagcgacgaggcccaggagaagaugguguacaucuaccacagccugaagaacagcagagagacccacaugaugggcaacgaggaggagaccgaguuccacggccugagauucccccugagccaccuggacgcccugaagcagaucuggaacagccccgccaucagcgugaaggaccugaagcugaccaccgacgaggagaaggagagccuggugcugagccuguggaccgagugccugauccaggugguguaa

SEQ ID NO: 19877 - RNA, 3939 nt, Artificial Sequence
  MINK1__Homo_sapiens__NP_001020108
augggcgaccccgcccccgccagaagccuggacgacaucgaccugagcgcccugagagaccccgccggcaucuucgagcugguggagguggugggcaacggcaccuacggccagguguacaagggcagacacgugaagaccggccagcuggccgccaucaaggugauggacgugaccgaggacgaggaggaggagaucaagcaggagaucaacaugcugaagaaguacagccaccacagaaacaucgccaccuacuacggcgccuucaucaagaagagcccccccggcaacgacgaccagcuguggcuggugauggaguucugcggcgccggcagcgugaccgaccuggugaagaacaccaagggcaacgcccugaaggaggacugcaucgccuacaucugcagagagauccugagaggccuggcccaccugcacgcccacaaggugauccacagagacaucaagggccagaacgugcugcugaccgagaacgccgaggugaagcugguggacuucggcgugagcgcccagcuggacagaaccgugggcagaagaaacaccuucaucggcacccccuacuggauggcccccgaggugaucgccugcgacgagaaccccgacgccaccuacgacuacagaagcgacaucuggagccugggcaucaccgccaucgagauggccgagggcgcccccccccugugcgacaugcaccccaugagagcccuguuccugauccccagaaaccccccccccagacugaagagcaagaaguggagcaagaaguucaucgacuucaucgacaccugccugaucaagaccuaccugagcagaccccccaccgagcagcugcugaaguuccccuucaucagagaccagcccaccgagagacaggugagaauccagcugaaggaccacaucgacagaagcagaaagaagagaggcgagaaggaggagaccgaguacgaguacagcggcagcgaggaggaggacgacagccacggcgaggagggcgagcccagcagcaucaugaacgugcccggcgagagcacccugagaagagaguuccugagacugcagcaggagaacaagagcaacagcgaggcccugaagcagcagcagcagcugcagcagcagcagcagagagaccccgaggcccacaucaagcaccugcugcaccagagacagagaagaaucgaggagcagaaggaggagagaagaagaguggaggagcagcagagaagagagagagagcagagaaagcugcaggagaaggagcagcagagaagacuggaggacaugcaggcccugagaagagaggaggagagaagacaggccgagagagagcaggaguacaagagaaagcagcuggaggagcagagacagagcgagagacugcagagacagcugcagcaggagcacgccuaccugaagagccugcagcagcagcagcagcagcagcagcugcagaagcagcagcagcagcagcugcugcccggcgacagaaagccccuguaccacuacggcagaggcaugaaccccgccgacaagcccgccugggccagagagguggaggagagaaccagaaugaacaagcagcagaacagcccccuggccaagagcaagcccggcagcaccggccccgagccccccaucccccaggccagccccggcccccccggcccccugagccagaccccccccaugcagagacccguggagccccaggagggcccccacaagagccugcaggaccagcccaccagaaaccuggccgccuuccccgccagccacgaccccgaccccgccauccccgcccccaccgccacccccagcgccagaggcgccgugaucagacagaacagcgaccccaccagcgagggccccggccccagccccaacccccccgccugggugagacccgacaacgaggccccccccaaggugccccagagaaccagcagcaucgccaccgcccugaacaccagcggcgccggcggcagcagacccgcccaggccgugagagccagacccagaagcaacagcgccuggcagaucuaccugcagagaagagccgagagaggcacccccaagccccccggcccccccgcccagccccccggcccccccaacgccagcagcaaccccgaccugagaagaagcgaccccggcugggagagaagcgacagcgugcugcccgccagccacggccaccugccccaggccggcagccuggagagaaacagagugggcgugagcagcaagcccgacagcagccccgugcugagccccggcaacaaggccaagcccgacgaccacagaagcagacccggcagacccgccgacuucgugcugcugaaggagagaacccuggacgaggcccccagaccccccaagaaggccauggacuacagcagcagcagcgaggagguggagagcagcgaggacgacgaggaggagggcgagggcggccccgccgagggcagcagagacacccccggcggcagaagcgacggcgacaccgacagcgugagcaccaugguggugcacgacguggaggagaucaccggcacccagccccccuacggcggcggcaccaugguggugcagagaacccccgaggaggagagaaaccugcugcacgccgacagcaacggcuacaccaaccugcccgacguggugcagcccagccacagccccaccgagaacagcaagggccagagcccccccagcaaggacggcagcggcgacuaccagagcagaggccuggugaaggcccccggcaagagcagcuucaccauguucguggaccugggcaucuaccagcccggcggcagcggcgacagcauccccaucaccgcccuggugggcggcgagggcaccagacuggaccagcugcaguacgacgugagaaagggcagcguggugaacgugaaccccaccaacaccagagcccacagcgagacccccgagaucagaaaguacaagaagagauucaacagcgagauccugugcgccgcccuguggggcgugaaccugcuggugggcaccgagaacggccugaugcugcuggacagaagcggccagggcaagguguacggccugaucggcagaagaagauuccagcagauggacgugcuggagggccugaaccugcugaucaccaucagcggcaagagaaacaagcugagaguguacuaccugagcuggcugagaaacaagauccugcacaacgaccccgagguggagaagaagcagggcuggaccaccgugggcgacauggagggcugcggccacuacagaguggugaaguacgagagaaucaaguuccuggugaucgcccugaagagcagcguggagguguacgccugggcccccaagcccuaccacaaguucauggccuucaagagcuucgccgaccugccccacagaccccugcugguggaccugaccguggaggagggccagagacugaaggugaucuacggcagcagcgccggcuuccacgccguggacguggacagcggcaacagcuacgacaucuacauccccgugcacauccagagccagaucaccccccacgccaucaucuuccugcccaacaccgacggcauggagaugcugcugugcuacgaggacgagggcguguacgugaacaccuacggcagaaucaucaaggacguggugcugcaguggggcgagaugcccaccagcguggccuacaucugcagcaaccagaucaugggcuggggcgagaaggccaucgagaucagaagcguggagaccggccaccuggacggcguguucaugcacaagagagcccagagacugaaguuccugugcgagagaaacgacaagguguucuucgccagcgugagaagcggcggcagcagccagguguacuucaugacccugaacagaaacugcaucaugaacugguaa

SEQ ID NO: 19878 - RNA, 939 nt, Artificial Sequence
  MINPP1__Homo_sapiens__NP_001171588
augcugagagcccccggcugccugcugagaaccagcguggcccccgccgccgcccuggccgccgcccugcugagcagccuggccagaugcagccugcuggagcccagagaccccguggccagcagccugagccccuacuucggcaccaagaccagauacgaggacgugaaccccgugcugcugagcggccccgaggcccccuggagagaccccgagcugcuggagggcaccugcacccccgugcagcugguggcccugaucagacacggcaccagauaccccaccgugaagcagaucagaaagcugagacagcugcacggccugcugcaggccagaggcagcagagacggcggcgccagcagcaccggcagcagagaccugggcgccgcccuggccgacuggccccugugguacgccgacuggauggacggccagcugguggagaagggcagacaggacaugagacagcuggcccugagacuggccagccuguuccccgcccuguucagcagagagaacuacggcagacugagacugaucaccagcagcaagcacagaugcauggacagcagcgccgccuuccugcagggccuguggcagcacuaccaccccggccugcccccccccgacguggccgacauggaguucggcccccccaccgugaacgacaagcugaugagauucuucgaccacugcgagaaguuccugaccgagguggagaagaacgccaccgcccuguaccacguggaggccuucaagaccggccccgagaugcagaacauccugaagaagguggccgccacccugcaggugcccgugaacgaccugaacgccggccugagccaguuccugcugcagagcagcagcagccuggugaugcagagacuguucuuccacugcuuccugagcugggccaccagcaagaccagaaaccccuaa

SEQ ID NO: 19879 - RNA, 858 nt, Artificial Sequence
  MIOX__Homo_sapiens__NP_060054
augaaggugaccgugggccccgaccccagccugguguacagacccgacguggaccccgagguggccaaggacaaggccagcuucagaaacuacaccagcggcccccugcuggacagaguguucaccaccuacaagcugaugcacacccaccagaccguggacuucgugagaagcaagcacgcccaguucggcggcuucagcuacaagaagaugaccgugauggaggccguggaccugcuggacggccugguggacgagagcgaccccgacguggacuuccccaacagcuuccacgccuuccagaccgccgagggcaucagaaaggcccaccccgacaaggacugguuccaccuggugggccugcugcacgaccugggcaaggugcuggcccuguucggcgagccccagugggccguggugggcgacaccuuccccgugggcugcagaccccaggccagcgugguguucugcgacagcaccuuccaggacaaccccgaccugcaggaccccagauacagcaccgagcugggcauguaccagccccacugcggccuggacagagugcugaugagcuggggccacgacgaguacauguaccaggugaugaaguucaacaaguucagccugccccccgaggccuucuacaugaucagauuccacagcuucuaccccuggcacaccggcagagacuaccagcagcugugcagccagcaggaccuggccaugcugcccugggugagagaguucaacaaguucgaccuguacaccaagugccccgaccugcccgacguggacaagcugagacccuacuaccagggccugaucgacaaguacugccccggcauccugagcugguaa

SEQ ID NO: 19880 - RNA, 2142 nt, Artificial Sequence
  MIPEP__Homo_sapiens__NP_005923
augcugugcgugggcagacugggcggccugggcgccagagccgccgcccugccccccagaagagccggcagaggcagccuggaggccggcaucagagccagaagagugagcaccagcuggagccccgugggcgccgccuucaacgugaagccccagggcagcagacuggaccuguucggcgagagaagaggccuguucggcgugcccgagcugagcgcccccgagggcuuccacaucgcccaggagaaggcccugagaaagaccgagcugcugguggacagagccugcagcaccccccccggcccccagaccgugcugaucuucgacgagcugagcgacagccugugcagaguggccgaccuggccgacuucgugaagaucgcccaccccgagcccgccuucagagaggccgccgaggaggccugcagaagcaucggcaccaugguggagaagcugaacaccaacguggaccuguaccagagccugcagaagcugcuggccgacaagaagcugguggacagccuggaccccgagaccagaagaguggccgagcuguucauguucgacuucgagaucagcggcauccaccuggacaaggagaagagaaagagagccguggaccugaacgugaagauccuggaccugagcagcaccuuccugaugggcaccaacuuccccaacaagaucgagaagcaccugcugcccgagcacaucagaagaaacuucaccagcgccggcgaccacaucaucaucgacggccugcacgccgagagccccgacgaccuggugagagaggccgccuacaagaucuuccuguaccccaacgccggccagcugaagugccuggaggagcugcugagcagcagagaccugcuggccaagcuggugggcuacagcaccuucagccacagagcccugcagggcaccaucgccaagaaccccgagaccgugaugcaguuccuggagaagcugagcgacaagcugagcgagagaacccugaaggacuucgagaugaucagaggcaugaagaugaagcugaacccccagaacagcgaggugaugcccugggacccccccuacuacagcggcgugaucagagccgagagauacaacaucgagcccagccuguacugccccuucuucagccugggcgccugcauggagggccugaacauccugcugaacagacugcugggcaucagccuguacgccgagcagcccgccaagggcgagguguggagcgaggacgugagaaagcuggccguggugcacgagagcgagggccugcugggcuacaucuacugcgacuucuuccagagagccgacaagccccaccaggacugccacuucaccaucagaggcggcagacugaaggaggacggcgacuaccagcugcccgugguggugcugaugcugaaccugcccagaagcagcagaagcagccccacccugcugacccccggcaugauggagaaccuguuccacgagaugggccacgccaugcacagcaugcugggcagaaccagauaccagcacgugaccggcaccagaugccccaccgacuucgccgaggugcccagcauccugauggaguacuucgccaacgacuacagaguggugaaccaguucgccagacacuaccagaccggccagccccugcccaagaacauggugagcagacugugcgagagcaagaaggugugcgccgccgccgacaugcagcugcagguguucuacgccacccuggaccagaucuaccacggcaagcacccccugagaaacagcaccaccgacauccugaaggagacccaggagaaguucuacggccugcccuacgugcccaacaccgccuggcagcugagauucagccaccuggugggcuacggcgccagauacuacagcuaccugaugagcagagccguggccagcaugguguggaaggagugcuuccugcaggaccccuucaacagagccgccggcgagagauacagaagagagaugcuggcccacggcggcggcagagagcccaugcugaugguggagggcaugcugcagaagugccccagcguggacgacuucgugagcgcccuggugagcgaccuggaccuggacuucgagaccuuccugauggacagcgaguaa

SEQ ID NO: 19881 - RNA, 792 nt, Artificial Sequence
  MIP__Homo_sapiens__NP_036196
augugggagcugagaagcgccagcuucuggagagccaucuucgccgaguucuucgccacccuguucuacguguucuucggccugggcagcagccugagaugggcccccggcccccugcacgugcugcagguggccauggccuucggccuggcccuggccacccuggugcagagcgugggccacaucagcggcgcccacgugaaccccgccgugaccuucgccuuccuggugggcagccagaugagccugcugagagccuucugcuacauggccgcccagcugcugggcgccguggccggcgccgccgugcuguacagcgugaccccccccgccgugagaggcaaccuggcccugaacacccugcaccccgccgugagcgugggccaggccaccaccguggagaucuuccugacccugcaguucgugcugugcaucuucgccaccuacgacgagagaagaaacggccagcugggcagcguggcccuggccgugggcuucagccuggcccugggccaccuguucggcauguacuacaccggcgccggcaugaaccccgccagaagcuucgcccccgccauccugaccggcaacuucaccaaccacuggguguacugggugggccccaucaucggcggcggccugggcagccugcuguacgacuuccugcuguuccccagacugaagagcaucagcgagagacugagcgugcugaagggcgccaagcccgacgugagcaacggccagcccgaggugaccggcgagcccguggagcugaacacccaggcccuguaa

SEQ ID NO: 19882 - RNA, 1329 nt, Artificial Sequence
  MIPOL1__Homo_sapiens__NP_620059
auggagaacuggagcaaggacaucacccacagcuaccuggagcaggagaccaccggcaucaacaagagcacccagcccgacgagcagcugaccaugaacagcgagaagagcaugcacagaaagagcaccgagcuggugaacgagaucaccugcgagaacaccgaguggcccggccagagaagcaccaacuuccagaucaucagcagcuaccccgacgacgagagcguguacugcaccaccgagaaguacaacgugauggagcacagacacaacgacaugcacuacgagugcaugacccccugccaggugaccagcgacagcgacaaggagaagaccaucgccuuccugcugaaggagcuggacauccugagaaccagcaacaagaagcugcagcagaagcuggccaaggaggacaaggagcagagaaagcugaaguucaagcuggagcugcaggagaaggagaccgaggccaagaucgccgagaagaccgccgcccugguggaggagguguacuucgcccagaaggagagagacgaggccgugaugagcagacugcagcuggccaucgaggagagagacgaggccaucgccagagccaagcacauggagaugagccugaaggugcuggagaacaucaaccccgaggagaacgacaugacccugcaggagcugcugaacagaaucaacaacgccgacaccggcaucgccauccagaagaacggcgccaucaucguggacagaaucuacaagaccaaggagugcaagaugagaaucaccgccgaggagaugagcgcccugaucgaggagagagacgccgcccugagcaagugcaagagacuggagcaggagcugcaccacgugaaggagcagaaccagaccagcgccaacaacaugagacaccugaccgccgagaacaaccaggagagagcccugaaggccaagcugcugagcaugcagcaggccagagagaccgccgugcagcaguacaagaagcuggaggaggagauccagacccugagaguguacuacagccugcacaagagccugagccaggaggagaaccugaaggaccaguucaacuacacccugagcaccuacgaggaggcccugaagaacagagagaacaucgugagcaucacccagcagcagaacgaggagcuggccacccagcugcagcaggcccugaccgagagagccaacauggagcugcagcugcagcacgccagagaggccagccagguggccaacgagaaggugcagaagcuggagagacugguggacgugcugagaaagaaggugggcaccggcaccaugagaaccgugaucuaa

SEQ ID NO: 19883 - RNA, 354 nt, Artificial Sequence
  MIR1-1HG__Homo_sapiens__NP_848558
augcccagcugcagcugcgcccugauggcccccugcggccccgccgccggccccgccgccguggagagaacccagcagguggccagaggcgagcccggcagcgccagaggccagcugcaggugagccccgagaugagcaucacccacaaggagaaggagaacgcccaccugaaggagauccugcuguucgugaacgccgaggccuucagccagccccagccccacagcgcccccgugugcgagggccagcagcugaccggcaaguucagcaccagcgugcugaccagagccggcggcgacgccagccccugcagcugggagagacugcugugcuacggcuggagccacugcuaa

SEQ ID NO: 19884 - RNA, 3399 nt, Artificial Sequence
  MIS18BP1__Homo_sapiens__XP_005267890
augaucgccaccccccugaagcacagcagaaucuaccugccccccgaggccagcagccagagaagaaaccugcccauggacgccaucuucuucgacagcauccccagcggcacccugacccccgugaaggaccuggugaaguaccagaacagcagccugaagcugaacgaccacaagaagaaccaguuccugaagaugaccaccuucaacaacaagaacaucuuccagagcaccaugcugaccgaggccaccaccagcaacagcagccuggacaucagcgccaucaagcccaacaaggacggccugaagaacaaggccaacuacgagagccccggcaagaucuuccugagaaugaaggagaaggugcugagagacaagcaggagcagcccagcagaaacagcagccugcuggagccccagaagagcggcaacaacgagaccuucacccccaacagaguggagaagaagaagcugcagcacaccuaccugugcgaggagaaggagaacaacaagagcuuccagagcgacgacagcagccugagagccagcgugcagggcgugccccuggagagcagcaacaacgacaucuuccugcccgugaagcagaagauccagugccagcaggagaagaaggccccccugcacaaccugaccuacgagcugcccacccugaaccaggagcaggagaacuuccuggccguggaggccagaaacaagacccugaccagagcccagcuggccaagcagaucuuccacagcaaggagagcaucguggccaccaccaagagcaagaaggacaccuucgugcuggagagcguggacagcgccgacgagcaguuccagaacaccaacgccgagacccugagcaccaacugcauccccaucaagaacggcagccugcugauggugagcgacagcgagagaaccaccgagggcaccagccagcagaaggugaaggagggcaacggcaagaccgugcccggcgagaccggccugcccggcagcaugaaggacaccugcaagaucgugcuggccacccccagacugcacaucaccauccccagaagaagcaagagaaacaucagcaagcugagcccccccagaaucuuccagaccgugaccaacggccugaagaagaaccagguggugcagcugcaggaguggaugaucaagagcaucaacaacaacaccgccaucugcguggagggcaagcugaucgacgugaccaacaucuacuggcacagcaacgugaucaucgagagaaucgagcacaacaagcugagaaccaucagcggcaacguguacauccugaagggcaugaucgaccagaucagcaugaaggaggccggcuaccccaacuaccugaucagaaaguucauguucggcuuccccgagaacuggaaggagcacaucgacaacuuccuggagcagcugagagccggcgagaagaacagagagaagaccaagcagaagcagaagaccggcagaagcgugagagacaucagaaagagcaugaagaacgacgccagagagaaccagaccgacaccgcccagagagccaccaccaccuacgacuucgacugcgacaaccuggagcugaagagcaacaagcacagcgagagccccggcgccaccgagcugaacaugugccacagcaacugccagaacaagcccacccugagauuccccgacgaccaggugaacaacaccauccagaacggcggcggcgacgaccugagcaaccaggagcugaucggcaagaaggaguacaagaugagcagcaagaagcugaagaucggcgagagaaccaacgagagaaucaucaagagccagaagcaggagaccaccgaggagcuggacgugagcaucgacauccugaccagcagagagcaguucuucagcgacgaggagagaaaguacauggccaucaaccagaagaaggccuacauccuggugaccccccugaagagcagaaaggugaucgagcagagaugcaugagauacaaccugagcgccggcaccaucaaggccgugaccgacuucgugauccccgagugccagaagaagagccccaucagcaagagcaugggcacccuggagaacaccuucgagggccacaagagcaagaacaaggaggacugcgacgagagagaccugcugaccgugaacagaaagaucaagaucagcaaccuggagaaggagcagaugcugaccagcgacuucaagaagaacaccagacugcugcccaagcugaagaagaucgagaaccagguggccaugagcuucuacaagcaccagagcagccccgaccugagcagcgaggagagcgagaccgagaaggagaucaagagaaaggccgaggugaagaagaccaaggccggcaacaccaaggaggccguggugcaccugagaaagagcaccagaaacaccagcaacauccccgugauccuggagcccgagaccgaggagagcgagaacgaguucuacaucaagcagaagaaggccagacccagcgugaaggagacccugcagaagagcggcgugagaaaggaguuccccaucaccgaggccgugggcagcgacaagaccaacagacacccccuggagugccugcccggccugauccaggacaaggaguggaacgagaaggagcugcagaagcugcacugcgccuucgccagccugcccaagcacaagcccggcuucuggagcgagguggccgccgccgugggcagcagaagccccgaggagugccagagaaaguacauggagaaccccagaggcaagggcagccagaagcacgugaccaagaagaagcccgccaacagcaagggccagaacggcaagagaggcgacgccgaccagaagcagaccaucaagaucaccgccaaggugggcacccugaagagaaagcagcagaugagagaguuccuggagcagcugcccaaggacgaccacgacgacuucuucagcaccaccccccugcagcaccagagaauccugcugcccagcuuccaggacagcgaggacgacgacgacauccugcccaacauggacaagaaccccaccacccccagcagcgugaucuucccccuggugaagaccccccagugccagcacgugagccccggcaugcugggcagcaucaacagaaacgacugcgacaaguacguguucagaaugcagaaguaccacaagagcaacggcggcaucguguggggcaacaucaagaagaagcugguggagaccgacuucagcacccccacccccagaagaaagacccccuucaacaccgaccugggcgagaacagcggcaucggcaagcuguucaccaacgccguggagagccuggacgaggaggagaaggacuacuacuucagcaacagcgacagcgccuaa

SEQ ID NO: 19885 - RNA, 1260 nt, Artificial Sequence
  MITF__Homo_sapiens__NP_000239
augcuggagaugcuggaguacaaccacuaccaggugcagacccaccuggagaaccccaccaaguaccacauccagcaggcccagagacagcaggugaagcaguaccugagcaccacccuggccaacaagcacgccaaccaggugcugagccugcccugccccaaccagcccggcgaccacgugaugccccccgugcccggcagcagcgcccccaacagccccauggccaugcugacccugaacagcaacugcgagaaggagggcuucuacaaguucgaggagcagaacagagccgagagcgagugccccggcaugaacacccacagcagagccagcugcaugcagauggacgacgugaucgacgacaucaucagccuggagagcagcuacaacgaggagauccugggccugauggaccccgcccugcagauggccaacacccugcccgugagcggcaaccugaucgaccuguacggcaaccagggccugcccccccccggccugaccaucagcaacagcugccccgccaaccugcccaacaucaagagagagcugaccgccugcaucuuccccaccgagagcgaggccagagcccuggccaaggagagacagaagaaggacaaccacaaccugaucgagagaagaagaagauucaacaucaacgacagaaucaaggagcugggcacccugauccccaagagcaacgaccccgacaugagauggaacaagggcaccauccugaaggccagcguggacuacaucagaaagcugcagagagagcagcagagagccaaggagcuggagaacagacagaagaagcuggagcacgccaacagacaccugcugcugagaauccaggagcuggagaugcaggccagagcccacggccugagccugauccccagcaccggccugugcagccccgaccuggugaacagaaucaucaagcaggagcccgugcuggagaacugcagccaggaccugcugcagcaccacgccgaccugaccugcaccaccacccuggaccugaccgacggcaccaucaccuucaacaacaaccugggcaccggcaccgaggccaaccaggccuacagcgugcccaccaagaugggcagcaagcuggaggacauccugauggacgacacccugagccccgugggcgugaccgacccccugcugagcagcgugagccccggcgccagcaagaccagcagcagaagaagcagcaugagcauggaggagaccgagcacaccugcuaa

SEQ ID NO: 19886 - RNA, 723 nt, Artificial Sequence
  MIXL1__Homo_sapiens__NP_001269331
auggccaccgccgagagcagagcccugcaguucgccgagggcgccgccuuccccgccuacagagccccccacgccggcggcgcccugcugcccccccccagccccgccgccgcccugcugcccgccccccccgccggccccggccccgccaccuucgccggcuuccugggcagagaccccggccccgccccccccccccccgccagccugggcagccccgccccccccaagggcgccgccgcccccagcgccagccagagaagaaagagaaccagcuucagcgccgagcagcugcagcugcuggagcugguguucagaagaaccagauaccccgacauccaccugagagagagacuggccgcccugacccugcugcccgagagcagaauccagcugcuguucagcccccuguuccaggugugguuccagaacagaagagccaagagcagaagacagagcggcaagagcuuccagccccuggccagacccgagaucauccugaaccacugcgcccccggcaccgagaccaagugccugaagccccagcugccccuggagguggacgugaacugccugcccgagcccaacggcgugggcggcggcaucagcgacagcagcagccagggccagaacuucgagaccugcagcccccugagcgaggacaucggcagcaagcuggacagcugggaggagcacaucuucagcgccuucggcaacuucuaa

SEQ ID NO: 19887 - RNA, 8691 nt, Artificial Sequence
  MKI67__Homo_sapiens__NP_001139438
auguggcccaccagaagacuggugaccaucaagagaagcggcguggacggcccccacuucccccugagccugagcaccugccuguucggcagaggcaucgagugcgacaucagaauccagcugcccguggugagcaagcagcacugcaagaucgagauccacgagcaggaggccauccugcacaacuucagcagcaccaaccccacccaggugaacggcagcgugaucgacgagcccgugagacugaagcacggcgacgugaucaccaucaucgacagaagcuucagauacgagaacgagagccugcagaacggcagaaagagcaccgaguuccccagaaagaucagagagcaggagcccgccagaagagugagcagaagcagcuucagcagcgaccccgacgagagcgagggcaucccccugaagagaagaagagugagcuucggcggccaccugagacccgagcuguucgacgagaaccugccccccaacaccccccugaagagaggcgaggcccccaccaagagaaagagccuggugaugcacaccccccccgugcugaagaagaucaucaaggagcagccccagcccagcggcaagcaggagagcggcagcgagauccacguggaggugaaggcccagagccuggugaucagcccccccgcccccagccccagaaagacccccguggccagcgaccagagaagaagaagcugcaagaccgcccccgccagcagcagcaagagccagaccgaggugcccaagagaggcggcagaaagagcggcaaccugcccagcaagagagugagcaucagcagaagccagcacgacauccugcagaugaucugcagcaagagaagaagcggcgccagcgaggccaaccugaucguggccaagagcugggccgacguggugaagcugggcgccaagcagacccagaccaaggugaucaagcacggcccccagagaagcaugaacaagagacagagaagacccgccacccccaagaagcccgugggcgaggugcacagccaguucagcaccggccacgccaacagccccugcaccaucaucaucggcaaggcccacaccgagaaggugcacgugcccgccagacccuacagagugcugaacaacuucaucagcaaccagaagauggacuucaaggaggaccugagcggcaucgccgagauguucaagacccccgugaaggagcagccccagcugaccagcaccugccacaucgccaucagcaacagcgagaaccugcugggcaagcaguuccagggcaccgacagcggcgaggagccccugcugcccaccagcgagagcuucggcggcaacguguucuucagcgcccagaacgccgccaagcagcccagcgacaagugcagcgccagccccccccugagaagacagugcaucagagagaacggcaacguggccaagacccccagaaacaccuacaagaugaccagccuggagaccaagaccagcgacaccgagaccgagcccagcaagaccgugagcaccgccaacagaagcggcagaagcaccgaguucagaaacauccagaagcugcccguggagagcaagagcgaggagaccaacaccgagaucguggagugcauccugaagagaggccagaaggccacccugcugcagcagagaagagagggcgagaugaaggagaucgagagacccuucgagaccuacaaggagaacaucgagcugaaggagaacgacgagaagaugaaggccaugaagagaagcagaaccuggggccagaagugcgcccccaugagcgaccugaccgaccugaagagccugcccgacaccgagcugaugaaggacaccgccagaggccagaaccugcugcagacccaggaccacgccaaggcccccaagagcgagaagggcaagaucaccaagaugcccugccagagccugcagcccgagcccaucaacacccccacccacaccaagcagcagcugaaggccagccugggcaaggugggcgugaaggaggagcugcuggccgugggcaaguucaccagaaccagcggcgagaccacccacacccacagagagcccgccggcgacggcaagagcaucagaaccuucaaggagagccccaagcagauccuggaccccgccgccagagugaccggcaugaagaaguggcccagaacccccaaggaggaggcccagagccuggaggaccuggccggcuucaaggagcuguuccagacccccggccccagcgaggagagcaugaccgacgagaagaccaccaagaucgccugcaagagccccccccccgagagcguggacacccccaccagcaccaagcaguggcccaagagaagccugagaaaggccgacguggaggaggaguuccuggcccugagaaagcugacccccagcgccggcaaggccaugcugacccccaagcccgccggcggcgacgagaaggacaucaaggccuucaugggcacccccgugcagaagcuggaccuggccggcacccugcccggcagcaagagacagcugcagacccccaaggagaaggcccaggcccuggaggaccuggccggcuucaaggagcuguuccagacccccggccacaccgaggagcugguggccgccggcaagaccaccaagauccccugcgacagcccccagagcgaccccguggacacccccaccagcaccaagcagagacccaagagaagcaucagaaaggccgacguggagggcgagcugcuggccugcagaaaccugaugcccagcgccggcaaggccaugcacacccccaagcccagcgugggcgaggagaaggacaucaucaucuucgugggcacccccgugcagaagcuggaccugaccgagaaccugaccggcagcaagagaagaccccagacccccaaggaggaggcccaggcccuggaggaccugaccggcuucaaggagcuguuccagacccccggccacaccgaggaggccguggccgccggcaagaccaccaagaugcccugcgagagcagcccccccgagagcgccgacacccccaccagcaccagaagacagcccaagaccccccuggagaagagagacgugcagaaggagcugagcgcccugaagaagcugacccagaccagcggcgagaccacccacaccgacaaggugcccggcggcgaggacaagagcaucaacgccuucagagagaccgccaagcagaagcuggaccccgccgccagcgugaccggcagcaagagacaccccaagaccaaggagaaggcccagccccuggaggaccuggccggccugaaggagcuguuccagacccccgugugcaccgacaagcccaccacccacgagaagaccaccaagaucgccugcagaagccagcccgaccccguggacacccccaccagcagcaagccccagagcaagagaagccugagaaagguggacguggaggaggaguucuucgcccugagaaagagaacccccagcgccggcaaggccaugcacacccccaagcccgccgugagcggcgagaagaacaucuacgccuucaugggcacccccgugcagaagcuggaccugaccgagaaccugaccggcagcaagagaagacugcagacccccaaggagaaggcccaggcccuggaggaccuggccggcuucaaggagcuguuccagaccagaggccacaccgaggagagcaugaccaacgacaagaccgccaagguggccugcaagagcagccagcccgaccccgacaagaaccccgccagcagcaagagaagacugaagaccagccugggcaaggugggcgugaaggaggagcugcuggccgugggcaagcugacccagaccagcggcgagaccacccacacccacaccgagcccaccggcgacggcaagagcaugaaggccuucauggagagccccaagcagauccuggacagcgccgccagccugaccggcagcaagagacagcugagaacccccaagggcaagagcgaggugcccgaggaccuggccggcuucaucgagcuguuccagacccccagccacaccaaggagagcaugaccaacgagaagaccaccaaggugagcuacagagccagccagcccgaccugguggacacccccaccagcagcaagccccagcccaagagaagccugagaaaggccgacaccgaggaggaguuccuggccuucagaaagcagacccccagcgccggcaaggccaugcacacccccaagcccgccgugggcgaggagaaggacaucaacaccuuccugggcacccccgugcagaagcuggaccagcccggcaaccugcccggcagcaacagaagacugcagaccagaaaggagaaggcccaggcccuggaggagcugaccggcuucagagagcuguuccagacccccugcaccgacaaccccaccaccgacgagaagaccaccaagaagauccugugcaagagcccccagagcgaccccgccgacacccccaccaacaccaagcagagacccaagagaagccugaagaaggccgacguggaggaggaguuccuggccuucagaaagcugacccccagcgccggcaaggccaugcacacccccaaggccgccgugggcgaggagaaggacaucaacaccuucgugggcacccccguggagaagcuggaccugcugggcaaccugcccggcagcaagagaagaccccagacccccaaggagaaggccaaggcccuggaggaccuggccggcuucaaggagcuguuccagacccccggccacaccgaggagagcaugaccgacgacaagaucaccgaggugagcugcaagagcccccagcccgaccccgugaagacccccaccagcagcaagcagagacugaagaucagccugggcaaggugggcgugaaggaggaggugcugcccgugggcaagcugacccagaccagcggcaagaccacccagacccacagagagaccgccggcgacggcaagagcaucaaggccuucaaggagagcgccaagcagaugcuggaccccgccaacuacggcaccggcauggagagauggcccagaacccccaaggaggaggcccagagccuggaggaccuggccggcuucaaggagcuguuccagacccccgaccacaccgaggagagcaccaccgacgacaagaccaccaagaucgccugcaagagccccccccccgagagcauggacacccccaccagcaccagaagaagacccaagaccccccugggcaagagagacaucguggaggagcugagcgcccugaagcagcugacccagaccacccacaccgacaaggugcccggcgacgaggacaagggcaucaacguguucagagagaccgccaagcagaagcuggaccccgccgccagcgugaccggcagcaagagacagcccagaacccccaagggcaaggcccagccccuggaggaccuggccggccugaaggagcuguuccagacccccaucugcaccgacaagcccaccacccacgagaagaccaccaagaucgccugcagaagcccccagcccgaccccgugggcacccccaccaucuucaagccccagagcaagagaagccugagaaaggccgacguggaggaggagagccuggcccugagaaagagaacccccagcgugggcaaggccauggacacccccaagcccgccggcggcgacgagaaggacaugaaggccuucaugggcacccccgugcagaagcuggaccugcccggcaaccugcccggcagcaagagauggccccagacccccaaggagaaggcccaggcccuggaggaccuggccggcuucaaggagcuguuccagacccccggcaccgacaagcccaccaccgacgagaagaccaccaagaucgccugcaagagcccccagcccgaccccguggacacccccgccagcaccaagcagagacccaagagaaaccugagaaaggccgacguggaggaggaguuccuggcccugagaaagagaacccccagcgccggcaaggccauggacacccccaagcccgccgugagcgacgagaagaacaucaacaccuucguggagacccccgugcagaagcuggaccugcugggcaaccugcccggcagcaagagacagccccagacccccaaggagaaggccgaggcccuggaggaccuggugggcuucaaggagcuguuccagacccccggccacaccgaggagagcaugaccgacgacaagaucaccgaggugagcugcaagagcccccagcccgagagcuucaagaccagcagaagcagcaagcagagacugaagaucccccuggugaagguggacaugaaggaggagccccuggccgugagcaagcugaccagaaccagcggcgagaccacccagacccacaccgagcccaccggcgacagcaagagcaucaaggccuucaaggagagccccaagcagauccuggaccccgccgccagcgugaccggcagcagaagacagcugagaaccagaaaggagaaggccagagcccuggaggaccugguggacuucaaggagcuguucagcgcccccggccacaccgaggagagcaugaccaucgacaagaacaccaagauccccugcaagagccccccccccgagcugaccgacaccgccaccagcaccaagagaugccccaagaccagacccagaaaggaggugaaggaggagcugagcgccguggagagacugacccagaccagcggccagagcacccacacccacaaggagcccgccagcggcgacgagggcaucaaggugcugaagcagagagccaagaagaagcccaaccccguggaggaggagcccagcagaagaagacccagagcccccaaggagaaggcccagccccuggaggaccuggccggcuucaccgagcugagcgagaccagcggccacacccaggagagccugaccgccggcaaggccaccaagauccccugcgagagccccccccuggaggugguggacaccaccgccagcaccaagagacaccugagaaccagagugcagaaggugcaggugaaggaggagcccagcgccgugaaguucacccagaccagcggcgagaccaccgacgccgacaaggagcccgccggcgaggacaagggcaucaaggcccugaaggagagcgccaagcagacccccgcccccgccgccagcgugaccggcagcagaagaagacccagagcccccagagagagcgcccaggccaucgaggaccuggccggcuucaaggaccccgccgccggccacaccgaggagagcaugaccgacgacaagaccaccaagauccccugcaagagcagccccgagcuggaggacaccgccaccagcagcaagagaagacccagaaccagagcccagaagguggaggugaaggaggagcugcuggccgugggcaagcugacccagaccagcggcgagaccacccacaccgacaaggagcccgugggcgagggcaagggcaccaaggccuucaagcagcccgccaagagaaagcuggacgccgaggacgugaucggcagcagaagacagcccagagcccccaaggagaaggcccagccccuggaggaccuggccagcuuccaggagcugagccagacccccggccacaccgaggagcuggccaacggcgccgccgacagcuucaccagcgcccccaagcagacccccgacagcggcaagccccugaagaucagcagaagagugcugagagcccccaagguggagcccgugggcgacguggugagcaccagagaccccgugaagagccagagcaagagcaacaccagccugcccccccugcccuucaagagaggcggcggcaaggacggcagcgugaccggcaccaagagacugagaugcaugcccgcccccgaggagaucguggaggagcugcccgccagcaagaagcagagaguggcccccagagccagaggcaagagcagcgagcccguggugaucaugaagagaagccugagaaccagcgccaagagaaucgagcccgccgaggagcugaacagcaacgacaugaagaccaacaaggaggagcacaagcugcaggacagcgugcccgagaacaagggcaucagccugagaagcagaagacagaacaagaccgaggccgagcagcagaucaccgagguguucgugcuggccgagagaaucgagaucaacagaaacgagaagaagcccaugaagaccagccccgagauggacauccagaaccccgacgacggcgccagaaagcccauccccagagacaaggugaccgagaacaagagaugccugagaagcgccagacagaacgagagcagccagcccaagguggccgaggagagcggcggccagaagagcgccaaggugcugaugcagaaccagaagggcaagggcgaggccggcaacagcgacagcaugugccugagaagcagaaagaccaagagccagcccgccgccagcacccuggagagcaagagcgugcagagagugaccagaagcgugaagagaugcgccgagaaccccaagaaggccgaggacaacgugugcgugaagaagaucagaaccagaagccacagagacagcgaggacaucuaa

SEQ ID NO: 19888 - RNA, 1713 nt, Artificial Sequence
  MKKS__Homo_sapiens__NP_061336
augagcagacuggaggccaagaagcccagccugugcaagagcgagccccugaccaccgagagagugagaaccacccugagcgugcugaagagaaucgugaccagcugcuacggccccagcggcagacugaagcagcugcacaacggcuucggcggcuacgugugcaccaccagccagagcagcgcccugcugagccaccugcuggugacccaccccauccugaagauccugaccgccagcauccagaaccacgugagcagcuucagcgacugcggccuguucaccgccauccugugcugcaaccugaucgagaacgugcagagacugggccugacccccaccaccgugaucagacugaacaagcaccugcugagccugugcaucagcuaccugaagagcgagaccugcggcugcagaauccccguggacuucagcagcacccagauccugcugugccuggugagaagcauccugaccagcaagcccgccugcaugcugaccagaaaggagaccgagcacgugagcgcccugauccugagagccuuccugcugaccauccccgagaacgccgagggccacaucauccugggcaagagccugaucgugccccugaagggccagagagugaucgacagcaccgugcugcccggcauccugaucgagaugagcgaggugcagcugaugagacugcugcccaucaagaagagcaccgcccugaagguggcccuguucugcaccacccugagcggcgacaccagcgacaccggcgagggcaccgugguggugagcuacggcgugagccuggagaacgccgugcuggaccagcugcugaaccugggcagacagcugaucagcgaccacguggaccuggugcugugccagaaggugauccaccccagccugaagcaguuccugaacaugcacagaaucaucgccaucgacagaaucggcgugacccugauggagccccugaccaagaugaccggcacccagcccaucggcagccugggcagcaucugccccaacagcuacggcagcgugaaggacgugugcaccgccaaguucggcagcaagcacuucuuccaccugauccccaacgaggccaccaucugcagccugcugcugugcaacagaaacgacaccgccugggacgagcugaagcugaccugccagaccgcccugcacgugcugcagcugacccugaaggagcccugggcccugcugggcggcggcugcaccgagacccaccuggccgccuacaucagacacaagacccacaacgaccccgagagcauccugaaggacgacgagugcacccagaccgagcugcagcugaucgccgaggccuucugcagcgcccuggagagcguggugggcagccuggagcacgacggcggcgagauccugaccgacaugaaguacggccaccuguggagcgugcaggccgacagccccugcguggccaacuggcccgaccugcugagccagugcggcugcggccuguacaacagccaggaggagcugaacuggagcuuccugagaagcaccagaagacccuucgugccccagagcugccugccccacgaggccgugggcagcgccagcaaccugacccuggacugccugaccgccaagcugagcggccugcagguggccguggagaccgccaaccugauccuggaccugagcuacgugaucgaggacaagaacuaa

SEQ ID NO: 19889 - RNA, 2796 nt, Artificial Sequence
  MKL1__Homo_sapiens__NP_001269589
augcccccccugaagagccccgccgccuuccacgagcagagaagaagccuggagagagccagaaccgaggacuaccugaagagaaagaucagaagcagacccgagagaagcgagcuggugagaaugcacauccuggaggagaccagcgccgagcccagccugcaggccaagcagcugaagcugaagagagccagacuggccgacgaccugaacgagaagaucgcccagagacccggccccauggagcugguggagaagaacauccugcccguggagagcagccugaaggaggccaucaucgugggccaggugaacuaccccaagguggccgacagcagcagcuucgacgaggacagcagcgacgcccugagccccgagcagcccgccagccacgagagccagggcagcgugcccagcccccuggaggccagagugagcgagccccugcugagcgccaccagcgccagccccacccagguggugagccagcugcccaugggcagagacagcagagagaugcuguuccuggccgagcagcccccccugcccccccccccccugcugccccccagccugaccaacggcaccaccauccccaccgccaagagcacccccacccugaucaagcagagccagcccaagagcgccagcgagaagagccagagaagcaagaaggccaaggagcugaagcccaaggugaagaagcugaaguaccaccaguacaucccccccgaccagaagcaggacagaggcgccccccccauggacagcagcuacgccaagauccugcagcagcagcagcuguuccugcagcugcagauccugaaccagcagcagcagcagcaccacaacuaccaggccauccugcccgccccccccaagagcgccggcgaggcccugggcagcagcggcaccccccccgugagaagccugagcaccaccaacagcagcagcagcagcggcgcccccggccccugcggccuggccagacagaacagcaccagccugaccggcaagcccggcgcccugcccgccaaccuggacgacaugaagguggccgagcugaagcaggagcugaagcugagaagccugcccgugagcggcaccaagaccgagcugaucgagagacugagagccuaccaggaccagaucagccccgugcccggcgcccccaaggcccccgccgccaccagcauccugcacaaggccggcgagguggugguggccuuccccgccgccagacugagcaccggccccgcccugguggccgccggccuggcccccgccgagguggugguggccaccguggccagcagcggcguggugaaguucggcagcaccggcagcaccccccccgugagccccacccccagcgagagaagccugcugagcaccggcgacgagaacagcacccccggcgacaccuucggcgagauggugaccagcccccugacccagcugacccugcaggccagcccccugcagauccuggugaaggaggagggccccagagccggcagcugcugccugagccccggcggcagagccgagcuggagggcagagacaaggaccagaugcugcaggagaaggacaagcagaucgaggcccugaccagaaugcugagacagaagcagcagcugguggagagacugaagcugcagcuggagcaggagaagagagcccagcagcccgcccccgcccccgccccccugggcacccccgugaagcaggagaacagcuucagcagcugccagcugagccagcagccccugggccccgcccaccccuucaaccccagccuggccgcccccgccaccaaccacaucgaccccugcgccguggcccccggcccccccagcgugguggugaagcaggaggcccugcagcccgagcccgagcccgugcccgccccccagcugcugcugggcccccagggccccagccugaucaagggcguggccccccccacccugaucaccgacagcaccggcacccaccuggugcugaccgugaccaacaagaacgccgacagccccggccugagcagcggcagcccccagcagcccagcagccagcccggcagccccgcccccgcccccagcgcccagauggaccuggagcacccccugcagccccuguucggcacccccaccagccugcugaagaaggagccccccggcuacgaggaggccaugagccagcagcccaagcagcaggagaacggcagcagcagccagcagauggacgaccuguucgacauccugauccagagcggcgagaucagcgccgacuucaaggagccccccagccugcccggcaaggagaagcccagccccaagaccgugugcggcagcccccuggccgcccagcccagccccagcgccgagcugccccaggccgccccccccccccccggcagccccagccugcccggcagacuggaggacuuccuggagagcagcaccggccugccccugcugaccagcggccacgacggccccgagccccugagccugaucgacgaccugcacagccagaugcugagcagcaccgccauccuggaccacccccccagccccauggacaccagcgagcugcacuucgugcccgagcccagcagcaccaugggccuggaccuggccgacggccaccuggacagcauggacuggcuggagcugagcagcggcggccccgugcugagccuggccccccugagcaccaccgcccccagccuguucagcaccgacuuccuggacggccacgaccugcagcugcacugggacagcugccuguaa

SEQ ID NO: 19890 - RNA, 3150 nt, Artificial Sequence
  MKL2__Homo_sapiens__NP_054767
auggaccacaccggcgccaucgacaccgaggacgaggugggcccccuggcccaccuggcccccagcccccagagcgaggccguggcccacgaguuccaggagcugagccugcagagcagccagaaccugcccccccugaacgagagaaagaacgugcugcagcugagacugcagcagagaagaaccagagagcagcugguggaccagggcaucaugcccccccugaagagccccgccgccuuccacgagcagaucaagagccuggagagagccagaaccgagaacuuccugaagcacaagaucagaagcagacccgacagaagcgagcuggugagaaugcacauccuggaggagaccuucgccgagcccagccugcaggccacccagaugaagcugaagagagccagacuggccgacgaccugaacgagaagaucgcccagagacccggccccauggagcugguggagaagaacauccugcccguggacagcagcgugaaggaggccaucaucggcgugggcaaggaggacuacccccacacccagggcgacuucagcuucgacgaggacagcagcgacgcccugagccccgaccagcccgccagccaggagagccagggcagcgccgccagccccagcgagcccaaggugagcgagagccccagccccgugaccaccaacacccccgcccaguucgccagcgugagccccaccgugcccgaguuccugaagaccccccccaccgccgaccagcccccccccagacccgccgcccccgugcugcccaccaacaccgugagcagcgccaagcccggccccgcccuggugaagcagagccaccccaagaaccccaacgacaagcacagaagcaagaagugcaaggaccccaagcccagagugaagaagcugaaguaccaccaguacaucccccccgaccagaagggcgagaagaacgagccccagauggacagcaacuacgccagacugcugcagcagcagcagcuguuccugcagcugcagauccugagccagcagaagcagcacuacaacuaccagaccauccugcccgcccccuucaagccccugaacgacaagaacagcaacagcggcaacagcgcccugaacaacgccacccccaacacccccagacagaacaccagcacccccgugagaaagcccggcccccugcccagcagccuggacgaccugaaggugagcgagcugaagaccgagcugaagcugagaggccugcccgugagcggcaccaagcccgaccugaucgagagacugaagcccuaccaggaggugaacagcagcggccuggccgccggcggcaucguggccgugagcagcagcgccaucgugaccagcaaccccgaggugaccguggcccugcccgugaccacccugcacaacaccgugaccagcagcgugagcacccugaaggccgagcugccccccaccggcaccagcaacgccaccagaguggagaacgugcacagcccccugcccaucagccccagccccagcgagcagagcagccugagcaccgacgacaccaacauggccgacaccuucaccgagaucaugaccaugaugagccccagccaguuccugagcagcagcccccugagaaugaccaacaacgaggacagccugagccccaccagcagcacccugagcaaccuggagcuggacgccgccgagaaggacagaaagcugcaggagaaggagaagcagaucgaggagcugaagagaaagcuggagcaggagcagaagcugguggaggugcugaagaugcagcuggagguggagaagagaggccagcagcagagaccccuggaggcccagcccagcgcccccggccacagcgugaagagcgaccagaagcacggcagccugggcagcagcaucaaggacgaggccagccugcccgacugcagcagcagcagacagcccauccccguggccagccacgccgugggccagcccgugagcaccggcggccagacccugguggccaagaaggccguggugaucaagcaggaggugcccgugggccaggccgagcagcagagcguggugagccaguucuacaccagcccccaggccggcaugcagacccagccccagaucgccaccgccgcccagauccccaccgccgcccuggccagcggccuggcccccaccgugccccagacccaggacaccuucccccagcacgugcugagccagccccagcaggugagaaagguguucaccaacagcgccagcagcaacaccgugcugcccuaccagagacaccccgcccccgccgugcagcagcccuucaucaacaaggccagcaacagcgugcugcagagcagaaacgccccccugcccagccugcagaacggccccaacacccccaacaagcccagcagccccccccccccccagcaguucguggugcagcacagccuguucggcagccccguggccaagaccaaggacccccccagauacgaggaggccaucaagcagaccagaagcacccaggccccccugcccgagaucagcaacgcccacagccagcagauggacgaccuguucgacauccugaucaagagcggcgagaucagccugcccaucaaggaggagcccagccccaucagcaagaugagacccgugaccgccagcaucaccaccaugcccgugaacaccguggugagcagaccccccccccaggugcagauggccccccccgugagccuggagcccaugggcagccugagcgccagccuggagaaccagcuggaggccuuccuggacggcacccugcccagcgccaacgagauccccccccugcagagcagcagcgaggacagagagcccuucagccugaucgaggaccugcagaacgaccugcugagccacagcggcaugcuggaccacagccacagccccauggagaccagcgagacccaguucgccgccggcacccccugccugagccuggaccugagcgacagcaaccuggacaacauggaguggcuggacaucaccaugcccaacagcagcagcggccugaccccccugagcaccaccgcccccagcauguucagcgccgacuuccuggacccccaggaccugccccugcccugggacuaa

SEQ ID NO: 19891 - RNA, 2208 nt, Artificial Sequence
  MKLN1__Homo_sapiens__NP_037387
auggccgccggcggcgccguggccgccgcccccgagugcagacugcugcccuacgcccugcacaaguggagcagcuucagcagcaccuaccugcccgagaacauccugguggacaagcccaacgaccagagcagcagauggagcagcgagagcaacuaccccccccaguaccugauccugaagcuggagagacccgccaucgugcagaacaucaccuucggcaaguacgagaagacccacgugugcaaccugaagaaguucaagguguucggcggcaugaacgaggagaacaugaccgagcugcugagcagcggccugaagaacgacuacaacaaggagaccuucacccugaagcacaagaucgacgagcagauguuccccugcagauucaucaagaucgugccccugcugagcuggggccccagcuucaacuucagcaucugguacguggagcugagcggcaucgacgaccccgacaucgugcagcccugccugaacugguacagcaaguacagagagcaggaggccaucagacugugccugaagcacuucagacagcacaacuacaccgaggccuucgagagccugcagaagaagaccaagaucgcccuggagcaccccaugcugaccgacauccacgacaagcuggugcugaagggcgacuucgacgccugcgaggagcugaucgagaaggccgugaacgacggccuguucaaccaguacaucagccagcaggaguacaagcccagauggagccagaucauccccaagagcaccaagggcgacggcgaggacaacagacccggcaugagaggcggccaccagauggugaucgacgugcagaccgagaccguguaccuguucggcggcugggacggcacccaggaccuggccgacuucugggccuacagcgugaaggagaaccaguggaccugcaucagcagagacaccgagaaggagaacggccccagcgccagaagcugccacaagaugugcaucgacauccagagaagacagaucuacacccugggcagauaccuggacagcagcgugagaaacagcaagagccugaagagcgacuucuacagauacgacaucgacaccaacaccuggaugcugcugagcgaggacaccgccgccgacggcggccccaagcugguguucgaccaccagaugugcauggacagcgagaagcacaugaucuacaccuucggcggcagaauccugaccugcaacggcagcguggacgacagcagagccagcgagccccaguucagcggccuguucgccuucaacugccagugccagaccuggaagcugcugagagaggacagcugcaacgccggccccgaggacauccagagcagaaucggccacugcaugcuguuccacagcaagaacagaugccuguacguguucggcggccagagaagcaagaccuaccugaacgacuucuucagcuacgacguggacagcgaccacguggacaucaucagcgacggcaccaagaaggacagcggcauggugcccaugaccggcuucacccagagagccaccaucgaccccgagcugaacgagauccacgugcugagcggccugagcaaggacaaggagaagagagaggagaacgugagaaacagcuucuggaucuacgacaucgugagaaacagcuggagcugcguguacaagaacgaccaggccgccaaggacaaccccaccaagagccugcaggaggaggagcccugccccagauucgcccaccagcugguguacgacgagcugcacaaggugcacuaccuguucggcggcaaccccggcaagagcugcagccccaagaugagacuggacgacuucuggagccugaagcugugcagacccagcaaggacuaccugcugagacacugcaaguaccugaucagaaagcacagauucgaggagaaggcccagguggacccccugagcgcccugaaguaccugcagaacgaccuguacaucaccguggaccacagcgaccccgaggagaccaaggaguuccagcugcuggccagcgcccuguucaagagcggcagcgacuucaccgcccugggcuucagcgacguggaccacaccuacgcccagagaacccagcuguucgacacccuggugaacuucuuccccgacagcaugaccccccccaagggcaaccugguggaccugaucacccuguaa

SEQ ID NO: 19892 - RNA, 990 nt, Artificial Sequence
  MKNK1__Homo_sapiens__XP_011540651
auggccaagagcaugcccagcaagagcagcagaaacaagcagggcaccgugggcgugggcugcuucgagagauggagaagaugcaucagcgugagagagaccagcagcauccuggcccacauccagaagcagaagcacuucaacgagagagaggccagcagaguggugagagacguggccgccgcccuggacuuccugcacaccaagggcaucgcccacagagaccugaagcccgagaacauccugugcgagagccccgagaaggugagccccgugaagaucugcgacuucgaccugggcagcggcaugaagcugaacaacagcugcacccccaucaccacccccgagcugaccacccccugcggcagcgccgaguacauggcccccgaggugguggagguguucaccgaccaggccaccuucuacgacaagagaugcgaccuguggagccugggcguggugcuguacaucaugcugagcggcuacccccccuucgugggccacugcggcgccgacugcggcugggacagaggcgaggugugcagagugugccagaacaagcuguucgagagcauccaggagggcaaguacgaguuccccgacaaggacugggcccacaucagcagcgaggccaaggaccugaucagcaagcugcuggugagagacgccaagcagagacugagcgccgcccaggugcugcagcaccccugggugcagggccaggcccccgagaagggccugcccaccccccaggugcugcagagaaacagcagcaccauggaccugacccuguucgccgccgaggccaucgcccugaacagacagcugagccagcacgaggagaacgagcuggccgaggagcccgaggcccuggccgacggccugugcagcaugaagcugagcccccccugcaagagcagacuggccagaagaagagcccuggcccaggccggcagaggcgaggacagaagcccccccaccgcccuguaa

SEQ ID NO: 19893 - RNA, 1245 nt, Artificial Sequence
  MKNK2__Homo_sapiens__NP_060042
auggugcagaagaagcccgccgagcugcagggcuuccacagaagcuucaagggccagaaccccuucgagcuggccuucagccuggaccagcccgaccacggcgacagcgacuucggccugcagugcagcgccagacccgacaugcccgccagccagcccaucgacauccccgacgccaagaagagaggcaagaagaagaagagaggcagagccaccgacagcuucagcggcagauucgaggacguguaccagcugcaggaggacgugcugggcgagggcgcccacgccagagugcagaccugcaucaaccugaucaccagccaggaguacgccgugaagaucaucgagaagcagcccggccacaucagaagcagaguguucagagagguggagaugcuguaccagugccagggccacagaaacgugcuggagcugaucgaguucuucgaggaggaggacagauucuaccugguguucgagaagaugagaggcggcagcauccugagccacauccacaagagaagacacuucaacgagcuggaggccagcgugguggugcaggacguggccagcgcccuggacuuccugcacaacaagggcaucgcccacagagaccugaagcccgagaacauccugugcgagcaccccaaccaggugagccccgugaagaucugcgacuucgaccugggcagcggcaucaagcugaacggcgacugcagccccaucagcacccccgagcugcugacccccugcggcagcgccgaguacauggcccccgaggugguggaggccuucagcgaggaggccagcaucuacgacaagagaugcgaccuguggagccugggcgugauccuguacauccugcugagcggcuacccccccuucgugggcagaugcggcagcgacugcggcugggacagaggcgaggccugccccgccugccagaacaugcuguucgagagcauccaggagggcaaguacgaguuccccgacaaggacugggcccacaucagcugcgccgccaaggaccugaucagcaagcugcuggugagagacgccaagcagagacugagcgccgcccaggugcugcagcaccccugggugcagggcugcgcccccgagaacacccugcccacccccauggugcugcagagaugggacagccacuuccugcugcccccccaccccugcagaauccacgugagacccggcggccuggugagaaccgugaccgugaacgaguaa

SEQ ID NO: 19894 - RNA, 990 nt, Artificial Sequence
  MKRN1__Homo_sapiens__NP_001138597
auggccgaggccgccacccccggcaccaccgccaccaccagcggcgccggcgccgccgccgccaccgccgccgccgccagccccacccccauccccaccgugaccgcccccagccugggcgccggcggcggcggcggcggcagcgacggcagcggcggcggcuggaccaagcaggugaccugcagauacuucaugcacggcgugugcaaggagggcgacaacugcagauacagccacgaccugagcgacagccccuacagcguggugugcaaguacuuccagagaggcuacugcaucuacggcgacagaugcagauacgagcacagcaagccccugaagcaggaggaggccaccgccaccgagcugaccaccaagagcagccuggccgccagcagcagccugagcagcaucgugggcccccugguggagaugaacaccggcgaggccgagagcagaaacagcaacuucgccaccgugggcgccggcagcgaggacugggugaacgccaucgaguucgugcccggccagcccuacugcggcagaaccgcccccagcugcaccgaggccccccugcagggcagcgugaccaaggaggagagcgagaaggagcagaccgccguggagaccaagaagcagcugugccccuacgccgccgugggcgagugcagauacggcgagaacugcguguaccugcacggcgacagcugcgacaugugcggccugcaggugcugcaccccauggacgccgcccagagaagccagcacaucaagagcugcaucgaggcccacgagaaggacauggagcugagcuucgccgugcagagaagcaaggacauggugugcggcaucugcauggaggugguguacgagaaggccaaccccagcgagagaagauucggcauccugagcaacugcaaccacaccuacugccugaagugcaucagaaaguggagaagcgccaagcaguucgagagcaagaucaucaaguaa

SEQ ID NO: 19895 - RNA, 1524 nt, Artificial Sequence
  MKRN3__Homo_sapiens__NP_005655
auggaggagcccgccgcccccagcgaggcccacgaggccgccggcgcccaggccggcgccgaggccgccagagagggcgugagcggccccgaccugcccgugugcgagcccagcggcgagagcgccgcccccgacagcgcccugccccacgccgccagaggcugggcccccuuccccguggcccccgugcccgcccaccugagaagaggcggccugagacccgcccccgccagcggcggcggcgccuggcccagcccccugcccagcagaagcagcggcaucuggaccaagcagaucaucugcagauacuacauccacggccagugcaaggagggcgagaacugcagauacagccacgaccugagcggcagaaagauggccaccgagggcggcgugagcccccccggcgccagcgccggcggcggccccagcaccgccgcccacaucgagccccccacccaggagguggccgaggccccccccgccgccagcagccugagccugcccgugaucggcagcgccgccgagagaggcuucuucgaggccgagagagacaacgccgacagaggcgccgccggcggcgccggcguggagagcugggccgacgccaucgaguucgugcccggccagcccuacagaggcagauggguggccagcgcccccgaggccccccugcagagcagcgagaccgagagaaagcagauggccgugggcagcggccugagauucugcuacuacgccagcagaggcgugugcuucagaggcgagagcugcauguaccugcacggcgacaucugcgacaugugcggccugcagacccugcaccccauggacgccgcccagagagaggagcacaugagagccugcaucgaggcccacgagaaggacauggagcugagcuucgccgugcagagaggcauggacaaggugugcggcaucugcauggaggugguguacgagaaggccaaccccaacgacagaagauucggcauccugagcaacugcaaccacagcuucugcaucagaugcaucagaagauggagaagcgccagacaguucgagaacagaaucgugaagagcugcccccagugcagagugaccagcgagcuggugauccccagcgaguucuggguggaggaggaggaggagaagcagaagcugauccagcaguacaaggaggccaugagcaacaaggccugcagauacuucgccgagggcagaggcaacugccccuucggcgacaccugcuucuacaagcacgaguaccccgagggcuggggcgacgagccccccggccccggcggcggcagcuucagcgccuacuggcaccagcugguggagcccgugagaaugggcgagggcaacaugcuguacaagagcaucaagaaggagcugguggugcugagacuggccagccugcuguucaagagauuccugagccugagagacgagcugcccuucagcgaggaccagugggaccugcugcacuacgagcuggaggaguacuucaaccugauccuguaa

SEQ ID NO: 19896 - RNA, 1650 nt, Artificial Sequence
  MKS1__Homo_sapiens__NP_001159399
auggccgugcccgugagcagcuucgcccagagaaccagaagcagauucagagugcaccugcagagaaucaccagcagcaacuuccugcacuaccagcccgccgccgagcugggcaaggaccugaucgaccuggccaccuucagaccccagcccaccgccagcggccacagacccgaggaggacgaggaggaggagaucgugaucggcuggcaggagaagcuguucagccaguucgagguggaccuguaccagaacgagaccgccugccagagcccccuggacuaccaguacagacaggagauccugaagcuggagaacagcggcggcaagaagaacagaagaaucuucaccuacaccgacagcgacagauacaccaaccuggaggagcacugccagagaaugaccaccgccgccagcgaggugcccagcuuccugguggagagaauggccaacgugagaagaagaagacaggacagaagaggcauggagggcggcauccugaagagcagaaucgugaccugggagcccagcgaggaguucgugagaaacaaccacgugaucaacaccccccugcagaccaugcacaucauggccgaccugggccccuacaagaagcugggcuacaagaaguacgagcacgugcugugcacccugaagguggacagcaacggcgugaucaccgugaagcccgacuucaccggccugaagggccccuacagaaucgagaccgagggcgagaagcaggagcuguggaaguacaccaucgacaacgugagcccccacgcccagcccgaggaggaggagagagagagaagaguguucaaggaccuguacggcagacacaaggaguaccugagcagccuggugggcaccgacuucgagaugaccgugcccggcgcccugagacuguucgugaacggcgagguggugagcgcccagggcuacgaguacgacaaccuguacgugcacuucuucguggagcugcccaccgcccacuggagcagccccgccuuccagcagcugagcggcgugacccagaccugcaccaccaagagccuggccauggacaagguggcccacuucagcuaccccuucaccuucgaggccuucuuccugcacgaggacgagagcagcgacgcccugcccgaguggcccgugcuguacugcgaggugcugagccuggacuucuggcagagauacagaguggagggcuacggcgccguggugcugcccgccacccccggcagccacacccugaccgugagcaccuggagacccguggagcugggcaccguggccgagcugagaagauucuucaucggcggcagccuggagcuggaggaccugagcuacgugagaauccccggcagcuucaagggcgagagacugagcagauucggccugagaaccgagaccaccggcaccgugaccuucagacugcacugccugcagcagagcagagccuucauggagagcagcagccugcagaagagaaugagaagcgugcuggacagacuggagggcuucagccagcagagcagcauccacaacgugcuggaggccuucagaagagccagaagaagaaugcaggaggccagagagagccugccccaggaccuggugagccccagcggcacccuggugagcuaa

SEQ ID NO: 19897 - RNA, 357 nt, Artificial Sequence
  MLANA__Homo_sapiens__NP_005502
augcccagagaggacgcccacuucaucuacggcuaccccaagaagggccacggccacagcuacaccaccgccgaggaggccgccggcaucggcauccugaccgugauccugggcgugcugcugcugaucggcugcugguacugcagaagaagaaacggcuacagagcccugauggacaagagccugcacgugggcacccagugcgcccugaccagaagaugcccccaggagggcuucgaccacagagacagcaaggugagccugcaggagaagaacugcgagcccguggugcccaacgccccccccgccuacgagaagcugagcgccgagcagagccccccccccuacagccccuaa

SEQ ID NO: 19898 - RNA, 1134 nt, Artificial Sequence
  MLC1__Homo_sapiens__NP_631941
augacccaggagcccuucagagaggagcuggccuacgacagaaugcccacccuggagagaggcagacaggaccccgccagcuacgcccccgacgccaagcccagcgaccugcagcugagcaagagacugccccccugcuucagccacaagaccuggguguucagcgugcugaugggcagcugccugcuggugaccagcggcuucagccuguaccugggcaacguguuccccgccgagauggacuaccugagaugcgccgccggcagcugcauccccagcgccaucgugagcuucaccgugagcagaagaaacgccaacgugauccccaacuuccagauccuguucgugagcaccuucgccgugaccaccaccugccugaucugguucggcugcaagcuggugcugaaccccagcgccaucaacaucaacuucaaccugauccugcugcugcugcuggagcugcugauggccgccaccgugaucaucgccgccagaagcagcgaggaggacugcaagaagaagaagggcagcaugagcgacagcgccaacauccuggacgaggugcccuuccccgccagagugcugaagagcuacagcgugguggaggugaucgccggcaucagcgccgugcugggcggcaucaucgcccugaacguggacgacagcgugagcggcccccaccugagcgugaccuucuucuggauccugguggccugcuuccccagcgccaucgccagccacguggccgccgagugccccagcaagugccugguggaggugcugaucgccaucagcagccugaccagcccccugcuguucaccgccagcggcuaccugagcuucagcaucaugagaaucguggagauguucaaggacuacccccccgccaucaagcccagcuacgacgugcugcugcugcugcugcugcuggugcugcugcugcaggccggccugaacaccggcaccgccauccagugcgugagauucaaggugagcgccagacugcagggcgccagcugggacacccagaacggcccccaggagagacuggccggcgagguggccagaagcccccugaaggaguucgacaaggagaaggccuggagagccgugguggugcagauggcccaguaa

SEQ ID NO: 19899 - RNA, 879 nt, Artificial Sequence
  MLEC__Homo_sapiens__NP_055545
augcugggcgccugggccguggagggcaccgccguggcccugcugagacugcugcugcugcugcugccccccgccaucagaggccccggccugggcguggccggcguggccggcgccgccggcgccggccugcccgagagcgugaucugggccgugaacgccggcggcgaggcccacguggacgugcacggcauccacuucagaaaggacccccuggagggcagagugggcagagccagcgacuacggcaugaagcugcccauccugagaagcaaccccgaggaccagauccuguaccagaccgagagauacaacgaggagaccuucggcuacgaggugcccaucaaggaggagggcgacuacgugcuggugcugaaguucgccgagguguacuucgcccagagccagcagaagguguucgacgugagacugaacggccacgugguggugaaggaccuggacaucuucgacagagugggccacagcaccgcccacgacgagaucauccccaugagcaucagaaagggcaagcugagcgugcagggcgaggugagcaccuucaccggcaagcuguacaucgaguucgugaagggcuacuacgacaaccccaaggugugcgcccuguacaucauggccggcaccguggacgacgugcccaagcugcagccccaccccggccuggagaagaaggaggaggaggaggaggaggaggaguacgacgagggcagcaaccugaagaagcagaccaacaagaacagagugcagagcggccccagaacccccaaccccuacgccagcgacaacagcagccugauguuccccauccugguggccuucggcguguucauccccacccuguucugccugugcagacuguaa

SEQ ID NO: 19900 - RNA, 732 nt, Artificial Sequence
  MLF1__Homo_sapiens__NP_001123629
augagacagaugaucagaagcuucagcgagcccuucggcagagaccugcugagcaucagcgacggcagaggcagagcccacaacagaagaggccacaacgacggcgaggacagccugacccacaccgacgugagcagcuuccagaccauggaccagauggugagcaacaugagaaacuacaugcagaagcuggagagaaacuucggccagcugagcguggaccccaacggccacagcuucugcagcagcagcgugaugaccuacagcaagaucggcgacgagccccccaagguguuccaggccagcacccagaccagaagagcccccggcggcaucaaggagaccagaaaggccaugagagacagcgacagcggccuggagaagauggccaucggccaccacauccacgacagagcccacgugaucaagaagagcaagaacaagaagaccggcgacgaggaggugaaccaggaguucaucaacaugaacgagagcgacgcccacgccuucgacgaggaguggcagagcgaggugcugaaguacaagcccggcagacacaaccugggcaacaccagaaugagaagcgugggccacgagaaccccggcagcagagagcugaagagaagagagaagccccagcagagccccgccaucgagcacggcagaagaagcaacgugcugggcgacaagcugcacaucaagggcagcagcgugaagagcaacaagaaguaa

SEQ ID NO: 19901 - RNA, 747 nt, Artificial Sequence
  MLF2__Homo_sapiens__NP_005430
auguucagauucaugagagacguggagcccgaggaccccauguuccugauggaccccuucgccauccacagacagcacaugagcagaaugcugagcggcggcuucggcuacagccccuuccugagcaucaccgacggcaacaugcccggcaccagacccgccagcagaagaaugcagcaggccggcgccgugagccccuucggcaugcugggcaugagcggcggcuucauggacauguucggcaugaugaacgacaugaucggcaacauggagcacaugaccgccggcggcaacugccagaccuucagcagcagcaccgugaucagcuacagcaacaccggcgacggcgcccccaagguguaccaggagaccagcgagaugagaagcgcccccggcggcaucagagagaccagaagaaccgugagagacagcgacagcggccuggagcagaugagcaucggccaccacaucagagacagagcccacauccugcagagaagcagaaaccacagaaccggcgaccaggaggagagacaggacuacaucaaccuggacgagagcgaggccgccgccuucgacgacgaguggagaagagagaccagcagauucagacagcagagaccccuggaguucagaagacuggagagcagcggcgccggcggcagaagagccgagggcccccccagacuggccauccagggccccgaggacagccccagcagacagagcagaagauacgacugguaa

SEQ ID NO: 19902 - RNA, 2271 nt, Artificial Sequence
  MLH1__Homo_sapiens__NP_000240
augagcuucguggccggcgugaucagaagacuggacgagaccguggugaacagaaucgccgccggcgaggugauccagagacccgccaacgccaucaaggagaugaucgagaacugccuggacgccaagagcaccagcauccaggugaucgugaaggagggcggccugaagcugauccagauccaggacaacggcaccggcaucagaaaggaggaccuggacaucgugugcgagagauucaccaccagcaagcugcagagcuucgaggaccuggccagcaucagcaccuacggcuucagaggcgaggcccuggccagcaucagccacguggcccacgugaccaucaccaccaagaccgccgacggcaagugcgccuacagagccagcuacagcgacggcaagcugaaggccccccccaagcccugcgccggcaaccagggcacccagaucaccguggaggaccuguucuacaacaucgccaccagaagaaaggcccugaagaaccccagcgaggaguacggcaagauccuggagguggugggcagauacagcgugcacaacgccggcaucagcuucagcgugaagaagcagggcgagaccguggccgacgugagaacccugcccaacgccagcaccguggacaacaucagaagcaucuucggcaacgccgugagcagagagcugaucgagaucggcugcgaggacaagacccuggccuucaagaugaacggcuacaucagcaacgccaacuacagcgugaagaagugcaucuuccugcuguucaucaaccacagacugguggagagcaccagccugagaaaggccaucgagaccguguacgccgccuaccugcccaagaacacccaccccuuccuguaccugagccuggagaucagcccccagaacguggacgugaacgugcaccccaccaagcacgaggugcacuuccugcacgaggagagcauccuggagagagugcagcagcacaucgagagcaagcugcugggcagcaacagcagcagaauguacuucacccagacccugcugcccggccuggccggccccagcggcgagauggugaagagcaccaccagccugaccagcagcagcaccagcggcagcagcgacaagguguacgcccaccagauggugagaaccgacagcagagagcagaagcuggacgccuuccugcagccccugagcaagccccugagcagccagccccaggccaucgugaccgaggacaagaccgacaucagcagcggcagagccagacagcaggacgaggagaugcuggagcugcccgcccccgccgagguggccgccaagaaccagagccuggagggcgacaccaccaagggcaccagcgagaugagcgagaagagaggccccaccagcagcaaccccagaaagagacacagagaggacagcgacguggagaugguggaggacgacagcagaaaggagaugaccgccgccugcacccccagaagaagaaucaucaaccugaccagcgugcugagccugcaggaggagaucaacgagcagggccacgaggugcugagagagaugcugcacaaccacagcuucgugggcugcgugaacccccagugggcccuggcccagcaccagaccaagcuguaccugcugaacaccaccaagcugagcgaggagcuguucuaccagauccugaucuacgacuucgccaacuucggcgugcugagacugagcgagcccgccccccuguucgaccuggccaugcuggcccuggacagccccgagagcggcuggaccgaggaggacggccccaaggagggccuggccgaguacaucguggaguuccugaagaagaaggccgagaugcuggccgacuacuucagccuggagaucgacgaggagggcaaccugaucggccugccccugcugaucgacaacuacgugcccccccuggagggccugcccaucuucauccugagacuggccaccgaggugaacugggacgaggagaaggagugcuucgagagccugagcaaggagugcgccauguucuacagcaucagaaagcaguacaucagcgaggagagcacccugagcggccagcagagcgaggugcccggcagcauccccaacagcuggaaguggaccguggagcacaucguguacaaggcccugagaagccacauccugccccccaagcacuucaccgaggacggcaacauccugcagcuggccaaccugcccgaccuguacaagguguucgagagaugcuaa

SEQ ID NO: 19903 - RNA, 4290 nt, Artificial Sequence
  MLH3__Homo_sapiens__NP_055196
augaucaagugccugagcguggaggugcaggccaagcugagaagcggccuggccaucagcagccugggccagugcguggaggagcuggcccugaacagcaucgacgccgaggccaagugcguggccgugagagugaacauggagaccuuccaggugcaggugaucgacaacggcuucggcaugggcagcgacgacguggagaaggugggcaacagauacuucaccagcaagugccacagcgugcaggaccuggagaaccccagauucuacggcuucagaggcgaggcccuggccaacaucgccgacauggccagcgccguggagaucagcagcaagaagaacagaaccaugaagaccuucgugaagcuguuccagagcggcaaggcccugaaggccugcgaggccgacgugaccagagccagcgccggcaccaccgugaccguguacaaccuguucuaccagcugcccgugagaagaaagugcauggaccccagacuggaguucgagaaggugagacagagaaucgaggcccugagccugaugcaccccagcaucagcuucagccugagaaacgacgugagcggcagcauggugcugcagcugcccaagaccaaggacgugugcagcagauucugccagaucuacggccugggcaagagccagaagcugagagagaucagcuucaaguacaaggaguucgagcugagcggcuacaucagcagcgaggcccacuacaacaagaacaugcaguuccuguucgugaacaagagacuggugcugagaaccaagcugcacaagcugaucgacuuccugcugagaaaggagagcaucaucugcaagcccaagaacggccccaccagcagacagaugaacagcagccugagacacagaagcacccccgagcuguacggcaucuacgugaucaacgugcagugccaguucugcgaguacgacgugugcauggagcccgccaagacccugaucgaguuccagaacugggacacccugcuguucugcauccaggagggcgugaagauguuccugaagcaggagaagcuguucguggagcugagcggcgaggacaucaaggaguucagcgaggacaacggcuucagccuguucgacgccacccugcagaagagagugaccagcgacgagagaagcaacuuccaggaggccugcaacaacauccuggacagcuacgagauguucaaccugcagagcaaggccgugaagagaaagaccaccgccgagaacgugaacacccagagcagcagagacagcgaggccaccagaaagaacaccaacgacgccuuccuguacaucuacgagagcggcggccccggccacagcaagaugaccgagcccagccugcagaacaaggacagcagcugcagcgagagcaagaugcuggagcaggagaccaucguggccagcgaggccggcgagaacgagaagcacaagaagagcuuccuggagcacagcagccuggagaaccccugcggcaccagccuggagauguuccugagccccuuccagacccccugccacuucgaggagagcggccaggaccuggagaucuggaaggagagcaccaccgugaacggcauggccgccaacauccugaagaacaacagaauccagaaccagcccaagagauucaaggacgccaccgaggugggcugccagccccugcccuucgccaccacccuguggggcgugcacagcgcccagaccgagaaggagaagaagaaggagagcagcaacugcggcagaagaaacguguucagcuacggcagagugaagcugugcagcaccggcuucaucacccacguggugcagaacgagaagaccaagagcaccgagaccgagcacagcuucaagaacuacgugagacccggccccaccagagcccaggagaccuucggcaacagaaccagacacagcguggagacccccgacaucaaggaccuggccagcacccugagcaaggagagcggccagcugcccaacaagaagaacugcagaaccaacaucagcuacggccuggagaacgagcccaccgccaccuacaccauguucagcgccuuccaggagggcagcaagaagagccagaccgacugcauccugagcgacaccagccccagcuuccccugguacagacacgugagcaacgacagcagaaagaccgacaagcugaucggcuucagcaagcccaucgugagaaagaagcugagccugagcagccagcugggcagccuggagaaguucaagagacaguacggcaagguggagaacccccuggacaccgagguggaggagagcaacggcgugaccaccaaccugagccugcagguggagcccgacauccugcugaaggacaagaacagacuggagaacagcgacgugugcaagaucaccaccauggagcacagcgacagcgacagcagcugccagcccgccagccacauccugaacagcgagaaguuccccuucagcaaggacgaggacugccuggagcagcagaugcccagccugagagagagccccaugacccugaaggagcugagccuguucaacagaaagccccuggaccuggagaagagcagcgagagccuggccagcaagcugagcagacugaagggcagcgagagagagacccagaccaugggcaugaugagcagauucaacgagcugcccaacagcgacagcagcagaaaggacagcaagcugugcagcgugcugacccaggacuucugcaugcuguucaacaacaagcacgagaagaccgagaacggcgugauccccaccagcgacagcgccacccaggacaacagcuucaacaagaacagcaagacccacagcaacagcaacaccaccgagaacugcgugaucagcgagaccccccuggugcugcccuacaacaacagcaaggugaccggcaaggacagcgacgugcugaucagagccagcgagcagcagaucggcagccuggacagccccagcggcaugcugaugaaccccguggaggacgccaccggcgaccagaacggcaucugcuuccagagcgaggagagcaaggccagagccugcagcgagaccgaggagagcaacaccugcugcagcgacuggcagagacacuucgacguggcccugggcagaaugguguacgugaacaagaugaccggccugagcaccuucaucgcccccaccgaggacauccaggccgccugcaccaaggaccugaccaccguggccguggacguggugcuggagaacggcagccaguacagaugccagcccuucagaagcgaccuggugcugcccuuccugcccagagccagagccgagagaaccgugaugagacaggacaacagagacaccguggacgacaccgugagcagcgagagccugcagagccuguucagcgagugggacaaccccguguucgccagauaccccgagguggccguggacgugagcagcggccaggccgagagccuggccgugaagauccacaacauccuguaccccuacagauucaccaagggcaugauccacagcaugcaggugcugcagcagguggacaacaaguucaucgccugccugaugagcaccaagaccgaggagaacggcgaggccgacagcuacgagaagcagcaggcccagggcagcggcagaaagaagcugcugagcagcacccugauccccccccuggagaucaccgugaccgaggagcagagaagacugcuguggugcuaccacaagaaccuggaggaccugggccuggaguucguguuccccgacaccagcgacagccuggugcuggugggcaaggugccccugugcuucguggagagagaggccaacgagcugagaagaggcagaagcaccgugaccaagagcaucguggaggaguucaucagagagcagcuggagcugcugcagaccaccggcggcauccagggcacccugccccugaccgugcagaaggugcuggccagccaggccugccacggcgccaucaaguucaacgacggccugagccugcaggagagcugcagacugaucgaggcccugagcagcugccagcugcccuuccagugcgcccacggcagacccagcaugcugccccuggccgacaucgaccaccuggagcaggagaagcagaucaagcccaaccugaccaagcugagaaagauggcccaggccuggagacuguucggcaaggccgagugcgacaccagacagagccugcagcagagcaugccccccugcgagccccccuaa

SEQ ID NO: 19904 - RNA, 792 nt, Artificial Sequence
  MLKL__Homo_sapiens__NP_001135969
auggagaaccugaagcacaucaucacccugggccaggugauccacaagagaugcgaggagaugaaguacugcaagaagcagugcagaagacugggccacagagugcugggccugaucaagccccuggagaugcugcaggaccagggcaagagaagcgugcccagcgagaagcugaccaccgccaugaacagauucaaggccgcccuggaggaggccaacggcgagaucgagaaguucagcaacagaagcaacaucugcagauuccugaccgccagccaggacaagauccuguucaaggacgugaacagaaagcugagcgacguguggaaggagcugagccugcugcugcagguggagcagagaaugcccgugagccccaucagccagggcgccagcugggcccaggaggaccagcaggacgccgacgaggacagaagagccuuccagaugcugagaagagacaacgagaagaucgaggccagccugagaagacuggagaucaacaugaaggagaucaaggagacccugagacagagccuggagagcagcagcggcaagagcccccuggagaucagcagauucaaggugaagaacgugaagaccggcagcgccagcggcugcaacagcgagaagaucagaaagcugguggccgugaagagacagcaggagccccugggcgaggacugccccagcgagcugagagagaucaucgacgagugcagagcccacgaccccagcgugagacccagcguggacgagauccugaagaagcugagcaccuucagcaaguaa

SEQ ID NO: 19905 - RNA, 3207 nt, Artificial Sequence
  MLLT10__Homo_sapiens__NP_001182555
auggugagcagcgacagacccgugagccuggaggacgaggugagccacagcaugaaggagaugaucggcggcugcugcgugugcagcgacgagagaggcugggccgagaacccccugguguacugcgacggccacggcugcagcguggccgugcaccaggccugcuacggcaucgugcaggugcccaccggccccugguucugcagaaagugcgagagccaggagagagccgccagagugagaugcgagcugugcccccacaaggacggcgcccugaagagaaccgacaacggcggcugggcccacguggugugcgcccuguacauccccgaggugcaguucgccaacgugagcaccauggagcccaucgugcugcagagcgugccccacgacagauacaacaagaccugcuacaucugcgacgagcagggcagagagagcaaggccgccaccggcgccugcaugaccugcaacaagcacggcugcagacaggccuuccacgugaccugcgcccaguucgccggccugcugugcgaggaggagggcaacggcgccgacaacgugcaguacugcggcuacugcaaguaccacuucagcaagcugaagaagagcaagagaggcagcaacagaagcuacgaccagagccugagcgacagcagcagccacagccaggacaagcaccacgagaaggagaagaagaaguacaaggagaaggacaagcacaagcagaagcacaagaagcagcccgagcccagccccgcccuggugcccagccugaccgugaccaccgagaagaccuacaccagcaccagcaacaacagcaucagcggcagccugaagagacuggaggacaccaccgccagauucaccaacgccaacuuccaggaggugagcgcccacaccagcagcggcaaggacgugagcgagaccagaggcagcgagggcaagggcaagaagagcagcgcccacagcagcggccagagaggcagaaagcccggcggcggcagaaaccccggcaccaccgugagcgccgccagccccuucccccagggcagcuucagcggcacccccggcagcgugaagagcagcagcggcagcagcgugcagagcccccaggacuuccugagcuucaccgacagcgaccugagaaacgacagcuacagccacagccagcagagcagcgccaccaaggacgugcacaagggcgagagcggcagccaggagggcggcgugaacagcuucagcacccugaucggccugcccagcaccagcgccgugaccagccagcccaagagcuucgagaacagccccggcgaccugggcaacagcagccugcccaccgccggcuacaagagagcccagaccagcggcaucgaggaggagaccgugaaggagaagaagagaaagggcaacaagcagagcaagcacggccccggcagacccaagggcaacaagaaccaggagaacgugagccaccugagcgugagcagcgccagccccaccagcagcguggccagcgccgccggcagcaucaccagcagcagccugcagaagagccccacccugcugagaaacggcagccugcagagccugagcgugggcagcagccccgugggcagcgagaucagcaugcaguacagacacgacggcgccugccccaccaccaccuucagcgagcugcugaacgccauccacaacggcaucuacaacagcaacgacguggccgugagcuuccccaacguggugagcggcagcggcagcagcacccccgugagcagcagccaccugccccagcagagcagcggccaccugcagcaggugggcgcccugagccccagcgccgugagcagcgccgcccccgccguggccaccacccaggccaacacccugagcggcagcagccugagccaggcccccagccacauguacggcaacagaagcaacagcagcauggccgcccugaucgcccagagcgagaacaaccagaccgaccaggaccugggcgacaacagcagaaaccuggugggcagaggcagcagccccagaggcagccugagccccagaagccccgugagcagccugcagaucagauacgaccagcccggcaacagcagccuggagaaccugccccccguggccgccagcaucgagcagcugcuggagagacaguggagcgagggccagcaguuccugcuggagcagggcacccccagcgacauccugggcaugcugaagagccugcaccagcugcagguggagaacagaagacuggaggagcagaucaagaaccugaccgccaagaaggagagacugcagcugcugaacgcccagcugagcgugcccuuccccaccaucaccgccaaccccagccccagccaccagauccacaccuucagcgcccagaccgcccccaccaccgacagccugaacagcagcaagagcccccacaucggcaacagcuuccugcccgacaacagccugcccgugcugaaccaggaccugaccagcagcggccagagcaccagcagcagcagcgcccugagcacccccccccccgccggccagagccccgcccagcagggcagcggcgugagcggcgugcagcaggugaacggcgugaccgugggcgcccuggccagcggcaugcagcccgugaccagcaccauccccgccgugagcgccgugggcggcaucaucggcgcccugcccggcaaccagcuggccaucaacggcaucgugggcgcccugaacggcgugaugcagacccccgugaccaugagccagaaccccaccccccugacccacaccaccgugccccccaacgccacccaccccaugcccgccacccugaccaacagcgccagcggccugggccugcugagcgaccagcagagacagauccugauccaccagcagcaguuccagcagcugcugaacagccagcagcugacccccgagcagcaccaggccuuccuguaccagcugaugcagcaccaccaccagcagcaccaccagcccgagcugcagcagcugcagauccccggccccacccagauccccaucaacaaccugcuggccggcacccaggcccccccccugcacaccgccaccaccaaccccuuccugaccauccacggcgacaacgccagccagaagguggccagacugagcgacaagaccggccccguggcccaggagaagagcuaa

SEQ ID NO: 19906 - RNA, 1680 nt, Artificial Sequence
  MLLT1__Homo_sapiens__NP_005925
auggacaaccagugcaccgugcaggugagacuggagcugggccacagagcccagcugagaaagaagcccaccaccgagggcuucacccacgacuggaugguguucgugagaggccccgagcagugcgacauccagcacuucguggagaaggugguguucuggcugcacgacagcuuccccaagcccagaagagugugcaaggagccccccuacaagguggaggagagcggcuacgccggcuucaucaugcccaucgaggugcacuucaagaacaaggaggagcccagaaaggugugcuucaccuacgaccuguuccugaaccuggagggcaacccccccgugaaccaccugagaugcgagaagcugaccuucaacaaccccaccaccgaguucagauacaagcugcugagagccggcggcgugauggugaugcccgagggcgccgacaccgugagcagacccagccccgacuaccccaugcugcccaccaucccccugagcgccuucagcgaccccaagaagaccaagcccagccacggcagcaaggacgccaacaaggagagcagcaagaccagcaagccccacaaggugaccaaggagcacagagagagacccagaaaggacagcgagagcaagagcagcagcaaggagcuggagagagagcaggccaagagcagcaaggacaccagcagaaagcugggcgagggcagacugcccaaggaggagaaggcccccccccccaaggccgccuucaaggagcccaagauggcccugaaggagaccaagcuggagagcaccagccccaagggcggccccccccccccccccccccccccccccagagccagcagcaagagacccgccaccgccgacagccccaagcccagcgccaagaagcagaagaagagcagcagcaagggcagcagaagcgcccccggcaccagccccagaaccagcagcagcagcagcuucagcgacaagaagcccgccaaggacaagagcagcaccagaggcgagaaggugaaggccgagagcgagcccagagaggccaagaaggcccuggagguggaggagagcaacagcgaggacgaggccagcuucaagagcgagagcgcccagagcagccccagcaacagcagcagcagcagcgacagcagcagcgacagcgacuucgagcccagccagaaccacagccagggcccccugagaagcaugguggaggaccugcagagcgaggagagcgacgaggacgacagcagcagcggcgaggaggccgccggcaagaccaaccccggcagagacagcagacugagcuucagcgacagcgagagcgacaacagcgccgacagcagccugcccagcagagagcccccccccccccagaagccccccccccccaacagcaaggugagcggcagaagaagccccgagagcugcagcaagcccgagaagauccugaagaagggcaccuacgacaaggccuacaccgacgagcugguggagcugcacagaagacugauggcccugagagagagaaacgugcugcagcagaucgugaaccugaucgaggagaccggccacuucaacgugaccaacaccaccuucgacuucgaccuguucagccuggacgagaccaccgugagaaagcugcagagcugccuggaggccguggccaccuaa

SEQ ID NO: 19907 - RNA, 1698 nt, Artificial Sequence
  MLLT3__Homo_sapiens__NP_001273620
augugcgccgugcaggugaagcuggagcugggccacagagcccaggugagaaagaagcccaccguggagggcuucacccacgacuggaugguguucgugagaggccccgagcacagcaacauccagcacuucguggagaaggugguguuccaccugcacgagagcuuccccagacccaagagagugugcaaggacccccccuacaagguggaggagagcggcuacgccggcuucauccugcccaucgagguguacuucaagaacaaggaggagcccagaaaggugagauucgacuacgaccuguuccugcaccuggagggccacccccccgugaaccaccugagaugcgagaagcugaccuucaacaaccccaccgaggacuucagaagaaagcugcugaaggccggcggcgaccccaacagaagcauccacaccagcagcagcagcagcagcagcagcagcagcagcagcagcagcagcagcagcagcagcagcagcagcagcagcagcagcagcagcagcagcagcagcagcagcagcagcagcagcagcagcagcagcaccagcuucagcaagccccacaagcugaugaaggagcacaaggagaagcccagcaaggacagcagagagcacaagagcgccuucaaggagcccagcagagaccacaacaagagcagcaaggagagcagcaagaagcccaaggagaacaagccccugaaggaggagaagaucgugcccaagauggccuucaaggagcccaagcccaugagcaaggagcccaagcccgacagcaaccugcugaccaucaccagcggccaggacaagaaggcccccagcaagagaccccccaucagcgacagcgaggagcugagcgccaagaagagaaagaagagcagcagcgaggcccuguucaagagcuucagcagcgcccccccccugauccugaccugcagcgccgacaagaagcagaucaaggacaagagccacgugaagaugggcaaggugaagaucgagagcgagaccagcgagaagaagaagagcacccugccccccuucgacgacaucguggaccccaacgacagcgacguggaggagaacaucagcagcaagagcgacagcgagcagcccagccccgccagcagcagcagcagcagcagcagcagcuucacccccagccagaccagacagcagggcccccugagaagcaucaugaaggaccugcacagcgacgacaacgaggaggagagcgacgagguggaggacaacgacaacgacagcgagauggagagacccgugaacagaggcggcagcagaagcagaagagugagccugagcgacggcagcgacagcgagagcagcagcgccagcagcccccugcaccacgagcccccccccccccugcugaagaccaacaacaaccagauccuggaggugaagagccccaucaagcagagcaagagcgacaagcagaucaagaacggcgagugcgacaaggccuaccuggacgagcugguggagcugcacagaagacugaugacccugagagagagacacauccugcagcagaucgugaaccugaucgaggagaccggccacuuccacaucaccaacaccaccuucgacuucgaccugugcagccuggacaagaccaccgugagaaagcugcagagcuaccuggagaccagcggcaccagcuaa

SEQ ID NO: 19908 - RNA, 4956 nt, Artificial Sequence
  MLLT4__Homo_sapiens__NP_001035089
augagcgccggcggcagagacgaggagagaagaaagcuggccgacaucauccaccacuggaacgccaacagacuggaccuguucgagaucagccagcccaccgaggaccuggaguuccacggcgugaugagauucuacuuccaggacaaggccgccggcaacuucgccaccaagugcaucagagugagcagcaccgccaccacccaggacgugaucgagacccuggccgagaaguucagacccgacaugagaaugcugagcagccccaaguacagccuguacgaggugcacgugagcggcgagagaagacuggacaucgacgagaagccccugguggugcagcugaacuggaacaaggacgacagagagggcagauucgugcugaagaacgagaacgacgccaucccccccaagaaggcccagagcaacggccccgagaagcaggagaaggagggcgugauccagaacuucaagagaacccugagcaagaaggagaagaaggagaagaagaagagagagaaggaggcccugagacaggccagcgacaaggacgacagacccuuccagggcgaggacguggagaacagcagacuggccgccgagguguacaaggacaugcccgagaccagcuucaccagaaccaucagcaaccccgagguggugaugaagagaagaagacagcagaagcuggagaagagaaugcaggaguucagaagcagcgacggcagacccgacagcggcggcacccugagaaucuacgccgacagccugaagcccaacauccccuacaagaccauccugcugagcaccaccgaccccgccgacuucgccguggccgaggcccuggagaaguacggccuggagaaggagaaccccaaggacuacugcaucgccagagugaugcugccccccggcgcccagcacagcgacgagaagggcgccaaggagaucauccuggacgacgacgagugcccccugcagaucuucagagaguggcccagcgacaagggcauccugguguuccagcugaagagaagaccccccgaccacauccccaagaagaccaagaagcaccuggagggcaagacccccaagggcaaggagagagccgacggcagcggcuacggcagcacccugccccccgagaagcugcccuaccugguggagcugagccccggcagaagaaaccacuucgccuacuacaacuaccacaccuacgaggacggcagcgacagcagagacaagcccaagcuguacagacugcagcugagcgugaccgaggugggcaccgagaagcuggacgacaacagcauccagcuguucggccccggcauccagccccaccacugcgaccugaccaacauggacggcguggugaccgugacccccagaagcauggacgccgagaccuacguggagggccagagaaucagcgagaccaccaugcugcagagcggcaugaaggugcaguucggcgccagccacguguucaaguucguggaccccagccaggaccacgcccuggccaagagaagcguggacggcggccugauggugaagggccccagacacaagcccggcaucgugcaggagaccaccuucgaccugggcggcgacauccacagcggcaccgcccugcccaccagcaagagcaccaccagacuggacagcgacagagugagcagcgccagcagcaccgccgagagaggcauggugaagcccaugaucagaguggagcagcagcccgacuacagaagacaggagagcagaacccaggacgccagcggccccgagcugauccugcccgccagcaucgaguucagagagagcagcgaggacagcuuccugagcgccaucaucaacuacaccaacagcagcaccgugcacuucaagcugagccccaccuacgugcuguacauggccugcagauacgugcugagcaaccaguacagacccgacaucagccccaccgagagaacccacaaggugaucgccguggugaacaagauggugagcaugauggagggcgugauccagaagcagaagaacaucgccggcgcccuggccuucuggauggccaacgccagcgagcugcugaacuucaucaagcaggacagagaccugagcagaaucacccuggacgcccaggacgugcuggcccaccuggugcagauggccuucaaguaccuggugcacugccugcagagcgagcugaacaacuacaugcccgccuuccuggacgaccccgaggagaacagccugcagagacccaagaucgacgacgugcugcacacccugaccggcgccaugagccugcugagaagaugcagagugaacgccgcccugaccauccagcuguucagccagcuguuccacuucaucaacauguggcuguucaacagacuggugaccgaccccgacagcggccugugcagccacuacuggggcgccaucaucagacagcagcugggccacaucgaggccugggccgagaagcagggccuggagcuggccgccgacugccaccugagcagaaucgugcaggccaccacccugcugaccauggacaaguacgcccccgacgacauccccaacaucaacagcaccugcuucaagcugaacagccugcagcugcaggcccugcugcagaacuaccacugcgcccccgacgagcccuucauccccaccgaccugaucgagaacguggugaccguggccgagaacaccgccgacgagcuggccagaagcgacggcagagaggugcagcuggaggaggaccccgaccugcagcugcccuuccugcugcccgaggacggcuacagcugcgacguggugagaaacauccccaacggccugcaggaguuccuggacccccugugccagagaggcuucugcagacugaucccccacaccagaagccccggcaccuggaccaucuacuucgagggcgccgacuacgagagccaccugcugagagagaacaccgagcuggcccagccccugagaaaggagcccgagaucaucaccgugacccugaagaagcagaacggcaugggccugagcaucguggccgccaagggcgccggccaggacaagcugggcaucuacgugaagagcguggugaagggcggcgccgccgacguggacggcagacuggccgccggcgaccagcugcugagcguggacggcagaagccuggugggccugagccaggagagagccgccgagcugaugaccagaaccagcagcguggugacccuggagguggccaagcagggcgccaucuaccacggccuggccacccugcugaaccagcccagccccaugaugcagagaaucagcgacagaagaggcagcggcaagcccagacccaagagcgagggcuucgagcuguacaacaacagcacccagaacggcagccccgagagcccccagcugcccugggccgaguacagcgagcccaagaagcugcccggcgacgacagacugaugaagaacagagccgaccacagaagcagccccaacguggccaaccagccccccagccccggcggcaagagcgccuacgccagcggcaccaccgccaagaucaccagcgugagcaccggcaaccugugcaccgaggagcagacccccccccccagacccgaggccuaccccauccccacccagaccuacaccagagaguacuucaccuuccccgccagcaagagccaggacagaauggcccccccccagaaccaguggcccaacuacgaggagaagccccacaugcacaccgacagcaaccacagcagcaucgccauccagagagugaccagaagccaggaggagcugagagaggacaaggccuaccagcuggagagacacagaaucgaggccgccauggacagaaagagcgacagcgacauguggaucaaccagagcagcagccuggacagcagcaccagcagccaggagcaccugaaccacagcagcaagagcgugacccccgccagcacccugaccaagagcggccccggcagauggaagacccccgccgccauccccgccacccccguggccgugagccagcccaucagaaccgaccugccccccccccccccccccccccccgugcacuacgccggcgacuucgacggcaugagcauggaccugccccugccccccccccccagcgccaaccagaucggccugcccagcgcccagguggccgccgccgagagaagaaagagagaggagcaccagagaugguacgagaaggagaaggccagacuggaggaggagagagagagaaagagaagagagcaggagagaaagcugggccagaugagaacccagagccugaaccccgcccccuucagcccccugaccgcccagcagaugaagcccgagaagcccagcacccugcagagaccccaggagaccgugaucagagagcugcagccccagcagcagcccagaaccaucgagagaagagaccugcaguacaucaccgugagcaaggaggagcugagcagcggcgacagccugagccccgaccccuggaagagagacgccaaggagaagcuggagaagcagcagcagaugcacaucguggacaugcugagcaaggagauccaggagcugcagagcaagcccgacagaagcgccgaggagagcgacagacugagaaagcugaugcuggaguggcaguuccagaagagacugcaggagagcaagcagaaggacgaggacgacgaggaggaggaggacgacgacguggacaccaugcugaucaugcagagacuggaggccgagagaagagccagagacgaggagagaagaagacagcagcagcuggaggagaugagaaagagagaggccgaggacagagccagacaggaggaggagagaagaagacaggaggaggagagaaccaagagagacgccgaggagaaggugauggugcuguaa

SEQ ID NO: 19909 - RNA, 3282 nt, Artificial Sequence
  MLLT6__Homo_sapiens__NP_005928
augaaggagauggugggcggcugcugcgugugcagcgacgagagaggcugggccgagaacccccugguguacugcgacggccacgccugcagcguggccgugcaccaggccugcuacggcaucgugcaggugcccaccggccccugguucugcagaaagugcgagagccaggagagagccgccagagugagaugcgagcugugcccccacaaggacggcgcccugaagagaaccgacaacggcggcugggcccacguggugugcgcccuguacauccccgaggugcaguucgccaacgugcugaccauggagcccaucgugcugcaguacgugccccacgacagauucaacaagaccugcuacaucugcgaggagcagggcagagagagcaaggccgccagcggcgccugcaugaccugcaacagacacggcugcagacaggccuuccacgugaccugcgcccagauggccggccugcugugcgaggaggaggugcuggagguggacaacgugaaguacugcggcuacugcaaguaccacuucagcaagaugaagaccagcagacacagcagcggcggcggcggcggcggcgccggcggcggcggcggcagcaugggcggcggcggcagcggcuucaucagcggcagaagaagcagaagcgccagccccagcacccagcaggagaagcaccccacccaccacgagagaggccagaagaagagcagaaaggacaaggagagacugaagcagaagcacaagaagagacccgagagcccccccagcauccugaccccccccguggugcccaccgccgacaaggugagcagcagcgccagcagcagcagccaccacgaggccagcacccaggagaccagcgagagcagcagagagagcaagggcaagaagagcagcagccacagccugagccacaagggcaagaagcugagcagcggcaagggcgugagcagcuucaccagcgccagcagcagcagcagcagcagcagcagcagcagcggcggccccuuccagcccgccgugagcagccugcagagcagccccgacuucagcgccuuccccaagcuggagcagcccgaggaggacaaguacagcaagcccaccgcccccgcccccagcgccccccccagccccagcgcccccgagccccccaaggccgaccuguucgagcagaaggugguguucagcggcuucggccccaucaugagauucagcaccaccaccagcagcagcggcagagccagagcccccagccccggcgacuacaagagcccccacgugaccggcagcggcgccagcgccggcacccacaagagaaugcccgcccugagcgccacccccgugcccgccgacgagacccccgagaccggccugaaggagaagaagcacaaggccagcaagagaagcagacacggccccggcagacccaagggcagcagaaacaaggagggcaccggcggccccgccgcccccagccugcccagcgcccagcuggccggcuucaccgccaccgccgccagccccuucagcggcggcagccuggugagcagcggccugggcggccugagcagcagaaccuucggccccagcggcagccugcccagccugagccuggagagcccccugcugggcgccggcaucuacaccagcaacaaggaccccaucagccacagcggcggcaugcugagagccgugugcagcaccccccugagcagcagccugcugggcccccccggcaccagcgcccugcccagacugagcagaagccccuucaccagcacccugcccagcagcagcgccagcaucagcaccacccagguguucagccuggccggcagcaccuucagccugcccagcacccacaucuucggcacccccaugggcgccgugaacccccugcugagccaggccgagagcagccacaccgagcccgaccuggaggacugcagcuucagaugcagaggcaccagcccccaggagagccugagcagcaugagccccaucagcagccugcccgcccuguucgaccagaccgccagcgcccccugcggcggcggccagcuggaccccgccgcccccggcaccaccaacauggagcagcugcuggagaagcagggcgacggcgaggccggcgugaacaucguggagaugcugaaggcccugcacgcccugcagaaggagaaccagagacugcaggagcagauccugagccugaccgccaagaaggagagacugcagauccugaacgugcagcugagcgugcccuuccccgcccugcccgccgcccugcccgccgccaacggccccgugcccggccccuacggccugcccccccaggccggcagcagcgacagccugagcaccagcaagagcccccccggcaagagcagccugggccuggacaacagccugagcaccagcagcgaggacccccacagcggcugccccagcagaagcagcagcagccugagcuuccacagcaccccccccccccugccccugcugcagcagagccccgccacccugccccuggcccugcccggcgcccccgccccccugcccccccagccccagaacggccugggcagagcccccggcgccgccggccugggcgccaugcccauggccgagggccugcugggcggccuggccggcagcggcggccugccccugaacggccugcugggcggccugaacggcgccgccgcccccaaccccgccagccugagccaggccggcggcgcccccacccugcagcugcccggcugccugaacagccugaccgagcagcagagacaccugcugcagcagcaggagcagcagcugcagcagcugcagcagcugcuggccagcccccagcugacccccgagcaccagaccgugguguaccagaugauccagcagauccagcagaagagagagcugcagagacugcagauggccggcggcagccagcugcccauggccagccugcuggccggcagcagcaccccccugcugagcgccggcacccccggccugcugcccaccgccagcgcccccccccugcugcccgccggcgcccugguggcccccagccugggcaacaacaccagccugauggccgccgccgccgccgccgccgccguggccgccgccggcggcccccccgugcugaccgcccagaccaaccccuuccugagccugagcggcgccgagggcagcggcggcggccccaagggcggcaccgccgacaagggcgccagcgccaaccaggagaagggcuaa

SEQ ID NO: 19910 - RNA, 345 nt, Artificial Sequence
  MLN__Homo_sapiens__NP_001035198
auggugagcagaaaggccguggccgcccugcugguggugcacguggccgccaugcuggccagccagaccgaggccuucgugcccaucuucaccuacggcgagcugcagagaaugcaggagaaggagagaaacaagggccagaagaagagccugagcguguggcagagaagcggcgaggagggccccguggaccccgccgagcccaucagagaggaggagaacgagaugaucaagcugaccgccccccuggagaucggcaugagaaugaacagcagacagcuggagaaguaccccgccacccuggagggccugcugagcgagaugcugccccagcacgccaaguaa

SEQ ID NO: 19911 - RNA, 1239 nt, Artificial Sequence
  MLNR__Homo_sapiens__NP_001498
augggcagccccuggaacggcagcgacggccccgagggcgccagagagccccccuggcccgcccugccccccugcgacgagagaagaugcagccccuucccccugggcgcccuggugcccgugaccgccgugugccugugccuguucguggugggcgugagcggcaacguggugaccgugaugcugaucggcagauacagagacaugagaaccaccaccaaccuguaccugggcagcauggccgugagcgaccugcugauccugcugggccugcccuucgaccuguacagacuguggagaagcagacccuggguguucggcccccugcugugcagacugagccuguacgugggcgagggcugcaccuacgccacccugcugcacaugaccgcccugagcguggagagauaccuggccaucugcagaccccugagagccagagugcuggugaccagaagaagagugagagcccugaucgccgugcugugggccguggcccugcugagcgccggccccuuccuguuccuggugggcguggagcaggaccccggcaucagcguggugcccggccugaacggcaccgccagaaucgccagcagcccccuggccagcagccccccccuguggcugagcagagcccccccccccagcccccccagcggccccgagaccgccgaggccgccgcccuguucagcagagagugcagacccagccccgcccagcugggcgcccugagagugaugcugugggugaccaccgccuacuucuuccugcccuuccugugccugagcauccuguacggccugaucggcagagagcuguggagcagcagaagaccccugagaggccccgccgccagcggcagagagagaggccacagacagaccgugagagugcugcuggugguggugcuggccuucaucaucugcuggcugcccuuccacgugggcagaaucaucuacaucaacaccgaggacagcagaaugauguacuucagccaguacuucaacaucguggcccugcagcuguucuaccugagcgccagcaucaaccccauccuguacaaccugaucagcaagaaguacagagccgccgccuucaagcugcugcuggccagaaagagcagacccagaggcuuccacagaagcagagacaccgccggcgagguggccggcgacaccggcggcgacaccgugggcuacaccgagaccagcgccaacgugaagaccaugggcuaa

SEQ ID NO: 19912 - RNA, 1719 nt, Artificial Sequence
  MLPH__Homo_sapiens__NP_001035932
augggcaagaagcuggaccugagcaagcugaccgacgaggaggcccagcacgugcuggagguggugcagagagacuucgaccugagaagaaaggaggaggagagacuggaggcccugaagggcaagaucaagaaggagagcagcaagagagagcugcugagcgacaccgcccaccugaacgagacccacugcgccagaugccugcagcccuaccagcugcuggugaacagcaagagacagugccuggagugcggccuguucaccugcaagagcugcggcagagugcaccccgaggagcagggcuggaucugcgaccccugccaccuggccagaguggugaagaucggcagccuggagugguacuacgagcacgugaaggccagauucaagagauucggcagcgccaaggugaucagaagccugcacggcagacugcagggcggcgccggccccgagcugaucagcgaggagagaagcggcgacagcgaccagaccgacgaggacggcgagcccggcagcgaggcccaggcccaggcccagcccuucggcagcaagaagaagagacugcugagcgugcacgacuucgacuucgagggcgacagcgacgacagcacccagccccagggccacagccugcaccugagcagcgugcccgaggccagagacagcccccagagccugaccgacgagagcugcagcgagaaggccgccccccacaaggccgagggccuggaggaggccgacaccggcgccagcggcugccacagccaccccgaggagcagcccaccagcaucagccccagcagacacggcgcccuggccgagcugugcccccccggcggcagccacagaauggcccugggcaccgccgccgcccugggcagcaacgugaucagaaacgagcagcugccccugcaguaccuggccgacguggacaccagcgacgaggagagcaucagagcccacgugauggccagccaccacagcaagagaagaggcagagccagcagcgagagccagggccugggcgccggcgugagaaccgaggccgacguggaggaggaggcccugagaagaaagcuggaggagcugaccagcaacgugagcgaccaggagaccagcagcgaggaggaggaggccaaggacgagaaggccgagcccaacagagacaagagcgugggcccccugccccaggccgaccccgaggugggcaccgccgcccaccagaccaacagacaggagaagagcccccaggaccccggcgaccccgugcaguacaacagaaccaccgacgaggagcugagcgagcuggaggacagaguggccgugaccgccagcgaggugcagcaggccgagagcgaggugagcgacaucgagagcagaaucgccgcccugagagccgccggccugaccgugaagcccagcggcaagcccagaagaaagagcaaccugcccaucuuccugcccagaguggccggcaagcugggcaagagacccgaggaccccaacgccgaccccagcagcgaggccaaggccauggccgugcccuaccugcugagaagaaaguucagcaacagccugaagagccagggcaaggacgacgacagcuucgacagaaagagcguguacagaggcagccugacccagagaaaccccaacgccagaaagggcauggccagccacaccuucgccaagcccgugguggcccaccagagcuaa

SEQ ID NO: 19913 - RNA, 981 nt, Artificial Sequence
  MLST8__Homo_sapiens__NP_001186102
augaacaccagccccggcaccgugggcagcgaccccgugauccuggccaccgccggcuacgaccacaccgugagauucuggcaggcccacagcggcaucugcaccagaaccgugcagcaccaggacagccaggugaacgcccuggaggugacccccgacagaagcaugaucgccgccgccggcuaccagcacaucagaauguacgaccugaacagcaacaaccccaaccccaucaucagcuacgacggcgugaacaagaacaucgccagcgugggcuuccacgaggacggcagauggauguacaccggcggcgaggacugcaccgccagaaucugggaccugagaagcagaaaccugcagugccagagaaucuuccaggugaacgcccccaucaacugcgugugccugcaccccaaccaggccgagcugaucgugggcgaccagagcggcgccauccacaucugggaccugaagaccgaccacaacgagcagcugauccccgagcccgaggugagcaucaccagcgcccacaucgaccccgacgccagcuacauggccgccgugaacagcaccggcaacugcuacguguggaaccugaccggcggcaucggcgacgaggugacccagcugauccccaagaccaagauccccgcccacaccagauacgcccugcagugcagauucagccccgacagcacccugcuggccaccugcagcgccgaccagaccugcaagaucuggagaaccagcaacuucagccugaugaccgagcugagcaucaagagcggcaaccccggcgagagcagcagaggcuggauguggggcugcgccuucagcggcgacagccaguacaucgugaccgccagcagcgacaaccuggccagacuguggugcguggagaccggcgagaucaagagagaguacggcggccaccagaaggccguggugugccuggccuucaacgacagcgugcugggcuaa

SEQ ID NO: 19914 - RNA, 897 nt, Artificial Sequence
  MLX__Homo_sapiens__NP_733752
augaccgagcccggcgccagccccgaggaccccugggugaaggccagccccgugggcgcccacgccggcgagggcagagccggcagagccagagccagaagaggcgccggcagaagaggcgccagccugcugagccccaagagccccacccugagcgugcccagaggcugcagagaggacagcagccaccccgccugcgccaagguggaguacgccuacagcgacaacagccuggaccccggccuguucguggagagcaccagaaagggcagcguggugagcagagccaacagcaucggcagcaccagcgccagcagcgugcccaacaccgacgacgaggacagcgacuaccaccaggaggccuacaaggagagcuacaaggacagaagaagaagagcccacacccaggccgagcagaagagaagagacgccaucaagagaggcuacgacgaccugcagaccaucgugcccaccugccagcagcaggacuucagcaucggcagccagaagcugagcaaggccaucgugcugcagaagaccaucgacuacauccaguuccugcacaaggagaagaagaagcaggaggaggaggugagcacccugagaaaggacgugaccgcccugaagaucaugaaggugaacuacgagcagaucgugaaggcccaccaggacaacccccacgagggcgaggaccaggugagcgaccaggugaaguucaacguguuccagggcaucauggacagccuguuccagagcuucaacgccagcaucagcguggccagcuuccaggagcugagcgccugcguguucagcuggaucgaggagcacugcaagccccagacccugagagagaucgugaucggcgugcugcaccagcugaagaaccagcuguacuaa

SEQ ID NO: 19915 - RNA, 2760 nt, Artificial Sequence
  MLXIP__Homo_sapiens__NP_055753
auggccgccgacguguucaugugcagccccagaagacccagaagcagaggcagacaggugcugcugaagccccaggugagcgaggacgacgacgacagcgacaccgacgagcccagccccccccccgccagcggcgccgccacccccgccagagcccacgccagcgccgccccccccccccccagagccggccccggcagagaggagccccccagaagacagcagaucauccacagcggccacuucauggugagcagcccccacagagagcacccccccaagaagggcuacgacuucgacaccgugaacaagcagaccugccagaccuacagcuucggcaagaccagcagcugccaccugagcaucgacgccagccugaccaagcuguucgagugcaugacccuggccuacagcggcaagcuggugagccccaaguggaagaacuucaagggccugaagcugcaguggagagacaagaucagacugaacaacgccaucuggagagccugguacaugcaguaccuggagaagagaaagaaccccgugugccacuucgugaccccccuggacggcagcguggacguggacgagcacagaagacccgaggccaucaccaccgagggcaaguacuggaagagcagaaucgagaucgugaucagagaguaccacaaguggagaaccuacuucaagaagagacugcagcagcacaaggacgaggaccugagcagccuggugcaggacgacgacaugcuguacuggcacaagcacggcgacggcuggaagacccccgugcccauggaggaggacccccugcuggacaccgacaugcugaugagcgaguucagcgacacccuguucagcacccugagcagccaccagcccguggccuggcccaaccccagagagaucgcccaccugggcaacgccgacaugauccagcccggccugaucccccugcagcccaaccuggacuucauggacaccuucgagcccuuccaggaccuguucagcagcagcagaagcaucuucggcagcaugcugcccgccagcgccagcgcccccgugcccgaccccaacaacccccccgcccaggagagcauccugcccaccaccgcccugcccaccgugagccugcccgacagccugaucgccccccccaccgcccccagccuggcccacauggacgagcagggcugcgagcacaccagcagaaccgaggaccccuucauccagcccaccgacuucggccccagcgagcccccccugagcgugccccagcccuuccugcccguguucaccaugccccugcugagccccagccccgcccccccccccaucagccccgugcugccccuggugcccccccccgccaccgcccugaacccccccgccccccccaccuuccaccagccccagaaguucgccggcgugaacaaggcccccagcgugaucacccacaccgccagcgccacccugacccacgacgcccccgccaccaccuucagccagagccagggccuggugaucaccacccaccaccccgcccccagcgccgcccccugcggccuggcccugagccccgugaccagacccccccagcccagacugaccuucgugcaccccaagcccgugagccugaccggcggcagacccaagcagccccacaagaucgugcccgcccccaagcccgagcccgugagccuggugcugaagaacgccagaaucgcccccgccgccuucagcggccagccccaggccgugaucaugaccagcggcccccugaagagagagggcaugcuggccagcaccgugagccagagcaacguggugaucgcccccgccgccaucgccagagcccccggcgugcccgaguuccacagcagcauccuggugaccgaccugggccacggcaccagcagcccccccgcccccgugagcagacuguuccccagcaccgcccaggacccccugggcaagggcgagcaggugccccugcacggcggcagcccccaggugaccgugaccggccccagcagagacugccccaacagcggccaggccagccccugcgccagcgagcagagccccagcccccagagcccccagaacaacugcagcggcaagagcgaccccaagaacguggccgcccugaagaacagacagaugaagcacaucagcgccgagcagaagagaagauucaacaucaagaugugcuucgacaugcugaacagccugaucagcaacaacagcaagcugaccagccacgccaucacccugcagaagaccguggaguacaucaccaagcugcagcaggagagaggccagaugcaggaggaggccagaagacugagagaggagaucgaggagcugaacgccaccaucaucagcugccagcagcugcugcccgccaccggcgugcccgugaccagaagacaguucgaccacaugaaggacauguucgacgaguacgugaagaccagaacccugcagaacuggaaguucuggaucuucagcaucaucaucaagccccuguucgagagcuucaagggcauggugagcaccagcagccuggaggagcugcacagaaccgcccugagcuggcuggaccagcacugcagccugcccauccugagacccauggugcugagcacccugagacagcugagcaccagcaccagcauccugaccgaccccgcccagcugcccgagcaggccagcaaggccgugaccagaaucggcaagagacugggcgagagcuaa

SEQ ID NO: 19916 - RNA, 2559 nt, Artificial Sequence
  MLXIPL__Homo_sapiens__NP_116569
auggccggcgcccuggccggccuggccgccggccugcaggugcccagaguggcccccagccccgacagcgacagcgacaccgacagcgaggaccccagccugagaagaagcgccggcggccugcugagaagccaggugauccacagcggccacuucauggugagcagcccccacagcgacagccugcccagaagaagagaccaggagggcagcgugggccccagcgacuucggccccagaagcaucgaccccacccugaccagacuguucgagugccugagccuggccuacagcggcaagcuggugagccccaaguggaagaacuucaagggccugaagcugcugugcagagacaagaucagacugaacaacgccaucuggagagccugguacauccaguacgugaagagaagaaagagccccgugugcggcuucgugaccccccugcagggccccgaggccgacgcccacagaaagcccgaggccguggugcuggagggcaacuacuggaagagaagaaucgagguggugaugagagaguaccacaaguggagaaucuacuacaagaagagacugagaaagcccagcagagaggacgaccugcuggcccccaagcaggccgagggcagauggcccccccccgagcaguggugcaagcagcuguucagcagcguggugcccgugcugcugggcgaccccgaggaggagcccggcggcagacagcugcuggaccugaacugcuuccugagcgacaucagcgacacccuguucaccaugacccagagcggccccagcccccugcagcugccccccgaggacgccuacgugggcaacgccgacaugauccagcccgaccugaccccccugcagcccagccuggacgacuucauggacaucagcgacuucuucaccaacagcagacugccccagccccccaugcccagcaacuuccccgagccccccagcuucagccccgugguggacagccuguucagcagcggcacccugggccccgaggugccccccgccagcagcgccaugacccaccugagcggccacagcagacugcaggccagaaacagcugccccggcccccuggacagcagcgccuuccugagcagcgacuuccugcugcccgaggaccccaagcccagacugccccccccccccgugccccccccccugcugcacuaccccccccccgccaaggugcccggccuggagcccugcccccccccccccuucccccccauggccccccccaccgcccugcugcaggaggagccccuguucagccccagauuccccuuccccaccgugccccccgcccccggcgugagcccccugcccgcccccgccgccuucccccccaccccccagagcgugcccagccccgcccccacccccuuccccaucgagcugcugccccugggcuacagcgagcccgccuucggccccugcuucagcaugcccagaggcaagccccccgcccccagccccagaggccagaaggccagcccccccacccuggcccccgccaccgccagcccccccaccaccgccggcagcaacaaccccugccugacccagcugcugaccgccgccaagcccgagcaggcccuggagcccccccuggugagcagcacccugcugagaagccccggcagcccccaggagaccgugcccgaguuccccugcaccuuccugccccccacccccgcccccaccccccccagacccccccccggccccgccacccuggcccccagcagaccccugcuggugcccaaggccgagagacugagcccccccgcccccagcggcagcgagagaagacugagcggcgaccugagcagcaugcccggccccggcacccugagcgugagagugagccccccccagcccauccugagcagaggcagacccgacagcaacaagaccgagaacagaagaaucacccacaucagcgccgagcagaagagaagauucaacaucaagcugggcuucgacacccugcacggccuggugagcacccugagcgcccagcccagccugaaggugagcaaggccaccacccugcagaagaccgccgaguacauccugaugcugcagcaggagagagccggccugcaggaggaggcccagcagcugagagacgagaucgaggagcugaacgccgccaucaaccugugccagcagcagcugcccgccaccggcgugcccaucacccaccagagauucgaccagaugagagacauguucgacgacuacgugagaaccagaacccugcacaacuggaaguucuggguguucagcauccugaucagaccccuguucgagagcuucaacggcauggugagcaccgccagcgugcacacccugagacagaccagccuggccuggcuggaccaguacugcagccugcccgcccugagacccaccgugcugaacagccugagacagcugggcaccagcaccagcauccugaccgaccccggcagaauccccgagcaggccaccagagccgugaccgagggcacccugggcaagccccuguaa

SEQ ID NO: 19917 - RNA, 1482 nt, Artificial Sequence
  MLYCD__Homo_sapiens__NP_036345
augagaggcuucggccccggccugaccgccagaagacugcugccccugagacugccccccagaccccccggccccagacuggccagcggccaggccgccggcgcccuggagagagccauggacgagcugcugagaagagccgugccccccacccccgccuacgagcugagagagaagacccccgcccccgccgagggccagugcgccgacuucgugagcuucuacggcggccuggccgagaccgcccagagagccgagcugcugggcagacuggccagaggcuucggcguggaccacggccagguggccgagcagagcgccggcgugcugcaccugagacagcagcagagagaggccgccgugcugcugcaggccgaggacagacugagauacgcccuggugcccagauacagaggccuguuccaccacaucagcaagcuggacggcggcgugagauuccuggugcagcugagagccgaccugcuggaggcccaggcccugaagcugguggagggccccgacgugagagagaugaacggcgugcugaagggcaugcugagcgagugguucagcagcggcuuccugaaccuggagagagugaccuggcacagccccugcgaggugcugcagaagaucagcgaggccgaggccgugcaccccgugaagaacuggauggacaugaagagaagagugggccccuacagaagaugcuacuucuucagccacugcagcacccccggcgagccccugguggugcugcacguggcccugaccggcgacaucagcagcaacauccaggccaucgugaaggagcacccccccagcgagaccgaggagaagaacaagaucaccgccgccaucuucuacagcaucagccugacccagcagggccugcagggcguggagcugggcaccuuccugaucaagagaguggugaaggagcugcagagagaguucccccaccugggcguguucagcagccugagccccauccccggcuucaccaaguggcugcugggccugcugaacagccagaccaaggagcacggcagaaacgagcuguucaccgacagcgagugcaaggagaucagcgagaucaccggcggccccaucaacgagacccugaagcugcugcugagcagcagcgagugggugcagagcgagaagcuggugagagcccugcagaccccccugaugagacugugcgccugguaccuguacggcgagaagcacagaggcuacgcccugaaccccguggccaacuuccaccugcagaacggcgccgugcuguggagaaucaacuggauggccgacgugagccugagaggcaucaccggcagcugcggccugauggccaacuacagauacuuccuggaggagaccggccccaacagcaccagcuaccugggcagcaagaucaucaaggccagcgagcaggugcugagccugguggcccaguuccagaagaacagcaagcuguaa

SEQ ID NO: 19918 - RNA, 1257 nt, Artificial Sequence
  MMAA__Homo_sapiens__NP_758454
augcccaugcugcugccccacccccaccagcacuuccugaagggccugcugagagcccccuucagaugcuaccacuucaucuuccacagcagcacccaccugggcagcggcauccccugcgcccagcccuucaacagccugggccugcacugcaccaaguggaugcugcugagcgacggccugaagagaaagcugugcgugcagaccacccugaaggaccacaccgagggccugagcgacaaggagcagagauucguggacaagcuguacaccggccugauccagggccagagagccugccuggccgaggccaucacccugguggagagcacccacagcagaaagaaggagcuggcccaggugcugcugcagaaggugcugcuguaccacagagagcaggagcagagcaacaagggcaagccccuggccuucagagugggccugagcggcccccccggcgccggcaagagcaccuucaucgaguacuucggcaagaugcugaccgagagaggccacaagcugagcgugcuggccguggaccccagcagcugcaccagcggcggcagccugcugggcgacaagaccagaaugaccgagcugagcagagacaugaacgccuacaucagacccagccccaccagaggcacccugggcggcgugaccagaaccaccaacgaggccauccugcugugcgagggcgccggcuacgacaucauccugaucgagaccgugggcgugggccagagcgaguucgccguggccgacaugguggacauguucgugcugcugcugccccccgccggcggcgacgagcugcagggcaucaagagaggcaucaucgagauggccgaccugguggccgugaccaagagcgacggcgaccugaucgugcccgccagaagaauccaggccgaguacgugagcgcccugaagcugcugagaaagagaagccagguguggaagcccaaggugaucagaaucagcgccagaagcggcgagggcaucagcgagaugugggacaagaugaaggacuuccaggaccugaugcuggccagcggcgagcugaccgccaagagaagaaagcagcagaagguguggauguggaaccugauccaggagagcgugcuggagcacuucagaacccaccccaccgugagagagcagaucccccugcuggagcagaaggugcugaucggcgcccugagccccggccuggccgccgacuuccugcugaaggccuucaagagcagagacuaa

SEQ ID NO: 19919 - RNA, 753 nt, Artificial Sequence
  MMAB__Homo_sapiens__NP_443077
auggccgugugcggccugggcagcagacugggccugggcagcagacugggccugagaggcugcuucggcgccgccagacugcuguaccccagauuccagagcagaggcccccagggcguggaggacggcgacagaccccagcccagcagcaagacccccagaauccccaagaucuacaccaagaccggcgacaagggcuucagcagcaccuucaccggcgagagaagacccaaggacgaccagguguucgaggccgugggcaccaccgacgagcugagcagcgccaucggcuucgcccuggagcuggugaccgagaagggccacaccuucgccgaggagcugcagaagauccagugcacccugcaggacgugggcagcgcccuggccacccccugcagcagcgccagagaggcccaccugaaguacaccaccuucaaggccggccccauccuggagcuggagcaguggaucgacaaguacaccagccagcugcccccccugaccgccuucauccugcccagcggcggcaagaucagcagcgcccugcacuucugcagagccgugugcagaagagccgagagaagaguggugccccuggugcagaugggcgagaccgacgccaacguggccaaguuccugaacagacugagcgacuaccuguucacccuggccagauacgccgccaugaaggagggcaaccaggagaagaucuacaugaagaacgaccccagcgccgagagcgagggccuguaa

SEQ ID NO: 19920 - RNA, 891 nt, Artificial Sequence
  MMADHC__Homo_sapiens__NP_056517
auggccaacgugcugugcaacagagccagacuggugagcuaccugcccggcuucugcagccuggugaagagaguggugaaccccaaggccuucagcaccgccggcagcagcggcagcgacgagagccacguggccgccgccccccccgacaucugcagcagaaccguguggcccgacgagaccaugggccccuucggcccccaggaccagagauuccagcugcccggcaacaucggcuucgacugccaccugaacggcaccgccagccagaagaagagccuggugcacaagacccugcccgacgugcuggccgagccccugagcagcgagagacacgaguucgugauggcccaguacgugaacgaguuccagggcaacgacgcccccguggagcaggagaucaacagcgccgagaccuacuucgagagcgccagaguggagugcgccauccagaccugccccgagcugcugagaaaggacuucgagagccuguuccccgagguggccaacggcaagcugaugauccugaccgugacccagaagaccaagaacgacaugaccguguggagcgaggagguggagaucgagagagaggugcugcuggagaaguucaucaacggcgccaaggagaucugcuacgcccugagagccgagggcuacugggccgacuucaucgaccccagcagcggccuggccuucuucggccccuacaccaacaacacccuguucgagaccgacgagagauacagacaccugggcuucagcguggacgaccugggcugcugcaaggugaucagacacagccuguggggcacccacgugguggugggcagcaucuucaccaacgccacccccgacagccacaucaugaagaagcugagcggcaacuaa

SEQ ID NO: 19921 - RNA, 813 nt, Artificial Sequence
  MMD2__Homo_sapiens__NP_001094070
auguucgcccccagacugcuggacuuccagaagaccaaguacgccagauucaugaaccacagagugcccgcccacaagagauaccagcccaccgaguacgagcacgccgccaacugcgccacccacgccuucuggaucauccccagcauccugggcagcagcaaccuguacuuccugagcgacgacgacugggagaccaucagcgccuggaucuacggccugggccugugcggccuguucguggugagcaccguguuccacaccaucagcuggaagaagagccaccugagaaugguggagcacugccugcacauguucgacagaauggugaucuacuucuucaucgccgccagcuacgcccccuggcugaaccugagagagcugggccccugggccagccacaugagauggcugguguggaucauggccagcgugggcaccaucuacguguucuucuuccacgagagaaccggcagcugcgugcaguuccugagaggcgaggccugccccaaggccggcaccgccugccugcccgccagauacaagcugguggagcugcugugcuacguggugaugggcuucuuccccgcccuggugauccugagcaugcccaacaccgagggcaucugggagcuggugaccggcggcguguucuacugccugggcaugguguucuucaagagcgacggcagaauccccuucgcccacgccaucuggcaccuguucguggccuucggcgccggcacccacuacuacgccaucuggagauaccuguaccugcccagcacccugcagaccaaggugagcaaguaa

SEQ ID NO: 19922 - RNA, 717 nt, Artificial Sequence
  MMD__Homo_sapiens__NP_036461
augagauucaagaacagauuccagagauucaugaaccacagagcccccgccaacggcagauacaagcccaccugcuacgagcacgccgccaacugcuacacccacgccuuccugaucgugcccgccaucgugggcagcgcccugcugcacagacugagcgacgacugcugggagaagaucaccgccuggaucuacggcaugggccugugcgcccuguucaucgugagcaccguguuccacaucgugagcuggaagaagagccaccugagaaccguggagcacugcuuccacaugugcgacagaauggugaucuacuucuucaucgccgccagcuacgcccccuggcugaaccugagagagcugggcccccuggccagccacaugagaugguucaucuggcugauggccgccggcggcaccaucuacguguuccuguaccacgagaaguacaaggugguggagcuguucuucuaccugaccaugggcuucagccccgcccugguggugaccagcaugaacaacaccgacggccugcaggagcuggccugcggcggccugaucuacugccugggcgugguguucuucaagagcgacggcaucauccccuucgcccacgccaucuggcaccuguucguggccaccgccgccgccgugcacuacuacgccaucuggaaguaccuguacagaagccccaccgacuucaugagacaccuguaa

SEQ ID NO: 19923 - RNA, 2253 nt, Artificial Sequence
  MME__Homo_sapiens__XP_011511160
augggcaagagcgagagccagauggacaucaccgacaucaacacccccaagcccaagaagaagcagagauggaccccccuggagaucagccugagcgugcuggugcugcugcugaccaucaucgccgugaccaugaucgcccuguacgccaccuacgacgacggcaucugcaagagcagcgacugcaucaagagcgccgccagacugauccagaacauggacgccaccaccgagcccugcaccgacuucuucaaguacgccugcggcggcuggcugaagagaaacgugauccccgagaccagcagcagauacggcaacuucgacauccugagagacgagcuggagguggugcugaaggacgugcugcaggagcccaagaccgaggacaucguggccgugcagaaggccaaggcccuguacagaagcugcaucaacgagagcgccaucgacagcagaggcggcgagccccugcugaagcugcugcccgacaucuacggcuggcccguggccaccgagaacugggagcagaaguacggcgccagcuggaccgccgagaaggccaucgcccagcugaacagcaaguacggcaagaaggugcugaucaaccuguucgugggcaccgacgacaagaacagcgugaaccacgugauccacaucgaccagcccagacugggccugcccagcagagacuacuacgagugcaccggcaucuacaaggaggccugcaccgccuacguggacuucaugaucagcguggccagacugaucagacaggaggagagacugcccaucgacgagaaccagcuggcccuggagaugaacaaggugauggagcuggagaaggagaucgccaacgccaccgccaagcccgaggacagaaacgaccccaugcugcuguacaacaagaugacccuggcccagauccagaacaacuucagccuggagaucaacggcaagcccuucagcuggcugaacuucaccaacgagaucaugagcaccgugaacaucagcaucaccaacgaggaggacguggugguguacgcccccgaguaccugaccaagcugaagcccauccugaccaaguacagcgccagagaccugcagaaccugaugagcuggagauucaucauggaccuggugagcagccugagcagaaccuacaaggagagcagaaacgccuucagaaaggcccuguacggcaccaccagcgagaccgccaccuggagaagaugcgccaacuacgugaacggcaacauggagaacgccgugggcagacuguacguggaggccgccuucgccggcgagagcaagcacgugguggaggaccugaucgcccagaucagagagguguucauccagacccuggacgaccugaccuggauggacgccgagaccaagaagagagccgaggagaaggcccuggccaucaaggagagaaucggcuaccccgacgacaucgugagcaacgacaacaagcugaacaacgaguaccuggagcugaacuacaaggaggacgaguacuucgagaacaucauccagaaccugaaguucagccagagcaagcagcugaagaagcugagagagaagguggacaaggacgaguggaucagcggcgccgccguggugaacgccuucuacagcagcggcagaaaccagaucguguuccccgccggcauccugcagccccccuucuucagcgcccagcagagcaacagccugaacuacggcggcaucggcauggugaucggccacgagaucacccacggcuucgacgacaacggcagaaacuucaacaaggacggcgaccugguggacugguggacccagcagagcgccagcaacuucaaggagcagagccagugcaugguguaccaguacggcaacuucagcugggaccuggccggcggccagcaccugaacggcaucaacacccugggcgagaacaucgccgacaacggcggccugggccaggccuacagagccuaccagaacuacaucaagaagaacggcgaggagaagcugcugcccggccuggaccugaaccacaagcagcuguucuuccugaacuucgcccagguguggugcggcaccuacagacccgaguacgccgugaacagcaucaagaccgacgugcacagccccggcaacuucagaaucaucggcacccugcagaacagcgccgaguucagcgaggccuuccacugcagaaagaacagcuacaugaaccccgagaagaagugcagagugugguaa

SEQ ID NO: 19924 - RNA, 1206 nt, Artificial Sequence
  MMEL1__Homo_sapiens__XP_011540425
augggcaagagcgagggccccgugggcaugguggagagcgccggcagagccggccagaagagacccggcuuccuggagggcggccugcugcugcugcugcugcuggugaccgccgcccugguggcccugggcgugcuguacgccgacagaagaggcaagcagcugcccagacuggccagcagacugugcuuccugcaggaggagagaaccuucgugaagagaaagcccagaggcauccccgaggcccaggaggugagcgaggugugcaccacccccggcugcgugaucgccgccgccagaauccugcagaacauggaccccaccaccgagcccugcgacgacuucuaccaguucgccugcggcggcuggcugagaagacacgugauccccgagaccaacagcagauacagcaucuucgacgugcugagagacgagcuggaggugauccugaaggccgugcuggagaacagcaccgccaaggacagacccgccguggagaaggccagaacccuguacagaagcugcaugaaccagagcgugaucgagaagagaggcagccagccccugcuggacauccuggagguggugggcggcuggcccguggccauggacagauggaacgagaccgugggccuggagugggagcuggagagacagcuggcccugaugaacagccaguucaacagaagagugcugaucgaccuguucaucuggaacgacgaccagaacagcagcagacacaucaucuacgugagagccgcccccgugggcagagacagacccgcccaccugggccacgcccugcccagagugcugcugcagagaagacagcagcccgaggagaacagccugggcgccaugguggccgaggccacccagcugugccccgccagcuucggccccggcgccggcagccugcccgccgugcacggcgugagcggccacguggccgccggcggcugcaagcccgcccagggccagcugcccggcgccggcggccacggcgccggcgccggcgccggcgacaccgccggccagggccacggcacccccggcggcgagaccagaagacacagacuggugccccccgacggcaccggcggcgccgccaagcccguguggcccgagggcagcggcgccggcgagggccagaagagcggcgugaccagcaagaccugccagaaggccagaaagggcgccggcuaa

SEQ ID NO: 19925 - RNA, 1431 nt, Artificial Sequence
  MMP10__Homo_sapiens__NP_002416
augaugcaccuggccuuccuggugcugcugugccugcccgugugcagcgccuacccccugagcggcgccgccaaggaggaggacagcaacaaggaccuggcccagcaguaccuggagaaguacuacaaccuggagaaggacgugaagcaguucagaagaaaggacagcaaccugaucgugaagaagauccagggcaugcagaaguuccugggccuggaggugaccggcaagcuggacaccgacacccuggaggugaugagaaagcccagaugcggcgugcccgacgugggccacuucagcagcuuccccggcaugcccaaguggagaaagacccaccugaccuacagaaucgugaacuacacccccgaccugcccagagacgccguggacagcgccaucgagaaggcccugaaggugugggaggaggugaccccccugaccuucagcagacuguacgagggcgaggccgacaucaugaucagcuucgccgugaaggagcacggcgacuucuacagcuucgacggccccggccacagccuggcccacgccuacccccccggccccggccuguacggcgacauccacuucgacgacgacgagaaguggaccgaggacgccagcggcaccaaccuguuccugguggccgcccacgagcugggccacagccugggccuguuccacagcgccaacaccgaggcccugauguacccccuguacaacagcuucaccgagcuggcccaguucagacugagccaggacgacgugaacggcauccagagccuguacggccccccccccgccagcaccgaggagccccuggugcccaccaagagcgugcccagcggcagcgagaugcccgccaagugcgaccccgcccugagcuucgacgccaucagcacccugagaggcgaguaccuguucuucaaggacagauacuucuggagaagaagccacuggaaccccgagcccgaguuccaccugaucagcgccuucuggcccagccugcccagcuaccuggacgccgccuacgaggugaacagcagagacaccguguucaucuucaagggcaacgaguucugggccaucagaggcaacgaggugcaggccggcuaccccagaggcauccacacccugggcuucccccccaccaucagaaagaucgacgccgccgugagcgacaaggagaagaagaagaccuacuucuucgccgccgacaaguacuggagauucgacgagaacagccagagcauggagcagggcuuccccagacugaucgccgacgacuuccccggcguggagcccaagguggacgccgugcugcaggccuucggcuucuucuacuucuucagcggcagcagccaguucgaguucgaccccaacgccagaauggugacccacauccugaagagcaacagcuggcugcacugcuaa

SEQ ID NO: 19926 - RNA, 1467 nt, Artificial Sequence
  MMP11__Homo_sapiens__NP_005931
auggcccccgccgccuggcugagaagcgccgccgccagagcccugcugccccccaugcugcugcugcugcugcagccccccccccugcuggccagagcccugccccccgacgcccaccaccugcacgccgagagaagaggcccccagcccuggcacgccgcccugcccagcagccccgcccccgcccccgccacccaggaggcccccagacccgccagcagccugagaccccccagaugcggcgugcccgaccccagcgacggccugagcgccagaaacagacagaagagauucgugcugagcggcggcagaugggagaagaccgaccugaccuacagaauccugagauuccccuggcagcuggugcaggagcaggugagacagaccauggccgaggcccugaagguguggagcgacgugaccccccugaccuucaccgaggugcacgagggcagagccgacaucaugaucgacuucgccagauacuggcacggcgacgaccugcccuucgacggccccggcggcauccuggcccacgccuucuuccccaagacccacagagagggcgacgugcacuucgacuacgacgagaccuggaccaucggcgacgaccagggcaccgaccugcugcagguggccgcccacgaguucggccacgugcugggccugcagcacaccaccgccgccaaggcccugaugagcgccuucuacaccuucagauacccccugagccugagccccgacgacugcagaggcgugcagcaccuguacggccagcccuggcccaccgugaccagcagaacccccgcccugggcccccaggccggcaucgacaccaacgagaucgccccccuggagcccgacgccccccccgacgccugcgaggccagcuucgacgccgugagcaccaucagaggcgagcuguucuucuucaaggccggcuucguguggagacugagaggcggccagcugcagcccggcuaccccgcccuggccagcagacacuggcagggccugcccagccccguggacgccgccuucgaggacgcccagggccacaucugguucuuccagggcgcccaguacuggguguacgacggcgagaagcccgugcugggccccgccccccugaccgagcugggccuggugagauuccccgugcacgccgcccugguguggggccccgagaagaacaagaucuacuucuucagaggcagagacuacuggagauuccaccccagcaccagaagaguggacagccccgugcccagaagagccaccgacuggagaggcgugcccagcgagaucgacgccgccuuccaggacgccgacggcuacgccuacuuccugagaggcagacuguacuggaaguucgaccccgugaaggugaaggcccuggagggcuuccccagacuggugggccccgacuucuucggcugcgccgagcccgccaacaccuuccuguaa

SEQ ID NO: 19927 - RNA, 1413 nt, Artificial Sequence
  MMP12__Homo_sapiens__NP_002417
augaaguuccugcugauccugcugcugcaggccaccgccagcggcgcccugccccugaacagcagcaccagccuggagaagaacaacgugcuguucggcgagagauaccuggagaaguucuacggccuggagaucaacaagcugcccgugaccaagaugaaguacagcggcaaccugaugaaggagaagauccaggagaugcagcacuuccugggccugaaggugaccggccagcuggacaccagcacccuggagaugaugcacgcccccagaugcggcgugcccgacgugcaccacuucagagagaugcccggcggccccguguggagaaagcacuacaucaccuacagaaucaacaacuacacccccgacaugaacagagaggacguggacuacgccaucagaaaggccuuccagguguggagcaacgugaccccccugaaguucagcaagaucaacaccggcauggccgacauccuggugguguucgccagaggcgcccacggcgacuuccacgccuucgacggcaagggcggcauccuggcccacgccuucggccccggcagcggcaucggcggcgacgcccacuucgacgaggacgaguucuggaccacccacagcggcggcaccaaccuguuccugaccgccgugcacgagaucggccacagccugggccugggccacagcagcgaccccaaggccgugauguuccccaccuacaaguacguggacaucaacaccuucagacugagcgccgacgacaucagaggcauccagagccuguacggcgaccccaaggagaaccagagacugcccaaccccgacaacagcgagcccgcccugugcgaccccaaccugagcuucgacgccgugaccaccgugggcaacaagaucuucuucuucaaggacagauucuucuggcugaaggugagcgagagacccaagaccagcgugaaccugaucagcagccuguggcccacccugcccagcggcaucgaggccgccuacgagaucgaggccagaaaccagguguuccuguucaaggacgacaaguacuggcugaucagcaaccugagacccgagcccaacuaccccaagagcauccacagcuucggcuuccccaacuucgugaagaagaucgacgccgccguguucaaccccagauucuacagaaccuacuucuucguggacaaccaguacuggagauacgacgagagaagacagaugauggaccccggcuaccccaagcugaucaccaagaacuuccagggcaucggccccaagaucgacgccguguucuacagcaagaacaaguacuacuacuucuuccagggcagcaaccaguucgaguacgacuuccugcugcagagaaucaccaagacccugaagagcaacagcugguucggcugcuaa

SEQ ID NO: 19928 - RNA, 1416 nt, Artificial Sequence
  MMP13__Homo_sapiens__NP_002418
augcaccccggcgugcuggccgccuuccuguuccugagcuggacccacugcagagcccugccccugcccagcggcggcgacgaggacgaccugagcgaggaggaccugcaguucgccgagagauaccugagaagcuacuaccaccccaccaaccuggccggcauccugaaggagaacgccgccagcagcaugaccgagagacugagagagaugcagagcuucuucggccuggaggugaccggcaagcuggacgacaacacccuggacgugaugaagaagcccagaugcggcgugcccgacgugggcgaguacaacguguuccccagaacccugaaguggagcaagaugaaccugaccuacagaaucgugaacuacacccccgacaugacccacagcgagguggagaaggccuucaagaaggccuucaagguguggagcgacgugaccccccugaacuucaccagacugcacgacggcaucgccgacaucaugaucagcuucggcaucaaggagcacggcgacuucuaccccuucgacggccccagcggccugcuggcccacgccuucccccccggccccaacuacggcggcgacgcccacuucgacgacgacgagaccuggaccagcagcagcaagggcuacaaccuguuccugguggccgcccacgaguucggccacagccugggccuggaccacagcaaggaccccggcgcccugauguuccccaucuacaccuacaccggcaagagccacuucaugcugcccgacgacgacgugcagggcauccagagccuguacggccccggcgacgaggaccccaaccccaagcaccccaagacccccgacaagugcgaccccagccugagccuggacgccaucaccagccugagaggcgagaccaugaucuucaaggacagauucuucuggagacugcacccccagcagguggacgccgagcuguuccugaccaagagcuucuggcccgagcugcccaacagaaucgacgccgccuacgagcaccccagccacgaccugaucuucaucuucagaggcagaaaguucugggcccugaacggcuacgacauccuggagggcuaccccaagaagaucagcgagcugggccugcccaaggaggugaagaagaucagcgccgccgugcacuucgaggacaccggcaagacccugcuguucagcggcaaccagguguggagauacgacgacaccaaccacaucauggacaaggacuaccccagacugaucgaggaggacuuccccggcaucggcgacaagguggacgccguguacgagaagaacggcuacaucuacuucuucaacggccccauccaguucgaguacagcaucuggagcaacagaaucgugagagugaugcccgccaacagcauccuguggugcuaa

SEQ ID NO: 19929 - RNA, 1749 nt, Artificial Sequence
  MMP14__Homo_sapiens__NP_004986
augagccccgcccccagaccccccagaugccugcugcugccccugcugacccugggcaccgcccuggccagccugggcagcgcccagagcagcagcuucagccccgaggccuggcugcagcaguacggcuaccugccccccggcgaccugagaacccacacccagagaagcccccagagccugagcgccgccaucgccgccaugcagaaguucuacggccugcaggugaccggcaaggccgacgccgacaccaugaaggccaugagaagacccagaugcggcgugcccgacaaguucggcgccgagaucaaggccaacgugagaagaaagagauacgccauccagggccugaaguggcagcacaacgagaucaccuucugcauccagaacuacacccccaaggugggcgaguacgccaccuacgaggccaucagaaaggccuucagagugugggagagcgccaccccccugagauucagagaggugcccuacgccuacaucagagagggccacgagaagcaggccgacaucaugaucuucuucgccgagggcuuccacggcgacagcacccccuucgacggcgagggcggcuuccuggcccacgccuacuuccccggccccaacaucggcggcgacacccacuucgacagcgccgagcccuggaccgugagaaacgaggaccugaacggcaacgacaucuuccugguggccgugcacgagcugggccacgcccugggccuggagcacagcagcgaccccagcgccaucauggcccccuucuaccaguggauggacaccgagaacuucgugcugcccgacgacgacagaagaggcauccagcagcuguacggcggcgagagcggcuuccccaccaagaugcccccccagcccagaaccaccagcagacccagcgugcccgacaagcccaagaaccccaccuacggccccaacaucugcgacggcaacuucgacaccguggccaugcugagaggcgagauguucguguucaaggagagaugguucuggagagugagaaacaaccaggugauggacggcuaccccaugcccaucggccaguucuggagaggccugcccgccagcaucaacaccgccuacgagagaaaggacggcaaguucguguucuucaagggcgacaagcacuggguguucgacgaggccagccuggagcccggcuaccccaagcacaucaaggagcugggcagaggccugcccaccgacaagaucgacgccgcccuguucuggaugcccaacggcaagaccuacuucuucagaggcaacaaguacuacagauucaacgaggagcugagagccguggacagcgaguaccccaagaacaucaaggugugggagggcauccccgagagccccagaggcagcuucaugggcagcgacgagguguucaccuacuucuacaagggcaacaaguacuggaaguucaacaaccagaagcugaagguggagcccggcuaccccaagagcgcccugagagacuggaugggcugccccagcggcggcagacccgacgagggcaccgaggaggagaccgaggugaucaucaucgagguggacgaggagggcggcggcgccgugagcgccgccgccguggugcugcccgugcugcugcugcugcuggugcuggccgugggccuggccguguucuucuucagaagacacggcacccccagaagacugcuguacugccagagaagccugcuggacaagguguaa

SEQ ID NO: 19930 - RNA, 2010 nt, Artificial Sequence
  MMP15__Homo_sapiens__NP_002419
augggcagcgaccccagcgcccccggcagacccggcuggaccggcagccugcugggcgacagagaggaggccgccagacccagacugcugccccugcugcuggugcugcugggcugccugggccugggcguggccgccgaggacgccgaggugcacgccgagaacuggcugagacuguacggcuaccugccccagcccagcagacacaugagcaccaugagaagcgcccagauccuggccagcgcccuggccgagaugcagagauucuacggcauccccgugaccggcgugcuggacgaggagaccaaggaguggaugaagagacccagaugcggcgugcccgaccaguucggcgugagagugaaggccaaccugagaagaagaagaaagagauacgcccugaccggcagaaaguggaacaaccaccaccugaccuucagcauccagaacuacaccgagaagcugggcugguaccacagcauggaggccgugagaagagccuucagagugugggagcaggccaccccccugguguuccaggaggugcccuacgaggacaucagacugagaagacagaaggaggccgacaucauggugcuguucgccagcggcuuccacggcgacagcagccccuucgacggcaccggcggcuuccuggcccacgccuacuuccccggccccggccugggcggcgacacccacuucgacgccgacgagcccuggaccuucagcagcaccgaccugcacggcaacaaccuguuccugguggccgugcacgagcugggccacgcccugggccuggagcacagcagcaaccccaacgccaucauggcccccuucuaccaguggaaggacguggacaacuucaagcugcccgaggacgaccugagaggcauccagcagcuguacggcacccccgacggccagccccagcccacccagccccugcccaccgugacccccagaagacccggcagacccgaccacagaccccccagacccccccagccccccccccccggcggcaagcccgagagaccccccaagcccggcccccccgugcagcccagagccaccgagagacccgaccaguacggccccaacaucugcgacggcgacuucgacaccguggccaugcugagaggcgagauguucguguucaagggcagaugguucuggagagugagacacaacagagugcuggacaacuaccccaugcccaucggccacuucuggagaggccugcccggcgacaucagcgccgccuacgagagacaggacggcagauucguguucuucaagggcgacagauacuggcuguucagagaggccaaccuggagcccggcuacccccagccccugaccagcuacggccugggcauccccuacgacagaaucgacaccgccaucuggugggagcccaccggccacaccuucuucuuccaggaggacagauacuggagauucaacgaggagacccagagaggcgaccccggcuaccccaagcccaucagcguguggcagggcauccccgccagccccaagggcgccuuccugagcaacgacgccgccuacaccuacuucuacaagggcaccaaguacuggaaguucgacaacgagagacugagaauggagcccggcuaccccaagagcauccugagagacuucaugggcugccaggagcacguggagcccggccccagauggcccgacguggccagaccccccuucaacccccacggcggcgccgagcccggcgccgacagcgccgagggcgacgugggcgacggcgacggcgacuucggcgccggcgugaacaaggacggcggcagcagagugguggugcagauggaggagguggccagaaccgugaacguggugauggugcuggugccccugcugcugcugcugugcgugcugggccugaccuacgcccuggugcagaugcagagaaagggcgcccccagagugcugcuguacugcaagagaagccugcaggaguggguguaa

SEQ ID NO: 19931 - RNA, 1824 nt, Artificial Sequence
  MMP16__Homo_sapiens__NP_005932
augauccugcugaccuucagcaccggcagaagacuggacuucgugcaccacagcggcguguucuuccugcagacccugcuguggauccugugcgccaccgugugcggcaccgagcaguacuucaacguggagguguggcugcagaaguacggcuaccugccccccaccgaccccagaaugagcgugcugagaagcgccgagaccaugcagagcgcccuggccgccaugcagcaguucuacggcaucaacaugaccggcaagguggacagaaacaccaucgacuggaugaagaagcccagaugcggcgugcccgaccagaccagaggcagcagcaaguuccacaucagaagaaagagauacgcccugaccggccagaaguggcagcacaagcacaucaccuacagcaucaagaacgugacccccaaggugggcgaccccgagaccagaaaggccaucagaagagccuucgacguguggcagaacgugaccccccugaccuucgaggaggugcccuacagcgagcuggagaacggcaagagagacguggacaucaccaucaucuucgccagcggcuuccacggcgacagcagccccuucgacggcgagggcggcuuccuggcccacgccuacuuccccggccccggcaucggcggcgacacccacuucgacagcgacgagcccuggacccugggcaaccccaaccacgacggcaacgaccuguuccugguggccgugcacgagcugggccacgcccugggccuggagcacagcaacgaccccaccgccaucauggcccccuucuaccaguacauggagaccgacaacuucaagcugcccaacgacgaccugcagggcauccagaagaucuacggcccccccgacaagauccccccccccaccagaccccugcccaccgugcccccccacagaagcaucccccccgccgaccccagaaagaacgacagacccaagccccccagaccccccaccggcagacccagcuaccccggcgccaagcccaacaucugcgacggcaacuucaacacccuggccauccugagaagagagauguucguguucaaggaccagugguucuggagagugagaaacaacagagugauggacggcuaccccaugcagaucaccuacuucuggagaggccugccccccagcaucgacgccguguacgagaacagcgacggcaacuucguguucuucaagggcaacaaguacuggguguucaaggacaccacccugcagcccggcuacccccacgaccugaucacccugggcagcggcauccccccccacggcaucgacagcgccaucuggugggaggacgugggcaagaccuacuucuucaagggcgacagauacuggagauacagcgaggagaugaagaccauggaccccggcuaccccaagcccaucaccguguggaagggcauccccgagagcccccagggcgccuucgugcacaaggagaacggcuucaccuacuucuacaagggcaaggaguacuggaaguucaacaaccagauccugaagguggagcccggcuaccccagaagcauccugaaggacuucaugggcugcgacggccccaccgacagagugaaggagggccacagcccccccgacgacguggacaucgugaucaagcuggacaacaccgccagcaccgugaaggccaucgccaucgugauccccugcauccuggcccugugccugcuggugcugguguacaccguguuccaguucaagagaaagggcacccccagacacauccuguacugcaagagaagcaugcaggaguggguguaa

SEQ ID NO: 19932 - RNA, 1812 nt, Artificial Sequence
  MMP17__Homo_sapiens__NP_057239
augagaagaagagccgccagaggccccggcccccccccccccggccccggccugagcagacugccccugccccugcugcugcugcuggcccugggcaccagaggcggcugcgccgcccccgcccccgcccccagagccgaggaccugagccugggcguggaguggcugagcagauucggcuaccugccccccgccgaccccaccaccggccagcugcagacccaggaggagcugagcaaggccaucaccgccaugcagcaguucggcggccuggaggccaccggcauccuggacgaggccacccuggcccugaugaagacccccagaugcagccugcccgaccugcccgugcugacccaggccagaagaagaagacaggcccccgcccccaccaaguggaacaagagaaaccugagcuggagagugagaaccuuccccagagacagcccccugggccacgacaccgugagagcccugauguacuacgcccugaagguguggagcgacaucgccccccugaacuuccacgagguggccggcagcgccgccgacauccagaucgacuucagcaaggccgaccacaacgacggcuaccccuucgacggccccggcggcaccguggcccacgccuucuuccccggccaccaccacaccgccggcgacacccacuucgacgacgacgaggccuggaccuucagaagcagcgacgcccacggcauggaccuguucgccguggccgugcacgaguucggccacgccaucggccugagccacguggccgccgcccacagcaucaugagacccuacuaccagggccccgugggcgacccccugagauacggccugcccuacgaggacaaggugagaguguggcagcuguacggcgugagagagagcgugagccccaccgcccagcccgaggagcccccccugcugcccgagccccccgacaacagaagcagcgccccccccagaaaggacgugccccacagaugcagcacccacuucgacgccguggcccagaucagaggcgaggccuucuucuucaagggcaaguacuucuggagacugaccagagacagacaccuggugagccugcagcccgcccagaugcacagauucuggagaggccugccccugcaccuggacagcguggacgccguguacgagagaaccagcgaccacaagaucguguucuucaagggcgacagauacuggguguucaaggacaacaacguggaggagggcuaccccagacccgugagcgacuucagccugccccccggcggcaucgacgccgccuucagcugggcccacaacgacagaaccuacuucuucaaggaccagcuguacuggagauacgacgaccacaccagacacauggaccccggcuaccccgcccagagcccccuguggagaggcgugcccagcacccuggacgacgccaugagauggagcgacggcgccagcuacuucuucagaggccaggaguacuggaaggugcuggacggcgagcuggagguggcccccggcuacccccagagcaccgccagagacuggcuggugugcggcgacagccaggccgacggcagcguggccgccggcguggacgccgccgagggccccagagccccccccggccagcacgaccagagcagaagcgaggacggcuacgaggugugcagcugcaccagcggcgccagcagcccccccggcgcccccggcccccugguggccgccaccaugcugcugcugcugcccccccugagccccggcgcccuguggaccgccgcccaggcccugacccuguaa

SEQ ID NO: 19933 - RNA, 918 nt, Artificial Sequence
  MMP19__Homo_sapiens__NP_001259030
augaacugccagcagcuguggcugggcuuccugcugcccaugaccgugagcggcagagugcugggccuggccgagguggcccccguggacuaccugagccaguacggcuaccugcagaagccccuggagggcagcaacaacuucaagcccgaggacaucaccgaggcccugagagccuuccaggaggccagcgagcugcccgugagcggccagcuggacgacgccaccagagccagaaugagacagcccagaugcggccuggaggaccccuucaaccagaagacccugaaguaccugcugcugggcagauggagaaagaagcaccugaccuucagaauccugaaccugcccagcacccugcccccccacaccgccagagccgcccugagacaggccuuccaggacuggagcaacguggccccccugaccuuccaggaggugcaggccggcgccgccgacaucagacugagcuuccacggcagacagagcagcuacugcagcaacaccuucgacggccccggcaagaagagccccgugaucagagacgaggaggaggaggagaccgagcugcccaccgugccccccgugcccaccgagcccagccccaugcccgaccccugcagcagcgagcuggacgccaugaugcugggcgaggcccccccccugcaggccgugggcagaagauggggccagcccgccgaccccgaggccuggaccaacggcagcgacaugggccugcagcacgagcaguggagagcccccugggaggaccugugcuuccagggcggccugugcguggacugcaucagauucagaaccggcccccuggugcccagcgugugcccccugggcggcgcccccagaaagcccggcugcugcugccugcuggccagcaacaccauggacagccugcuguaa

SEQ ID NO: 19934 - RNA, 1410 nt, Artificial Sequence
  MMP1__Homo_sapiens__NP_002412
augcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacuaa

SEQ ID NO: 19935 - RNA, 1452 nt, Artificial Sequence
  MMP20__Homo_sapiens__NP_004762
augaaggugcugcccgccagcggccuggccguguuccugaucauggcccugaaguucagcaccgccgcccccagccugguggccgccagccccagaaccuggagaaacaacuacagacuggcccaggccuaccuggacaaguacuacaccaacaaggagggccaccagaucggcgagaugguggccagaggcagcaacagcaugaucagaaagaucaaggagcugcaggccuucuucggccugcaggugaccggcaagcuggaccagaccaccaugaacgugaucaagaagcccagaugcggcgugcccgacguggccaacuacagacuguuccccggcgagcccaaguggaagaagaacacccugaccuacagaaucagcaaguacacccccagcaugagcagcguggagguggacaaggccguggagauggcccugcaggccuggagcagcgccgugccccugagcuucgugagaaucaacagcggcgaggccgacaucaugaucagcuucgagaacggcgaccacggcgacagcuaccccuucgacggccccagaggcacccuggcccacgccuucgcccccggcgagggccugggcggcgacacccacuucgacaacgccgagaaguggaccaugggcaccaacggcuucaaccuguucaccguggccgcccacgaguucggccacgcccugggccuggcccacagcaccgaccccagcgcccugauguaccccaccuacaaguacaagaaccccuacggcuuccaccugcccaaggacgacgugaagggcauccaggcccuguacggccccagaaagguguuccugggcaagcccacccugccccacgccccccaccacaagcccagcauccccgaccugugcgacagcagcagcagcuucgacgccgugaccaugcugggcaaggagcugcugcuguucaaggacagaaucuucuggagaagacaggugcaccugagaaccggcaucagacccagcaccaucaccagcagcuucccccagcugaugagcaacguggacgccgccuacgagguggccgagagaggcaccgccuacuucuucaagggcccccacuacuggaucaccagaggcuuccagaugcagggcccccccagaaccaucuacgacuucggcuuccccagacacgugcagcagaucgacgccgccguguaccugagagagccccagaagacccuguucuucgugggcgacgaguacuacagcuacgacgagagaaagagaaagauggagaaggacuaccccaagaacaccgaggaggaguucagcggcgugaacggccagaucgacgccgccguggagcugaacggcuacaucuacuucuucagcggccccaagaccuacaaguacgacaccgagaaggaggacguggugagcguggugaagagcagcagcuggaucggcugcuaa

SEQ ID NO: 19936 - RNA, 1710 nt, Artificial Sequence
  MMP21__Homo_sapiens__XP_011537559
augcuggccgccagcaucuucagacccacccugcugcugugcuggcuggccgcccccuggcccacccagcccgagagccuguuccacagcagagacagaagcgaccuggagcccagcccccugagacaggccaagcccaucgccgaccugcacgccgcccagagauuccugagcagauacggcuggagcggcgugugggccgccuggggccccagccccgagggcccccccgagacccccaagggcgccgcccuggccgaggccgugagaagauuccagagagccaacgcccugcccgccagcggcgagcuggacgccgccacccuggccgccaugaacagacccagaugcggcgugcccgacaugagaccccccccccccagcgccccccccagcccccccggccccccccccagagccagaagcagaagaagccccagagccccccugagccugagcagaagaggcuggcagcccagaggcuaccccgacggcggcgccgcccaggccuucagcaagagaacccugagcuggagacugcugggcgaggcccugagcagccagcugagcguggccgaccagagaagaaucguggcccuggccuucagaauguggagcgaggugaccccccuggacuucagagaggaccuggccgcccccggcgccgccguggacaucaagcugggcuucggcagaggcagacaccugggcugccccagagccuucgacggcagcggccaggaguucgcccacgccuggagacugggcgacauccacuucgacgacgacgagcacuucaccccccccaccagcgacaccggcaucagccugcugaagguggccgugcacgagaucggccacgugcugggccugccccacaccuacagaaccggcagcaucaugcagcccaacuacaucccccaggagcccgccuucgagcuggacuggagcgacagaaaggccauccagaagcuguacggcagcugcgagggcagcuucgacaccgccuucgacuggaucagaaaggagagaaaccaguacggcgaggugauggugagauucagcaccuacuucuucagaaacagcugguacuggcuguacgagaacagaaacaacagaaccagauacggcgaccccauccagauccugaccggcuggcccggcauccccacccacaacaucgacgccuucgugcacaucuggaccuggaagagagacgagagauacuucuuccagggcaaccaguacuggagauacgacagcgacaaggaccaggcccugaccgaggacgagcagggcaagagcuaccccaagcugaucagcgagggcuuccccggcauccccagcccccuggacaccgccuucuacgacagaagacagaagcugaucuacuucuucaaggagagccugguguucgccuucgacgugaacagaaacagagugcugaacagcuaccccaagagaaucaccgagguguuccccgccgugaucccccagaaccaccccuucagaaacaucgacagcgccuacuacagcuacgccuacaacagcaucuucuucuucaagggcaacgccuacuggaagguggugaacgacaaggacaagcagcagaacagcuggcugcccgccaacggccuguuccccaagaaguucaucagcgagaagugguucgacgugugcgacgugcacaucagcacccugaacauguaa

SEQ ID NO: 19937 - RNA, 1938 nt, Artificial Sequence
  MMP24__Homo_sapiens__NP_006681
augcccagaagcagaggcggcagagccgcccccggcccccccccccccccccccccccccggccaggcccccagauggagcagauggagagugcccggcagacugcugcugcugcugcugcccgcccugugcugccugcccggcgccgccagagccgccgccgccgccgccggcgccggcaacagagccgccguggccguggccguggccagagccgacgaggccgaggcccccuucgccggccagaacuggcugaagagcuacggcuaccugcugcccuacgacagcagagccagcgcccugcacagcgccaaggcccugcagagcgccgugagcaccaugcagcaguucuacggcauccccgugaccggcgugcuggaccagaccaccaucgaguggaugaagaagcccagaugcggcgugcccgaccacccccaccugagcagaagaagaagaaacaagagauacgcccugaccggccagaaguggagacagaagcacaucaccuacagcauccacaacuacacccccaaggugggcgagcuggacaccagaaaggccaucagacaggccuucgacguguggcagaaggugaccccccugaccuucgaggaggugcccuaccacgagaucaagagcgacagaaaggaggccgacaucaugaucuucuucgccagcggcuuccacggcgacagcagccccuucgacggcgagggcggcuuccuggcccacgccuacuuccccggccccggcaucggcggcgacacccacuucgacagcgacgagcccuggacccugggcaacgccaaccacgacggcaacgaccuguuccugguggccgugcacgagcugggccacgcccugggccuggagcacagcagcgaccccagcgccaucauggcccccuucuaccaguacauggagacccacaacuucaagcugccccaggacgaccugcagggcauccagaagaucuacggcccccccgccgagccccuggagcccaccagaccccugcccacccugcccgugagaagaauccacagccccagcgagagaaagcacgagagacagcccagaccccccagacccccccugggcgacagacccagcacccccggcaccaagcccaacaucugcgacggcaacuucaacaccguggcccuguucagaggcgagauguucguguucaaggacagaugguucuggagacugagaaacaacagagugcaggagggcuaccccaugcagaucgagcaguucuggaagggccugcccgccagaaucgacgccgccuacgagagagccgacggcagauucguguucuucaagggcgacaaguacuggguguucaaggaggugaccguggagcccggcuacccccacagccugggcgagcugggcagcugccugcccagagagggcaucgacaccgcccugagaugggagcccgugggcaagaccuacuucuucaagggcgagagauacuggagauacagcgaggagagaagagccaccgaccccggcuaccccaagcccaucaccguguggaagggcaucccccaggccccccagggcgccuucaucagcaaggagggcuacuacaccuacuucuacaagggcagagacuacuggaaguucgacaaccagaagcugagcguggagcccggcuaccccagaaacauccugagagacuggaugggcugcaaccagaaggagguggagagaagaaaggagagaagacugccccaggacgacguggacaucauggugaccaucaacgacgugcccggcagcgugaacgccguggccguggugauccccugcauccugagccugugcauccuggugcugguguacaccaucuuccaguucaagaacaagaccggcccccagcccgugaccuacuacaagagacccgugcaggaguggguguaa

SEQ ID NO: 19938 - RNA, 1689 nt, Artificial Sequence
  MMP25__Homo_sapiens__NP_071913
augagacugagacugagacugcuggcccugcugcugcugcugcuggccccccccgccagagcccccaagcccagcgcccaggacgugagccugggcguggacuggcugaccagauacggcuaccugccccccccccaccccgcccaggcccagcugcagagccccgagaagcugagagacgccaucaaggugaugcagagauucgccggccugcccgagaccggcagaauggaccccggcaccguggccaccaugagaaagcccagaugcagccugcccgacgugcugggcguggccggccuggugagaagaagaagaagauacgcccugagcggcagcguguggaagaagagaacccugaccuggagagugagaagcuucccccagagcagccagcugagccaggagaccgugagagugcugaugagcuacgcccugauggccuggggcauggagagcggccugaccuuccacgagguggacagcccccagggccaggagcccgacauccugaucgacuucgccagagccuuccaccaggacagcuaccccuucgacggccugggcggcacccuggcccacgccuucuuccccggcgagcaccccaucagcggcgacacccacuucgacgacgaggagaccuggaccuucggcagcaaggacggcgagggcaccgaccuguucgccguggccgugcacgaguucggccacgcccugggccugggccacagcagcgcccccaacagcaucaugagacccuucuaccagggccccgugggcgaccccgacaaguacagacugagccaggacgacagagacggccugcagcagcuguacggcaaggccccccagacccccuacgacaagcccaccagaaagccccuggccccccccccccagccccccgccagccccacccacagccccagcuuccccauccccgacagaugcgagggcaacuucgacgccaucgccaacaucagaggcgagaccuucuucuucaagggccccugguucuggagacugcagcccagcggccagcuggugagccccagacccgccagacugcacagauucugggagggccugcccgcccaggugagaguggugcaggccgccuacgccagacacagagacggcagaauccugcuguucagcggcccccaguucuggguguuccaggacagacagcuggagggcggcgccagaccccugaccgagcugggccugccccccggcgaggagguggacgccguguucagcuggccccagaacggcaagaccuaccuggugagaggcagacaguacuggagauacgacgaggccgccgccagacccgaccccggcuaccccagagaccugagccugugggagggcgccccccccagccccgacgacgugaccgugagcaacgccggcgacaccuacuucuucaagggcgcccacuacuggagauuccccaagaacagcaucaagaccgagcccgacgccccccagcccaugggccccaacuggcuggacugccccgcccccagcagcggccccagagcccccagaccccccaaggccacccccgugagcgagaccugcgacugccagugcgagcugaaccaggccgccggcagauggcccgcccccaucccccugcugcugcugccccugcuggugggcggcguggccagcagauaa

SEQ ID NO: 19939 - RNA, 786 nt, Artificial Sequence
  MMP26__Homo_sapiens__NP_068573
augcagcuggugauccugagagugaccaucuuccugcccuggugcuucgccgugcccgugccccccgccgccgaccacaagggcugggacuucguggagggcuacuuccaccaguucuuccugaccaagaaggagagcccccugcugacccaggagacccagacccagcugcugcagcaguuccacagaaacggcaccgaccugcuggacaugcagaugcacgcccugcugcaccagccccacugcggcgugcccgacggcagcgacaccagcaucagccccggcagaugcaaguggaacaagcacacccugaccuacagaaucaucaacuacccccacgacaugaagcccagcgccgugaaggacagcaucuacaacgccgugagcaucuggagcaacgugaccccccugaucuuccagcaggugcagaacggcgacgccgacaucaaggugagcuucuggcagugggcccacgaggacggcuggcccuucgacggccccggcggcauccugggccacgccuuccugcccaacagcggcaaccccggcguggugcacuucgacaagaacgagcacuggagcgccagcgacaccggcuacaaccuguuccugguggccacccacgagaucggccacagccugggccugcagcacagcggcaaccagagcagcaucauguaccccaccuacugguaccacgaccccagaaccuuccagcugagcgccgacgacauccagagaauccagcaccuguacggcgagaagugcagcagcgacauccccuaa

SEQ ID NO: 19940 - RNA, 393 nt, Artificial Sequence
  MMP28__Homo_sapiens__NP_001027449
augguggccagagugggccugcugcugagagcccugcagcugcugcuguggggccaccuggacgcccagcccgccgagagaggcggccaggagcugagaaaggaggccgaggccuuccuggagaaguacggcuaccugaacgagcaggugcccaaggcccccaccagcaccagauucagcgacgccaucagagccuuccagugggugagccagcugcccgugagcggcgugcuggacagagccacccugagacagaugaccagacccagaugcggcgugaccgacaccaacagcuacgccgccugggccgagagaaucagcgaccuguucgccagacacagaaccaagaugagaagaaagaagagauucgccaagcagggcgagcacugcuaa

SEQ ID NO: 19941 - RNA, 1833 nt, Artificial Sequence
  MMP2__Homo_sapiens__NP_001121363
augcaguaccugaacaccuucuacggcugccccaaggagagcugcaaccuguucgugcugaaggacacccugaagaagaugcagaaguucuucggccugccccagaccggcgaccuggaccagaacaccaucgagaccaugagaaagcccagaugcggcaaccccgacguggccaacuacaacuucuuccccagaaagcccaagugggacaagaaccagaucaccuacagaaucaucggcuacacccccgaccuggaccccgagaccguggacgacgccuucgccagagccuuccagguguggagcgacgugaccccccugagauucagcagaauccacgacggcgaggccgacaucaugaucaacuucggcagaugggagcacggcgacggcuaccccuucgacggcaaggacggccugcuggcccacgccuucgcccccggcaccggcgugggcggcgacagccacuucgacgacgacgagcuguggacccugggcgagggccagguggugagagugaaguacggcaacgccgacggcgaguacugcaaguuccccuuccuguucaacggcaaggaguacaacagcugcaccgacaccggcagaagcgacggcuuccuguggugcagcaccaccuacaacuucgagaaggacggcaaguacggcuucugcccccacgaggcccuguucaccaugggcggcaacgccgagggccagcccugcaaguuccccuucagauuccagggcaccagcuacgacagcugcaccaccgagggcagaaccgacggcuacagauggugcggcaccaccgaggacuacgacagagacaagaaguacggcuucugccccgagaccgccaugagcaccgugggcggcaacagcgagggcgcccccugcguguuccccuucaccuuccugggcaacaaguacgagagcugcaccagcgccggcagaagcgacggcaagauguggugcgccaccaccgccaacuacgacgacgacagaaaguggggcuucugccccgaccagggcuacagccuguuccugguggccgcccacgaguucggccacgccaugggccuggagcacagccaggaccccggcgcccugauggcccccaucuacaccuacaccaagaacuucagacugagccaggacgacaucaagggcauccaggagcuguacggcgccagccccgacaucgaccugggcaccggccccacccccacccugggccccgugacccccgagaucugcaagcaggacaucguguucgacggcaucgcccagaucagaggcgagaucuucuucuucaaggacagauucaucuggagaaccgugacccccagagacaagcccaugggcccccugcugguggccaccuucuggcccgagcugcccgagaagaucgacgccguguacgaggccccccaggaggagaaggccguguucuucgccggcaacgaguacuggaucuacagcgccagcacccuggagagaggcuaccccaagccccugaccagccugggccugccccccgacgugcagagaguggacgccgccuucaacuggagcaagaacaagaagaccuacaucuucgccggcgacaaguucuggagauacaacgaggugaagaagaagauggaccccggcuuccccaagcugaucgccgacgccuggaacgccauccccgacaaccuggacgccgugguggaccugcagggcggcggccacagcuacuucuucaagggcgccuacuaccugaagcuggagaaccagagccugaagagcgugaaguucggcagcaucaagagcgacuggcugggcugcuaa

SEQ ID NO: 19942 - RNA, 1434 nt, Artificial Sequence
  MMP3__Homo_sapiens__NP_002413
augaagagccugcccauccugcugcugcugugcguggccgugugcagcgccuacccccuggacggcgccgccagaggcgaggacaccagcaugaaccuggugcagaaguaccuggagaacuacuacgaccugaagaaggacgugaagcaguucgugagaagaaaggacagcggccccguggugaagaagaucagagagaugcagaaguuccugggccuggaggugaccggcaagcuggacagcgacacccuggaggugaugagaaagcccagaugcggcgugcccgacgugggccacuucagaaccuuccccggcauccccaaguggagaaagacccaccugaccuacagaaucgugaacuacacccccgaccugcccaaggacgccguggacagcgccguggagaaggcccugaaggugugggaggaggugaccccccugaccuucagcagacuguacgagggcgaggccgacaucaugaucagcuucgccgugagagagcacggcgacuucuaccccuucgacggccccggcaacgugcuggcccacgccuacgcccccggccccggcaucaacggcgacgcccacuucgacgacgacgagcaguggaccaaggacaccaccggcaccaaccuguuccugguggccgcccacgagaucggccacagccugggccuguuccacagcgccaacaccgaggcccugauguacccccuguaccacagccugaccgaccugaccagauucagacugagccaggacgacaucaacggcauccagagccuguacggccccccccccgacagccccgagaccccccuggugcccaccgagcccgugccccccgagcccggcacccccgccaacugcgaccccgcccugagcuucgacgccgugagcacccugagaggcgagauccugaucuucaaggacagacacuucuggagaaagagccugagaaagcuggagcccgagcugcaccugaucagcagcuucuggcccagccugcccagcggcguggacgccgccuacgaggugaccagcaaggaccugguguucaucuucaagggcaaccaguucugggccaucagaggcaacgaggugagagccggcuaccccagaggcauccacacccugggcuucccccccaccgugagaaagaucgacgccgccaucagcgacaaggagaagaacaagaccuacuucuucguggaggacaaguacuggagauucgacgagaagagaaacagcauggagcccggcuuccccaagcagaucgccgaggacuuccccggcaucgacagcaagaucgacgccguguucgaggaguucggcuucuucuacuucuucaccggcagcagccagcuggaguucgaccccaacgccaagaaggugacccacacccugaagagcaacagcuggcugaacugcuaa

SEQ ID NO: 19943 - RNA, 804 nt, Artificial Sequence
  MMP7__Homo_sapiens__NP_002414
augagacugaccgugcugugcgccgugugccugcugcccggcagccuggcccugccccugccccaggaggccggcggcaugagcgagcugcagugggagcaggcccaggacuaccugaagagauucuaccuguacgacagcgagaccaagaacgccaacagccuggaggccaagcugaaggagaugcagaaguucuucggccugcccaucaccggcaugcugaacagcagagugaucgagaucaugcagaagcccagaugcggcgugcccgacguggccgaguacagccuguuccccaacagccccaaguggaccagcaagguggugaccuacagaaucgugagcuacaccagagaccugccccacaucaccguggacagacuggugagcaaggcccugaacauguggggcaaggagaucccccugcacuucagaaaggugguguggggcaccgccgacaucaugaucggcuucgccagaggcgcccacggcgacagcuaccccuucgacggccccggcaacacccuggcccacgccuucgcccccggcaccggccugggcggcgacgcccacuucgacgaggacgagagauggaccgacggcagcagccugggcaucaacuuccuguacgccgccacccacgagcugggccacagccugggcaugggccacagcagcgaccccaacgccgugauguaccccaccuacggcaacggcgacccccagaacuucaagcugagccaggacgacaucaagggcauccagaagcuguacggcaagagaagcaacagcagaaagaaguaa

SEQ ID NO: 19944 - RNA, 1404 nt, Artificial Sequence
  MMP8__Homo_sapiens__NP_002415
auguucagccugaagacccugcccuuccugcugcugcugcacgugcagaucagcaaggccuuccccgugagcagcaaggagaagaacaccaagaccgugcaggacuaccuggagaaguucuaccagcugcccagcaaccaguaccagagcaccagaaagaacggcaccaacgugaucguggagaagcugaaggagaugcagagauucuucggccugaacgugaccggcaagcccaacgaggagacccuggacaugaugaagaagcccagaugcggcgugcccgacagcggcggcuucaugcugacccccggcaaccccaagugggagagaaccaaccugaccuacagaaucagaaacuacaccccccagcugagcgaggccgagguggagagagccaucaaggacgccuucgagcuguggagcguggccagcccccugaucuucaccagaaucagccagggcgaggccgacaucaacaucgccuucuaccagagagaccacggcgacaacagccccuucgacggccccaacggcauccuggcccacgccuuccagcccggccagggcaucggcggcgacgcccacuucgacgccgaggagaccuggaccaacaccagcgccaacuacaaccuguuccugguggccgcccacgaguucggccacagccugggccuggcccacagcagcgaccccggcgcccugauguaccccaacuacgccuucagagagaccagcaacuacagccugccccaggacgacaucgacggcauccaggccaucuacggccugagcagcaaccccauccagcccaccggccccagcacccccaagcccugcgaccccagccugaccuucgacgccaucaccacccugagaggcgagauccuguucuucaaggacagauacuucuggagaagacacccccagcugcagagaguggagaugaacuucaucagccuguucuggcccagccugcccaccggcauccaggccgccuacgaggacuucgacagagaccugaucuuccuguucaagggcaaccaguacugggcccugagcggcuacgacauccugcagggcuaccccaaggacaucagcaacuacggcuuccccagcagcgugcaggccaucgacgccgccguguucuacagaagcaagaccuacuucuucgugaacgaccaguucuggagauacgacaaccagagacaguucauggagcccggcuaccccaagagcaucagcggcgccuuccccggcaucgagagcaagguggacgccguguuccagcaggagcacuucuuccacguguucagcggccccagauacuacgccuucgaccugaucgcccagagagugaccagaguggccagaggcaacaaguggcugaacugcagauacggcuaa

SEQ ID NO: 19945 - RNA, 2124 nt, Artificial Sequence
  MMP9__Homo_sapiens__NP_004985
augagccuguggcagccccuggugcuggugcugcuggugcugggcugcugcuucgccgcccccagacagagacagagcacccuggugcuguuccccggcgaccugagaaccaaccugaccgacagacagcuggccgaggaguaccuguacagauacggcuacaccagaguggccgagaugagaggcgagagcaagagccugggccccgcccugcugcugcugcagaagcagcugagccugcccgagaccggcgagcuggacagcgccacccugaaggccaugagaacccccagaugcggcgugcccgaccugggcagauuccagaccuucgagggcgaccugaaguggcaccaccacaacaucaccuacuggauccagaacuacagcgaggaccugcccagagccgugaucgacgacgccuucgccagagccuucgcccuguggagcgccgugaccccccugaccuucaccagaguguacagcagagacgccgacaucgugauccaguucggcguggccgagcacggcgacggcuaccccuucgacggcaaggacggccugcuggcccacgccuucccccccggccccggcauccagggcgacgcccacuucgacgacgacgagcuguggagccugggcaagggcgugguggugcccaccagauucggcaacgccgacggcgccgccugccacuuccccuucaucuucgagggcagaagcuacagcgccugcaccaccgacggcagaagcgacggccugcccuggugcagcaccaccgccaacuacgacaccgacgacagauucggcuucugccccagcgagagacuguacacccaggacggcaacgccgacggcaagcccugccaguuccccuucaucuuccagggccagagcuacagcgccugcaccaccgacggcagaagcgacggcuacagauggugcgccaccaccgccaacuacgacagagacaagcuguucggcuucugccccaccagagccgacagcaccgugaugggcggcaacagcgccggcgagcugugcguguuccccuucaccuuccugggcaaggaguacagcaccugcaccagcgagggcagaggcgacggcagacuguggugcgccaccaccagcaacuucgacagcgacaagaaguggggcuucugccccgaccagggcuacagccuguuccugguggccgcccacgaguucggccacgcccugggccuggaccacagcagcgugcccgaggcccugauguaccccauguacagauucaccgagggccccccccugcacaaggacgacgugaacggcaucagacaccuguacggccccagacccgagcccgagcccagaccccccaccaccaccaccccccagcccaccgccccccccaccgugugccccaccggcccccccaccgugcaccccagcgagagacccaccgccggccccaccggcccccccagcgccggccccaccggcccccccaccgccggccccagcaccgccaccaccgugccccugagccccguggacgacgccugcaacgugaacaucuucgacgccaucgccgagaucggcaaccagcuguaccuguucaaggacggcaaguacuggagauucagcgagggcagaggcagcagaccccagggccccuuccugaucgccgacaaguggcccgcccugcccagaaagcuggacagcguguucgaggagagacugagcaagaagcuguucuucuucagcggcagacagguguggguguacaccggcgccagcgugcugggccccagaagacuggacaagcugggccugggcgccgacguggcccaggugaccggcgcccugagaagcggcagaggcaagaugcugcuguucagcggcagaagacuguggagauucgacgugaaggcccagaugguggaccccagaagcgccagcgagguggacagaauguuccccggcgugccccuggacacccacgacguguuccaguacagagagaaggccuacuucugccaggacagauucuacuggagagugagcagcagaagcgagcugaaccagguggaccaggugggcuacgugaccuacgacauccugcagugccccgaggacuaa

SEQ ID NO: 19946 - RNA, 3687 nt, Artificial Sequence
  MMRN1__Homo_sapiens__NP_031377
augaagggcgccagacuguucgugcugcugagcagccuguggagcggcggcaucggccugaacaacagcaagcacagcuggaccauccccgaggacggcaacagccagaagaccaugcccagcgccagcgugccccccaacaagauccagagccugcagauccugcccaccaccagagugaugagcgccgagaucgccaccacccccgaggccagaaccagcgaggacagccugcugaagagcacccugccccccagcgagaccagcgcccccgccgagggcgugagaaaccagacccugaccagcaccgagaaggccgagggcguggugaagcugcagaaccugacccugcccaccaacgccagcaucaaguucaaccccggcgccgagagcguggugcugagcaacagcacccugaaguuccugcagagcuucgccagaaagagcaacgagcaggccaccagccugaacaccgugggcggcaccggcggcaucggcggcgugggcggcaccggcggcgugggcaacagagcccccagagagaccuaccugagcagaggcgacagcagcagcagccagagaaccgacuaccagaagagcaacuucgagaccaccagaggcaagaacuggugcgccuacgugcacaccagacugagccccaccgugauccuggacaaccaggugaccuacgugcccggcggcaagggccccugcggcuggaccggcggcagcugcccccagagaagccagaagaucagcaaccccguguacagaaugcagcacaagaucgugaccagccuggacuggagaugcugccccggcuacagcggccccaagugccagcugagagcccaggagcagcagagccugauccacaccaaccaggccgagagccacaccgccgugggcagaggcguggccgagcagcagcagcagcagggcugcggcgaccccgaggugaugcagaagaugaccgaccaggugaacuaccaggccaugaagcugacccugcugcagaagaagaucgacaacaucagccugaccgugaacgacgugagaaacaccuacagcagccuggagggcaaggugagcgaggacaagagcagagaguuccagagccugcugaagggccugaagagcaagagcaucaacgugcugaucagagacaucgugagagagcaguucaagaucuuccagaacgacaugcaggagaccguggcccagcuguucaagaccgugagcagccugagcgaggaccuggagagcaccagacagaucauccagaaggugaacgagagcguggugagcaucgccgcccagcagaaguucgugcuggugcaggagaacagacccacccugaccgacaucguggagcugagaaaccacaucgugaacgugagacaggagaugacccugaccugcgagaagcccaucaaggagcuggaggugaagcagacccaccuggagggcgcccuggagcaggagcacagcagaagcauccuguacuacgagagccugaacaagacccugagcaagcugaaggaggugcacgagcagcugcugagcaccgagcaggugagcgaccagaagaacgcccccgccgccgagagcgugagcaacaacgugaccgaguacaugagcacccugcacgagaacaucaagaagcagagccugaugaugcugcagauguucgaggaccugcacauccaggagagcaagaucaacaaccugaccgugagccuggagauggagaaggagagccugagaggcgagugcgaggacaugcugagcaagugcagaaacgacuucaaguuccagcugaaggacaccgaggagaaccugcacgugcugaaccagacccuggccgaggugcuguuccccauggacaacaagauggacaagaugagcgagcagcugaacgaccugaccuacgacauggagauccugcagccccugcuggagcagggcgccagccugagacagaccaugaccuacgagcagcccaaggaggccaucgugaucagaaagaagaucgagaaccugaccagcgccgugaacagccugaacuucaucaucaaggagcugaccaagagacacaaccugcugagaaacgaggugcagggcagagacgacgcccuggagagaagaaucaacgaguacgcccuggagauggaggacggccugaacaagaccaugaccaucaucaacaacgccaucgacuucauccaggacaacuacgcccugaaggagacccugagcaccaucaaggacaacagcgagauccaccacaagugcaccagcgacauggagaccauccugaccuucaucccccaguuccacagacugaacgacagcauccagacccuggugaacgacaaccagagauacaacuucgugcugcagguggccaagacccuggccggcauccccagagacgagaagcugaaccagagcaacuuccagaagauguaccagauguucaacgagaccaccagccaggugagaaaguaccagcagaacaugagccaccuggaggagaagcugcugcugaccaccaagaucagcaagaacuucgagaccagacugcaggacaucgagagcaaggugacccagacccugauccccuacuacaucagcgugaagaagggcagcguggugaccaacgagagagaccaggcccugcagcugcaggugcugaacagcagauucaaggcccuggaggccaagagcauccaccugagcaucaacuucuucagccugaacaagacccugcacgaggugcugaccaugugccacaacgccagcaccagcgugagcgagcugaacgccaccauccccaaguggaucaagcacagccugcccgacauccagcugcugcagaagggccugaccgaguucguggagcccaucauccagaucaagacccaggccgcccugagcaaccugaccugcugcaucgacagaagccugcccggcagccuggccaacguggugaagagccagaagcaggugaagagccugcccaagaagaucaacgcccugaagaagcccaccgugaaccugaccaccgugcugaucggcagaacccagagaaacaccgacaacaucaucuaccccgaggaguacagcagcugcagcagacaccccugccagaacggcggcaccugcaucaacggcagaaccagcuucaccugcgccugcagacaccccuucaccggcgacaacugcaccaucaagcugguggaggagaacgcccuggcccccgacuucagcaagggcagcuacagauacgcccccaugguggccuucuucgccagccacaccuacggcaugaccauccccggccccauccuguucaacaaccuggacgugaacuacggcgccagcuacacccccagaaccggcaaguucagaauccccuaccugggcguguacguguucaaguacaccaucgagagcuucagcgcccacaucagcggcuuccuggugguggacggcaucgacaagcuggccuucgagagcgagaacaucaacagcgagauccacugcgacagagugcugaccggcgacgcccugcuggagcugaacuacggccaggagguguggcugagacuggccaagggcaccauccccgccaaguucccccccgugaccaccuucagcggcuaccugcuguacagaaccuaa

SEQ ID NO: 19947 - RNA, 2850 nt, Artificial Sequence
  MMRN2__Homo_sapiens__NP_079032
augauccugagccugcuguucagccugggcggcccccugggcuggggccugcugggcgccugggcccaggccagcagcaccagccugagcgaccugcagagcagcagaacccccggcguguggaaggccgaggccgaggacaccggcaaggaccccgugggcagaaacuggugccccuaccccaugagcaagcuggugacccugcuggcccugugcaagaccgagaaguuccugauccacagccagcagcccugcccccagggcgcccccgacugccagaaggugaaggugauguacagaauggcccacaagcccguguaccaggugaagcagaaggugcugaccagccuggccuggagaugcugccccggcuacaccggccccaacugcgagcaccacgacagcauggccauccccgagcccgccgaccccggcgacagccaccaggagccccaggacggccccgugagcuucaagcccggccaccuggccgccgugaucaacgagguggaggugcagcaggagcagcaggagcaccugcugggcgaccugcagaacgacgugcacagaguggccgacagccugcccggccuguggaaggcccugcccggcaaccugaccgccgccgugauggaggccaaccagaccggccacgaguuccccgacagaagccuggagcaggugcugcugccccacguggacaccuuccugcaggugcacuucagccccaucuggagaagcuucaaccagagccugcacagccugacccaggccaucagaaaccugagccuggacguggaggccaacagacaggccaucagcagagugcaggacagcgccguggccagagccgacuuccaggagcugggcgccaaguucgaggccaaggugcaggagaacacccagagagugggccagcugagacaggacguggaggacagacugcacgcccagcacuucacccugcacagaagcaucagcgagcugcaggccgacguggacaccaagcugaagagacugcacaaggcccaggaggcccccggcaccaacggcagccuggugcuggccacccccggcgccggcgccagacccgagcccgacagccugcaggccagacugggccagcugcagagaaaccugagcgagcugcacaugaccaccgccagaagagaggaggagcugcaguacacccuggaggacaugagagccacccugaccagacacguggacgagaucaaggagcuguacagcgagagcgacgagaccuucgaccagaucagcaagguggagagacagguggaggagcugcaggugaaccacaccgcccugagagagcugagagugauccugauggagaagagccugaucauggaggagaacaaggaggagguggagagacagcugcuggagcugaaccugacccugcagcaccugcagggcggccacgccgaccugaucaaguacgugaaggacugcaacugccagaagcuguaccuggaccuggacgugaucagagagggccagagagacgccaccagagcccuggaggagacccaggugagccuggacgagagaagacagcuggacggcagcagccugcaggcccugcagaacgccguggacgccgugagccuggccguggacgcccacaaggccgagggcgagagagccagagccgccaccagcagacugagaagccaggugcaggcccuggacgacgaggugggcgcccugaaggccgccgccgccgaggccagacacgaggugagacagcugcacagcgccuucgccgcccugcuggaggacgcccugagacacgaggccgugcuggccgcccuguucggcgaggaggugcuggaggagaugagcgagcagacccccggcccccugccccugagcuacgagcagaucagaguggcccugcaggacgccgccagcggccugcaggagcaggcccugggcugggacgagcuggccgccagagugaccgcccuggagcaggccagcgagccccccagacccgccgagcaccuggagcccagccacgacgccggcagagaggaggccgccaccaccgcccuggccggccuggccagagagcugcagagccugagcaacgacgugaagaacgugggcagaugcugcgaggccgaggccggcgccggcgccgccagccugaacgccagccugcacggccugcacaacgcccuguucgccacccagagaagccuggagcagcaccagagacuguuccacagccuguucggcaacuuccagggccugauggaggccaacgugagccuggaccugggcaagcugcagaccaugcugagcagaaagggcaagaagcagcagaaggaccuggaggcccccagaaagagagacaagaaggaggccgagccccugguggacaucagagugaccggccccgugcccggcgcccugggcgccgcccugugggaggccggcagccccguggccuucuacgccagcuucagcgagggcaccgccgcccugcagaccgugaaguucaacaccaccuacaucaacaucggcagcagcuacuuccccgagcacggcuacuucagagcccccgagagaggcguguaccuguucgccgugagcguggaguucggccccggccccggcaccggccagcugguguucggcggccaccacagaacccccgugugcaccaccggccagggcagcggcagcaccgccaccguguucgccauggccgagcugcagaagggcgagagagugugguucgagcugacccagggcagcaucaccaagagaagccugagcggcaccgccuucggcggcuuccugauguucaagaccuaa

SEQ ID NO: 19948 - RNA, 2964 nt, Artificial Sequence
  MMS19__Homo_sapiens__NP_001276332
auggccgccgccgccgccguggaggccgccgcccccaugggcgcccuguggggccuggugcacgacuucguggugggccagcaggagggccccgccgaccagguggccgccgacgugaagagcggcaacuacaccgugcugcaggugguggaggcccugggcagcagccuggagaaccccgagcccagaaccagagccagagccauccagcugcugagccaggugcugcugcacugccacacccugcugcuggagaaggagguggugcaccugauccuguucuacgagaacagacugaaggaccaccaccuggugauccccagcgugcugcagggccugaaggcccugagccugugcguggcccugccccccggccuggccgugagcgugcugaaggccaucuuccaggaggugcacgugcagagccugccccagguggacagacacaccguguacaacaucaucaccaacuucaugagaaccagagaggagggccccuucguggaggagcuguucgaggugaccagcugcuacuuccccaucgacuucacccccccccccaacgacccccacggcauccagagagaggaccugauccugagccugagagccgugcuggccagcacccccagauucgccgaguuccugcugccccugcugaucgagaagguggacagcgaggugcugagcgccaagcuggacagccugcagacccugaacgccugcugcgccguguacggccagaaggagcugaaggacuuccugcccagccugugggccagcaucagaagagagguguuccagaccgccagcgagagaguggaggccgagggccuggccgcccugcacagccugaccgccugccugagcagaagcgugcugagagccgacgccgaggaccugcuggacagcuuccugagcaacauccugcaggacugcagacaccaccugugcgagcccgacaugaagcugguguggcccagcgccaagcugcugcaggccgccgccggcgccagcgccagagccugcgacagcgugaccagcaacgugcugccccugcugcuggagcaguuccacaagcacagccagagcagccagagaagaaccauccuggagaugcugcugggcuuccugaagcugcagcagaaguggagcuacgaggacaaggaccagagaccccugaacggcuucaaggaccagcugugcagccugguguucauggcccugaccgaccccagcacccagcugcagcuggugggcaucagaacccugaccgugcugggcgcccagcccgaccugcugagcuacgaggaccuggagcuggccgugggccaccuguacagacugagcuuccugaaggaggacagccagagcugcagaguggccgcccuggaggccagcggcacccuggccgcccuguaccccguggccuucagcagccaccuggugcccaagcuggccgaggagcugagagugggcgagagcaaccugaccaacggcgacgagcccacccagugcagcagacaccugugcugccugcaggcccugagcgccgugagcacccaccccagcaucgugaaggagacccugccccugcugcugcagcaccuguggcaggugaacagaggcaacaugguggcccagagcagcgacgugaucgccgugugccagagccugagacagauggccgagaagugccagcaggaccccgagagcugcugguacuuccaccagaccgccauccccugccugcuggcccuggccgugcaggccagcaugcccgagaaggagcccagcgugcugagaaaggugcugcuggaggacgaggugcuggccgccauggugagcgugaucggcaccgccaccacccaccugagccccgagcuggccgcccagagcgugacccacaucgugccccuguuccuggacggcaacgugagcuuccugcccgagaacagcuuccccagcagauuccagcccuuccaggacggcagcagcggccagagaagacugaucgcccugcugauggccuucgugugcagccugcccagaaacguggagaucccccagcugaaccagcugaugagagagcugcuggagcugagcugcugccacagcugccccuucagcagcaccgccgccgccaagugcuucgccggccugcugaacaagcaccccgccggccagcagcuggacgaguuccugcagcuggccguggacaagguggaggccggccugggcagcggccccugcagaagccaggccuucacccugcugcugugggugaccaaggcccuggugcugagauaccacccccugagcagcugccugaccgccagacugaugggccugcugagcgaccccgagcugggccccgccgccgccgacggcuucagccugcugaugagcgacugcaccgacgugcugaccagagccggccacgccgaggugagaaucauguucagacagagauucuucaccgacaacgugcccgcccuggugcagggcuuccacgccgccccccaggacgugaagcccaacuaccugaagggccugagccacgugcugaacagacugcccaagcccgugcugcugcccgagcugcccacccugcugagccugcugcuggaggcccugagcugccccgacugcguggugcagcugagcacccugagcugccugcagccccugcugcuggaggccccccaggugaugagccugcacguggacacccuggugaccaaguuccugaaccugagcagcagccccagcauggccgugagaaucgccgcccugcagugcaugcacgcccugaccagacugcccacccccgugcugcugcccuacaagccccaggugaucagagcccuggccaagccccuggacgacaagaagagacuggugagaaaggaggccgugagcgccagaggcgagugguuccugcugggcagccccggcagcuaa

SEQ ID NO: 19949 - RNA, 3732 nt, Artificial Sequence
  MMS22L__Homo_sapiens__NP_940870
auggagaacugcagcgccgccagcaccuuccugaccgacagccuggagcuggagcugggcaccgaguggugcaagccccccuacuucagcugcgccguggacaacagaggcggcggcaagcacuucagcggcgagagcuaccugugcagcggcgcccugaagagacugauccugaaccuggacccccugcccaccaacuucgaggaggacacccuggagaucuucggcauccagugggugaccgagaccgcccuggugaacagcagcagagagcuguuccaccuguucagacagcagcuguacaaccuggagacccugcugcagagcagcugcgacuucggcaaggugagcacccugcacugcaaggccgacaacaucagacagcagugcgugcuguuccugcacuacgugaagguguucaucuucagauaccugaaggugcagaacgccgagagccacgugcccgugcaccccuacgaggcccuggaggcccagcugcccagcgugcugaucgacgagcugcacggccugcugcuguacaucggccaccugagcgagcugcccagcgugaacaucggcgccuucgugaaccagaaccagaucaagcuguucccccccagcuggcaccugcugcaccugcaccuggacauccacuggcuggugcuggagauccuguacaugcugggcgagaagcugaagcaggugguguacggccaccaguucaugaaccuggccagcgacaaccugaccaacaucagccuguucgaggagcacugcgagacccugcugugcgaccugaucagccugagccugaacagauacgacaaggugagaagcagcgagagccugaugagcgaccagugccccugccugugcaucaaggagcugugggugcugcugauccaccugcuggaccacagaagcaagugguucgugagcgagagcuucuggaacuggcugaacaagcugcugaagacccugcuggagaagagcagcgacagaagaagaagcagcaugcccgugauccagagcagagacccccugggcuucagcugguggaucaucacccacguggccagcuucuacaaguucgacagacacggcgugcccgacgagaugagaaagguggagagcaacuggaacuucguggaggagcugcugaagaagagcaucagcgugcagggcgugauccuggaggagcagcugagaauguaccugcacugcugccugacccugugcgacuucugggagcccaacaucgccaucgugaccauccugugggaguacuacagcaagaaccugaacagcagcuucagcaucagcuggcugcccuucaagggccuggccaacaccaugaagagcccccugagcaugcuggagauggugaagaccugcugcugcgacaagcaggaccaggagcuguacaagagcagcagcagcuacaccaucuuccugugcauccuggccaagguggugaagaaggccaugaagagcaacggcccccaccccuggaagcaggugaagggcagaaucuacagcaaguuccaccagaagagaauggaggagcugaccgaggugggccugcagaacuucuucagccuguuccugcugcuggccgccguggccgagguggaggacguggccagccacgugcuggaccugcugaacuuccugaagcccgccuucgugaccagccagagagcccugaucuggaagggccacauggccuuccugcugauguacgcccagaagaaccuggacaucggcgugcuggccgagaaguucagcugcgccuucagagagaaggccaaggaguuccuggugagcaagaacgaggagauggugcagagacagaccaucuggacccugcugagcaucuacaucgacggcgugcaggagguguucgagaccagcuacugccuguaccccagccacgagaagcugcugaacgacggcuucagcaugcugcugagagccugcagagagagcgagcugagaaccgugcugagcuuccugcaggccgugcuggccagaaucagaagcaugcaccagcagcugugccaggagcugcagagagacaacguggaccuguucgugcagagcagccugagcgccaaggagagacaccuggccgccguggccagcgcccuguggagacacuucuucagcuuccugaagagccagagaaugagccagguggugcccuucagccagcuggccgacgccgccgccgacuucacccugcuggccauggacaugcccagcaccgcccccagcgacuuccagccccagcccgugaucagcaucauccagcuguucggcugggacgacaucaucugcccccaggugguggccagauaccugagccacgugcugcagaacagcacccugugcgaggcccugagccacagcggcuacgugagcuuccaggcccugaccgugagaagcuggaucagaugcgugcugcagauguacaucaagaaccugagcggccccgacgaccugcugaucgacaagaaccuggaggaggccguggagaaggaguacaugaagcagcuggugaagcugaccagacugcuguucaaccugagcgaggugaagagcaucuucagcaaggcccagguggaguaccugagcaucagcgaggaccccaagaaggcccuggugagauucuucgaggccgugggcgugaccuacggcaacgugcagacccugagcgacaagagcgccauggugaccaagagccuggaguaccugggcgaggugcugaaguacaucaagcccuaccugggcaagaagguguucagcgccggccugcagcugaccuacggcaugaugggcauccuggugaagagcugggcccagaucuucgccaccagcaaggcccagaagcugcuguucagaaucaucgacugccugcugcugccccacgccgugcugcagcaggagaaggagcugcccgcccccaugcugagcgccauccagaagagccugccccuguaccugcagggcaugugcaucgugugcugccagagccagaaccccaacgccuaccugaaccagcugcugggcaacgugaucgagcaguacaucggcagauuccugcccgccagccccuacgugagcgaccugggccagcaccccgugcugcuggcccugagaaacaccgccaccaucccccccaucagcagccugaagaagugcaucgugcaggugaucagaaagagcuaccuggaguacaagggcagcagccccccccccagacuggccagcauccuggccuucauccugcagcuguucaaggagaccaacaccgacaucuacgagguggagcugcugcugcccggcauccugaagugccuggugcuggugagcgagccccaggugaagagacuggccaccgagaaccugcaguacauggugaaggccugccaggugggcagcgaggaggagcccagcagccagcugaccagcguguucagacaguucauccaggacuacggcaugagauacuacuaccagguguacagcauccuggagaccguggccacccuggaccagcagguggugauccaccugaucagcacccugacccagagccugaaggacagcgagcagaaguggggccugggcagaaacaucgcccagagagaggccuacagcaagcugcugagccaccugggccagaugggccaggacgagaugcagagacuggagaacgacaacaccuaa

SEQ ID NO: 19950 - RNA, 3963 nt, Artificial Sequence
  MN1__Homo_sapiens__NP_002421
auguucggccuggaccaguucgagccccaggugaacagcagaaacgccggccagggcgagagaaacuucaacgagaccggccugagcaugaacacccacuucaaggcccccgccuuccacaccggcggcccccccggccccguggaccccgccaugagcgcccugggcgagccccccauccugggcaugaacauggagcccuacggcuuccacgccagaggccacagcgagcugcacgccggcggccugcaggcccagcccgugcacggcuucuucggcggccagcagccccaccacggccaccccggcagccaccacccccaccagcaccacccccacuucggcggcaacuucggcggccccgaccccggcgccagcugccugcacggcggcagacugcugggcuacggcggcgccgccggcggccugggcagccagccccccuucgccgagggcuacgagcacauggccgagagccagggccccgagagcuucggcccccagagacccggcaaccugcccgacuuccacagcagcggcgccagcagccacgccgugcccgcccccugccugccccuggaccagagccccaacagagccgccagcuuccacggccugcccagcagcagcggcagcgacagccacagccuggagcccagaagagugaccaaccagggcgccguggacagccuggaguacaacuaccccggcgaggcccccagcggccacuucgacauguucagccccagcgacagcgagggccagcugccccacuacgccgccggcagacaggugcccggcggcgccuuccccggcgccagcgccaugcccagagccgccggcauggugggccugagcaagaugcacgcccagcccccccagcagcagccccagcagcagcagcagccccagcagcagcagcagcagcacggcguguucuucgagagauucagcggcgccagaaagaugcccgugggccuggagcccagcgugggcagcagacacccccugaugcagcccccccagcaggcccccccccccccccagcagcagcccccccagcagcccccccagcagcagcccccccccccccccggccugcuggugagacagaacagcugcccccccgcccugcccagaccccagcagggcgaggccggcacccccagcggcggccugcaggacggcggccccaugcugcccagccagcacgcccaguucgaguaccccauccacagacuggagaacagaagcaugcaccccuacagcgagcccguguucagcaugcagcacccccccccccagcaggcccccaaccagagacugcagcacuucgacgccccccccuacaugaacguggccaagagacccagauucgacuuccccggcagcgccggcguggacagaugcgccagcuggaacggcagcaugcacaacggcgcccuggacaaccaccugagccccagcgccuaccccggccugcccggcgaguucaccccccccgugcccgacagcuuccccagcggccccccccugcagcaccccgcccccgaccaccagagccugcagcagcagcagcagcagcagcagcagcagcagcagcagcagcagcagcagcagcagcagcagcagcagcagcagcagcagcagagacagaacgccgcccugaugaucaagcagauggccagcagaaaccagcagcagagacugagacagcccaaccuggcccagcugggccaccccggcgacgugggccagggcggccuggugcacggcggccccgugggcggccuggcccagcccaacuucgagagagagggcggcagcaccggcgccggcagacugggcaccuucgagcagcaggccccccaccuggcccaggagagcgccugguucagcggcccccaccccccccccggcgaccugcugcccagaagaaugggcggcagcggccugcccgccgacugcggcccccacgaccccagccuggcccccccccccccccccggcggcagcggcgugcuguucagaggcccccugcaggagcccaugagaaugcccggcgagggccacgugcccgcccugcccagccccggccugcaguucggcggcagccugggcggccugggccagcugcagagccccggcgccggcgugggccugcccagcgccgccagcgagagaagaccccccccccccgacuucgccaccagcgcccugggcggccagcccggcuuccccuucggcgccgccggcagacagagcaccccccacagcggccccggcgugaacagcccccccagcgccggcggcggcggcggcagcagcggcggcggcggcggcggcggcgccuaccccccccagcccgacuuccagcccagccagagaaccagcgccagcaagcugggcgcccugagccugggcagcuucaacaagcccagcagcaaggacaaccuguucggccagagcugccuggccgcccugagcaccgccugccagaacaugaucgccagccugggcgcccccaaccugaacgugaccuucaacaagaagaacccccccgagggcaagagaaagcugagccagaacgagaccgacggcgccgccguggccggcaaccccggcagcgacuacuuccccggcggcaccgcccccggcgcccccggccccggcggccccagcggcaccagcagcagcggcagcaaggccagcggcccccccaacccccccgcccagggcgacggcaccagccugagccccaacuacacccuggagagcaccagcggcaacgacggcaagcccgugagcggcggcggcggcagaggcagaggcagaagaaagagagacagcggccacgugagccccggcaccuucuucgacaaguacagcgccgcccccgacagcggcggcgcccccggcgugagccccggccagcagcaggccagcggcgccgccgugggcggcagcagcgccggcgagaccagaggcgcccccaccccccacgagaaggcccugaccagccccagcuggggcaagggcgccgagcugcugcugggcgaccagcccgaccugaucggcagccuggacggcggcgccaagagcgacagcagcagccccaacgugggcgaguucgccagcgacgaggugagcaccagcuacgccaacgaggacgaggugagcagcagcagcgacaacccccaggcccuggugaaggccagcagaagcccccuggugaccggcagccccaagcugccccccagaggcgugggcgccggcgagcacggccccaaggcccccccccccgcccugggccugggcaucaugagcaacagcaccagcacccccgacagcuacggcggcggcggcggccccggccaccccggcacccccggccuggagcaggugagaacccccaccagcagcagcggcgcccccccccccgacgagauccacccccuggagauccugcaggcccagauccagcugcagagacagcaguucagcaucagcgaggaccagccccugggccugaagggcggcaagaagggcgagugcgccgugggcgccagcggcgcccagaacggcgacagcgagcugggcagcugcugcagcgaggccgugaagagcgccaugagcaccaucgaccuggacagccugauggccgagcacagcgccgccugguacaugcccgccgacaaggcccugguggacagcgccgacgacgacaagacccuggcccccugggagaaggccaagccccagaaccccaacagcaaggaggcccacgaccugcccgccaacaaggccagcgccagccagcccggcagccaccugcagugccugagcgugcacugcaccgacgacgugggcgacgccaaggccagagccagcgugcccaccuggagaagccugcacagcgacaucagcaacagauucggcaccuucguggccgcccugaccuaa

SEQ ID NO: 19951 - RNA, 804 nt, Artificial Sequence
  MNAT1__Homo_sapiens__NP_001171434
auggacgaccagggcugccccagaugcaagaccaccaaguacagaaaccccagccugaagcugauggugaacgugugcggccacacccugugcgagagcugcguggaccugcuguucgugagaggcgccggcaacugccccgagugcggcaccccccugagaaagagcaacuucagagugcagcuguucgaggaccccaccguggacaaggagguggagaucagaaagaaggugcugaagaucuacaacaagagagaggaggacuuccccagccugagagaguacaacgacuuccuggaggagguggaggagaucguguucaaccugaccaacaacguggaccuggacaacaccaagaagaagauggagaucuaccagaaggagaacaaggacgugauccagaagaacaagcugaagcugaccagagagcaggaggagcuggaggaggcccuggagguggagagacaggagaacgagcagagaagacuguucauccagaaggaggagcagcugcagcagauccugaagagaaagaacaagcaggccuuccuggacgagcugggccagcacaucagccuggcccccauccacaagcuggaggaggcccuguacgaguaccagccccugcagaucgagaccuacggcccccacgugcccgagcuggagaugcugggcagacugggcuaccugaaccacgugagagccgccagcccccaggaccuggccggcggcuacaccagcagccuggccugccacagagcccugcaggacgccuucagcggccuguucuggcagcccagcuaa

SEQ ID NO: 19952 - RNA, 1224 nt, Artificial Sequence
  MNDA__Homo_sapiens__NP_002423
auggugaacgaguacaagaagauccugcugcugaagggcuucgagcugauggacgacuaccacuucaccagcaucaagagccugcuggccuacgaccugggccugaccaccaagaugcaggaggaguacaacagaaucaagaucaccgaccugauggagaagaaguuccagggcguggccugccuggacaagcugaucgagcuggccaaggacaugcccagccugaagaaccuggugaacaaccugagaaaggagaagagcaagguggccaagaagaucaagacccaggagaaggcccccgugaagaagaucaaccaggaggaggugggccuggccgcccccgcccccaccgccagaaacaagcugaccagcgaggccagaggcagaauccccguggcccagaagagaaagacccccaacaaggagaagaccgaggccaagagaaacaaggugagccaggagcagagcaagccccccggccccagcggcgccagcaccagcgccgccguggaccaccccccccugccccagaccagcagcagcacccccagcaacaccagcuucacccccaaccaggagacccaggcccagagacagguggacgccagaagaaacgugccccagaacgaccccgugaccgugguggugcugaaggccaccgcccccuucaaguacgagagccccgagaacggcaagagcaccauguuccacgccaccguggccagcaagacccaguacuuccacgugaagguguucgacaucaaccugaaggagaaguucgugagaaagaaggugaucaccaucagcgacuacagcgagugcaagggcgugauggagaucaaggaggccagcagcgugagcgacuucaaccagaacuucgaggugcccaacagaaucaucgagaucgccaacaagacccccaagaucagccagcuguacaagcaggccagcggcaccaugguguacggccuguucaugcugcagaagaagagcgugcacaagaagaacaccaucuacgagauccaggacaacaccggcagcauggacguggugggcagcggcaaguggcacaacaucaagugcgagaagggcgacaagcugagacuguucugccugcagcugagaaccguggacagaaagcugaagcuggugugcggcagccacagcuucaucaaggugaucaaggccaagaagaacaaggagggccccaugaacgugaacuaa

SEQ ID NO: 19953 - RNA, 1488 nt, Artificial Sequence
  MNS1__Homo_sapiens__NP_060835
augggcagcaagagaagaaaccugagcugcagcgagagacaccagaagcugguggacgagaacuacugcaagaagcugcacgugcaggcccugaagaacgugaacagccagaucagaaaccagauggugcagaacgagaacgacaacagagugcagagaaagcaguuccugagacugcugcagaacgagcaguucgagcuggacauggaggaggccauccagaaggccgaggagaacaagagacugaaggagcugcagcugaagcaggaggagaagcuggccauggagcuggccaagcugaagcacgagagccugaaggacgagaagaugagacagcaggugagagagaacagcaucgagcugagagagcuggagaagaagcugaaggccgccuacaugaacaaggagagagccgcccagaucgccgagaaggacgccaucaaguacgagcagaugaagagagacgccgagaucgccaagaccaugauggaggagcacaagagaaucaucaaggaggagaacgccgccgaggacaagagaaacaaggccaaggcccaguacuaccuggaccuggagaagcagcuggaggagcaggagaagaagaagcaggaggccuacgagcagcugcugaaggagaagcugaugaucgacgagaucgugagaaagaucuacgaggaggaccagcuggagaagcagcagaagcuggagaagaugaacgccaugagaagauacaucgaggaguuccagaaggagcaggcccuguggagaaagaagaagagagaggagauggaggaggagaacagaaagaucaucgaguucgccaacaugcagcagcagagagaggaggacagaauggccaaggugcaggagaacgaggagaagagacugcagcugcagaacgcccugacccagaagcuggaggagaugcugagacagagagaggaccuggagcaggugagacaggagcuguaccaggaggagcaggccgagaucuacaagagcaagcugaaggaggaggccgagaagaagcugagaaagcagaaggagaugaagcaggacuucgaggagcagauggcccugaaggagcuggugcugcaggccgccaaggaggaggaggagaacuucagaaagaccaugcuggccaaguucgccgaggacgacagaaucgagcugaugaacgcccagaagcagagaaugaagcagcuggagcacagaagagccguggagaagcugaucgaggagagaagacagcaguuccuggccgacaagcagagagagcuggaggaguggcagcugcagcagagaagacagggcuucaucaacgccaucaucgaggaggagagacugaagcugcugaaggagcacgccaccaaccugcugggcuaccugcccaagggcguguucaagaaggaggacgacaucgaccugcugggcgaggaguucagaaagguguaccagcagagaagcgagaucugcgaggagaaguaa

SEQ ID NO: 19954 - RNA, 1749 nt, Artificial Sequence
  MNT__Homo_sapiens__NP_064706
augagcaucgagacccugcuggaggccgccagauuccuggaguggcaggcccagcagcagcagagagccagagaggagcaggagagacugagacuggagcaggagagagagcaggagcagaagaaggccaacagccuggccagacuggcccacacccugcccguggaggagcccagaauggaggcccccccccugccccugagcccccccgcccccccccccgcccccccccccccccuggccacccccgccccccugaccgugauccccauccccguggugaccaacagcccccagccccugccccccccccccccccugcccgccgccgcccagccccugccccuggcccccagacagcccgcccuggugggcgcccccggccugagcaucaaggagcccgccccccugcccagcagaccccaggugcccacccccgccccccugcugcccgacagcaaggccaccaucccccccaacggcagccccaagccccugcagccccugcccacccccgugcugaccaucgccccccaccccggcgugcagccccagcuggccccccagcagccccccccccccacccugggcacccugaagcuggcccccgccgaggaggugaagagcagcgagcagaagaagagacccggcggcaucggcaccagagaggugcacaacaagcuggagaagaacagaagagcccaccugaaggagugcuucgagacccugaagagaaacauccccaacguggacgacaagaagaccagcaaccugagcgugcugagaaccgcccugagauacauccagagccugaagagaaaggagaaggaguacgagcacgagauggagagacuggccagagagaagaucgccacccagcagagacuggccgagcugaagcacgagcugagccaguggauggacgugcuggagaucgacagagugcugagacagaccggccagcccgaggacgaccaggccagcaccagcaccgccagcgagggcgaggacaacaucgacgaggacauggaggaggacagagccggccugggcccccccaagcugagccacagaccccagcccgagcugcugaagagcacccugcccccccccagcaccacccccgccccccugcccccccacccccacccccacccccacagcguggcccugccccccgcccaccugcccgugcagcagcagcagccccagcagaagaccccccugcccgcccccccccccccccccgccgcccccgcccagacccuggugcccgcccccgcccaccugguggccaccgccggcggcggcagcaccgugaucgcccacaccgccaccacccacgccagcgugauccagaccgugaaccacgugcugcagggccccggcggcaagcacaucgcccacaucgcccccagcgcccccagccccgccgugcagcuggcccccgccaccccccccaucggccacaucaccgugcaccccgccacccugaaccacguggcccaccugggcagccagcugccccuguacccccagcccguggccgugagccacaucgcccacacccugagccaccagcaggugaacggcaccgccggccugggcccccccgccaccgugauggccaagcccgccgugggcgcccagguggugcaccacccccagcuggugggccagaccgugcugaaccccgugaccauggugaccaugcccagcuuccccgugagcacccugaagcuggccuaa

SEQ ID NO: 19955 - RNA, 570 nt, Artificial Sequence
  MNX1__Homo_sapiens__NP_001158727
augggcggccugagcaccgugggcgccugccccggcauccugggcgcccagcaggcccaggcccagagcaaccugcugggcaagugcagaagacccagaaccgccuucaccagccagcagcugcuggagcuggagcaccaguucaagcugaacaaguaccugagcagacccaagagauucgagguggccaccagccugaugcugaccgagacccaggugaagaucugguuccagaacagaagaaugaaguggaagagaagcaagaaggccaaggagcaggccgcccaggaggccgagaagcagaagggcggcggcggcggcgccggcaagggcggcgccgaggagcccggcgccgaggagcugcugggcccccccgcccccggcgacaagggcagcggcagaagacugagagaccugagagacagcgaccccgaggaggacgaggacgaggacgacgaggaccacuuccccuacagcaacggcgccagcgugcacgccgccagcagcgacugcagcagcgaggacgacagccccccccccagacccagccaccagcccgccccccaguaa

SEQ ID NO: 19956 - RNA, 1056 nt, Artificial Sequence
  MOAP1__Homo_sapiens__NP_071434
augacccugagacugcuggaggacuggugcagaggcauggacaugaaccccagaaaggcccugcugaucgccggcaucagccagagcugcagcguggccgagaucgaggaggcccugcaggccggccuggccccccugggcgaguacagacugcugggcagaauguucagaagagacgagaacagaaagguggcccuggugggccugaccgccgagaccagccacgcccuggugcccaaggagauccccggcaagggcggcaucuggagagugaucuucaagccccccgaccccgacaacaccuuccugagcagacugaacgaguuccuggccggcgagggcaugaccgugggcgagcugagcagagcccugggccacgagaacggcagccuggaccccgagcagggcaugauccccgagaugugggcccccaugcuggcccaggcccuggaggcccugcagcccgcccugcagugccugaaguacaagaagcugagaguguucagcggcagagagagccccgagcccggcgaggaggaguucggcagauggauguuccacaccacccagaugaucaaggccuggcaggugcccgacguggagaagagaagaagacugcuggagagccugagaggccccgcccuggacgugaucagagugcugaagaucaacaacccccugaucaccguggacgagugccugcaggcccuggaggagguguucggcgugaccgacaaccccagagagcugcaggugaaguaccugaccaccuaccagaaggacgaggagaagcugagcgccuacgugcugagacuggagccccugcugcagaagcuggugcagagaggcgccaucgagagagacgccgugaaccaggccagacuggaccaggugaucgccggcgccgugcacaagaccaucagaagagagcugaaccugcccgaggacggccccgcccccggcuuccugcagcugcuggugcugaucaaggacuacgaggccgccgaggaggaggaggcccugcugcaggccauccuggagggcaacuucaccuaa

SEQ ID NO: 19957 - RNA, 651 nt, Artificial Sequence
  MOB1A__Homo_sapiens__NP_060691
augagcuuccuguucagcagcagaagcagcaagaccuucaagcccaagaagaacauccccgagggcagccaccaguacgagcugcugaagcacgccgaggccacccugggcagcggcaaccugagacaggccgugaugcugcccgagggcgaggaccugaacgaguggaucgccgugaacaccguggacuucuucaaccagaucaacaugcuguacggcaccaucaccgaguucugcaccgaggccagcugccccgugaugagcgccggccccagauacgaguaccacugggccgacggcaccaacaucaagaagcccaucaagugcagcgcccccaaguacaucgacuaccugaugaccugggugcaggaccagcuggacgacgagacccuguuccccagcaagaucggcgugcccuuccccaagaacuucaugagcguggccaagaccauccugaagagacuguucagaguguacgcccacaucuaccaccagcacuucgacagcgugaugcagcugcaggaggaggcccaccugaacaccagcuucaagcacuucaucuucuucgugcaggaguucaaccugaucgacagaagagagcuggccccccugcaggagcugaucgagaagcugggcagcaaggacagauaa

SEQ ID NO: 19958 - RNA, 651 nt, Artificial Sequence
  MOB1B__Homo_sapiens__NP_775739
augagcuuccuguucggcagcagaagcagcaagaccuucaagcccaagaagaacauccccgagggcagccaccaguacgagcugcugaagcacgccgaggccacccugggcagcggcaaccugagaauggccgugaugcugcccgagggcgaggaccugaacgaguggguggccgugaacaccguggacuucuucaaccagaucaacaugcuguacggcaccaucaccgacuucugcaccgaggagagcugccccgugaugagcgccggccccaaguacgaguaccacugggccgacggcaccaacaucaagaagcccaucaagugcagcgcccccaaguacaucgacuaccugaugaccugggugcaggaccagcuggacgacgagacccuguuccccagcaagaucggcgugcccuuccccaagaacuucaugagcguggccaagaccauccugaagagacuguucagaguguacgcccacaucuaccaccagcacuucgaccccgugauccagcugcaggaggaggcccaccugaacaccagcuucaagcacuucaucuucuucgugcaggaguucaaccugaucgacagaagagagcuggccccccugcaggagcugaucgagaagcugaccagcaaggacagauaa

SEQ ID NO: 19959 - RNA, 807 nt, Artificial Sequence
  MOB2__Homo_sapiens__NP_001165694
augcugggcgaccacugcagccugcccgaggaccaggccagacccggccagagccugcagagcggccugugcugcaagauggugcugcaggccgugagcaaggugcugagaaagagcaaggccaagcccaacggcaagaagcccgccgccgaggagagaaaggccuaccuggagcccgagcacaccaaggccagaaucaccgacuuccaguucaaggagcugguggugcugcccagagagaucgaccugaacgaguggcuggccagcaacaccaccaccuucuuccaccacaucaaccugcaguacagcaccaucagcgaguucugcaccggcgagaccugccagaccauggccgugugcaacacccaguacuacugguacgacgagagaggcaagaaggugaagugcaccgccccccaguacguggacuucgugaugagcagcgugcagaagcuggugaccgacgaggacguguuccccaccaaguacggcagagaguuccccagcagcuucgagagccuggugagaaagaucugcagacaccuguuccacgugcuggcccacaucuacugggcccacuucaaggagacccuggcccuggagcugcacggccaccugaacacccuguacgugcacuucauccuguucgccagagaguucaaccugcuggaccccaaggagaccgccaucauggacgaccugaccgaggugcugugcagcggcgccggcggcgugcacagcggcggcagcggcgacggcgccggcagcggcggccccggcgcccagaaccacgugaaggagagauaa

SEQ ID NO: 19960 - RNA, 651 nt, Artificial Sequence
  MOB3B__Homo_sapiens__NP_079037
augagcaucgcccugaagcagguguucaacaaggacaagaccuucagacccaagagaaaguucgagcccggcacccagagauucgagcugcacaagagagcccaggccagccugaacagcggcguggaccugaaggccgccgugcagcugcccagcggcgaggaccagaacgacuggguggccgugcacgugguggacuucuucaacagaaucaaccugaucuacggcaccaucugcgaguucugcaccgagagaaccugccccgugaugagcggcggccccaaguacgaguacagauggcaggacgaccugaaguacaagaagcccaccgcccugcccgccccccaguacaugaaccugcugauggacuggaucgaggugcagaucaacaacgaggagaucuuccccaccugcgugggcgugcccuuccccaagaacuuccugcagaucugcaagaagauccugugcagacuguucagaguguucgugcacguguacauccaccacuucgacagagugaucgugaugggcgccgaggcccacgugaacaccugcuacaagcacuucuacuacuucgugaccgagaugaaccugaucgacagaaaggagcuggagccccugaaggagaugaccagcagaaugugccacuaa

SEQ ID NO: 19961 - RNA, 615 nt, Artificial Sequence
  MOB4__Homo_sapiens__NP_001094289
auggugauggccgagggcaccgccgugcugagaagaaacagacccggcaccaaggcccaguacauccagcagaacaucagagccgacugcagcaacaucgacaagauccuggagccccccgagggccaggacgagggcguguggaaguacgagcaccugagacaguucugccuggagcugaacggccuggccgugaagcugcagagcgagugccaccccgacaccugcacccagaugaccgccaccgagcaguggaucuuccugugcgccgcccacaagacccccaaggagugccccgccaucgacuacaccagacacacccuggacggcgccgccugccugcugaacagcaacaaguacuuccccagcagagugagcaucaaggagagcagcguggccaagcugggcagcgugugcagaagaaucuacagaaucuucagccacgccuacuuccaccacagacagaucuucgacgaguacgagaacgagaccuuccugugccacagauucaccaaguucgugaugaaguacaaccugaugagcaaggacaaccugaucgugcccauccuggaggaggaggugcagaacagcgugagcggcgagagcgaggccuaa

SEQ ID NO: 19962 - RNA, 621 nt, Artificial Sequence
  MOBP__Homo_sapiens__NP_001265251
augagccagaagcccgccaaggagggccccagacugagcaagaaccagaaguacagcgagcacuucagcauccacugcugcccccccuucaccuuccugaacagcaagaaggagaucguggacagaaaguacagcaucugcaagagcggcugcuucuaccagaagaaggaggaggacuggaucugcugcgccugccagaagaccagcagcugccagagaagacugagcagcagaggcgagcccuggcugcccccccccgccagcuucggcccccugagaaccagcagaagagccaagagcccccagagacccaagcagcagcccgccgccccccccgccguggugagagcccccgccaagcccagaagcccccccagaagcgagagacagcccagaagcccccccagaagcgagagacagcccagaagcccccccagaagcgagagacagcccagaagcccccccagaagcgagagacagcccagacccagacccgaggugagacccccccccgccaagcagagacccccccagaagagcaagcagcagcccagaagcagcccccugagaggccccggcgccagcagaggcggcagccccgugaaggccagcagauucuaa

SEQ ID NO: 19963 - RNA, 2667 nt, Artificial Sequence
  MOCOS__Homo_sapiens__NP_060417
auggccggcgccgccgccgagagcggcagagagcuguggaccuucgccggcagcagagaccccagcgcccccagacuggccuacggcuacggccccggcagccugagagagcugagagccagagaguucagcagacuggccggcaccguguaccuggaccacgccggcgccacccuguucagccagagccagcuggagagcuucaccagcgaccugauggagaacaccuacggcaacccccacagccagaacaucagcagcaagcugacccacgacaccguggagcaggugagauacagaauccuggcccacuuccacaccaccgccgaggacuacaccgugaucuucaccgccggcagcaccgccgcccugaagcugguggccgaggccuuccccugggugagccagggccccgagagcagcggcagcagauucugcuaccugaccgacagccacaccagcguggugggcaugagaaacgugaccauggccaucaacgugaucagcacccccgugagacccgaggaccuguggagcgccgaggagagaagcgccagcgccagcaaccccgacugccagcugccccaccuguucugcuaccccgcccagagcaacuucagcggcgugagauacccccugagcuggaucgaggaggugaagagcggcagacugcaccccgugagcacccccggcaagugguucgugcugcuggacgccgccagcuacgugagcaccagcccccuggaccugagcgcccaccaggccgacuucgugcccaucagcuucuacaagaucuucggcuuccccaccggccugggcgcccugcuggugcacaacagagccgccccccugcugagaaagaccuacuucggcggcggcaccgccagcgccuaccuggccggcgaggacuucuacauccccagacagagcguggcccagagauucgaggacggcaccaucagcuuccuggacgugaucgcccugaagcacggcuucgacacccuggagagacugaccggcggcauggagaacaucaagcagcacaccuucacccuggcccaguacaccuacguggcccugagcagccugcaguaccccaacggcgcccccguggugagaaucuacagcgacagcgaguucagcagccccgaggugcagggccccaucaucaacuucaacgugcuggacgacaagggcaacaucaucggcuacagccagguggacaagauggccagccuguacaacauccaccugagaaccggcugcuucugcaacaccggcgccugccagagacaccugggcaucagcaacgagauggugagaaagcacuuccaggccggccacgugugcggcgacaacauggaccugaucgacggccagcccaccggcagcgugagaaucagcuucggcuacaugagcacccuggacgacgugcaggccuuccugagauucaucaucgacaccagacugcacagcagcggcgacuggcccgugccccaggcccacgccgacaccggcgagaccggcgcccccagcgccgacagccaggccgacgugauccccgccgugaugggcagaagaagccugagcccccaggaggacgcccugaccggcagcagaguguggaacaacagcagcaccgugaacgccgugcccguggccccccccgugugcgacguggccagaacccagcccacccccagcgagaaggccgccggcgugcuggagggcgcccugggcccccacguggugaccaaccuguaccuguaccccaucaagagcugcgccgccuucgaggugaccagauggcccgugggcaaccagggccugcuguacgacagaagcuggaugguggugaaccacaacggcgugugccugagccagaagcaggagcccagacugugccugauccagcccuucaucgaccugagacagagaaucauggugaucaaggccaagggcauggagcccaucgaggugccccuggaggagaacagcgagagaacccagaucagacagagcagagugugcgccgacagagugagcaccuacgacugcggcgagaagaucagcagcuggcugagcaccuucuucggcagacccugccaccugaucaagcagagcagcaacagccagagaaacgccaagaagaagcacggcaaggaccagcugcccggcaccauggccacccugagccuggugaacgaggcccaguaccugcugaucaacaccagcagcauccuggagcugcacagacagcugaacaccagcgacgagaacggcaaggaggagcuguucagccugaaggaccugagccugagauucagagccaacaucaucaucaacggcaagagagccuucgaggaggagaagugggacgagaucagcaucggcagccugagauuccaggugcugggccccugccacagaugccagaugaucugcaucgaccagcagaccggccagagaaaccagcacguguuccagaagcugagcgagagcagagagaccaaggugaacuucggcauguaccugaugcacgccagccuggaccugagcagccccugcuuccugagcgugggcagccaggugcugcccgugcugaaggagaacguggagggccacgaccugcccgccagcgagaagcaccaggacgugaccagcuaa

SEQ ID NO: 19964 - RNA, 1158 nt, Artificial Sequence
  MOCS1__Homo_sapiens__NP_001068566
auggccgccagaccccugagcagaaugcugagaagacugcugagaagcagcgccagaagcugcagcagcggcgcccccgugacccagcccugccccggcgagagcgccagagccgccagcgaggaggugagcagaagaagacaguuccugagagagcacgccgcccccuucagcgccuuccugaccgacagcuucggcagacagcacagcuaccugagaaucagccugaccgagaagugcaaccugagaugccaguacugcaugcccgaggagggcgugccccugacccccaaggccaaccugcugaccaccgaggagauccugacccuggccagacuguucgugaaggagggcaucgacaagaucagacugaccggcggcgagccccugaucagacccgacgugguggacaucguggcccagcugcagagacuggagggccugagaaccaucggcgugaccaccaacggcaucaaccuggccagacugcugccccagcugcagaaggccggccugagcgccaucaacaucagccuggacacccuggugcccgccaaguucgaguucaucgugagaagaaagggcuuccacaaggugauggagggcauccacaaggccaucgagcugggcuacaaccccgugaaggugaacugcguggugaugagaggccugaacgaggacgagcugcuggacuucgccgcccugaccgagggccugccccuggacgugagauucaucgaguacaugcccuucgacggcaacaaguggaacuucaagaagauggugagcuacaaggagaugcuggacaccgugagacagcaguggcccgagcuggagaaggugcccgaggaggagagcagcaccgccaaggccuucaagauccccggcuuccagggccagaucagcuucaucaccagcaugagcgagcacuucugcggcaccugcaacagacugagaaucaccgccgacggcaaccugaaggugugccuguucggcaacagcgaggugagccugagagaccaccugagagccggcgccagcgagcaggagcugcugagaaucaucggcgccgccgugggcagaaagaagagacagcacgccggcauguucagcaucagccagaugaagaacagacccaugauccugaucggcggcuaa

SEQ ID NO: 19965 - RNA, 567 nt, Artificial Sequence
  MOCS2__Homo_sapiens__NP_004522
augagcagccuggagaucagcagcagcugcuucagccuggagaccaagcugccccugagccccccccugguggaggacagcgccuucgagcccagcagaaaggacauggacgagguggaggagaagagcaaggacgugaucaacuucaccgccgagaagcugagcguggacgaggugagccagcuggugaucagcccccugugcggcgccaucagccuguucgugggcaccaccagaaacaacuucgagggcaagaaggugaucagccuggaguacgaggccuaccugcccauggccgagaacgaggugagaaagaucugcagcgacaucagacagaaguggcccgugaagcacaucgccguguuccacagacugggccuggugcccgugagcgaggccagcaucaucaucgccgugagcagcgcccacagagccgccagccuggaggccgugagcuacgccaucgacacccugaaggccaaggugcccaucuggaagaaggagaucuacgaggagagcagcaccuggaagggcaacaaggagugcuucugggccagcaacagcuaa

SEQ ID NO: 19966 - RNA, 1008 nt, Artificial Sequence
  MOGAT1__Homo_sapiens__NP_477513
augaagguggaguucgccccccugaacauccagcuggccagaagacugcagaccguggccgugcugcagugggugcugaaguaccugcugcugggccccaugagcaucggcaucaccgugaugcugaucauccacaacuaccuguuccuguacauccccuaccugauguggcuguacuucgacuggcacacccccgagagaggcggcagaagaagcagcuggaucaagaacuggacccuguggaagcacuucaaggacuacuuccccauccaccugaucaagacccaggaccuggaccccagccacaacuacaucuucggcuuccacccccacggcaucauggccgugggcgccuucggcaacuucagcgugaacuacagcgacuucaaggaccuguuccccggcuucaccagcuaccugcacgugcugccccugugguucuggugccccguguucagagaguacgugaugagcgugggccuggugagcgugagcaagaagagcgugagcuacauggugagcaaggagggcggcggcaacaucagcgugaucgugcugggcggcgccaaggagagccuggacgcccaccccggcaaguucacccuguucaucagacagagaaagggcuucgugaagaucgcccugacccacggcgccagccuggugcccguggugagcuucggcgagaacgagcuguucaagcagaccgacaaccccgagggcagcuggaucagaaccgugcagaacaagcugcagaagaucaugggcuucgcccugccccuguuccacgccagaggcguguuccaguacaacuucggccugaugaccuacagaaaggccauccacaccguggugggcagacccauccccgugagacagacccugaaccccacccaggagcagaucgaggagcugcaccagaccuacauggaggagcugagaaagcuguucgaggagcacaagggcaaguacggcauccccgagcacgagacccuggugcugaaguaa

SEQ ID NO: 19967 - RNA, 1005 nt, Artificial Sequence
  MOGAT2__Homo_sapiens__NP_079374
augguggaguucgccccccuguucaugcccugggagagaagacugcagacccuggccgugcugcaguucguguucagcuuccuggcccuggccgagaucugcaccgugggcuucaucgcccugcuguucaccagauucuggcugcugaccgugcuguacgccgccuggugguaccuggacagagacaagcccagacagggcggcagacacauccaggccaucagaugcuggaccaucuggaaguacaugaaggacuacuuccccaucagccuggugaagaccgccgagcuggaccccagcagaaacuacaucgccggcuuccacccccacggcgugcuggccgugggcgccuucgccaaccugugcaccgagagcaccggcuucagcagcaucuuccccggcaucagaccccaccugaugaugcugacccugugguucagagcccccuucuucagagacuacaucaugagcgccggccuggugaccagcgagaaggagagcgccgcccacauccugaacagaaagggcggcggcaaccugcugggcaucaucgugggcggcgcccaggaggcccuggacgccagacccggcagcuucacccugcugcugagaaacagaaagggcuucgugagacuggcccugacccacggcgccccccuggugcccaucuucagcuucggcgagaacgaccuguucgaccagauccccaacagcagcggcagcuggcugagauacauccagaacagacugcagaagaucaugggcaucagccugccccuguuccacggcagaggcguguuccaguacagcuucggccugauccccuacagaagacccaucaccaccguggugggcaagcccaucgaggugcagaagacccugcaccccagcgaggaggaggugaaccagcugcaccagagauacaucaaggagcugugcaaccuguucgaggcccacaagcugaaguucaacauccccgccgaccagcaccuggaguucugcuaa

SEQ ID NO: 19968 - RNA, 846 nt, Artificial Sequence
  MOGAT3__Homo_sapiens__NP_001274076
augggcguggccaccacccugcagccccccaccaccagcaagacccugcagaagcagcaccuggaggccgugggcgccuaccaguacgugcugaccuuccuguucaugggccccuucuucagccugcugguguucgugcugcuguucaccagccuguggcccuucagcguguucuaccugguguggcuguacguggacugggacacccccaaccagggcggcagaagaagcgaguggaucagaaacagagccaucuggagacagcugagagacuacuaccccgugaagcuggugaagaccgccgagcugccccccgacagaaacuacgugcugggcgcccacccccacggcaucaugugcaccggcuuccugugcaacuucagcaccgagagcaacggcuucagccagcuguuccccggccugagacccuggcuggccgugcuggccggccuguucuaccugcccguguacagagacuacaucaugagcuucggccugugccccgugagcagacagagccuggacuucauccugagccagccccagcugggccaggccguggugaucauggugggcggcgcccacgaggcccuguacagcgugcccggcgagcacugccugacccugcagaagagaaagggcuucgugagacuggcccugagacacggcggccccccccaccccagaccccccgccccccccccccacagaggcggcagccagagccugagcagaccccugcacgacggccccggcgccgcccugagaggcgcccagggcaagcuguggggccccagauuccaccugccccaccugcaccugggccuggccgccgccuucagauaa

SEQ ID NO: 19969 - RNA, 675 nt, Artificial Sequence
  MOG__Homo_sapiens__NP_001008229
auggccagccugagcagacccagccugcccagcugccugugcagcuuccugcugcugcugcugcugcaggugagcagcagcuacgccggccaguucagagugaucggccccagacaccccaucagagcccuggugggcgacgagguggagcugcccugcagaaucagccccggcaagaacgccaccggcauggaggugggcugguacagaccccccuucagcagaguggugcaccuguacagaaacggcaaggaccaggacggcgaccaggcccccgaguacagaggcagaaccgagcugcugaaggacgccaucggcgagggcaaggugacccugagaaucagaaacgugagauucagcgacgagggcggcuucaccugcuucuucagagaccacagcuaccaggaggaggccgccauggagcugaagguggaggaccccuucuacugggugagccccggcgugcuggugcugcuggccgugcugcccgugcugcugcugcagaucaccgugggccugaucuuccugugccugcaguacagacugagaggcaagcugagagccgagaucgagaaccugcacagaaccuucgagagcuucggcgugcugggcccccaggugaaggagcccaagaagaccggccaguuccuggaggagcugagaaaccccuucuaa

SEQ ID NO: 19970 - RNA, 2196 nt, Artificial Sequence
  MOGS__Homo_sapiens__NP_001139630
augaagaccagaagccccaagccccugcugaccggccugaugugggcccagcagggcaccacccccggcacccccaagcugagacacaccugcgagcagggcgacggcgugggccccuacggcugggaguuccacgacggccugagcuucggcagacagcacauccaggacggcgcccugagacugaccaccgaguucgugaagagacccggcggccagcacggcggcgacuggagcuggagagugaccguggagccccaggacagcggcaccagcgcccugccccuggugagccuguucuucuacguggugaccgacggcaaggaggugcugcugcccgaggugggcgccaagggccagcugaaguucaucagcggccacaccagcgagcugggcgacuucagauucacccugcugccccccaccagccccggcgacaccgcccccaaguacggcagcuacaacguguucuggaccagcaaccccggccugccccugcugaccgagauggugaagagcagacugaacagcugguuccagcacagaccccccggcgccccccccgagagauaccugggccugcccggcagccugaagugggaggacagaggccccagcggccagggccagggccaguuccugauccagcaggugacccugaagauccccaucagcaucgaguucguguucgagagcggcagcgcccaggccggcggcaaccaggcccugcccagacuggccggcagccugcugacccaggcccuggagagccacgccgagggcuucagagagagauucgagaagaccuuccagcugaaggagaagggccugagcagcggcgagcaggugcugggccaggccgcccugagcggccugcugggcggcaucggcuacuucuacggccagggccuggugcugcccgacaucggcguggagggcagcgagcagaagguggaccccgcccuguucccccccgugccccuguucaccgccgugcccagcagaagcuucuuccccagaggcuuccugugggacgagggcuuccaccagcugguggugcagagaugggaccccagccugaccagagaggcccugggccacuggcugggccugcugaacgccgacggcuggaucggcagagagcagauccugggcgacgaggccagagccagagugccccccgaguuccuggugcagagagccgugcacgccaacccccccacccugcugcugcccguggcccacaugcuggaggugggcgaccccgacgaccuggccuuccugagaaaggcccugcccagacugcacgccugguucagcuggcugcaccagagccaggccggcccccugccccugagcuacagauggagaggcagagaccccgcccugcccacccugcugaaccccaagacccugcccagcggccuggacgacuaccccagagccagccaccccagcgugaccgagagacaccuggaccugagaugcuggguggcccugggcgccagagugcugaccagacuggccgagcaccugggcgaggccgagguggccgccgagcugggcccccuggccgccagccuggaggccgccgagagccuggacgagcugcacugggcccccgagcugggcguguucgccgacuucggcaaccacaccaaggccgugcagcugaagcccagacccccccagggccuggugagaguggugggcagaccccagccccagcugcaguacguggacgcccugggcuacgugagccuguucccccugcugcugagacugcuggaccccaccagcagcagacugggcccccugcuggacauccuggccgacagcagacaccuguggagccccuucggccugagaagccuggccgccagcagcagcuucuacggccagagaaacagcgagcacgacccccccuacuggagaggcgccguguggcugaacgugaacuaccuggcccugggcgcccugcaccacuacggccaccuggagggcccccaccaggccagagccgccaagcugcacggcgagcugagagccaacguggugggcaacguguggagacaguaccaggccaccggcuuccugugggagcaguacagcgacagagacggcagaggcaugggcugcagacccuuccacggcuggaccagccuggugcugcuggccauggccgaggacuacuaa

SEQ ID NO: 19971 - RNA, 1260 nt, Artificial Sequence
  MOK__Homo_sapiens__NP_055041
augaagaacuacaaggccaucggcaagaucggcgagggcaccuucagcgaggugaugaagaugcagagccugagagacggcaacuacuacgccugcaagcagaugaagcagagauucgagagcaucgagcaggugaacaaccugagagagauccaggcccugagaagacugaacccccaccccaacauccugaugcugcacgaggugguguucgacagaaagagcggcagccuggcccugaucugcgagcugauggacaugaacaucuacgagcugaucagaggcagaagauacccccugagcgagaagaagaucaugcacuacauguaccagcugugcaagagccuggaccacauccacagaaacggcaucuuccacagagacgugaagcccgagaacauccugaucaagcaggacgugcugaagcugggcgacuucggcagcugcagaagcguguacagcaagcagcccuacaccgaguacaucagcaccagaugguacagagcccccgagugccugcugaccgacggcuucuacaccuacaagauggaccuguggagcgccggcugcguguucuacgagaucgccagccugcagccccuguuccccggcgugaacgagcuggaccagaucagcaagauccacgacgugaucggcacccccgcccagaagauccugaccaaguucaagcagagcagagccaugaacuucgacuuccccuucaagaagggcagcggcaucccccugcugaccaccaaccugagcccccagugccugagccugcugcacgccaugguggccuacgaccccgacgagagaaucgccgcccaccaggcccugcagcaccccuacuuccaggagcagagaaagaccgagaagagagcccugggcagccacagaaaggccggcuuccccgagcaccccguggcccccgagccccugagcaacagcugccagaucagcaaggagggcagaaagcagaagcagagccugaagcaggaggaggacagacccaagagaagaggccccgccuacgugauggagcugcccaagcugaagcugagcggcguggugagacugagcagcuacagcagccccacccugcagagcgugcugggcagcggcaccaacggcagagugcccgugcugagaccccugaagugcauccccgccagcaagaagaccgacccccagaaggaccugaagcccgccccccagcagugcagacugcccaccaucgugagaaagggcggcagauaa

SEQ ID NO: 19972 - RNA, 1473 nt, Artificial Sequence
  MON1A__Homo_sapiens__NP_001135973
augcaccccggcggcggccccagcagagccgagagacuggagcugggccugggcagagagagacccgccaaggccaucuuccugcacagaagacccggcgagggcggcggcagagagagaugccugagaugcggccacgugugcgugagaagaggccccggccccagagaggccgugcccagcggcagacccagacccgacacccugaccccccccugggugagacagagagccgugaccggcaccuucugcgccagcuggaccccccugagaaacagaagagcccagagaauggccaccgacaugcagagaaagagaagcagcgagugccuggacggcacccugacccccagcgacggccagagcauggagagagccgagagccccacccccggcauggcccagggcauggagcccgacggcuacaaggugguguucgugagaagaagcccccuggugcugguggccguggccagaaccagacagagcgcccaggagcuggcccaggagcugcuguacaucuacuaccagauccugagccugcugaccggcgcccagcugagccacaucuuccagcagaagcagaacuacgaccugagaagacugcugagcggcagcgagagaaucaccgacaaccugcugcagcugauggccagagaccccagcuuccugaugggcgccgccagaugccugccccuggccgccgccgugagagacaccgugagcgccagccugcagcaggccagagccagaagccugguguucagcauccugcuggccagaaaccagcugguggcccuggugagaagaaaggaccaguuccugcaccccaucgaccugcaccugcuguucaaccugaucagcagcagcagcagcuucagagagggcgaggccuggacccccgugugccugcccaaguucaacgccgccggcuucuuccacgcccacaucagcuaccuggagcccgacaccgaccugugccugcugcuggugagcaccgacagagaggacuucuucgccgugagcgacugcagaagaagauuccaggagagacugagaaagagaggcgcccaccuggcccugagagaggcccugagaacccccuacuacagcguggcccaggugggcauccccgaccugagacacuuccuguacaagagcaagagcagcggccuguucaccagccccgagaucgaggcccccuacaccagcgaggaggagcaggagagacugcugggccuguaccaguaccugcacagcagagcccacaacgccagcagaccccugaagaccaucuacuacaccggccccaacgagaaccugcuggccugggugaccggcgccuucgagcuguacaugugcuacagcccccugggcaccaaggccagcgccgugagcgccauccacaagcugaugagauggaucagaaaggaggaggacagacuguucauccugaccccccugaccuacuaa

SEQ ID NO: 19973 - RNA, 1317 nt, Artificial Sequence
  MON1B__Homo_sapiens__NP_001273568
auggaggugggcggcgacaccgccgcccccgcccccggcggcgccgaggaccuggaggacacccaguuccccagcgaggaggccagagagggcggcggcgugcacgccgugccccccgaccccgaggacgagggccuggaggagaccgaggaccacaagcugguguuccugcagcagggcccccugcugcugguggccaugagcagaaccagccagagcgccgcccagcugagaggcgagcugcuggccgugcacgcccagaucgugagcacccugaccagagccagcguggccagaaucuucgcccacaagcagaacuacgaccugagaagacugcuggccggcagcgagagaacccuggacagacugcuggacagcauggagcaggaccccggcgcccugcugcugggcgccgugagaugcgugccccuggccagaccccugagagacgcccugggcgcccugcugagaagaugcaccgcccccggccuggcccugagcgugcuggccgugggcggcagacugaucaccgccgcccaggagagaaacgugcuggccgagugcagacuggaccccgccgaccugcagcugcugcuggacugggugggcgcccccgccuucgccgccggcgaggccugggcccccgugugccugcccagauucaaccccgacggcuucuucuacgccuacguggccagacuggacgccaugcccgugugccugcugcugcugggcacccagagagaggccuuccacgccauggccgccugcagaagacugguggaggacggcaugcacgcccugggcgccaugagagcccugggcgaggccgccagcuucagcaacgccagcagcgccagcgcccccgccuacagcgugcaggccgugggcgcccccggccugagacacuuccuguacaagccccuggacauccccgaccaccacagacagcugccccaguucaccagccccgagcuggaggcccccuacagcagagaggaggagagacagagacugagcgaccuguaccacagacugcacgccagacugcacagcaccagcagaccccugagacugaucuaccacguggccgagaaggagacccugcuggccugggugaccagcaaguucgagcuguacaccugccugagcccccuggugaccaaggccggcgccauccugguggugaccaagcugcugagaugggugaagaaggaggaggacagacuguucaucagauacccccccaaguacagcaccccccccgccaccagcaccgaccaggccgcccacaacggccuguucaccggccuguaa

SEQ ID NO: 19974 - RNA, 5028 nt, Artificial Sequence
  MON2__Homo_sapiens__NP_001265398
augagcggcaccagcagccccgaggccgugaagaagcugcuggagaacaugcagagcgaccugagagcccugagccuggagugcaagaagaaguucccccccgugaaggaggccgccgagagcggcaucaucaaggugaagaccaucgccgccagaaacaccgagauccuggccgcccugaaggagaacagcagcgagguggugcagcccuuccugaugggcugcggcaccaaggagcccaagaucacccagcugugccuggccgccauccagagacugaugagccacgagguggugagcgagaccgccgccggcaacaucaucaacaugcuguggcagcugauggagaacagccuggaggagcugaagcugcugcagaccgugcuggugcugcugaccaccaacaccguggugcacgacgaggcccugagcaaggccaucgugcugugcuucagacugcacuucaccaaggacaacaucaccaacaacaccgccgccgccaccgugagacagguggugaccgugguguucgagagaaugguggccgaggacgagagacacagagacaucaucgagcagcccgugcuggugcagggcaacagcaacagaagaagcgugagcacccugaagcccugcgccaaggacgccuacaugcuguuccaggaccugugccagcuggugaacgccgacgcccccuacuggcuggugggcaugaccgagaugaccagaaccuucggccuggagcugcuggagagcgugcugaacgacuucccccagguguuccugcagcaccaggaguucagcuuccugcugaaggagagagugugcccccuggugaucaagcuguucagccccaacaucaaguucagacagggcagcagcaccagcagcagccccgcccccguggagaagcccuacuuccccaucugcaugagacugcugagaguggugagcgugcugaucaagcaguucuacagccugcuggugaccgagugcgagaucuuccugagccugcuggugaaguuccuggacgccgacaagccccaguggcugagagccguggccguggagagcauccacagauucugcgugcagccccagcugcugagaagcuucugccagagcuacgacaugaagcagcacagcaccaagguguucagagacaucgugaacgcccugggcagcuucauccagagccuguuccuggugccccccaccggcaaccccgccaccagcaaccaggccggcaacaacaaccugggcggcagcgugagcgcccccgccaacagcggcauggugggcaucggcggcggcgugacccugcugcccgccuucgaguacagaggcaccuggauccccauccugaccaucaccgugcagggcagcgccaaggccaccuaccuggagaugcuggacaagguggagccccccaccauccccgagggcuacgccaugagcguggccuuccacugccugcuggaccuggugagaggcaucaccagcaugaucgagggcgagcugggcgagcuggagaccgagugccagaccaccaccgaggagggcagcagccccacccagagcaccgagcagcaggaccugcagagcaccagcgaccagauggacaaggagaucgugagcagagccgugugggaggagauggugaacgccugcuggugcggccugcuggccgcccugagccugcugcuggacgccagcaccgacgaggccgccaccgagaacauccugaaggccgagcugaccauggccgcccugugcggcagacugggccuggugaccagcagagacgccuucaucaccgccaucugcaagggcagccugcccccccacuacgcccugaccgugcugaacaccaccaccgccgccacccugagcaacaagagcuacagcgugcagggccagagcgugaugaugaucagccccagcagcgagagccaccagcaggugguggccgugggccagccccuggccgugcagccccagggcaccgugaugcugaccagcaagaacauccagugcaugagaacccugcugaaccuggcccacugccacggcgccgugcugggcaccagcuggcagcuggugcuggccacccugcagcaccugguguggauccugggccugaagcccagcagcggcggcgcccugaagcccggcagagccguggagggccccagcaccgugcugaccaccgccgugaugaccgaccugcccgugaucagcaacauccugagcagacuguucgagagcagccaguaccuggacgacgugagccugcaccaccugaucaacgcccugugcagccugagccuggaggccauggacauggccuacggcaacaacaaggagcccagccuguucgccguggccaagcugcuggagaccggccuggugaacaugcacagaaucgagauccuguggagaccccugaccggccaccugcuggaggugugccagcaccccaacagcagaaugagagaguggggcgccgaggcccugaccagccugaucaaggccggccugaccuucaaccacgaccccccccugagccagaaccagagacugcagcugcugcugcugaacccccugaaggagaugagcaacaucaaccaccccgacaucagacugaagcagcuggagugcgugcugcagauccugcagagccagggcgacagccugggccccggcuggccccuggugcugggcgugaugggcgccaucagaaacgaccagggcgagagccugaucagaaccgccuuccagugccugcagcugguggugaccgacuuccugcccaccaugcccugcaccugccugcagaucgugguggacguggccggcagcuucggccugcacaaccaggagcugaacaucagccugaccagcaucggccugcuguggaacaucagcgacuacuucuuccagagaggcgagaccaucgagaaggagcugaacaaggaggaggccgcccagcagaagcaggccgaggagaagggcguggugcugaacagacccuuccaccccgccccccccuucgacugccuguggcugugccuguacgccaagcugggcgagcugugcguggaccccagacccgccgugagaaagagcgccggccagacccuguucagcaccaucggcgcccacggcacccugcugcagcacagcaccuggcacaccgugaucuggaaggugcuguuccaccugcuggacagagugagagagagcagcaccaccgccgacaaggagaagaucgagagcggcggcggcaacauccugauccaccacagcagagacaccgccgagaagcagugggccgagaccugggugcugacccuggccggcguggccagaaucuucaacaccagaagauaccugcugcagccccugggcgacuucagcagagccugggacgugcugcuggaccacauccagagcgccgcccugagcaagaacaacgaggugagccuggccgcccugaagagcuuccaggagauccugcagaucgugagccccgugagagacagcgacaagcccgagaccccccccguggugaacgugcccgugcccgugcugaucggccccaucagcggcaugagcagacccuucgugagaaccgacagcaucggcgagaagcugggcagauacagcagcagcgagccccccaucgugaccgacgagcuggaggaccugaaccuguggugggccgccuggaacaccugguacagaaucggcagcgagagcaccaagccccccaucaccuucgacaagcugaccuucauccccagccagcccuuccugaccgcccugauccagaucuuccccgcccuguaccagcacaucaagaccggcuucaacauggacgaccugcagaagcugggcgugauccugcacagcgccaucagcgugcccaucagcagcgacgccagccccuucauccugcccagcuacaccgaggccgugcugaccagccugcaggaggccgugcugaccgcccuggacgugcugcagaaggccaucugcgugggccccgagaacaugcagaucauguaccccgccaucuucgaccagcugcuggccuucguggaguucagcugcaagcccccccaguacggccagcuggagaccaagcacaucgccaacgccaaguacaaccagauccagcuguucgcccccgccgaguggguggcccugaacuacgugcccuucgccgagagaagccuggagguggugguggaccuguaccagaagaccgccugccacaaggccguggugaacgagaaggugcugcagaacaucaucaagacccugagagugccccugagccugaaguacagcugccccagcgagagcaccuggaagcuggccgugagcagccugcugagagugcugagcaucggccugcccguggccagacagcacgccagcagcggcaaguucgacagcauguggcccgagcuggccaacaccuucgaggacuuccuguucaccaagagcaucccccccgacaaccugagcauccaggaguuccagagaaacgagaacaucgacguggagguggugcagcugaucagcaacgagauccugcccuacgccaacuucauccccaaggaguucgugggccagaucaugaccaugcugaacaagggcagcauccacagccagagcagcagcuucaccgaggccgagaucgacaucagacugagagaggaguucagcaagaugugcuucgagacccugcugcaguucagcuucagcaacaaggugaccaccccccaggagggcuacaucagcagaauggcccugagcgugcugcugaagagaagccaggacgugcugcacagauacaucgaggacgagagacugagcggcaagugcccccugcccagacagcaggugaccgagaucaucuucgugcugaaggccgugagcacccugaucgacagccugaagaagacccagcccgagaacgccugcaucagccuguucggcaucccccccuacuucuaa

SEQ ID NO: 19975 - RNA, 2820 nt, Artificial Sequence
  MORC3__Homo_sapiens__NP_056173
auggccgcccagccccccagaggcaucagacugagcgcccugugccccaaguuccugcacaccaacagcaccagccacaccuggcccuucagcgccguggccgagcugaucgacaacgccuacgaccccgacgugaacgccaagcagaucuggaucgacaagaccgugaucaacgaccacaucugccugaccuucaccgacaacggcaacggcaugaccagcgacaagcugcacaagaugcugagcuucggcuucagcgacaaggugaccaugaacggccacgugcccgugggccuguacggcaacggcuucaagagcggcagcaugagacugggcaaggacgccaucguguucaccaagaacggcgagagcaugagcgugggccugcugagccagaccuaccuggaggugaucaaggccgagcacgugguggugcccaucguggccuucaacaagcacagacagaugaucaaccuggccgagagcaaggccagccuggccgccauccuggagcacagccuguucagcaccgagcagaagcugcuggccgagcuggacgccaucaucggcaagaagggcaccagaaucaucaucuggaaccugagaagcuacaagaacgccaccgaguucgacuucgagaaggacaaguacgacaucagaauccccgaggaccuggacgagaucaccggcaagaagggcuacaagaagcaggagagaauggaccagaucgcccccgagagcgacuacagccugagagccuacugcagcauccuguaccugaagcccagaaugcagaucauccugagaggccagaaggugaagacccagcuggugagcaagagccuggccuacaucgagagagacguguacagacccaaguuccugagcaagaccgugagaaucaccuucggcuucaacugcagaaacaaggaccacuacggcaucaugauguaccacagaaacagacugaucaaggccuacgagaaggugggcugccagcugagagccaacaacaugggcgugggcguggugggcaucaucgagugcaacuuccugaagcccacccacaacaagcaggacuucgacuacaccaacgaguacagacugaccaucaccgcccugggcgagaagcugaacgacuacuggaacgagaugaaggugaagaagaacaccgaguacccccugaaccugcccguggaggacauccagaagagacccgaccagaccugggugcagugcgacgccugccugaaguggagaaagcugcccgacggcauggaccagcugcccgagaagugguacugcagcaacaaccccgacccccaguucagaaacugcgaggugcccgaggagcccgaggacgaggaccuggugcaccccaccuacgagaagaccuacaagaagaccaacaaggagaaguucagaaucagacagcccgagaugauccccagaaucaacgccgagcugcuguucagacccaccgcccugagcacccccagcuucagcagccccaaggagagcgugcccagaagacaccugagcgagggcaccaacagcuacgccaccagacugcugaacaaccaccaggugcccccccagagcgagcccgagagcaacagccugaagagaagacugagcaccagaagcagcauccugaacgccaagaacagaagacugagcagccaguucgagaacagcguguacaagggcgacgacgacgacgaggacgugaucauccuggaggagaacagcacccccaagcccgccguggaccacgacaucgacaugaagagcgagcagagccacguggagcagggcggcgugcagguggaguucgugggcgacagcgagcccugcggccagaccggcagcaccagcaccagcagcagcagaugcgaccagggcaacaccgccgccacccagaccgaggugcccagccugguggugaagaaggaggagaccguggaggacgagaucgacgugagaaacgacgccgugauccugcccagcugcguggaggccgaggccaagauccacgagacccaggagaccaccgacaagagcgccgacgacgccggcugccagcugcaggagcugagaaaccagcugcugcuggugaccgaggagaaggagaacuacaagagacagugccacauguucaccgaccagaucaaggugcugcagcagagaauccuggagaugaacgacaaguacgugaagaaggagaccugccaccagagcaccgagaccgacgccguguuccugcuggagagcaucaacggcaagagcgagagccccgaccacauggugagccaguaccagcaggcccuggaggagaucgagagacugaagaagcagugcagcgcccugcagcacgugaaggccgagugcagccagugcagcaacaacgagagcaagagcgagauggacgagauggccgugcagcuggacgacguguucagacagcuggacaagugcagcaucgagagagaccaguacaagagcgagguggagcugcuggagauggagaagagccagaucagaagccagugcgaggagcugaagaccgagguggagcagcugaagagcaccaaccagcagaccgccaccgacgugagcaccagcagcaacaucgaggagagcgugaaccacauggacggcgagagccugaagcugagaagccugagagugaacgugggccagcugcuggccaugaucgugcccgaccuggaccugcagcaggugaacuacgacguggacgugguggacgagauccugggccaggugguggagcagaugagcgagaucagcagcaccuaa

SEQ ID NO: 19976 - RNA, 708 nt, Artificial Sequence
  MORF4L1__Homo_sapiens__NP_001252534
augagaggcgccgcccccggcaagaagaccagcggccugcagcagaagaacguggaggugaagaccaagaagaacaagcagaagacccccggcaacggcgacggcggcagcaccagcgagaccccccagccccccagaaagaagagagccagaguggaccccaccguggagaacgaggagaccuucaugaacagaguggaggugaaggugaagauccccgaggagcugaagcccuggcugguggacgacugggaccugaucaccagacagaagcagcuguucuaccugcccgccaagaagaacguggacagcauccuggaggacuacgccaacuacaagaagagcagaggcaacaccgacaacaaggaguacgccgugaacgaggugguggccggcaucaaggaguacuucaacgugaugcugggcacccagcugcuguacaaguucgagagaccccaguacgccgagauccuggccgaccaccccgacgcccccaugagccagguguacggcgccccccaccugcugagacuguucgugagaaucggcgccaugcuggccuacaccccccuggacgagaagagccuggcccugcugcugaacuaccugcacgacuuccugaaguaccuggccaagaacagcgccacccuguucagcgccagcgacuacgagguggccccccccgaguaccacagaaaggccguguaa

SEQ ID NO: 19977 - RNA, 1053 nt, Artificial Sequence
  MORN1__Homo_sapiens__NP_001287989
auggccgccgccggcgagggcacccccagcagcagaggccccagaagagacccccccagaagaccccccagaaacggcuacggcguguacguguaccccaacagcuucuucagauacgagggcgaguggaaggccggcagaaagcacggccacggcaagcugcuguucaaggacggcagcuacuacgagggcgccuucguggacggcgagaucaccggcgagggcagaagacacugggccuggagcggcgacaccuucagcggccaguucgugcugggcgagccccagggcuacggcgugauggaguacaaggccggcggcugcuacgagggcgaggugagccacggcaugagagagggccacggcuuccugguggacagagacggccagguguaccagggcagcuuccacgacaacaagagacacggccccggccagaugcuguuccagaacggcgacaaguacgacggcgacugggugagagacagaagacagggccacggcgugcugagaugcgccgacggcagcaccuacaagggccaguggcacagcgacguguucagcggccugggcagcauggcccacugcagcggcgugaccuacuacggccuguggaucaacggccaccccgccgagcaggccaccagaaucgugauccugggccccgaggugauggagguggcccagggcagccccuucagcgugaacgugcagcugcugcaggaccacggcgagaucgccaagagcgagagcggcagagugcugcagaucagcgccggcgugagauacgugcagcugagcgccuacagcgaggugaacuucuucaagguggacagagacaaccaggagacccugauccagacccccuucggcuucgagugcauccccuaccccgugagcagccccgccgccggcgugcccggccccagagccgccaagggcggcgccgaggccgacgugccccugcccagaggcgaccuggagcugcaccugggcgcccugcacggccaggaggacacccccggcggccugcugggcagcagccuguucuaa

SEQ ID NO: 19978 - RNA, 240 nt, Artificial Sequence
  MORN2__Homo_sapiens__NP_001138922
augaacggcuucggcagacuggagcacuucagcggcgccguguacgagggccaguucaaggacaacauguuccacggccugggcaccuacaccuuccccaacggcgccaaguacaccggcaacuucaacgagaacagaguggagggcgagggcgaguacaccgacauccagggccuggaguggagcggcaacuuccacuucaccgccgcccccgaccugaagcugaagcugcacauguaa

SEQ ID NO: 19979 - RNA, 486 nt, Artificial Sequence
  MORN5__Homo_sapiens__NP_940871
auggaguacaccggcagcaaguacaucggcgaguacguggacggcagaauggagggcaaggccaaguacauccugcccaccgagaccaucuacgugggcgagaugaaggacggcauguuccacggcgagggcacccuguacuuccccagcggcagccaguacgacgccaucugggagaacggccuggccaucaagggcaccuacaccuucagcgacggccugcacuacgacgagaagaacuggcacuacugcgacggcuacgacagaagauucuacaccgagauccugaacggccugaagcccgccggcauggcccagcugaccaacauggacccccccagaaagauccccaagggcuacuacgacugcggcgacggcuucuacaaccccgugaccagaguggugaaggacuacagaaacagauuccugagaaacgccgacgacgacgagcacgaguggaucaccagaaccugcagaaagggcuaa

SEQ ID NO: 19980 - RNA, 1041 nt, Artificial Sequence
  MOS__Homo_sapiens__NP_005363
augcccagcccccuggcccugagacccuaccugagaagcgaguucagccccagcguggacgccagacccugcagcagccccagcgagcugcccgccaagcugcugcugggcgccacccugcccagagcccccagacugcccagaagacuggccuggugcagcaucgacugggagcaggugugccugcugcagagacugggcgccggcggcuucggcagcguguacaaggccaccuacagaggcgugcccguggccaucaagcaggugaacaagugcaccaagaacagacuggccagcagaagaagcuucugggccgagcugaacguggccagacugagacacgacaacaucgugagagugguggccgccagcaccagaacccccgccggcagcaacagccugggcaccaucaucauggaguucggcggcaacgugacccugcaccaggugaucuacggcgccgccggccaccccgagggcgacgccggcgagccccacugcagaaccggcggccagcugagccugggcaagugccugaaguacagccuggacguggugaacggccugcuguuccugcacagccagagcaucgugcaccuggaccugaagcccgccaacauccugaucagcgagcaggacgugugcaagaucagcgacuucggcugcagcgagaagcuggaggaccugcugugcuuccagacccccagcuacccccugggcggcaccuacacccacagagcccccgagcugcugaagggcgagggcgugacccccaaggccgacaucuacagcuucgccaucacccuguggcagaugaccaccaagcaggcccccuacagcggcgagagacagcacauccuguacgccgugguggccuacgaccugagacccagccugagcgccgccguguucgaggacagccugcccggccagagacugggcgacgugauccagagaugcuggagacccagcgccgcccagagacccagcgccagacugcugcugguggaccugaccagccugaaggccgagcugggcuaa

SEQ ID NO: 19981 - RNA, 3498 nt, Artificial Sequence
  MOV10L1__Homo_sapiens__NP_001157576
augcugagccuggccgccaagcugguggccuucuucuggagaaccgccgacacccccagagaggaggccggccagcuggagcccgagcuggccgagggcgacaccaagcugaagaccgugagaggcguggugaccagauacugcagcgacuacggcaugaucgacgacaugaucuacuucagcagcgacgccgugaccagcagagugcugcugaacgugggccaggaggugaucgccgugguggaggagaacaaggugagcaacggccugaaggccaucagaguggaggccgugagcgacaagugggaggacgacagcagaaaccacggcagccccagcgacugcggccccagagugcugaucggcugcgugaccagccugguggagggcgccggcugcaucagccagaccaccuacuucagccuggagagcgugugcgagggcuucgagcccugcaagggcgacuggguggaggccgaguacagaaucagacccggcaccuggagcagcgaggccaccagcgugaagccccugagauacaagagaguggacaaggugugcaucagcagccugugcggcagaaacggcgugcuggaggagagcaucuucuucacccuggacagccugaagcugcccgacggcuacacccccagaagaggcgacguggugaacgccguggugguggagagcagccagagcugcuacguguggagagcccugugcaugacccuggugaagagaagagacgccgcccccgugcacgaggccacccacuucuacggcaccauccugcugaagaacaagggcgacaucgaggugacccaggugacccacuucggcacccugaaggagggcagaagcaagaccauggugaucuggaucgagaacaagggcgacaucccccagaaccuggugagcugcaagcuggccggcugggacaagagcaagcaguucagauuccagaugcuggacaaggaccagaugugccccguggugagcuucgugagcgugcccgagaaggagaacagcagcgacgagaacaucaacagccugaacagccacaccaagaacaagaccagccagaugagcgagagcagccuggugaacaacagaggcaucagccccggcgacugcaccugcaagggcgagaacggcgagaaggacaacauccugagcagaaagcagaugaccgagcccgagcccggcggccuggugccccccggcggcaagaccuucaucguggugaucugcgacggcaagaaccccggcagaugcaaggagcugcugcugcugugcuucagcgacuuccugaucggcagauaccuggaggugaacgugaucagcggcgaggagagccugaucgccgccagagagcccuucagcuggaagaagcugaagagcagccaggcccugaccagcgccaagaccaccgugguggugaccgcccagaagagaaacagcagaagacagcugcccagcuuccugccccaguaccccauccccgacagacugagaaagugcguggagcagaagaucgacauccugaccuuccagccccugcuggccgagcugcugaacaugagcaacuacaaggagaaguucagcacccugcuguggcuggaggagaucuacgccgagauggagcugaaggaguacaacaugagcggcaucauccugagaagaaacggcgaccugcuggugcuggaggugcccggccuggccgagggcagacccagccuguacgccggcgacaagcugauccugaagacccaggaguacaacggccacgccaucgaguacaucagcuacgugaccgagauccacgaggaggacgugacccugaagaucaaccccgaguucgagcaggccuacaacuucgagcccauggacguggaguucaccuacaacagaaccaccagcagaagaugccacuucgcccuggagcacgugauccaccugggcgugaaggugcuguuccccgaggagaucauccugcagagcccccaggugaccggcaacuggaaccacgcccaggacaccaagagcagcggccagagcaccagcaagaagaacagaaagaccaugaccgaccaggccgagcacggcaccgaggagagaagagugggcgacaaggaccugcccgugcuggcccccuucaccgccgagaugagcgacuggguggacgagauccagacccccaaggccagaaagauggaguucuucaaccccgugcugaacgagaaccagaagcuggccgugaagagaauccugagcggcgacugcagaccccugcccuacauccuguucggcccccccggcaccggcaagaccgugaccaucaucgaggccgugcugcaggugcacuucgcccugcccgacagcagaauccuggugugcgcccccagcaacagcgccgccgaccuggugugccugagacugcacgagagcaaggugcugcagcccgccaccauggugagagugaacgccaccugcagauucgaggagaucgugaucgacgccgugaagcccuacugcagagacggcgaggacaucuggaaggccagcagauucagaaucaucaucaccaccugcagcagcagcggccuguucuaccagaucggcgugagagugggccacuucacccacguguucguggacgaggccggccaggccagcgagcccgagugccugaucccccugggccugaugagcgacaucagcggccagaucgugcuggccggcgaccccaugcagcugggccccgugaucaagagcagacuggccauggccuacggccugaacgugagcuuccuggagagacugaugagcagacccgccuaccagagagacgagaacgccuucggcgccugcggcgcccacaacccccugcuggugaccaagcuggugaagaacuacagaagccacgaggcccugcugaugcugcccagcagacuguucuaccacagagagcuggaggugugcgccgaccccaccguggugaccagccugcugggcugggagaagcugcccaagaagggcuucccccugaucuuccacggcgugagaggcagcgaggccagagagggcaagagccccagcugguucaaccccgccgaggccgugcaggugcugagauacugcugccugcuggcccacagcaucagcagccaggugagcgccagcgacaucggcgugaucacccccuacagaaagcagguggagaagaucagaauccugcugagaaacguggaccugauggacaucaaggugggcagcguggaggaguuccagggccaggaguaccuggugaucaucaucagcaccgaccccugcuucggcgcccugcuggaguacagcaucaccaacggcguguacaugggcugcgaccugccccccgcccugcagagccugcagaacugcggcgagggcguggccgaccccagcuaccccguggugcccgagagcaccggccccgagaagcaccaggagcccagcuaa

SEQ ID NO: 19982 - RNA, 201 nt, Artificial Sequence
  MPC1__Homo_sapiens__NP_001257808
augaagaagagccccgagaucaucagcggcagaaugaccuucgcccugugcugcuacagccugaccuucaugagauucgccuacaaggugcagcccagaaacuggcugcuguucgccugccacgccaccaacgagguggcccagcugauccagggcggcagacugaucaagcacgagaugaccaagaccgccagcgccuaa

SEQ ID NO: 19983 - RNA, 384 nt, Artificial Sequence
  MPC2__Homo_sapiens__NP_001137146
augagcgccgccggcgccagaggccugagagccaccuaccacagacugcuggacaagguggagcugaugcugcccgagaagcugagaccccuguacaaccaccccgccggccccagaaccguguucuucugggcccccaucaugaaguggggccuggugugcgccggccuggccgacauggccagacccgccgagaagcugagcaccgcccagagcgccgugcugauggccaccggcuucaucuggagcagauacagccuggugaucauccccaagaacuggagccuguucgccgugaacuucuucgugggcgccgccggcgccagccagcuguucagaaucuggagauacaaccaggagcugaaggccaaggcccacaaguaa

SEQ ID NO: 19984 - RNA, 744 nt, Artificial Sequence
  MPDU1__Homo_sapiens__NP_004861
auggccgccgaggccgacggcccccugaagagacugcuggugcccauccugcugcccgagaagugcuacgaccagcuguucgugcagugggaccugcugcacgugcccugccugaagauccugcugagcaagggccugggccugggcaucguggccggcagccugcuggugaagcugccccagguguucaagauccugggcgccaagagcgccgagggccugagccugcagagcgugaugcuggagcugguggcccugaccggcaccaugguguacagcaucaccaacaacuuccccuucagcagcuggggcgaggcccuguuccugaugcugcagaccaucaccaucugcuuccuggugaugcacuacagaggccagaccgugaagggcguggccuuccuggccugcuacggccuggugcugcuggugcugcugagcccccugaccccccugaccguggugacccugcugcaggccagcaacgugcccgccgugguggugggcagacugcugcaggccgccaccaacuaccacaacggccacaccggccagcugagcgccaucaccguguuccugcuguucggcggcagccuggccagaaucuucaccagcauccaggagaccggcgacccccugauggccggcaccuucguggugagcagccugugcaacggccugaucgccgcccagcugcuguucuacuggaacgccaagcccccccacaagcagaagaaggcccaguaa

SEQ ID NO: 19985 - RNA, 6114 nt, Artificial Sequence
  MPDZ__Homo_sapiens__NP_001248335
augcuggaggccaucgacaagaacagagcccugcacgccgccgagagacugcagaccaagcugagagagagaggcgacguggccaacgaggacaagcugagccugcugaagagcgugcugcagagcccccuguucagccagauccugagccugcagaccagcgugcagcagcugaaggaccaggugaacaucgccaccagcgccaccagcaacaucgaguacgcccacgugccccaccugagccccgccgugauccccacccugcagaacgagagcuuccugcugagccccaacaacggcaaccuggaggcccugaccggccccggcaucccccacaucaacggcaagcccgccugcgacgaguucgaccagcugaucaagaacauggcccagggcagacacguggagguguucgagcugcugaagccccccagcggcggccugggcuucagcguggugggccugagaagcgagaacagaggcgagcugggcaucuucgugcaggagauccaggagggcagcguggcccacagagacggcagacugaaggagaccgaccagauccuggccaucaacggccaggcccuggaccagaccaucacccaccagcaggccaucagcauccugcagaaggccaaggacaccgugcagcuggugaucgccagaggcagccugccccagcuggugagccccaucgugagcagaagccccagcgccgccagcaccaucagcgcccacagcaaccccgugcacuggcagcacauggagaccaucgagcuggugaacgacggcagcggccugggcuucggcaucaucggcggcaaggccaccggcgugaucgugaagaccauccugcccggcggcguggccgaccagcacggcagacugugcagcggcgaccacauccugaagaucggcgacaccgaccuggccggcaugagcagcgagcagguggcccaggugcugagacagugcggcaacagagugaagcugaugaucgccagaggcgccaucgaggagagaaccgcccccaccgcccugggcaucacccugagcagcagccccaccagcacccccgagcugagaguggacgccagcacccagaagggcgaggagagcgagaccuucgacguggagcugaccaagaacgugcagggccugggcaucaccaucgccggcuacaucggcgacaagaagcuggagcccagcggcaucuucgugaagagcaucaccaagagcagcgccguggagcacgacggcagaauccagaucggcgaccagaucaucgccguggacggcaccaaccugcagggcuucaccaaccagcaggccguggaggugcugagacacaccggccagaccgugcugcugacccugaugagaagaggcaugaagcaggaggccgagcugaugagcagagaggacgugaccaaggacgccgaccugagccccgugaacgccagcaucaucaaggagaacuacgagaaggacgaggacuuccugagcagcaccagaaacaccaacauccugcccaccgaggaggagggcuacccccugcugagcgccgagaucgaggagaucgaggacgcccagaagcaggaggccgcccugcugaccaaguggcagagaaucaugggcaucaacuacgagaucgugguggcccacgugagcaaguucagcgagaacagcggccugggcaucagccuggaggccaccgugggccaccacuucaucagaagcgugcugcccgagggccccgugggccacagcggcaagcuguucagcggcgacgagcugcuggaggugaacggcaucacccugcugggcgagaaccaccaggacguggugaacauccugaaggagcugcccaucgaggugaccauggugugcugcagaagaaccgugccccccaccacccagagcgagcuggacagccuggaccugugcgacaucgagcugaccgagaagccccacguggaccugggcgaguucaucggcagcagcgagaccgaggaccccgugcuggccaugaccgacgccggccagagcaccgaggaggugcaggccccccuggccaugugggaggccggcauccagcacaucgagcuggagaagggcagcaagggccugggcuucagcauccuggacuaccaggaccccaucgaccccgccagcaccgugaucaucaucagaagccuggugcccggcggcaucgccgagaaggacggcagacugcugcccggcgacagacugauguucgugaacgacgugaaccuggagaacagcagccuggaggaggccguggaggcccugaagggcgcccccagcggcaccgugagaaucggcguggccaagccccugccccugagccccgaggagggcuacgugagcgccaaggaggacagcuuccuguaccccccccacagcugcgaggaggccggccuggccgacaagccccuguucagagccgaccuggcccuggugggcaccaacgacgccgaccugguggacgagagcaccuucgagagccccuacagccccgagaacgacagcaucuacagcacccaggccagcauccugagccugcacggcagcagcugcggcgacggccugaacuacggcagcagccugcccagcagcccccccaaggacgugaucgagaacagcugcgaccccgugcuggaccugcacaugagccuggaggagcuguacacccagaaccugcugcagagacaggacgagaacacccccagcguggacaucagcaugggccccgccagcggcuucaccaucaacgacuacacccccgccaacgccaucgagcagcaguacgagugcgagaacaccaucguguggaccgagagccaccugcccagcgaggugaucagcagcgccgagcugcccagcgugcugcccgacagcgccggcaagggcagcgaguaccugcuggagcagagcagccuggccugcaacgccgagugcgugaugcugcagaacgugagcaaggagagcuucgagagaaccaucaacaucgccaagggcaacagcagccugggcaugaccgugagcgccaacaaggacggccugggcaugaucgugagaagcaucauccacggcggcgccaucagcagagacggcagaaucgccaucggcgacugcauccugagcaucaacgaggagagcaccaucagcgugaccaacgcccaggccagagccaugcugagaagacacagccugaucggccccgacaucaagaucaccuacgugcccgccgagcaccuggaggaguucaagaucagccugggccagcagagcggcagagugauggcccuggacaucuucagcagcuacaccggcagagacauccccgagcugcccgagagagaggagggcgagggcgaggagagcgagcugcagaacaccgccuacagcaacuggaaccagcccagaagaguggagcuguggagagagcccagcaagagccugggcaucagcaucgugggcggcagaggcaugggcagcagacugagcaacggcgaggugaugagaggcaucuucaucaagcacgugcuggaggacagccccgccggcaagaacggcacccugaagcccggcgacagaaucguggagguggacggcauggaccugagagacgccagccacgagcaggccguggaggccaucagaaaggccggcaaccccgugguguucauggugcagagcaucaucaacagacccagagcccccagccagagcgagagcgagcccgagaaggccccccugugcagcgugcccccccccccccccagcgccuucgccgagaugggcagcgaccacacccagagcagcgccagcaagaucagccaggacguggacaaggaggacgaguucggcuacagcuggaagaacaucagagagagauacggcacccugaccggcgagcugcacaugaucgagcuggagaagggccacagcggccugggccugagccuggccggcaacaaggacagaagcagaaugagcguguucaucgugggcaucgaccccaacggcgccgccggcaaggacggcagacugcagaucgccgacgagcugcuggagaucaacggccagauccuguacggcagaagccaccagaacgccagcagcaucaucaagugcgcccccagcaaggugaagaucaucuucaucagaaacaaggacgccgugaaccagauggccgugugccccggcaacgccguggagccccugcccagcaacagcgagaaccugcagaacaaggagaccgagcccaccgugaccaccagcgacgccgccguggaccugagcagcuucaagaacgugcagcaccuggagcugcccaaggaccagggcggccugggcaucgccaucagcgaggaggacacccugagcggcgugaucaucaagagccugaccgagcacggcguggccgccaccgacggcagacugaaggugggcgaccagauccuggccguggacgacgagaucguggugggcuaccccaucgagaaguucaucagccugcugaagaccgccaagaugaccgugaagcugaccauccacgccgagaaccccgacagccaggccgugcccagcgccgccggcgccgccagcggcgagaagaagaacagcagccagagccugauggugccccagagcggcagccccgagcccgagagcaucagaaacaccagcagaagcagcacccccgccaucuucgccagcgaccccgccaccugccccaucauccccggcugcgagaccaccaucgagaucagcaagggcagaaccggccugggccugagcaucgugggcggcagcgacacccugcugggcgccaucaucauccacgagguguacgaggagggcgccgccugcaaggacggcagacugugggccggcgaccagauccuggaggugaacggcaucgaccugagaaaggccacccacgacgaggccaucaacgugcugagacagaccccccagagagugagacugacccuguacagagacgaggcccccuacaaggaggaggaggugugcgacacccugaccaucgagcugcagaagaagcccggcaagggccugggccugagcaucgugggcaagagaaacgacaccggcguguucgugagcgacaucgugaagggcggcaucgccgacgccgacggcagacugaugcagggcgaccagauccugauggugaacggcgaggacgugagaaacgccacccaggaggccguggccgcccugcugaagugcagccugggcaccgugacccuggaggugggcagaaucaaggccggccccuuccacagcgagagaagacccagccagagcagccaggugagcgagggcagccugagcagcuucaccuucccccugagcggcagcagcaccagcgagagccuggagagcagcagcaagaagaacgcccuggccagcgagauccagggccugagaaccguggagaugaagaagggccccaccgacagccugggcaucagcaucgccggcggcgugggcagcccccugggcgacgugcccaucuucaucgccaugaugcaccccaccggcguggccgcccagacccagaagcugagagugggcgacagaaucgugaccaucugcggcaccagcaccgagggcaugacccacacccaggccgugaaccugcugaagaacgccagcggcagcaucgagaugcaggugguggccggcggcgacgugagcguggugaccggccaccagcaggagcccgccagcagcagccugagcuucaccggccugaccagcagcagcaucuuccaggacgaccugggccccccccagugcaagagcaucacccuggagagaggccccgacggccugggcuucagcaucgugggcggcuacggcagcccccacggcgaccugcccaucuacgugaagaccguguucgccaagggcgccgccagcgaggacggcagacugaagagaggcgaccagaucaucgccgugaacggccagagccuggagggcgugacccacgaggaggccguggccauccugaagagaaccaagggcaccgugacccugauggugcugagcuaa

SEQ ID NO: 19986 - RNA, 2151 nt, Artificial Sequence
  MPEG1__Homo_sapiens__NP_001034485
augaacaacuucagagccaccauccuguucugggccgccgccgccugggccaagagcggcaagcccagcggcgagauggacgaggugggcgugcagaagugcaagaacgcccugaagcugcccgugcuggaggugcugcccggcggcggcugggacaaccugagaaacguggacaugggcagagugauggagcugaccuacagcaacugcagaaccaccgaggacggccaguacaucauccccgacgagaucuucaccaucccccagaagcagagcaaccuggagaugaacagcgagauccuggagagcugggccaacuaccagagcagcaccagcuacagcaucaacaccgagcugagccuguucagcaaggugaacggcaaguucagcaccgaguuccagagaaugaagacccugcaggugaaggaccaggccaucaccaccagagugcaggugagaaaccugguguacaccgugaagaucaaccccacccuggagcugagcagcggcuucagaaaggagcugcuggacaucagcgacagacuggagaacaaccagaccagaauggccaccuaccuggccgagcugcuggugcugaacuacggcacccacgugaccaccagcguggacgccggcgccgcccugauccaggaggaccaccugagagccagcuuccugcaggacagccagagcagcagaagcgccgugaccgccagcgccggccuggccuuccagaacaccgugaacuucaaguucgaggagaacuacaccagccagaacgugcugaccaagagcuaccugagcaacagaaccaacagcagagugcagagcaucggcggcgugcccuucuaccccggcaucacccugcaggccuggcagcagggcaucaccaaccaccugguggccaucgacagaagcggccugccccugcacuucuucaucaaccccaacaugcugcccgaccugcccggcccccuggugaagaaggugagcaagaccguggagaccgccgugaagagauacuacaccuucaacaccuaccccggcugcaccgaccugaacagccccaacuucaacuuccaggccaacaccgacgacggcagcugcgagggcaagaugaccaacuucagcuucggcggcguguaccaggagugcacccagcugagcggcaacagagacgugcugcugugccagaagcuggagcagaagaacccccugaccggcgacuucagcugccccagcggcuacagccccgugcaccugcugagccagauccacgaggagggcuacaaccaccuggagugccacagaaagugcacccugcugguguucugcaagaccgugugcgaggacguguuccagguggccaaggccgaguucagagccuucuggugcguggccagcagccaggugcccgagaacagcggccugcuguucggcggccuguucagcagcaagagcaucaaccccaugaccaacgcccagagcugccccgccggcuacuucccccugagacuguucgagaaccugaaggugugcgugagccaggacuacgagcugggcagcagauucgccgugcccuucggcggcuucuucagcugcaccgugggcaacccccugguggaccccgccaucagcagagaccugggcgcccccagccugaagaagugccccggcggcuucagccagcaccccgcccugaucagcgacggcugccaggugagcuacugcgugaagagcggccuguucaccggcggcagccugccccccgccagacugccccccuucaccagacccccccugaugagccaggccgccaccaacaccgugaucgugaccaacagcgagaacgccagaagcuggaucaaggacagccagacccaccaguggagacugggcgagcccaucgagcugagaagagccaugaacgugauccacggcgacggcggcggccugagcggcggcgccgccgccggcgugaccgugggcgugaccaccauccuggccguggugaucacccuggccaucuacggcaccagaaaguucaagaagaaggccuaccaggccaucgaggagagacagagccuggugcccggcaccgccgccaccggcgacaccaccuaccaggagcagggccagagccccgccuaa

SEQ ID NO: 19987 - RNA, 882 nt, Artificial Sequence
  MPG__Homo_sapiens__NP_001015052
augcccgccagaagcggcgcccaguucugcagaagaaugggccagaagaagcagagacccgccagagccggccagccccacagcagcagcgacgccgcccaggcccccgccgagcagccccacagcagcagcgacgccgcccaggcccccugccccagagagagaugccugggcccccccaccacccccggccccuacagaagcaucuacuucagcagccccaagggccaccugaccagacugggccuggaguucuucgaccagcccgccgugccccuggccagagccuuccugggccaggugcuggugagaagacugcccaacggcaccgagcugagaggcagaaucguggagaccgaggccuaccugggccccgaggacgaggccgcccacagcagaggcggcagacagacccccagaaacagaggcauguucaugaagcccggcacccuguacguguacaucaucuacggcauguacuucugcaugaacaucagcagccagggcgacggcgccugcgugcugcugagagcccuggagccccuggagggccuggagaccaugagacagcugagaagcacccugagaaagggcaccgccagcagagugcugaaggacagagagcugugcagcggccccagcaagcugugccaggcccuggccaucaacaagagcuucgaccagagagaccuggcccaggacgaggccguguggcuggagagaggcccccuggagcccagcgagcccgccgugguggccgccgccagagugggcgugggccacgccggcgagugggccagaaagccccugagauucuacgugagaggcagccccugggugagcgugguggacagaguggccgagcaggacacccaggccuaa

SEQ ID NO: 19988 - RNA, 2046 nt, Artificial Sequence
  MPHOSPH10__Homo_sapiens__NP_005782
auggccccccagguguggagaagaagaacccuggagagaugccugaccgaggugggcaaggccaccggcagacccgagugcuuccugaccauccaggagggccuggccagcaaguucaccagccugaccaaggugcuguacgacuucaacaagauccuggagaacggcagaauccacggcagcccccugcagaagcuggugaucgagaacuucgacgacgagcagaucuggcagcagcuggagcugcagaacgagcccauccugcaguacuuccagaacgccgugagcgagaccaucaacgacgaggacaucagccugcugcccgagagcgaggagcaggagagagaggaggacggcagcgagaucgaggccgacgacaaggaggaccuggaggaccuggaggaggaggaggugagcgacaugggcaacgacgaccccgagaugggcgagagagccgagaacagcagcaagagcgaccugagaaagagccccguguucagcgacgaggacagcgaccuggacuucgacaucagcaagcuggagcagcagagcaaggugcagaacaagggccagggcaagcccagagagaagagcaucguggacgacaaguucuucaagcugagcgagauggaggccuaccuggagaacaucgagaaggaggaggagagaaaggacgacaacgacgaggaggaggaggacaucgacuucuucgaggacaucgacagcgacgaggacgagggcggccuguucggcagcaagaagcugaagagcggcaagagcagcagaaaccugaaguacaaggacuucuucgaccccguggagagcgacgaggacaucaccaacgugcacgacgacgagcuggacagcaacaaggaggacgacgagaucgccgaggaggaggccgaggagcugagcaucagcgagaccgacgaggacgacgaccugcaggagaacgaggacaacaagcagcacaaggagagccugaagagagugaccuucgcccugcccgacgacgccgagaccgaggacaccggcgugcugaacgugaagaagaacagcgacgaggugaagagcagcuucgagaagagacaggagaagaugaacgagaagaucgccagccuggagaaggagcugcuggagaagaagcccuggcagcugcagggcgaggugaccgcccagaagagacccgagaacagccugcuggaggagacccugcacuucgaccacgccgugagaauggcccccgugaucaccgaggagaccacccugcagcuggaggacaucaucaagcagagaaucagagaccaggccugggacgacguggugagaaaggagaagcccaaggaggacgccuacgaguacaagaagagacugacccuggaccacgagaagagcaagcugagccuggccgagaucuacgagcaggaguacaucaagcugaaccagcagaagaccgccgaggaggagaaccccgagcacguggagauccagaagaugauggacagccuguuccugaagcuggacgcccugagcaacuuccacuucauccccaagccccccgugcccgagaucaagguggugagcaaccugcccgccaucaccauggaggagguggcccccgugagcgugagcgacgccgcccugcuggcccccgaggagaucaaggagaagaacaaggccggcgacaucaagaccgccgccgagaagaccgccaccgacaagaagagagagagaagaaagaagaaguaccagaagagaaugaagaucaaggagaaggagaagagaagaaagcugcuggagaagagcagcguggaccaggccggcaaguacagcaagaccguggccagcgagaagcugaagcagcugaccaagaccggcaaggccagcuucaucaaggacgagggcaaggacaaggcccugaagagcagccaggccuucuucagcaagcugcaggaccaggugaagaugcagaucaacgacgccaagaagaccgagaagaagaagaagaagagacaggacaucagcgugcacaagcugaagcuguaa

SEQ ID NO: 19989 - RNA, 483 nt, Artificial Sequence
  MPHOSPH6__Homo_sapiens__NP_005783
auggccgccgagagaaagaccagacugagcaagaaccugcugagaaugaaguucaugcagagaggccuggacagcgagaccaagaagcagcuggaggaggaggagaagaagaucaucagcgaggagcacugguaccuggaccugcccgagcugaaggagaaggagagcuucaucaucgaggagcagagcuuccugcugugcgaggaccugcuguacggcagaaugagcuucagaggcuucaaccccgagguggagaagcugaugcugcagaugaacgccaagcacaaggccgaggagguggaggacgagaccguggagcuggacgugagcgacgaggagauggccagaagauacgagacccuggugggcaccaucggcaagaaguucgccagaaagagagaccacgccaacuacgaggaggacgagaacggcgacaucacccccaucaaggccaagaagauguuccugaagccccaggacuaa

SEQ ID NO: 19990 - RNA, 2583 nt, Artificial Sequence
  MPHOSPH8__Homo_sapiens__NP_059990
auggagcagguggccgagggcgccagagugaccgccgugcccgugagcgccgccgacagcaccgaggagcuggccgagguggaggagggcgugggcguggugggcgaggacaacgacgccgccgccagaggcgccgaggccuucggcgacagcgaggaggacggcgaggacguguucgagguggagaagauccuggacaugaagaccgagggcggcaaggugcuguacaaggugagauggaagggcuacaccagcgacgacgacaccugggagcccgagauccaccuggaggacugcaaggaggugcugcuggaguucagaaagaagaucgccgagaacaaggccaaggccgugagaaaggacauccagagacugagccugaacaacgacaucuucgaggccaacagcgacagcgaccagcagagcgagaccaaggaggacaccagccccaagaagaagaagaagaagcugagacagagagaggagaagagccccgacgaccugaagaagaagaaggccaaggccggcaagcugaaggacaagagcaagcccgaccuggagagcagccuggagagccugguguucgaccugagaaccaagaagagaaucagcgaggccaaggaggagcugaaggagagcaagaagcccaagaaggacgaggugaaggagaccaaggagcugaagaaggugaagaagggcgagaucagagaccugaagaccaagaccagagaggaccccaaggagaacagaaagaccaagaaggagaaguucguggagagccagguggagagcgagagcagcgugcugaacgacagccccuuccccgaggacgacagcgagggccugcacagcgacagcagagaggagaagcagaacaccaagagcgccagagagagagccggccaggacaugggccuggagcacggcuucgagaagccccuggacagcgccaugagcgccgaggaggacaccgacgugagaggcagaagaaagaagaagacccccagaaaggccgaggacaccagagagaacagaaagcuggagaacaagaacgccuuccuggagaagaagaccgugcccaagaagcagagaaaccaggacagaagcaagagcgccgccgagcuggagaagcugaugcccgugagcgcccagacccccaagggcagaagacugagcggcgaggagagaggccuguggagcaccgacagcgccgaggaggacaaggagaccaagagaaacgagagcaaggagaaguaccagaagagacacgacagcgacaaggaggagaagggcagaaaggagcccaagggccugaagacccugaaggagaucagaaacgccuucgaccuguucaagcugacccccgaggagaagaacgacgugagcgagaacaacagaaagagagaggagaucccccuggacuucaagaccaucgacgaccacaagaccaaggagaacaagcagagccugaaggagagaagaaacaccagagacgagaccgacaccugggccuacaucgccgccgagggcgaccaggaggugcuggacagcgugugccaggccgacgagaacagcgacggcagacagcagauccugagccugggcauggaccugcagcuggaguggaugaagcuggaggacuuccagaagcaccuggacggcaaggacgagaacuucgccgccaccgacgccauccccagcaacgugcugagagacgccgugaagaacggcgacuacaucaccgugaagguggcccugaacagcaacgaggaguacaaccuggaccaggaggacagcagcggcaugacccuggugaugcuggccgccgccggcggccaggacgaccugcugagacugcugaucaccaagggcgccaaggugaacggcagacagaagaacggcaccaccgcccugauccacgccgccgagaagaacuuccugaccaccguggccauccugcuggaggccggcgccuucgugaacgugcagcagagcaacggcgagaccgcccugaugaaggccugcaagagaggcaacagcgacaucgugagacuggugaucgagugcggcgccgacugcaacauccugagcaagcaccagaacagcgcccugcacuucgccaagcagagcaacaacgugcugguguacgaccugcugaagaaccaccuggagacccugagcagaguggccgaggagaccaucaaggacuacuucgaggccagacuggcccugcuggagcccguguuccccaucgccugccacagacugugcgagggccccgacuucagcaccgacuucaacuacaagcccccccagaacauccccgagggcagcggcauccugcuguucaucuuccacgccaacuuccugggcaaggaggugaucgccagacugugcggccccugcagcgugcaggccguggugcugaacgacaaguuccagcugcccguguuccuggacagccacuucguguacagcuucagccccguggccggccccaacaagcuguucaucagacugaccgaggcccccagcgccaaggugaagcugcugaucggcgccuacagagugcagcugcaguaa

SEQ ID NO: 19991 - RNA, 3552 nt, Artificial Sequence
  MPHOSPH9__Homo_sapiens__NP_073619
auggaggaguucgaccuggugaagacccugcacaagaccagcagcagcgugggcagcgacgagaacagccugcacagccugggccugaaccugaacaccgacagaagcagcccccaccugagcaccaacggcgugagcagcuucagcggcaagaccagacccagcgugauccagggcaccguggaggugcugaccagccugaugcaggagcugcagaacagcggcaagaccgacagcgagcuguggaagaacugcgagaccagauggcugcagcuguucaaccugguggagaagcagugccaggagcagaucguggcccagcaggagcaguuccacaaccagauccagcacauccaggaggagaucaagaaccuggugaagcugcagaccagcagcgccagccuggccagcugcgagggcaacagcagcaacaagcaggugagcagcgagagccagaugggcuucuucagccugagcagcgagagaaacgagagcgugauccacuaccccgagagcaccgagcccgagauccagcaggagaugagcaccagccagcccgacugcaacguggacagcugcagcgugagcagcggcuacggcaccuucugcaucagcgagcugaaccuguacaagagcaaggaccccaaggaguucauggagcacaucgacgugcccaagggccaguacguggcccccgccgugcccgccgagagccugguggacggcgugaagaacgagaacuucuacauccagacccccgaggagugccacgugagccugaaggaggacgugagcaucagccccggcgaguucgagcacaacuuccugggcgagaacaaggugagcgagguguacagcggcaagaccaacagcaacgccaucaccagcugggcccagaagcugaagcagaaccagcccaagagagcccacguggaggacggcggcagcagaagcaagcagggcaacgagcagagcaagaagacccccaucgagaagagcgacuucgccgccgccacccaccccagagccuucuaccugagcaagcccgacgagacccccaacgccuggaugagcgacagcggcaccggccugaccuacuggaagcuggaggagaaggacaugcaccacagccugcccgagacccuggagaagaccuucaucagccugagcagcaccgacgugagccccaaccagagcaacaccagcaacgagaugaagcugcccagccugaaggacaucuacuacaagaagcagagagagaacaagcagcugcccgagagaaaccugaccagcgccagcaaccccaaccacccccccgaggugcugacccuggaccccacccugcacaugaagcccaagcagcagaucagcggcauccagccccacggccugcccaacgcccuggacgacagaaucagcuucagccccgacagcgugcuggagcccagcaugagcagccccagcgacaucgacagcuucagccaggccagcaacgugaccagccagcugcccggcuuccccaaguaccccagccacaccaaggccagccccguggacagcuggaagaaccagaccuuccagaacgagagcagaaccagcagcaccuuccccagcguguacaccaucaccagcaacgacaucagcgugaacaccguggacgaggagaacaccgugaugguggccagcgccagcgugagccagagccagcugcccggcaccgccaacagcgugcccgagugcaucagccugaccagccuggaggaccccgugauccugagcaagaucagacagaaccugaaggagaagcacgccagacacaucgccgaccugagagccuacuacgagagcgagaucaacagccugaagcagaagcuggaggccaaggagaucagcggcguggaggacuggaagaucaccaaccagauccugguggacagaugcggccagcuggacagcgcccugcacgaggccaccagcagagugagaacccuggagaacaagaacaaccugcuggagaucgaggugaacgaccugagagagagauucagcgccgccagcagcgccagcaagauccugcaggagagaaucgaggagaugagaaccagcagcaaggagaaggacaacaccaucaucagacugaagagcagacugcaggaccuggaggaggccuucgagaacgccuacaagcugagcgacgacaaggaggcccagcugaagcaggagaacaagauguuccaggaccugcugggcgaguacgagagccugggcaaggagcacagaagagugaaggacgcccugaacaccaccgagaacaagcugcuggacgccuacacccagaucagcgaccugaagagaaugaucagcaagcuggaggcccaggugaagcagguggagcacgagaacaugcugagccugagacacaacagcagaauccacgugagacccagcagagccaacacccuggccaccagcgacgugagcagaagaaaguggcugauccccggcgccgaguacagcaucuucaccggccagccccuggacacccaggacagcaacguggacaaccagcuggaggagaccugcagccugggccacagaagcccccuggagaaggacagcagccccggcagcagcagcaccagccugcugaucaagaagcagagagagaccagcgacacccccaucaugagagcccugaaggagcuggacgagggcaagaucuucaagaacuggggcacccagaccgagaaggaggacaccagcaacaucaaccccagacagaccgagaccagcgugaacgccagcagaagccccgagaagugcgcccagcagagacagaagagacugaacagcgccagccagagaagcagcagccugccccccagcaacagaaagagcagcacccccaccaagagagagaucaugcugacccccgugaccguggccuacagccccaagagaagccccaaggagaaccugagccccggcuucagccaccugcugagcaagaacgagagcagccccaucagauucgacauccugcuggacgaccuggacaccgugcccgugagcacccugcagagaaccaaccccagaaagcagcugcaguuccugccccuggacgacagcgaggagaagaccuacagcgagaaggccaccgacaaccacgugaaccacagcagcugccccgagcccgugcccaacggcgugaagaaggugagcgugagaaccgccugggagaagaacaagagcgugagcuacgagcagugcaagcccgugagcgugaccccccagggcaacgacuucgaguacaccgccaagaucagaacccuggccgagaccgagagauucuucgacgagcugaccaaggagaaggaccagaucgaggccgcccugagcagaaugcccagccccggcggcagaaucacccugcagaccagacugaaccaggaggcccuggaggacagacuggagagaaucaacagagagcugggcagcgugagaaugacccugaagaaguuccacgugcugagaaccagcgccaaccuguaa

SEQ ID NO: 19992 - RNA, 864 nt, Artificial Sequence
  MPI__Homo_sapiens__NP_001276084
auggccgcccccagaguguucccccugagcugcgccgugcagcaguacgccuggggcaagaugggcagcaacagcgagguggccagacugcuggccagcagcgacccccuggcccagaucgccgaggacaagcccuacgccgagcuguggaugggcacccaccccagaggcgacgccaagauccuggacaacagaaucagccagaagacccugagccaguggaucgccgagaaccaggacagccugggcagcaaggugaaggacaccuucaacggcaaccugcccuuccuguucaaggugcugagcguggagaccccccugagcauccaggcccaccccaacaaggagcuggccgagaagcugcaccugcaggccccccagcacuaccccgacgccaaccacaagcccgagauggccaucgcccugacccccuuccagggccugugcggcuucagacccguggaggagaucgugaccuuccugaagaaggugcccgaguuccaguuccugaucggcgacgaggccgccacccaccugaagcagaccaugagccacgacagccaggccguggccagcagccugcagagcugcuucagccaccugaugaagagcgagaagaagguggugguggagcagcugaaccugcuggugaagagaaucagccagcaggccgccgccggcaacaacauggaggacaucuucggcgagcugcugcugcagcugcaccagcaguaccccggcgacaucggcugcuucgccaucuacuuccugaaccugcugacccugaagcccggcgaggccauguuccuggaggccaacgugccccacgccuaccugaagggcggccccuggcugugccacuaa

SEQ ID NO: 19993 - RNA, 540 nt, Artificial Sequence
  MPLKIP__Homo_sapiens__NP_619646
augcagagacagaacuucagaccccccaccccccccuaccccggccccggcggcggcggcuggggcagcggcagcagcuucagaggcacccccggcggcggcggccccagaccccccagccccagagacggcuacggcagcccccaccacaccccccccuacggccccagaagcagacccuacggcagcagccacagccccagacacggcggcagcuuccccggcggcagauucggcagccccagccccggcggcuaccccggcagcuacagcagaagccccgccggcagccagcagcaguucggcuacagccccggccagcagcagacccacccccagggcagccccagaaccagcacccccuucggcagcggcagagugagagagaagagaaugagcaacgagcuggagaacuacuucaagcccagcaugcuggaggaccccugggccggccuggagcccgugagcgugguggacaucagccagcaguacagcaacacccagaccuucaccggcaagaagggcagauacuucugcuaa

SEQ ID NO: 19994 - RNA, 2238 nt, Artificial Sequence
  MPO__Homo_sapiens__NP_000241
augggcgugcccuucuucagcagccugagaugcaugguggaccugggccccugcugggccggcggccugaccgccgagaugaagcugcugcuggcccuggccggccugcuggccauccuggccaccccccagcccagcgagggcgccgcccccgccgugcugggcgagguggacaccagccuggugcugagcagcauggaggaggccaagcagcugguggacaaggccuacaaggagagaagagagagcaucaagcagagacugagaagcggcagcgccagccccauggagcugcugagcuacuucaagcagcccguggccgccaccagaaccgccgugagagccgccgacuaccugcacguggcccuggaccugcuggagagaaagcugagaagccuguggagaagacccuucaacgugaccgacgugcugacccccgcccagcugaacgugcugagcaagagcagcggcugcgccuaccaggacgugggcgugaccugccccgagcaggacaaguacagaaccaucaccggcaugugcaacaacagaagaagccccacccugggcgccagcaacagagccuucgugagauggcugcccgccgaguacgaggacggcuucagccugcccuacggcuggacccccggcgugaagagaaacggcuuccccguggcccuggccagagccgugagcaacgagaucgugagauuccccaccgaccagcugacccccgaccaggagagaagccugauguucaugcaguggggccagcugcuggaccacgaccuggacuucacccccgagcccgccgccagagccagcuucgugaccggcgugaacugcgagaccagcugcgugcagcagccccccugcuucccccugaagaucccccccaacgaccccagaaucaagaaccaggccgacugcauccccuucuucagaagcugccccgccugccccggcagcaacaucaccaucagaaaccagaucaacgcccugaccagcuucguggacgccagcaugguguacggcagcgaggagccccuggccagaaaccugagaaacaugagcaaccagcugggccugcuggccgugaaccagagauuccaggacaacggcagagcccugcugcccuucgacaaccugcacgacgaccccugccugcugaccaacagaagcgccagaauccccugcuuccuggccggcgacaccagaagcagcgagaugcccgagcugaccagcaugcacacccugcugcugagagagcacaacagacuggccaccgagcugaagagccugaaccccagaugggacggcgagagacuguaccaggaggccagaaagaucgugggcgccauggugcagaucaucaccuacagagacuaccugccccuggugcugggccccaccgccaugagaaaguaccugcccaccuacagaagcuacaacgacagcguggaccccagaaucgccaacguguucaccaacgccuucagauacggccacacccugauccagcccuucauguucagacuggacaacagauaccagcccauggagcccaaccccagagugccccugagcagaguguucuucgccagcuggagaguggugcuggagggcggcaucgaccccauccugagaggccugauggccacccccgccaagcugaacagacagaaccagaucgccguggacgagaucagagagagacuguucgagcaggugaugagaaucggccuggaccugcccgcccugaacaugcagagaagcagagaccacggccugcccggcuacaacgccuggagaagauucugcggccugccccagcccgagaccgugggccagcugggcaccgugcugagaaaccugaagcuggccagaaagcugauggagcaguacggcacccccaacaacaucgacaucuggaugggcggcgugagcgagccccugaagagaaagggcagagugggcccccugcuggccugcaucaucggcacccaguucagaaagcugagagacggcgacagauucuggugggagaacgagggcguguucagcaugcagcagagacaggcccuggcccagaucagccugcccagaaucaucugcgacaacaccggcaucaccaccgugagcaagaacaacaucuucaugagcaacagcuaccccagagacuucgugaacugcagcacccugcccgcccugaaccuggccagcuggagagaggccagcuaa

SEQ ID NO: 19995 - RNA, 1341 nt, Artificial Sequence
  MPP1__Homo_sapiens__NP_001159933
augacccugaaggccagcgagggcgagagcggcggcagcaugcacaccgcccugagcgaccuguaccuggagcaccugcugcagaagagaagcagacccgaggccgugagccacccccugaacaccgugaccgaggacauguacaccaacggcagccccgcccccggcagccccgcccaggugaagggccaggaggugagaaaggugagacugauccaguucgagaaggugaccgaggagcccaugggcaucacccugaagcugaacgagaagcagagcugcaccguggccagaauccugcacggcggcaugauccacagacagggcagccugcacgugggcgacgagauccuggagaucaacggcaccaacgugaccaaccacagcguggaccagcugcagaaggccaugaaggagaccaagggcaugaucagccugaaggugauccccaaccagcagagcagacugcccgcccugcaggaggccggccugaaguucgccaccggcgacaucauccagaucaucaacaaggacgacagcaacugguggcagggcagaguggagggcagcagcaaggagagcgccggccugauccccagccccgagcugcaggaguggagaguggccagcauggcccagagcgcccccagcgaggcccccagcugcagccccuucggcaagaagaagaaguacaaggacaaguaccuggccaagcacagcagcaucuucgaccagcuggacguggugagcuacgaggagguggugagacugcccgccuucaagagaaagacccuggugcugaucggcgccagcggcgugggcagaagccacaucaagaacgcccugcugagccagaaccccgagaaguucguguaccccgugcccuacaccaccagaccccccagaaagagcgaggaggacggcaaggaguaccacuucaucagcaccgaggagaugaccagaaacaucagcgccaacgaguuccuggaguucggcagcuaccagggcaacauguucggcaccaaguucgagaccgugcaccagauccacaagcagaacaagaucgccauccuggacaucgagccccagacccugaagaucgugagaaccgccgagcugagccccuucaucguguucaucgcccccaccgaccagggcacccagaccgaggcccugcagcagcugcagaaggacagcgaggccaucagaagccaguacgcccacuacuucgaccugagccuggugaacaacggcguggacgagacccugaagaagcugcaggaggccuucgaccaggccugcagcagcccccagugggugcccgugagcuggguguacuaa

SEQ ID NO: 19996 - RNA, 1794 nt, Artificial Sequence
  MPP2__Homo_sapiens__NP_001265299
augagcugggccccccccccccaggugggccagaaccugagaagccagaccgugcugagaauccugaacggcauggaggaccugauguggguggccauggaggagagaagauucagagcccuggccagcuucaccaugcccguggccgccaccaacagcgagaccgccaugcagcaggugcuggacaaccugggcagccugcccagcgccaccggcgccgccgagcuggaccugaucuuccugagaggcaucauggagagccccaucgugagaagccuggccaaggcccacgagagacuggaggagaccaagcuggaggccgugagagacaacaaccuggagcuggugcaggagauccugagagaccuggcccagcuggccgagcagagcagcaccgccgccgagcuggcccacauccugcaggagccccacuuccagagccugcuggagacccacgacagcguggccagcaagaccuacgagacccccccccccagccccggccuggaccccaccuucagcaaccagcccgugccccccgacgccgugagaauggugggcaucagaaagaccgccggcgagcaccugggcgugaccuucagaguggagggcggcgagcuggugaucgccagaauccugcacggcggcaugguggcccagcagggccugcugcacgugggcgacaucaucaaggaggugaacggccagcccgugggcagcgaccccagagcccugcaggagcugcugagaaacgccagcggcagcgugauccugaagauccugcccagcuaccaggagccccaccugcccagacagguguucgugaagugccacuucgacuacgaccccgccagagacagccugauccccugcaaggaggccggccugagauucaacgccggcgaccugcugcagaucgugaaccaggacgacgccaacugguggcaggccugccacguggagggcggcagcgccggccugauccccagccagcugcuggaggagaagagaaaggccuucgugaagagagaccuggagcugacccccaacagcggcacccugugcggcagccugagcggcaagaagaagaagagaaugauguaccugaccaccaagaacgccgaguucgacagacacgagcugcugaucuacgaggagguggccagaaugccccccuucagaagaaagacccuggugcugaucggcgcccagggcgugggcagaagaagccugaagaacaagcugaucaugugggaccccgacagauacggcaccaccgugcccuacaccagcagaagacccaaggacagcgagagagagggccagggcuacagcuucgugagcagaggcgagauggaggccgacgugagagccggcagauaccuggagcacggcgaguacgagggcaaccuguacggcaccagaaucgacagcaucagaggcgugguggccgccggcaaggugugcgugcuggacgugaacccccaggccgugaaggugcugagaaccgccgaguucgugcccuacgugguguucaucgaggcccccgacuucgagacccugagagccaugaacagagccgcccuggagagcggcaucagcaccaagcagcugaccgaggccgaccugagaagaaccguggaggagagcagcagaauccagagaggcuacggccacuacuucgaccugugccuggugaacagcaaccuggagagaaccuucagagagcugcagaccgccauggagaagcugagaaccgagccccagugggugcccgugagcuggguguacuaa

SEQ ID NO: 19997 - RNA, 1758 nt, Artificial Sequence
  MPP3__Homo_sapiens__NP_001923
augcccgugcugagcgaggacagcggccugcacgagacccuggcccugcugaccagccagcugagacccgacagcaaccacaaggaggagaugggcuuccugagagacguguucagcgagaagagccugagcuaccugaugaagauccacgagaagcugagauacuacgagagacagagccccacccccgugcugcacagcgccguggcccuggccgaggacgugauggaggagcugcaggccgccagcgugcacagcgacgagagagagcugcugcagcugcugagcaccccccaccugagagccgugcugauggugcacgacaccguggcccagaagaacuucgaccccgugcugcccccccugcccgacaacaucgacgaggacuucgacgaggagagcgugaagaucgugagacuggugaagaacaaggagccccugggcgccaccaucagaagagacgagcacagcggcgccguggugguggccagaaucaugagaggcggcgccgccgacagaagcggccuggugcacgugggcgacgagcugagagaggugaacggcaucgccgugcugcacaagagacccgacgagaucagccagauccuggcccagagccagggcagcaucacccugaagaucauccccgccacccaggaggaggacagacugaaggagagcaagguguucaugagagcccuguuccacuacaaccccagagaggacagagccauccccugccaggaggccggccugcccuuccagagaagacaggugcuggagguggugagccaggacgaccccaccugguggcaggccaagagagugggcgacaccaaccugagagccggccugauccccagcaagggcuuccaggagagaagacugagcuacagaagagccgccggcacccugcccagcccccagagccugagaaagccccccuacgaccagcccugcgacaaggagaccugcgacugcgagggcuaccugaagggccacuacguggccggccugagaagaagcuucagacugggcugcagagagagacugggcggcagccaggagggcaagaugagcagcggcgccgagagccccgagcugcugaccuacgaggagguggccagauaccagcaccagcccggcgagagacccagacugguggugcugaucggcagccugggcgccagacugcacgagcugaagcagaaggugguggccgagaacccccagcacuucggcguggccgugccccacaccaccagacccagaaagagccacgagaaggagggcguggaguaccacuucgugagcaagcaggccuucgaggccgaccugcaccacaacaaguuccuggagcacggcgaguacaaggagaaccuguacggcaccagccuggaggccauccaggccgugauggccaagaacaaggugugccugguggacguggagcccgaggcccugaagcagcugagaaccagcgaguucaagcccuacaucaucuucgugaagcccgccauccaggagaagagaaagaccccccccaugagccccgccugcgaggacaccgccgcccccuucgacgagcagcagcaggagauggccgccagcgccgccuucaucgacagacacuacggccaccugguggacgccgugcuggugaaggaggaccugcagggcgccuacagccagcugaagguggugcuggagaagcugagcaaggacacccacugggugcccgugagcugggugagauaa

SEQ ID NO: 19998 - RNA, 1926 nt, Artificial Sequence
  MPP5__Homo_sapiens__NP_001243479
auggccguggacugccccggcgaccugggcaccagaaugaugcccaucagaagaagcgcccagcuggagagaaucagacagcagcaggaggacaugagaagaagaagagaggaggagggcaagaagcaggagcuggaccugaacagcagcaugagacugaagaagcuggcccagaucccccccaagaccggcaucgacaaccccauguucgacaccgaggagggcaucgugcuggagagcccccacuacgccgugaagauccuggagaucgaggaccuguucagcagccugaagcacauccagcacacccugguggacagccagagccaggaggacaucagccugcugcugcagcuggugcagaacaaggacuuccagaacgccuucaagauccacaacgccaucaccgugcacaugaacaaggccagcccccccuucccccugaucagcaacgcccaggaccuggcccaggaggugcagaccgugcugaagcccgugcaccacaaggagggccaggagcugaccgcccugcugaacaccccccacauccaggcccugcugcuggcccacgacaagguggccgagcaggagaugcagcuggagcccaucaccgacgagagaguguacgagagcaucggccaguacggcggcgagaccgugaagaucgugagaaucgagaaggccagagacaucccccugggcgccaccgugagaaacgagauggacagcgugaucaucagcagaaucgugaagggcggcgccgccgagaagagcggccugcugcacgagggcgacgaggugcuggagaucaacggcaucgagaucagaggcaaggacgugaacgagguguucgaccugcugagcgacaugcacggcacccugaccuucgugcugauccccagccagcagaucaagcccccccccgccaaggagaccgugauccacgugaaggcccacuucgacuacgaccccagcgacgaccccuacgugcccugcagagagcugggccugagcuuccagaagggcgacauccugcacgugaucagccaggaggaccccaacugguggcaggccuacagagagggcgacgaggacaaccagccccuggccggccuggugcccggcaagagcuuccagcagcagagagaggccaugaagcagaccaucgaggaggacaaggagcccgagaagagcggcaagcuguggugcgccaagaagaacaagaagaagagaaagaaggugcuguacaacgccaacaagaacgacgacuacgacaacgaggagauccugaccuacgaggagaugagccuguaccaccagcccgccaacagaaagagacccaucauccugaucggcccccagaacugcggccagaacgagcugagacagagacugaugaacaaggagaaggacagauucgccagcgccgugccccacaccaccagaagcagaagagaccaggagguggccggcagagacuaccacuucgugagcagacaggccuucgaggccgacaucgccgccggcaaguucaucgagcacggcgaguucgagaagaaccuguacggcaccagcaucgacagcgugagacaggugaucaacagcggcaagaucugccugcugagccugagaacccagagccugaagacccugagaaacagcgaccugaagcccuacaucaucuucaucgccccccccagccaggagagacugagagcccugcuggccaaggagggcaagaaccccaagcccgaggagcugagagagaucaucgagaagaccagagagauggagcagaacaacggccacuacuucgacaccgccaucgugaacagcgaccuggacaaggccuaccaggagcugcugagacugaucaacaagcuggacaccgagccccagugggugcccagcaccuggcugagauaa

SEQ ID NO: 19999 - RNA, 1500 nt, Artificial Sequence
  MPP7__Homo_sapiens__XP_005252425
augcccgcccugagcaccggcagcggcagcgacaccggccuguacgagcugcuggccgcccugcccgcccagcugcagccccacguggacagccaggaggaccugaccuuccugugggacauguucggcgagaagagccugcacagccuggugaagauccacgagaagcugcacuacuacgagaagcagagccccgugcccauccugcacggcgccgccgcccuggccgacgaccuggccgaggagcugcagaacaagccccugaacagcgagaucagagagcugcugaagcugcugagcaagcccaacgugaaggcccugcugagcgugcacgacaccguggcccagaagaacuacgaccccgugcugccccccaugcccgaggacaucgacgacgaggaggacagcgugaagaucaucagacuggugaagaacagagagccccugggcgccaccaucaagaaggacgagcagaccggcgccaucaucguggccagaaucaugagaggcggcgccgccgacagaagcggccugauccacgugggcgacgagcugagagaggugaacggcauccccguggaggacaagagacccgaggagaucauccagauccuggcccagagccagggcgccaucaccuucaagaucauccccggcagcaaggaggagacccccagcaaggagggcaagauguucaucaaggcccuguucgacuacaaccccaacgaggacaaggccauccccugcaaggaggccggccugagcuucaagaagggcgacauccugcagaucaugagccaggacgacgccaccugguggcaggccaagcacgaggccgacgccaaccccagagccggccugauccccagcaagcacuuccaggagagaagacuggcccugagaagacccgagauccuggugcagccccugaaggugagcaacagaaagagcagcggcuucagaaagagcuucagacugagcagaaaggacaagaagaccaacaagagcauguacgagugcaagaagagcgaccaguacgacaccgccgacgugcccaccuacgaggaggugacccccuacagaagacagaccaacgagaaguacagacugguggugcuggugggccccgugggcgugggccugaacgagcugaagagaaagcugcugaucagcgacacccagcacuacggcgugaccgugccccacaccaccagagccagaagaagccaggagagcgacggcguggaguacaucuucaucagcaagcaccuguucgagaccgacgugcagaacaacaaguucaucgaguacggcgaguacaagaacaacuacuacggcaccagcaucgacagcgugagaagcgugcuggccaagaacaaggugugccugcuggacgugcagccccacggccccugguuccugcugccccugauggccgugcccuggggcgccaagccccccaacgccagaaugaccugcggcagcccccuggaccuguaa

SEQ ID NO: 20000 - RNA, 1002 nt, Artificial Sequence
  MPPE1__Homo_sapiens__NP_001229833
auggccaugaucgagcugggcuucggcagacagaacuuccacccccugaagagaaagagcagccugcugcugaagcugaucgccgugguguucgccgugcugcuguucugcgaguuccugaucuacuaccuggccaucuuccagugcaacuggcccgaggugaagaccaccgccagcgacggcgagcagaccaccagagagcccgugcugaaggccauguuccuggccgacacccaccugcugggcgaguuccugggccacuggcuggacaagcugagaagagaguggcagauggagagagccuuccagaccgcccuguggcugcugcagcccgaggugguguucauccugggcgacaucuucgacgagggcaaguggagcacccccgaggccugggccgacgacguggagagauuccagaagauguucagacaccccagccacgugcagcugaaggugguggccggcaaccacgacaucggcuuccacuacgagaugaacaccuacaagguggagagauucgagaagguguucagcagcgagagacuguucagcuggaagggcaucaacuucgugauggugaacagcguggcccugaacggcgacggcugcggcaucugcagcgagaccgaggccgagcugaucgaggugagccacagacugaacugcagcagagagcugcugugguggcugcagcccagacuggugcugagcggccacacccacagcgccugcgaggugcaccacggcggcagagugcccgagcugagcgugcccagcuucagcuggagaaacagaaacaaccccagcuucaucaugggcagcaucacccccaccgacuacacccugagcaagugcuaccugcccagagaggacguggugcugaucaucuacugcggcguggugggcuuccugguggugcugacccugacccacuucggccugcuggccagccccuuccugagcggccugaaccugcugggcaagagaaagaccagauaa

SEQ ID NO: 20001 - RNA, 834 nt, Artificial Sequence
  MPPED2__Homo_sapiens__NP_001138871
auggcccacggcauccccagccagggcaaggugaccaucaccguggacgaguacagcagcaaccccacccaggccuucacccacuacaacaucaaccagagcagauuccagcccccccacgugcacaugguggaccccauccccuacgacacccccaagcccgccggccacaccagauucgugugcaucagcgacacccacagcagaaccgacggcauccagaugcccuacggcgacauccugcugcacaccggcgacuucaccgagcugggccugcccagcgaggugaagaaguucaacgacuggcugggcaaccugcccuacgaguacaagaucgugaucgccggcaaccacgagcugaccuucgacaaggaguucauggccgaccuggugaagcaggacuacuacagauuccccagcgugagcaagcugaagcccgaggacuucgacaacgugcagagccugcugaccaacagcaucuaccugcaggacagcgaggugaccgugaagggcuucagaaucuacggcgcccccuggacccccugguucaacggcuggggcuucaaccugcccagaggccagagccugcuggacaaguggaaccugauccccgagggcaucgacauccugaugacccacggccccccccugggcuucagagacugggugcccaaggagcugcagagagugggcugcguggagcugcugaacaccgugcagagaagagugagacccaagcugcacguguucggcggcauccacgaggugaaccccgugagcaucagcaaggcccugagaaccaagaucugcagccugcccagcaagaccagcuaa

SEQ ID NO: 20002 - RNA, 3117 nt, Artificial Sequence
  MPRIP__Homo_sapiens__NP_055949
augagcgccgccaaggagaaccccugcagaaaguuccaggccaacaucuucaacaagagcaagugccagaacugcuucaagcccagagagagccaccugcugaacgacgaggaccugacccaggccaagcccaucuacggcggcuggcugcugcuggcccccgacggcaccgacuucgacaaccccgugcacagaagcagaaaguggcagagaagauucuucauccuguacgagcacggccugcugagauacgcccuggacgagaugcccaccacccugccccagggcaccaucaacaugaaccagugcaccgacgugguggacggcgagggcagaaccggccagaaguucagccugugcauccugacccccgagaaggagcacuucaucagagccgagaccaaggagaucgugagcggcuggcuggagaugcugaugguguaccccagaaccaacaagcagaaccagaagaagaagagaaagguggagccccccaccccccaggagcccggccccgccaagguggccgugaccagcagcagcagcagcagcagcagcagcagcagcauccccagcgccgagaaggugcccaccaccaagagcacccuguggcaggaggagaugagaaccaaggaccagcccgacggcagcagccugagccccgcccagagccccagccagagccagccccccgccgccagcagccugagagagcccggccuggagagcaaggaggaggagagcgccaugagcagcgacagaauggacugcggcagaaaggugagaguggagagcggcuacuucagccuggagaagaccaagcaggaccugaaggccgaggagcagcagcugccccccccccugagcccccccagccccagcacccccaaccacagaagaagccaggugaucgagaaguucgaggcccuggacaucgagaaggccgagcacauggagaccaacgccgugggccccagccccagcagcgacaccagacagggcagaagcgagaagagagccuuccccagaaagagagacuucaccaacgaggccccccccgccccccugcccgacgccagcgccagcccccugagcccccacagaagagccaagagccuggacagaagaagcaccgagcccagcgugacccccgaccugcugaacuucaagaagggcuggcugaccaagcaguacgaggacggccaguggaagaagcacugguucgugcuggccgaccagagccugagauacuacagagacagcguggccgaggaggccgccgaccuggacggcgagaucgaccugagcgccugcuacgacgugaccgaguaccccgugcagagaaacuacggcuuccagauccacaccaaggagggcgaguucacccugagcgccaugaccagcggcaucagaagaaacuggauccagaccaucaugaagcacgugcaccccaccaccgcccccgacgugaccagcagccugcccgaggagaagaacaagagcagcugcagcuucgagaccugccccagacccaccgagaagcaggaggccgagcugggcgagcccgaccccgagcagaagagaagcagagccagagagagaagaagagagggcagaagcaagaccuucgacugggccgaguucagacccauccagcaggcccuggcccaggagagagugggcggcgugggccccgccgacacccacgagccccugagacccgaggccgagcccggcgagcuggagagagagagagccagaagaagagaggagagaagaaagagauucggcaugcuggacgccaccgacggccccggcaccgaggacgccgcccugagaauggagguggacagaagccccggccugcccaugagcgaccugaagacccacaacgugcacguggagaucgagcagagauggcaccagguggagaccaccccccugagagaggagaagcaggugcccaucgcccccgugcaccugagcagcgaggacggcggcgacagacugagcacccacgagcugaccagccugcuggagaaggagcuggagcagagccagaaggaggccagcgaccugcuggagcagaacagacugcugcaggaccagcugagaguggcccugggcagagagcagagcgccagagagggcuacgugcugcaggccaccugcgagagaggcuucgccgccauggaggagacccaccagaagaagaucgaggaccugcagagacagcaccagagagagcuggagaagcugagagaggagaaggacagacugcuggccgaggagaccgccgccaccaucagcgccaucgaggccaugaagaacgcccacagagaggagauggagagagagcuggagaagagccagagaagccagaucagcagcgugaacagcgacguggaggcccugagaagacaguaccuggaggagcugcagagcgugcagagagagcuggaggugcugagcgagcaguacagccagaagugccuggagaacgcccaccuggcccaggcccuggaggccgagagacaggcccugagacagugccagagagagaaccaggagcugaacgcccacaaccaggagcugaacaacagacuggccgccgagaucaccagacugagaacccugcugaccggcgacggcggcggcgaggccaccggcagcccccuggcccagggcaaggacgccuacgagcuggaggugcugcugagagugaaggagagcgagauccaguaccugaagcaggagaucagcagccugaaggacgagcugcagaccgcccugagagacaagaaguacgccagcgacaaguacaaggacaucuacaccgagcugagcaucgccaaggccaaggccgacugcgacaucagcagacugaaggagcagcugaaggccgccaccgaggcccugggcgagaagagccccgacagcgccaccgugagcggcuacgacaucaugaagagcaagagcaaccccgacuuccugaagaaggacagaagcugcgugaccagacagcugagaaacaucagaagcaagagccugaaggagggccugaccgugcaggagagacugaagcuguucgagagcagagaccugaagaaggacuaa

SEQ ID NO: 20003 - RNA, 894 nt, Artificial Sequence
  MPST__Homo_sapiens__NP_001123989
auggccagcccccagcugugcagagcccuggugagcgcccaguggguggccgaggcccugagagcccccagagccggccagccccugcagcugcuggacgccagcugguaccugcccaagcugggcagagacgccagaagagaguucgaggagagacacauccccggcgccgccuucuucgacaucgaccagugcagcgacagaaccagccccuacgaccacaugcugcccggcgccgagcacuucgccgaguacgccggcagacugggcgugggcgccgccacccacguggugaucuacgacgccagcgaccagggccuguacagcgcccccagagugugguggauguucagagccuucggccaccacgccgugagccugcuggacggcggccugagacacuggcugagacagaaccugccccugagcagcggcaagagccagcccgcccccgccgaguucagagcccagcuggaccccgccuucaucaagaccuacgaggacaucaaggagaaccuggagagcagaagauuccaggugguggacagcagagccaccggcagauucagaggcaccgagcccgagcccagagacggcaucgagcccggccacauccccggcaccgugaacauccccuucaccgacuuccugagccaggagggccuggagaagagccccgaggagaucagacaccuguuccaggagaagaagguggaccugagcaagccccugguggccaccugcggcagcggcgugaccgccugccacguggcccugggcgccuaccugugcggcaagcccgacgugcccaucuacgacggcagcuggguggagugguacaugagagccagacccgaggacgugaucagcgagggcagaggcaagacccacuaa

SEQ ID NO: 20004 - RNA, 531 nt, Artificial Sequence
  MPV17__Homo_sapiens__XP_005264383
auggcccuguggagagccuaccagagagcccuggccgcccaccccuggaaggugcaggugcugaccgccggcagccugaugggccugggcgacaucaucagccagcagcugguggagagaagaggccugcaggagcaccagagaggcagaacccugaccauggugagccugggcugcggcuucgugggccccguggugggcggcugguacaaggugcuggacagauucauccccggcaccaccaagguggacgcccugaagaagaugcugcuggaccagggcggcuucgcccccugcuuccugggcugcuuccugccccuggugggcgcccugaacggccugagcgcccaggacaacugggccaagcugcagagagacuaccccgacgcccugaucaccaacuacuaccuguggcccgccgugcagcuggccaacuucuaccuggugccccugcacuacagacuggccguggugcagugcguggccgugaucuggaacagcuaccugagcuggaaggcccacagacuguaa

SEQ ID NO: 20005 - RNA, 621 nt, Artificial Sequence
  MPV17L2__Homo_sapiens__NP_116072
auggccagaggcggcuggagaagacugagaagacugcugagcgccggccagcugcuguuccagggcagagcccugcuggugaccaacacccugggcugcggcgcccugauggccgccggcgacggcgugagacagagcugggagaucagagccagacccggccagguguucgaccccagaagaagcgccagcauguucgccgugggcugcagcaugggccccuuccugcacuacugguaccugagccuggacagacuguuccccgccagcggccugagaggcuuccccaacgugcugaagaaggugcugguggaccagcugguggccagcccccugcugggcgugugguacuuccugggccugggcugccuggagggccagaccgugggcgagagcugccaggagcugagagagaaguucugggaguucuacaaggccgacuggugcguguggcccgccgcccaguucgugaacuuccuguucgugcccccccaguucagagugaccuacaucaacggccugacccugggcugggacaccuaccugagcuaccugaaguacagaagccccgugccccugaccccccccggcugcguggcccuggacaccagagccgacuaa

SEQ ID NO: 20006 - RNA, 747 nt, Artificial Sequence
  MPZ__Homo_sapiens__NP_000521
auggcccccggcgcccccagcagcagccccagccccauccuggccgugcugcuguucagcagccuggugcugagccccgcccaggccaucgugguguacaccgacagagaggugcacggcgccgugggcagcagagugacccugcacugcagcuucuggagcagcgagugggugagcgacgacaucagcuucaccuggagauaccagcccgagggcggcagagacgccaucagcaucuuccacuacgccaagggccagcccuacaucgacgaggugggcaccuucaaggagagaauccagugggugggcgaccccagauggaaggacggcagcaucgugauccacaaccuggacuacagcgacaacggcaccuucaccugcgacgugaagaacccccccgacaucgugggcaagaccagccaggugacccuguacguguucgagaaggugcccaccagauacggcguggugcugggcgccgugaucggcggcgugcugggcguggugcugcugcugcugcugcuguucuacguggugagauacugcuggcugagaagacaggccgcccugcagagaagacugagcgccauggagaagggcaagcugcacaagcccggcaaggacgccagcaagagaggcagacagacccccgugcuguacgccaugcuggaccacagcagaagcaccaaggccgugagcgagaagaaggccaagggccugggcgagagcagaaaggacaagaaguaa

SEQ ID NO: 20007 - RNA, 360 nt, Artificial Sequence
  MPZL1__Homo_sapiens__NP_001139663
auggccgccagcgccggcgccggcgccgugaucgccgcccccgacagcagaagauggcuguggagcgugcuggccgccgcccugggccugcugaccgccggcgugagcgcccuggagguguacacccccaaggagaucuucguggccaacggcacccagggcaagcugaccugcaaguucaagagcaccagcaccaccggcggccugaccagcgugagcuggagcuuccagcccgagggcgccgacaccaccgugagcggccccgugaucuacgcccagcuggaccacagcggcggccaccacagcgacaagaucaacaagagcgagagcgugguguacgccgacaucagaaagaacuaa

SEQ ID NO: 20008 - RNA, 648 nt, Artificial Sequence
  MPZL2__Homo_sapiens__NP_658911
auguacggcaagagcagcaccagagccgugcugcugcugcugggcauccagcugaccgcccuguggcccaucgccgccguggagaucuacaccagcagagugcuggaggccgugaacggcaccgacgccagacugaagugcaccuucagcagcuucgcccccgugggcgacgcccugaccgugaccuggaacuucagaccccuggacggcggccccgagcaguucguguucuacuaccacaucgaccccuuccagcccaugagcggcagauucaaggacagagugagcugggacggcaaccccgagagauacgacgccagcauccugcuguggaagcugcaguucgacgacaacggcaccuacaccugccaggugaagaacccccccgacguggacggcgugaucggcgagaucagacugagcguggugcacaccgugagauucagcgagauccacuuccuggcccuggccaucggcagcgccugcgcccugaugaucaucaucgugaucgugguggugcuguuccagcacuacagaaagaagagaugggccgagagagcccacaaggugguggagaucaagagcaaggaggaggagagacugaaccaggagaagaaggugagcguguaccuggaggacaccgacuaa

SEQ ID NO: 20009 - RNA, 672 nt, Artificial Sequence
  MPZL3__Homo_sapiens__NP_001273081
augcagcagagaggcgccgccggcagcagaggcugcgcccuguucccccugcugggcgugcuguucuuccaggacgcccacgugagaggcuacgugggcgagaagaucaagcugaagugcaccuucaagagcaccagcgacgugaccgacaagcugaccaucgacuggaccuacagaccccccagcagcagccacaccgugagcaucuuccacuaccagagcuuccaguaccccaccaccgccggcaccuucagagacagaaucagcugggugggcaacguguacaagggcgacgccagcaucagcaucagcaaccccaccaucaaggacaacggcaccuucagcugcgccgugaagaacccccccgacgugcaccacaacauccccaugaccgagcugaccgugaccgagagaggcuucggcaccaugcugagcagcguggcccugcugagcauccugguguucgugcccagcgccguggugguggcccugcugcuggugagaaugggcagaaaggccgccggccugaagaagagaagcagaagcggcuacaagaagagcagcaucgaggugagcgacgacaccgaccaggaggaggaggaggccugcauggccagacugugcgugagaugcgccgagugccuggacagcgacuacgaggagaccuacuaa

SEQ ID NO: 20010 - RNA, 891 nt, Artificial Sequence
  MR1__Homo_sapiens__NP_001181928
augggcgagcugauggccuuccugcugccccugaucaucgugcugauggugaagcacagcgacagcagaacccacagccugagauacuucagacugggcgugagcgaccccauccacggcgugcccgaguucaucagcgugggcuacguggacagccaccccaucaccaccuacgacagcgugaccagacagaaggagcccagagcccccuggauggccgagaaccuggcccccgaccacugggagagauacacccagcugcugagaggcuggcagcagauguucaagguggagcugaagagacugcagagacacuacaaccacagcgacaacguggcccacaccaucaagcaggccugggaggccaaccagcacgagcugcuguaccagaagaacuggcuggaggaggagugcaucgccuggcugaagagauuccuggaguacggcaaggacacccugcagagaaccgagcccccccuggugagagugaacagaaaggagaccuuccccggcgugaccgcccuguucugcaaggcccacggcuucuacccccccgagaucuacaugaccuggaugaagaacggcgaggagaucgugcaggagaucgacuacggcgacauccugcccagcggcgacggcaccuaccaggccugggccagcaucgagcuggacccccagagcagcaaccuguacagcugccacguggagcacugcggcgugcacauggugcugcaggugccccaggagagcgagaccaucccccuggugaugaaggccgugagcggcagcaucgugcuggugaucgugcuggccggcgugggcgugcugguguggagaagaagacccagagagcagaacggcgccaucuaccugcccacccccgacagauaa

SEQ ID NO: 20011 - RNA, 618 nt, Artificial Sequence
  MRAP2__Homo_sapiens__XP_011533703
augagcgcccagagacugaucagcaacagaaccagccagcagagcgccagcaacagcgacuacaccugggaguacgaguacuacgagaucggccccgugagcuucgagggccugaaggcccacaaguacagcaucgugaucggcuucugggugggccuggccguguucgugaucuucauguucuucgugcugacccugcugaccaagaccggcgccccccaccaggacaacgccgagagcagcgagaagagauucagaaugaacagcuucgugagcgacuucggcagaccccuggagcccgacaagguguucagcagacagggcaacgaggagagcagaagccuguuccacugcuacaucaacgagguggagagacuggacagagccaaggccugccaccagaccaccgcccuggacagcgacgugcagcugcaggaggccaucagaagcagcggccagcccgaggaggagcugaacagacugaugaaguucgacauccccaacuucgugaacaccgaccagaacuacuucggcgaggacgaccugcugaucagcgagccccccaucgugcuggagaccaagccccugagccagaccagccacaaggaccuggacuaa

SEQ ID NO: 20012 - RNA, 519 nt, Artificial Sequence
  MRAP__Homo_sapiens__NP_848932
auggccaacggcaccaacgccagcgcccccuacuacagcuacgaguacuaccuggacuaccuggaccugauccccguggacgagaagaagcugaaggcccacaagcacagcaucgugaucgccuucugggugagccuggccgccuucguggugcugcuguuccugauccugcuguacaugagcuggagcgccagcccccagaugagaaacagccccaagcaccaccagaccugccccuggagccacggccugaaccugcaccugugcauccagaagugccugcccugccacagagagccccuggccaccagccaggcccaggccagcagcguggagcccggcagcagaaccggccccgaccagccccugagacaggagagcagcagcacccugccccugggcggcuuccagacccaccccacccugcugugggagcugacccugaacggcggcccccuggugagaagcaagcccagcgagcccccccccggcgacagaaccagccagcugcagagcuaa

SEQ ID NO: 20013 - RNA, 627 nt, Artificial Sequence
  MRAS__Homo_sapiens__NP_001239019
auggccaccagcgccgugcccagcgacaaccugcccaccuacaagcuggugguggugggcgacggcggcgugggcaagagcgcccugaccauccaguucuuccagaagaucuucgugcccgacuacgaccccaccaucgaggacagcuaccugaagcacaccgagaucgacaaccagugggccauccuggacgugcuggacaccgccggccaggaggaguucagcgccaugagagagcaguacaugagaaccggcgacggcuuccugaucguguacagcgugaccgacaaggccagcuucgagcacguggacagauuccaccagcugauccugagagugaaggacagagagagcuuccccaugauccugguggccaacaagguggaccugaugcaccugagaaagaucaccagagagcagggcaaggagauggccaccaagcacaacauccccuacaucgagaccagcgccaaggaccccccccugaacguggacaaggccuuccacgaccuggugagagugaucagacagcagauccccgagaagagccagaagaagaagaagaagaccaaguggagaggcgacagagccaccggcacccacaagcugcagugcgugauccuguaa

SEQ ID NO: 20014 - RNA, 4371 nt, Artificial Sequence
  MRC1__Homo_sapiens__NP_002429
augagacugccccugcugcugguguucgccagcgugauccccggcgccgugcugcugcuggacaccagacaguuccugaucuacaacgaggaccacaagagaugcguggacgccgugagccccagcgccgugcagaccgccgccugcaaccaggacgccgagagccagaaguucagaugggugagcgagagccagaucaugagcguggccuucaagcugugccugggcgugcccagcaagaccgacuggguggccaucacccuguacgccugcgacagcaagagcgaguuccagaagugggagugcaagaacgacacccugcugggcaucaagggcgaggaccuguucuucaacuacggcaacagacaggagaagaacaucaugcuguacaagggcagcggccuguggagcagauggaagaucuacggcaccaccgacaaccugugcagcagaggcuacgaggccauguacacccugcugggcaacgccaacggcgccaccugcgccuuccccuucaaguucgagaacaagugguacgccgacugcaccagcgccggcagaagcgacggcuggcuguggugcggcaccaccaccgacuacgacaccgacaagcuguucggcuacugcccccugaaguucgagggcagcgagagccuguggaacaaggacccccugaccagcgugagcuaccagaucaacagcaagagcgcccugaccuggcaccaggccagaaagagcugccagcagcagaacgccgagcugcugagcaucaccgagauccacgagcagaccuaccugaccggccugaccagcagccugaccagcggccuguggaucggccugaacagccugagcuucaacagcggcuggcaguggagcgacagaagccccuucagauaccugaacuggcugcccggcagccccagcgccgagcccggcaagagcugcgugagccugaaccccggcaagaacgccaagugggagaaccuggagugcgugcagaagcugggcuacaucugcaagaagggcaacaccacccugaacagcuucgugauccccagcgagagcgacgugcccacccacugccccagccagugguggcccuacgccggccacugcuacaagauccacagagacgagaagaagauccagagagacgcccugaccaccugcagaaaggagggcggcgaccugaccagcauccacaccaucgaggagcuggacuucaucaucagccagcugggcuacgagcccaacgacgagcuguggaucggccugaacgacaucaagauccagauguacuucgaguggagcgacggcacccccgugaccuucaccaaguggcugagaggcgagcccagccacgagaacaacagacaggaggacugcguggugaugaagggcaaggacggcuacugggccgacagaggcugcgaguggccccugggcuacaucugcaagaugaagagcagaagccagggccccgagaucguggagguggagaagggcugcagaaagggcuggaagaagcaccacuucuacugcuacaugaucggccacacccugagcaccuucgccgaggccaaccagaccugcaacaacgagaacgccuaccugaccaccaucgaggacagauacgagcaggccuuccugaccagcuucgugggccugagacccgagaaguacuucuggaccggccugagcgacauccagaccaagggcaccuuccaguggaccaucgaggaggaggugagauucacccacuggaacagcgacaugcccggcagaaagcccggcugcguggccaugagaaccggcaucgccggcggccugugggacgugcugaagugcgacgagaaggccaaguucgugugcaagcacugggccgagggcgugacccacccccccaagcccaccaccacccccgagcccaagugccccgaggacuggggcgccagcagcagaaccagccugugcuucaagcuguacgccaagggcaagcacgagaagaagaccugguucgagagcagagacuucugcagagcccugggcggcgaccuggccagcaucaacaacaaggaggagcagcagaccaucuggagacugaucaccgccagcggcagcuaccacaagcuguucuggcugggccugaccuacggcagccccagcgagggcuucaccuggagcgacggcagccccgugagcuacgagaacugggccuacggcgagcccaacaacuaccagaacguggaguacugcggcgagcugaagggcgaccccaccaugagcuggaacgacaucaacugcgagcaccugaacaacuggaucugccagauccagaagggccagacccccaagcccgagcccacccccgccccccaggacaacccccccgugaccgaggacggcugggugaucuacaaggacuaccaguacuacuucagcaaggagaaggagaccauggacaacgccagagccuucugcaagagaaacuucggcgaccuggugagcauccagagcgagagcgagaagaaguuccuguggaaguacgugaacagaaacgacgcccagagcgccuacuucaucggccugcugaucagccuggacaagaaguucgccuggauggacggcagcaagguggacuacgugagcugggccaccggcgagcccaacuucgccaacgaggacgagaacugcgugaccauguacagcaacagcggcuucuggaacgacaucaacugcggcuaccccaacgccuucaucugccagagacacaacagcagcaucaacgccaccaccgugaugcccaccaugcccagcgugcccagcggcugcaaggagggcuggaacuucuacagcaacaagugcuucaagaucuucggcuucauggaggaggagagaaagaacuggcaggaggccagaaaggccugcaucggcuucggcggcaaccuggugagcauccagaacgagaaggagcaggccuuccugaccuaccacaugaaggacagcaccuucagcgccuggaccggccugaacgacgugaacagcgagcacaccuuccuguggaccgacggcagaggcgugcacuacaccaacuggggcaagggcuaccccggcggcagaagaagcagccugagcuacgaggacgccgacugcguggugaucaucggcggcgccagcaacgaggccggcaaguggauggacgacaccugcgacagcaagagaggcuacaucugccagaccagaagcgaccccagccugaccaacccccccgccaccauccagaccgacggcuucgugaaguacggcaagagcagcuacagccugaugagacagaaguuccaguggcacgaggccgagaccuacugcaagcugcacaacagccugaucgccagcauccuggaccccuacagcaacgccuucgccuggcugcagauggagaccagcaacgagagaguguggaucgcccugaacagcaaccugaccgacaaccaguacaccuggaccgacaaguggagagugagauacaccaacugggccgccgacgagcccaagcugaagagcgccugcguguaccuggaccuggacggcuacuggaagaccgcccacugcaacgagagcuucuacuuccugugcaagagaagcgacgagauccccgccaccgagcccccccagcugcccggcagaugccccgagagcgaccacaccgccuggauccccuuccacggccacugcuacuacaucgagagcagcuacaccagaaacuggggccaggccagccuggagugccugagaaugggcagcagccuggugagcaucgagagcgccgccgagagcagcuuccugagcuacagaguggagccccugaagagcaagaccaacuucuggaucggccuguucagaaacguggagggcaccuggcuguggaucaacaacagccccgugagcuucgugaacuggaacaccggcgaccccagcggcgagagaaacgacugcguggcccugcacgccagcagcggcuucuggagcaacauccacugcagcagcuacaagggcuacaucugcaagagacccaagaucaucgacgccaagcccacccacgagcugcugaccaccaaggccgacaccagaaagauggaccccagcaagcccagcagcaacguggccggcguggugaucaucgugauccugcugauccugaccggcgccggccuggccgccuacuucuucuacaagaagagaagagugcaccugccccaggagggcgccuucgagaacacccuguacuucaacagccagagcagccccggcaccagcgacaugaaggaccuggugggcaacaucgagcagaacgagcacagcgugaucuaa

SEQ ID NO: 20015 - RNA, 4440 nt, Artificial Sequence
  MRC2__Homo_sapiens__NP_006030
augggccccggcagacccgcccccgcccccuggcccagacaccugcugagaugcgugcugcugcugggcugccugcaccugggcagacccggcgcccccggcgacgccgcccugcccgagcccaacguguuccugaucuucagccacggccugcagggcugccuggaggcccagggcggccaggugagagugacccccgccugcaacaccagccugcccgcccagagauggaagugggugagcagaaacagacuguucaaccugggcaccaugcagugccugggcaccggcuggcccggcaccaacaccaccgccagccugggcauguacgagugcgacagagaggcccugaaccugagauggcacugcagaacccugggcgaccagcugagccugcugcugggcgccagaaccagcaacaucagcaagcccggcacccuggagagaggcgaccagaccagaagcggccaguggagaaucuacggcagcgaggaggaccugugcgcccugcccuaccacgagguguacaccauccagggcaacagccacggcaagcccugcaccauccccuucaaguacgacaaccagugguuccacggcugcaccagcaccggcagagaggacggccaccuguggugcgccaccacccaggacuacggcaaggacgagagauggggcuucugccccaucaagagcaacgacugcgagaccuucugggacaaggaccagcugaccgacagcugcuaccaguucaacuuccagagcacccugagcuggagagaggccugggccagcugcgagcagcagggcgccgaccugcugagcaucaccgagauccacgagcagaccuacaucaacggccugcugaccggcuacagcagcacccuguggaucggccugaacgaccuggacaccagcggcggcuggcaguggagcgacaacagcccccugaaguaccugaacugggagagcgaccagcccgacaaccccagcgaggagaacugcggcgugaucagaaccgagagcagcggcggcuggcagaacagagacugcagcaucgcccugcccuacgugugcaagaagaagcccaacgccaccgccgagcccaccccccccgacagaugggccaacgugaagguggagugcgagcccagcuggcagcccuuccagggccacugcuacagacugcaggccgagaagagaagcuggcaggagagcaagaaggccugccugagaggcggcggcgaccuggugagcauccacagcauggccgagcuggaguucaucaccaagcagaucaagcaggagguggaggagcuguggaucggccugaacgaccugaagcugcagaugaacuucgaguggagcgacggcagccuggugagcuucacccacuggcaccccuucgagcccaacaacuucagagacagccuggaggacugcgugaccaucuggggccccgagggcagauggaacgacagccccugcaaccagagccugcccagcaucugcaagaaggccggccagcugagccagggcgccgccgaggaggaccacggcugcagaaagggcuggaccuggcacagccccagcugcuacuggcugggcgaggaccaggugaccuacagcgaggccagaagacugugcaccgaccacggcagccagcuggugaccaucaccaacagauucgagcaggccuucgugagcagccugaucuacaacugggagggcgaguacuucuggaccgcccugcaggaccugaacagcaccggcagcuucuucuggcugagcggcgacgaggugauguacacccacuggaacagagaccagcccggcuacagcagaggcggcugcguggcccuggccaccggcagcgccaugggccugugggaggugaagaacugcaccagcuucagagccagauacaucugcagacagagccugggcacccccgugacccccgagcugcccggccccgaccccacccccagccugaccggcagcugcccccagggcugggccagcgacaccaagcugagauacugcuacaagguguucagcagcgagagacugcaggacaagaagagcugggugcaggcccagggcgccugccaggagcugggcgcccagcugcugagccuggccagcuacgaggaggagcacuucguggccaacaugcugaacaagaucuucggcgagagcgagcccgagauccacgagcagcacugguucuggaucggccugaacagaagagaccccagaggcggccagagcuggagauggagcgacggcgugggcuucagcuaccacaacuucgacagaagcagacacgacgacgacgacaucagaggcugcgccgugcuggaccuggccagccugcaguggguggccaugcagugcgacacccagcuggacuggaucugcaagauccccagaggcaccgacgugagagagcccgacgacagcccccagggcagaagagaguggcugagauuccaggaggccgaguacaaguucuucgagcaccacagcaccugggcccaggcccagagaaucugcaccugguuccaggccgagcugaccagcgugcacagccaggccgagcuggacuuccugagccacaaccugcagaaguucagcagagcccaggagcagcacugguggaucggccugcacaccagcgagagcgacggcagauucagauggaccgacggcagcaucaucaacuucaucagcugggcccccggcaagcccagacccgugggcaaggacaagaagugcguguacaugaccgccagcagagaggacuggggcgaccagagaugccugaccgcccugcccuacaucugcaagagaagcaacgugaccaaggagacccagccccccgaccugcccaccaccgcccugggcggcugccccagcgacuggauccaguuccugaacaagugcuuccaggugcagggccaggagccccagagcagagugaaguggagcgaggcccaguucagcugcgagcagcaggaggcccagcuggugaccaucaccaacccccuggagcaggccuucaucaccgccagccugcccaacgugaccuucgaccuguggaucggccugcacgccagccagagagacuuccaguggguggagcaggagccccugauguacgccaacugggcccccggcgagcccagcggccccagccccgcccccagcggcaacaagcccaccagcugcgccguggugcugcacagccccagcgcccacuucaccggcagaugggacgacagaagcugcaccgaggagacccacggcuucaucugccagaagggcaccgaccccagccugagccccagccccgccgcccugccccccgcccccggcaccgagcugagcuaccugaacggcaccuucagacugcugcagaagccccugagauggcacgacgcccugcugcugugcgagagcagaaacgccagccuggccuacgugcccgaccccuacacccaggccuuccugacccaggccgccagaggccugagaaccccccuguggaucggccuggccggcgaggagggcagcagaagauacagcugggugagcgaggagccccugaacuacgugggcuggcaggacggcgagccccagcagcccggcggcugcaccuacguggacguggacggcgccuggagaaccaccagcugcgacaccaagcugcagggcgccgugugcggcgugagcagcggcccccccccccccagaagaaucagcuaccacggcagcugcccccagggccuggccgacagcgccuggauccccuucagagagcacugcuacagcuuccacauggagcugcugcugggccacaaggaggccagacagagaugccagagagccggcggcgccgugcugagcauccuggacgagauggagaacguguucgugugggagcaccugcagagcuacgagggccagagcagaggcgccuggcugggcaugaacuucaaccccaagggcggcacccugguguggcaggacaacaccgccgugaacuacagcaacuggggcccccccggccugggccccagcaugcugagccacaacagcugcuacuggauccagagcaacagcggccuguggagacccggcgccugcaccaacaucaccaugggcguggugugcaagcugcccagagccgagcagagcagcuucagccccagcgcccugcccgagaaccccgccgcccuggugguggugcugauggccgugcugcugcugcuggcccugcugaccgccgcccugauccuguacagaagaagacagagcaucgagagaggcgccuucgagggcgccagauacagcagaagcagcagcagccccaccgaggccaccgagaagaacauccuggugagcgacauggagaugaacgagcagcaggaguaa

SEQ ID NO: 20016 - RNA, 2043 nt, Artificial Sequence
  MRE11A__Homo_sapiens__NP_005581
augagcaccgccgacgcccuggacgacgagaacaccuucaagauccugguggccaccgacauccaccugggcuucauggagaaggacgccgugagaggcaacgacaccuucgugacccuggacgagauccugagacuggcccaggagaacgagguggacuucauccugcugggcggcgaccuguuccacgagaacaagcccagcagaaagacccugcacaccugccuggagcugcugagaaaguacugcaugggcgacagacccgugcaguucgagauccugagcgaccagagcgugaacuucggcuucagcaaguuccccugggugaacuaccaggacggcaaccugaacaucagcauccccguguucagcauccacggcaaccacgacgaccccaccggcgccgacgcccugugcgcccuggacauccugagcugcgccggcuucgugaaccacuucggcagaagcaugagcguggagaagaucgacaucagccccgugcugcugcagaagggcagcaccaagaucgcccuguacggccugggcagcauccccgacgagagacuguacagaauguucgugaacaagaaggugaccaugcugagacccaaggaggacgagaacagcugguucaaccuguucgugauccaccagaacagaagcaagcacggcagcaccaacuucauccccgagcaguuccuggacgacuucaucgaccuggugaucuggggccacgagcacgagugcaagaucgcccccaccaagaacgagcagcagcuguucuacaucagccagcccggcagcagcguggugaccagccugagccccggcgaggccgugaagaagcacgugggccugcugagaaucaagggcagaaagaugaacaugcacaagaucccccugcacaccgugagacaguucuucauggaggacaucgugcuggccaaccaccccgacaucuucaaccccgacaaccccaaggugacccaggccauccagagcuucugccuggagaagaucgaggagaugcuggagaacgccgagagagagagacugggcaacagccaccagcccgagaagccccuggugagacugagaguggacuacagcggcggcuucgagcccuucagcgugcugagauucagccagaaguucguggacagaguggccaaccccaaggacaucauccacuucuucagacacagagagcagaaggagaagaccggcgaggagaucaacuucggcaagcugaucaccaagcccagcgagggcaccacccugagaguggaggaccuggugaagcaguacuuccagaccgccgagaagaacgugcagcugagccugcugaccgagagaggcaugggcgaggccgugcaggaguucguggacaaggaggagaaggacgccaucgaggagcuggugaaguaccagcuggagaagacccagagauuccugaaggagagacacaucgacgcccuggaggacaagaucgacgaggaggugagaagauucagagagaccagacagaagaacaccaacgaggaggacgacgaggugagagaggccaugaccagagccagagcccugagaagccagagcgaggagagcgccagcgccuucagcgccgacgaccugaugagcaucgaccuggccgagcagauggccaacgacagcgacgacagcaucagcgccgccaccaacaagggcagaggcagaggcagaggcagaagaggcggcagaggccagaacagcgccagcagaggcggcagccagagaggcagagccuucaagagcaccagacagcagcccagcagaaacgugaccaccaagaacuacagcgaggugaucgagguggacgagagcgacguggaggaggacaucuuccccaccaccagcaagaccgaccagagauggagcagcaccagcagcagcaagaucaugagccagagccaggugagcaagggcguggacuucgagagcagcgaggacgacgacgacgaccccuucaugaacaccagcagccugagaagaaacagaagauaa

SEQ ID NO: 20017 - RNA, 645 nt, Artificial Sequence
  MREG__Homo_sapiens__NP_060470
augggccugagagacuggcugagaaccgugugcugcugcugcggcugcgagugccuggaggagagagcccugcccgagaaggagccccuggugagcgacaacaaccccuacagcagcuucggcgccacccuggugagagacgacgagaagaaccuguggagcaugccccacgacgugagccacaccgaggccgacgacgacagaacccuguacaaccugaucgugaucagaaaccagcaggccaaggacagcgaggaguggcagaagcugaacuacgacauccacacccugagacaggugagaagagaggugagaaacagauggaagugcauccuggaggaccugggcuuccagaaggaggccgacagccugcugagcgugaccaagcugagcaccaucagcgacagcaagaacaccagaaaggccagagagaugcugcugaagcuggccgaggagaccaacaucuuccccaccagcugggagcugagcgagagauaccuguucgugguggacagacugaucgcccuggacgccgccgaggaguucuucaagcuggccagaagaaccuaccccaagaagcccggcgugcccugccuggccgacggccagaaggagcugcacuaccugcccuuccccagccccuaa

SEQ ID NO: 20018 - RNA, 384 nt, Artificial Sequence
  MRFAP1__Homo_sapiens__NP_150638
augagaccccuggacaucguggagcuggccgagcccgaggagguggaggugcuggagcccgaggaggacuucgagcaguuccugcugcccgugaucaacgagaugagagaggacaucgccagccugaccagagagcacggcagagccuaccugagaaacagaagcaagcugugggagauggacaacaugcugauccagaucaagacccagguggaggccagcgaggagagcgcccugaaccaccugcagaaccccggcgacgccgccgagggcagagccgccaagagaugcgagaaggccgaggagaaggccaaggagaucgccaagauggccgagaugcugguggagcuggugagaagaaucgagaagagcgagagcagcuaa

SEQ ID NO: 20019 - RNA, 615 nt, Artificial Sequence
  MRGBP__Homo_sapiens__NP_060740
augggcgaggccgaggugggcggcggcggcgccgccggcgacaagggccccggcgaggccgccaccagccccgccgaggagaccgugguguggagccccgagguggaggugugccuguuccacgccaugcugggccacaagcccgugggcgugaacagacacuuccacaugaucugcaucagagacaaguucagccagaacaucggcagacaggugcccagcaaggugaucugggaccaccugagcaccauguacgacaugcaggcccugcacgagagcgagauccugcccuuccccaaccccgagagaaacuucgugcugcccgaggagaucauccaggaggugagagagggcaaggugaugaucgaggaggagaugaaggaggagaugaaggaggacguggacccccacaacggcgccgacgacguguucagcagcagcggcagccugggcaaggccagcgagaagagcagcaaggacaaggagaagaacagcagcgaccugggcugcaaggagggcgccgacaagagaaagagaagcagagugaccgacaaggugcugaccgccaacagcaaccccagcagccccagcgccgccaagagaagaagaaccuaa

SEQ ID NO: 20020 - RNA, 1032 nt, Artificial Sequence
  MRGPRF__Homo_sapiens__NP_659452
auggccggcaacugcagcugggaggcccaccccggcaacagaaacaagaugugccccggccugagcgaggcccccgagcuguacagcagaggcuuccugaccaucgagcagaucgccaugcugcccccccccgccgugaugaacuacaucuuccugcugcugugccugugcggccuggugggcaacggccuggugcugugguucuucggcuucagcaucaagagaaaccccuucagcaucuacuuccugcaccuggccagcgccgacgugggcuaccuguucagcaaggccguguucagcauccugaacaccggcggcuuccugggcaccuucgccgacuacaucagaagcgugugcagagugcugggccugugcauguuccugaccggcgugagccugcugcccgccgugagcgccgagagaugcgccagcgugaucuuccccgccugguacuggagaagaagacccaagagacugagcgccguggugugcgcccugcugugggugcugagccugcuggugaccugccugcacaacuacuucugcguguuccugggcagaggcgcccccggcgccgccugcagacacauggacaucuuccugggcauccugcuguuccugcugugcugcccccugauggugcugcccugccuggcccugauccugcacguggagugcagagccagaagaagacagagaagcgccaagcugaaccacgugauccuggccauggugagcguguuccuggugagcagcaucuaccugggcaucgacugguuccuguucuggguguuccagauccccgcccccuuccccgaguacgugaccgaccugugcaucugcaucaacagcagcgccaagcccaucguguacuuccuggccggcagagacaagagccagagacugugggagccccugagagugguguuccagagagcccugagagacggcgccgagcugggcgaggccggcggcagcacccccaacaccgugaccauggagaugcagugcccccccggcaacgccagcuaa

SEQ ID NO: 20021 - RNA, 969 nt, Artificial Sequence
  MRGPRX1__Homo_sapiens__NP_671732
auggaccccaccaucagcacccuggacaccgagcugacccccaucaacggcaccgaggagacccugugcuacaagcagacccugagccugaccgugcugaccugcaucgugagccuggugggccugaccggcaacgccguggugcuguggcugcugggcugcagaaugagaagaaacgccuucagcaucuacauccugaaccuggccgccgccgacuuccuguuccugagcggcagacugaucuacagccugcugagcuucaucagcaucccccacaccaucagcaagauccuguaccccgugaugauguucagcuacuucgccggccugagcuuccugagcgccgugagcaccgagagaugccugagcgugcuguggcccaucugguacagaugccacagacccacccaccugagcgccguggugugcgugcugcugugggcccugagccugcugagaagcauccuggaguggaugcugugcggcuuccuguucagcggcgccgacagcgccuggugccagaccagcgacuucaucaccguggccuggcugaucuuccugugcguggugcugugcggcagcagccuggugcugcugaucagaauccugugcggcagcagaaagaucccccugaccagacuguacgugaccauccugcugaccgugcugguguuccugcugugcggccugcccuucggcauccaguucuuccuguuccuguggauccacguggacagagaggugcuguucugccacgugcaccuggugagcaucuuccugagcgcccugaacagcagcgccaaccccaucaucuacuucuucgugggcagcuucagacagagacagaacagacagaaccugaagcuggugcugcagagagcccugcaggacgccagcgagguggacgagggcggcggccagcugcccgaggagauccuggagcugagcggcagcagacuggagcaguaa

SEQ ID NO: 20022 - RNA, 969 nt, Artificial Sequence
  MRGPRX3__Homo_sapiens__NP_473372
auggacagcaccauccccgugcugggcaccgagcugacccccaucaacggcagagaggagacccccugcuacaagcagacccugagcuucaccggccugaccugcaucgugagccugguggcccugaccggcaacgccguggugcuguggcugcugggcugcagaaugagaagaaacgccgugagcaucuacauccugaaccugguggccgccgacuuccuguuccugagcggccacaucaucugcagcccccugagacugaucaacaucagacaccccaucagcaagauccugagccccgugaugaccuuccccuacuucaucggccugagcaugcugagcgccaucagcaccgagagaugccugagcauccuguggcccaucugguaccacugcagaagacccagauaccugagcagcgugaugugcgugcugcugugggcccugagccugcugagaagcauccuggaguggauguucugcgacuuccuguucagcggcgccaacagcguguggugcgagaccagcgacuucaucaccaucgccuggcugguguuccugugcguggugcugugcggcagcagccuggugcugcuggugagaauccugugcggcagcagaaagaugccccugaccagacuguacgugaccauccugcugaccgugcugguguuccugcugugcggccugcccuucggcauccagugggcccuguucagcagaauccaccuggacuggaaggugcuguucugccacgugcaccuggugagcaucuuccugagcgcccugaacagcagcgccaaccccaucaucuacuucuucgugggcagcuucagacagagacagaacagacagaaccugaagcuggugcugcagagagcccugcaggacacccccgagguggacgagggcggcggcuggcugccccaggagacccuggagcugagcggcagcagacuggagcaguaa

SEQ ID NO: 20023 - RNA, 969 nt, Artificial Sequence
  MRGPRX4__Homo_sapiens__NP_473373
auggaccccaccgugcccguguucggcaccaagcugacccccaucaacggcagagaggagacccccugcuacaaccagacccugagcuucaccgugcugaccugcaucaucagccuggugggccugaccggcaacgccguggugcuguggcugcugggcuacagaaugagaagaaacgccgugagcaucuacauccugaaccuggccgccgccgacuuccuguuccugagcuuccagaucaucagacugccccugagacugaucaacaucagccaccugaucagaaagauccuggugagcgugaugaccuuccccuacuucaccggccugagcaugcugagcgccaucagcaccgagagaugccugagcgugcuguggcccaucugguacagaugcagaagacccacccaccugagcgccguggugugcgugcugcuguggggccugagccugcuguucagcaugcuggaguggagauucugcgacuuccuguucagcggcgccgacagcagcuggugcgagaccagcgacuucauccccguggccuggcugaucuuccugugcguggugcugugcgugagcagccuggugcugcuggugagaauccugugcggcagcagaaagaugccccugaccagacuguacgugaccauccugcugaccgugcugguguuccugcugugcggccugcccuucggcauccugggcgcccugaucuacagaaugcaccugaaccuggaggugcuguacugccacguguaccuggugugcaugagccugagcagccugaacagcagcgccaaccccaucaucuacuucuucgugggcagcuucagacagagacagaacagacagaaccugaagcuggugcugcagagagcccugcaggacaagcccgagguggacaagggcgagggccagcugcccgaggagagccuggagcugagcggcagcagacugggccccuaa

SEQ ID NO: 20024 - RNA, 1110 nt, Artificial Sequence
  MRI1__Homo_sapiens__NP_001026897
augacccuggaggccaucagauacagcagaggcagccugcagauccuggaccagcugcugcugcccaagcagagcagauacgaggccgugggcagcgugcaccaggccugggaggccaucagagccaugaaggugagaggcgcccccgccaucgcccuggugggcugccugagccuggccguggagcugcaggccggcgccggcggccccggccuggccgcccugguggccuucgugagagacaagcugagcuuccuggugaccgccagacccaccgccgugaacauggccagagccgccagagaccuggccgacguggccgccagagaggccgagagagagggcgccaccgaggaggccgugagagagagagugaucugcugcaccgaggacaugcuggagaaggaccugagagacaacagaagcaucggcgaccugggcgccagacaccugcuggagagaguggcccccagcggcggcaaggugaccgugcugacccacugcaacaccggcgcccuggccaccgccggcuacggcaccgcccugggcgugaucagaagccugcacagccugggcagacuggagcacgccuucugcaccgagaccagacccuacaaccagggcgccagacugaccgccuucgagcugguguacgagcagauccccgccacccugaucaccgacagcaugguggccgccgccauggcccacagaggcgugagcgccgugguggugggcgccgacagagugguggccaacggcgacaccgccaacaaggugggcaccuaccagcuggccaucguggccaagcaccacggcauccccuucuacguggccgcccccagcagcagcugcgaccugagacuggagaccggcaaggagaucaucaucgaggagagacccggccaggagcugaccgacgugaacggcgugagaaucgccgcccccggcaucggcguguggaaccccgccuucgacgugaccccccacgaccugaucaccggcggcaucaucaccgagcugggcguguucgcccccgaggagcugagaaccgcccugaccaccaccaucagcagcagagacggcacccuggacggcccccagauguaa

SEQ ID NO: 20025 - RNA, 1062 nt, Artificial Sequence
  MRM1__Homo_sapiens__NP_079140
auggcccugcugagcaccgugagaggcgccaccuggggcagacuggugaccagacacuucagccacgccgccagacacggcgagagacccggcggcgaggagcugagcagacugcugcuggacgaccuggugcccaccagcagacuggagcugcuguucggcaugacccccugccugcuggcccugcaggccgccagaagaagcguggccagacugcugcugcaggccggcaaggccggccugcagggcaagagagccgagcugcugagaauggccgaggccagagacauccccgugcugagacccagaagacagaagcuggacaccaugugcagauaccaggugcaccagggcgugugcauggaggugagcccccugagacccagacccuggagagaggccggcgaggccagccccggcgacgacccccagcagcuguggcuggugcuggacggcauccaggaccccagaaacuucggcgccgugcugagaagcgcccacuuccugggcguggacaaggugaucaccagcagaagaaacagcugcccccugacccccguggugagcaagagcagcgccggcgccauggaggugauggacguguucagcaccgacgaccugaccggcuuccugcagaccaaggcccagcagggcuggcugguggccggcaccgugggcugccccagcaccgaggacccccagagcagcgagauccccaucaugagcugccuggaguuccugugggagagacccacccugcuggugcugggcaacgagggcagcggccugagccaggaggugcaggccagcugccagcugcugcugaccauccugcccagaagacagcugccccccggccuggagagccugaacgugagcguggccgccggcauccugcugcacagcaucugcagccagagaaagggcuuccccaccgagggcgagagaagacagcugcugcaggacccccaggagcccagcgccagaagcgagggccugagcauggcccagcaccccggccugagcagcggccccgagaaggagagacagaacgagggcuaa

SEQ ID NO: 20026 - RNA, 4758 nt, Artificial Sequence
  MROH2B__Homo_sapiens__NP_775760
augacccugagcaccgaggagagcaucgagauguucggcgacaucaaccugacccugggcaugcugaacaaggaggacaucgugaacaaggaggacaucuacagccaccugaccagcgugauccagaacaccgacauccuggacgacgccaucgugcagagacugaucuacuacgccagcaaggacaugagagacaacaacaugcugagagagaucagaaugcuggccggcgaggugcuggugagccuggccgcccacgacuucaacagcgugauguacgaggugcagagcaacuucagaauccuggagcugcccgacgaguucguggugcuggcccuggccgagcuggccaccagcuacgugagccagagcauccccuucaugaugaugacccugcugaccaugcagaccaugcugagacuggccgaggacgagagaaugaagggcaccuucugcaucgcccuggagaaguucagcaaggccaucuacaaguacgugaaccacuggagagacuuccccuaccccagacuggacgccaacagacugagcgacaagaucuucaugcuguucugguacaucauggagaagugggccccccuggccagccccaugcagacccugagcaucgugaaggcccacggccccaccgugagccugcugcugcacagagaggacuucagaggcuacgcccugggccaggugcccuggcugcugaaccaguacaaggacaaggagaucgacuuccacgugacccagagccugaagcagauccugaccgccgccgugcuguacgacaucggccugcccagaagccugagaagaagcaucuucaucaaccugcugcagcagaucugcagagcccccgagccccccgugaaggagaacgagaugaaggccagcagcugcuuccugauccuggcccacagcaaccccggcgagcugauggaguucuucgacgagcaggugagaagcaacaacgaggccaucagagugggcauccugacccugcugagacuggccgugaacgccgacgagcccagacugagagaccacaucaucagcaucgagagaaccgugaagaucgugaugggcgaccugagcaccaaggugagaaacagcgugcugcugcugauccagaccaugugcgagaagagcuacaucgaggccagagagggcuggccccugaucgacuacguguucagccaguucgccacccugaacagaaaccuggagaagcccgugaagaccaacuuccacgagaacgagaaggaggaggagagcgugagagagaccagccuggaggugcugaagacccuggacccccuggugaucggcaugccccaggugcuguggcccagaauccugaccuucguggugcccgccgaguacaccgaggcccuggagccccuguucagcaucaucagaauccugaucauggccgaggagaagaagcagcacagcgccaaggagagcaccgcccugguggugagcaccggcgccgugaagcugcccagcccccagcagcugcuggccagacugcuggugaucagcaugcccgccagccugggcgagcugagaggcgccggcgccaucggccugcugaagauccugcccgagaucauccaccccaagcugguggaccuguggaagaccagacugcccgagcugcugcagccccuggagggcaagaacaucagcaccgugcugugggagaccaugcugcugcagcugcugaaggagagccuguggaagaucagcgacguggccuggaccauccagcugacccaggacuucaagcagcagaugggcagcuacagcaacaacagcaccgagaagaaguuccuguggaaggcccugggcaccacccuggccugcugccaggacagcgacuucgugaacagccagaucaaggaguuccugaccgcccccaaccagcugggcgaccagagacagggcaucaccagcauccugggcuacugcgccgagaaccaccuggacaucgugcugaaggugcugaagaccuuccagaaccaggagaaguucuucaugaacagaugcaagagccuguucagcggcaagaagagccugaccaagaccgacgugauggugaucuacggcgccguggcccugcacgcccccaagaagcagcugcugagcagacugaaccaggacaucaucagccaggugcugagccugcacggccagugcagccaggugcugggcaugagcgugaugaacaaggacauggaccugcagaugagcuucaccagaagcaucaccgagaucggcaucgccgugcaggacgccgaggaccagggcuuccaguucagcuacaaggagaugcugaucggcuacaugcuggacuucaucagagacgagccccuggacagccuggccagccccaucagauggaaggcccugaucgccaucagauaccugagcaagcugaagccccagcugagccugcaggaccaccugaacauccuggaggagaacaucagaagacugcugccccugcccccccuggagaaccugaagagcgagggccagaccgacaaggacaaggagcacauccaguuccuguacgagagaagcauggacgcccugggcaagcugcugaagaccaugaugugggacaacgugaacgccgaggacugccaggagauguucaaccugcugcagauguggcuggugagccagaaggagugggagagagagagagccuuccagaucaccgccaaggugcugaccaacgacaucgaggcccccgagaacuucaagaucggcagccugcugggccugcuggccccccacagcugcgacacccugcccaccaucagacaggccgccgccagcagcaccaucggccuguucuacaucaagggcauccaccuggagguggagagacugcagggccugcaggagggccuggagagcgacgacgugcaggugcagaucaagaucagcagcaagaucgccaagaucgugagcaaguucauccccaacgaggagauccugauguuccuggaggagaugcuggacggccuggagagccugaaccccaccugcaccaaggccugcggcaucuggaugaucaccgugcugaagcagcagggcgccgcccuggaggaccagcugcuggagauccugggcaccaucuaccaccacaugcccgugcugagacagaaggaggagagcuuccaguucauccuggaggccaucagccagaucgccagcuuccacauggacaccgugguggugaaccugcugcagaagccccugcccuucgacagagacaccaagacccuguggaaggcccuggccgagaagcccgccagcagcggcaagcugcugcaggcccugaucgacaagcuggagaccgagcuggaggacgacaucgccagaguggaggccaucagcguggccugcgccauguacgaggugaucagcaugggcaccagcgugaccggccuguaccccgagcuguucacccugcugcugaagcuggugagcugcacccugggccagaagaugcugaccugccccuggagccacagaagacacgugaugcagcagggcgagcagcagcagauccccgaccccugcagacugagcaccgccacccugaagugccugcaggcccaggccaugagagagggccuggccaaggagagcgacgagggcgacaaccuguggacccugcugagcagccccagcacccaccacaucggcgugugcagccuggccagaagcauggccguguggcagcacggcgugauccuggacaucauggagcagcugcugagcagccugaccagcagcagcgagaacuacagaaucaccggcgccgccuucuucagcgagcugaugaaggagcccauccuguggaagcacggcaaccugagaaacgugcugauccugauggaccagagcgccugggacagcaacgccacccugagacagauggccaucagaggccugggcaacaccgccagcggcgccccccacaaggugaagaagcacaagcagcugaugcuggagagcaucaucagaggccuguaccaccuggccagaaccgagguggugugcgagagccugaaggcccugaagaagauccuggagcugcugaccgacagagacgugagcuucuacuucaaggagaucgugcugcagaccagaaccuucuucgaggacgagcaggacgacgugagacugaccgccaucuuccuguucgaggaccuggccccccugaccggcagaagauggaagaucuucuucgccgaggagaucaagaagagccugaucagcuuccugcugcaccugugggaccccaaccccaagaucggcguggccugcagagacgugcugauggugugcauccccuuccugggccugcaggagcuguacggcgugcuggacagacugcuggaccaggaccugcccagagccagagacuucuacagacaguucugcgugaagcuggccaagaagaaccaggagauccuguggauccugcacacccacagcuucaccuucuucaccagcaccugggaggugaucagaagcgccgccgugaagcugaccgacgccguggugcugaaccugaccagccaguacguggagcugcuggacagagagcagcugaccaccagacugcaggcccugagacaggaccccugcaucagcgugcagagagccgccgaggccgcccugcagacccugcugagaagaugcaaggagaccagcaucccccuguaa

SEQ ID NO: 20027 - RNA, 633 nt, Artificial Sequence
  MRO__Homo_sapiens__NP_001120647
auggccuggggcagcaagggcauccagggcugggagaaccuggccgagagcagccaccuggccaccaccagagagagcagcccccccgagagcggcaccggcagcggcagcagcagaggcagcagacugcaggagccccaggugagcuggaagcugagauuccagaagagagagccccugaagaacguguucuucauccuggccgagagagccagagaccccagcgccaagaagagacacauggccaugagaaaccugggcaccauggccuacgaggcccccgacaaggugagaaaguacaagaagaucgugcuggaccugcugguguacggccuguacgaccccgugaaccuggaggugauccacgagagcaugaagacccugaccguggugcugggcaagauccagggcaagggccugggcagcuucuucaucgacaucacccugcagaccagaacccugcuggacgacgccugcaagaccaccuuccaggccugcagccccuaccugaagcugaaggaggaguacagcuuccagagcgaggaggaccagagaaacaccaagcuguaccagcagcugagccacuaccaccccgagauccugcaguucuucuacgccaacaagauccuguaa

SEQ ID NO: 20028 - RNA, 786 nt, Artificial Sequence
  MRPL10__Homo_sapiens__NP_660298
auggccgccgccguggccggcaugcugagaggcggccugcugccccaggccggcagacugcccacccugcagaccgugagauacggcagcaaggccgugaccagacacagaagagugaugcacuuccagagacagaagcugauggccgugaccgaguacaucccccccaagcccgccauccaccccagcugccugcccagcccccccagccccccccaggaggagaucggccugaucagacugcugagaagagagaucgccgccguguuccaggacaacagaaugaucgccgugugccagaacguggcccugagcgccgaggacaagcugcugaugagacaccagcugagaaagcacaagauccugaugaagguguuccccaaccaggugcugaagcccuuccuggaggacagcaaguaccagaaccugcugccccuguucgugggccacaacaugcugcuggugagcgaggagcccaaggugaaggagauggugagaauccugagaaccgugcccuuccugccccugcugggcggcugcaucgacgacaccauccugagcagacagggcuucaucaacuacagcaagcugcccagccugccccuggugcagggcgagcuggugggcggccugaccugccugaccgcccagacccacagccugcugcagcaccagccccugcagcugaccacccugcuggaccaguacaucagagagcagagagagaaggacagcgugaugagcgccaacggcaagcccgaccccgacaccgugcccgacagcuaa

SEQ ID NO: 20029 - RNA, 579 nt, Artificial Sequence
  MRPL11__Homo_sapiens__NP_057134
augagcaagcugggcagagccgccagaggccugagaaagcccgaggugggcggcgugaucagagccaucgugagagccggccuggccaugcccggccccccccugggccccgugcugggccagagaggcgugagcaucaaccaguucugcaaggaguucaacgagagaaccaaggacaucaaggagggcaucccccugcccaccaagauccuggugaagcccgacagaaccuucgagaucaagaucggccagcccaccgugagcuacuuccugaaggccgccgccggcaucgagaagggcgccagacagaccggcaaggagguggccggccuggugacccugaagcacguguacgagaucgccagaaucaaggcccaggacgaggccuucgcccugcaggacgugccccugagcagcguggugagaagcaucaucggcagcgccagaagccugggcaucagaguggugaaggaccugagcagcgaggagcuggccgccuuccagaaggagagagccaucuuccuggccgcccagaaggaggccgaccuggccgcccaggaggaggccgccaagaaguaa

SEQ ID NO: 20030 - RNA, 537 nt, Artificial Sequence
  MRPL13__Homo_sapiens__NP_054797
augagcagcuucagcagagccccccagcagugggccaccuucgccagaaucugguaccugcuggacggcaagaugcagccccccggcaagcuggccgccauggccagcaucagacugcagggccugcacaagcccguguaccacgcccugagcgacugcggcgaccacguggugaucaugaacaccagacacaucgccuucagcggcaacaagugggagcagaagguguacagcagccacaccggcuaccccggcggcuucagacaggugaccgccgcccagcugcaccugagagaccccguggccaucgugaagcuggccaucuacggcaugcugcccaagaaccugcacagaagaaccaugauggagagacugcaccuguuccccgacgaguacauccccgaggacauccugaagaaccugguggaggagcugccccagcccagaaagauccccaagagacuggacgaguacacccaggaggagaucgacgccuuccccagacuguggaccccccccgaggacuacagacuguaa

SEQ ID NO: 20031 - RNA, 891 nt, Artificial Sequence
  MRPL15__Homo_sapiens__NP_054894
auggccggcccccugcagggcggcggcgccagagcccuggaccugcugagaggccugcccagagugagccuggccaaccugaagcccaaccccggcagcaagaagcccgagagaagacccagaggcagaagaagaggcagaaagugcggcagaggccacaagggcgagagacagagaggcaccagacccagacugggcuucgagggcggccagacccccuucuacaucagaauccccaaguacggcuucaacgagggccacagcuucagaagacaguacaagccccugagccugaacagacugcaguaccugaucgaccugggcagaguggaccccagccagcccaucgaccugacccagcuggugaacggcagaggcgugaccauccagccccugaagagagacuacggcgugcagcugguggaggagggcgccgacaccuucaccgccaaggugaacaucgaggugcagcuggccagcgagcuggccaucgccgccaucgagaagaacggcggcguggugaccaccgccuucuacgaccccagaagccuggacaucgugugcaagcccgugcccuucuuccugagaggccagcccauccccaagagaaugcugccccccgaggagcuggugcccuacuacaccgacgccaagaacagaggcuaccuggccgaccccgccaaguuccccgaggccagacuggagcuggccagaaaguacggcuacauccugcccgacaucaccaaggacgagcuguucaagaugcugugcaccagaaaggaccccagacagaucuucuucggccuggcccccggcuggguggugaacauggccgacaagaagauccugaagcccaccgacgagaaccugcugaaguacuacaccagcuaa

SEQ ID NO: 20032 - RNA, 528 nt, Artificial Sequence
  MRPL17__Homo_sapiens__NP_071344
augagacugagcguggccgccgccaucagccacggcagaguguucagaagaaugggccugggccccgagagcagaauccaccugcugagaaaccugcugaccggccuggugagacacgagagaaucgaggcccccugggccagaguggacgagaugagaggcuacgccgagaagcugaucgacuacggcaagcugggcgacaccaacgagagagccaugagaauggccgacuucuggcugaccgagaaggaccugauccccaagcuguuccaggugcuggcccccagauacaaggaccagaccggcggcuacaccagaaugcugcagauccccaacagaagccuggacagagccaagauggccgugaucgaguacaagggcaacugccugcccccccugccccugcccagaagagacagccaccugacccugcugaaccagcugcugcagggccugagacaggaccugagacagagccaggaggccagcaaccacagcagccacaccgcccagacccccggcaucuaa

SEQ ID NO: 20033 - RNA, 879 nt, Artificial Sequence
  MRPL19__Homo_sapiens__NP_055578
auggccgccugcaucgccgccggccacugggccgccaugggccugggcagaagcuuccaggccgccagaacccugcugcccccccccgccagcaucgccugcagagugcacgccggccccgugagacagcagagcaccggccccagcgagcccggcgccuuccagcccccccccaagcccgugaucguggacaagcacagacccguggagcccgagagaagauuccugagccccgaguucauccccagaagaggcagaaccgacccccugaaguuccagaucgagagaaaggacaugcuggagagaagaaaggugcugcacauccccgaguucuacgugggcagcauccugagagugaccaccgccgaccccuacgccagcggcaagaucagccaguuccugggcaucugcauccagagaagcggcagaggccugggcgccaccuucauccugagaaacgugaucgagggccagggcguggagaucugcuucgagcuguacaaccccagagugcaggagauccagguggugaagcuggagaagagacuggacgacagccugcuguaccugagagacgcccugcccgaguacagcaccuucgacgugaacaugaagcccguggugcaggagcccaaccagaaggugcccgugaacgagcugaaggugaagaugaagcccaagcccuggagcaagagaugggagagacccaacuucaacaucaagggcaucagauucgaccugugccugaccgagcagcagaugaaggaggcccagaaguggaaccagcccuggcuggaguucgacaugaugagagaguacgacaccagcaagaucgaggccgccaucuggaaggagaucgaggccagcaagagaagcuaa

SEQ ID NO: 20034 - RNA, 978 nt, Artificial Sequence
  MRPL1__Homo_sapiens__NP_064621
auggccgccgccgugagaugcaugggcagagcccugauccaccaccagagacacagccugagcaagaugguguaccagaccagccugugcagcugcagcgugaacaucagagugcccaacagacacuucgccgccgccaccaagagcgccaagaagaccaagaagggcgccaaggagaagacccccgacgagaagaaggacgagaucgagaagaucaaggccuaccccuacauggagggcgagcccgaggacgacguguaccugaagagacuguaccccagacagaucuacgagguggagaaggccgugcaccugcugaagaaguuccagauccuggacuucaccagccccaagcagagcguguaccuggaccugacccuggacauggcccugggcaagaagaagaacguggagcccuucaccagcgugcugagccugcccuaccccuucgccagcgagaucaacaagguggccguguucaccgagaacgccagcgaggugaagaucgccgaggagaacggcgccgccuucgccggcggcaccagccugauccagaagaucugggacgacgagaucguggccgacuucuacguggccgugcccgagaucaugcccgagcugaacagacugagaaagaagcugaacaagaaguaccccaagcugagcagaaacagcaucggcagagacauccccaagaugcuggagcuguucaagaacggccacgagaucaagguggacgaggagagagagaacuuccugcagaccaagaucgccacccuggacaugagcagcgaccagaucgccgccaaccugcaggccgugaucaacgaggugugcagacacagaccccugaaccugggccccuucguggugagagccuuccugagaagcagcaccagcgagggccugcugcugaagaucgacccccugcugcccaaggaggugaagaacgaggagagcgagaaggaggacgccuaa

SEQ ID NO: 20035 - RNA, 462 nt, Artificial Sequence
  MRPL23__Homo_sapiens__NP_066957
auggccagaaacgugguguacccccuguacagacugggcggcccccagcugagaguguucagaaccaacuucuucauccagcuggugagacccggcguggcccagcccgaggacaccgugcaguucagaauccccauggagaugaccagaguggaccugagaaacuaccuggagggcaucuacaacgugcccguggccgccgugagaaccagagugcagcacggcagcaacaagagaagagaccacagaaacgugagaaucaagaagcccgacuacaagguggccuacgugcagcuggcccacggccagaccuucaccuuccccgaccuguuccccgagaaggacgagagccccgagggcagcgccgccgacgaccuguacagcaugcuggaggaggagagacagcagagacagagcagcgaccccagaagaggcggcgugcccagcugguucggccuguaa

SEQ ID NO: 20036 - RNA, 771 nt, Artificial Sequence
  MRPL28__Homo_sapiens__XP_011520653
augccccugcacaaguaccccguguggcuguggaagagacugcagcugagagagggcaucugcagcagacugcccggccacuaccugagaagccuggaggaggagagaacccccacccccgugcacuacagaccccacggcgccaaguucaagaucaaccccaagaacggccagagagagagaguggaggacgugcccauccccaucuacuucccccccgagagccagagaggccuguggggcggcgagggcuggauccugggccagaucuacgccaacaacgacaagcugagcaagagacugaagaagguguggaagccccagcuguucgagagagaguucuacagcgagauccuggacaagaaguucaccgugaccgugaccaugagaacccuggaccugaucgacgaggccuacggccuggacuucuacauccugaagacccccaaggaggaccugugcagcaaguucggcauggaccugaagagaggcaugcugcugagacuggccagacaggacccccagcugcaccccgaggaccccgagagaagagccgccaucuacgacaaguacaaggaguucgccauccccgaggaggaggccgagugggugggccugacccuggaggaggccaucgagaagcagagacugcuggaggagaaggaccccgugccccuguucaagaucuacguggccgagcugauccagcagcugcagcagcaggcccugagcgagcccgccguggugcagaagagagccagcggccaguaa

SEQ ID NO: 20037 - RNA, 198 nt, Artificial Sequence
  MRPL33__Homo_sapiens__NP_004882
auguuccugagcgccguguucuucgccaagagcaagagcaagaacauccuggugagaauggugagcgaggccggcaccggcuucugcuucaacaccaagagaaacagacugagagagaagcugacccugcugcacuacgaccccguggugaagcagagagugcuguucguggagaagaagaagaucagaagccuguaa

SEQ ID NO: 20038 - RNA, 312 nt, Artificial Sequence
  MRPL36__Homo_sapiens__NP_115868
auggccaaccuguucaucagaaagauggugaacccccugcuguaccugagcagacacaccgugaagcccagagcccugagcaccuuccuguucggcagcaucagaggcgccgcccccguggccguggagcccggcgccgccgugagaagccugcugagccccggccugcugccccaccugcugcccgcccugggcuucaagaacaagaccgugcugaagaagagaugcaaggacugcuaccuggugaagagaagaggcagaugguacguguacugcaagacccaccccagacacaagcagagacagauguaa

SEQ ID NO: 20039 - RNA, 1047 nt, Artificial Sequence
  MRPL3__Homo_sapiens__NP_009139
augcccggcuggagacugcugacccaggugggcgcccaggugcugggcagacugggcgacggccugggcgccgcccugggccccggcaacagaacccacaucuggcuguucgugagaggccugcacggcaagagcggcaccuggugggacgagcaccugagcgaggagaacgugcccuucaucaagcagcuggugagcgacgaggacaaggcccagcuggccagcaagcugugcccccugaaggacgagcccuggcccauccaccccugggagcccggcagcuucagagugggccugaucgcccugaagcugggcaugaugccccuguggaccaaggacggccagaagcacguggugacccugcugcaggugcaggacugccacgugcugaaguacaccagcaaggagaacugcaacggcaagauggccacccugagcgugggcggcaagaccgugagcagauucagaaaggccaccagcauccuggaguucuacagagagcugggccugccccccaagcagaccgugaagaucuucaacaucaccgacaacgccgccaucaagcccggcaccccccuguacgccgcccacuucagacccggccaguacguggacgugaccgccaagaccaucggcaagggcuuccagggcgugaugaagagauggggcuucaagggccagcccgccacccacggccagaccaagacccacagaagacccggcgccguggccaccggcgacaucggcagaguguggcccggcaccaagaugcccggcaagaugggcaacaucuacagaaccgaguacggccugaagguguggagaaucaacaccaagcacaacaucaucuacgugaacggcagcgugcccggccacaagaacugccuggugaaggugaaggacagcaagcugcccgccuacaaggaccugggcaagaaccugcccuuccccaccuacuuccccgacggcgacgaggaggagcugcccgaggaccuguacgacgagaacgugugccagcccggcgcccccagcaucaccuucgccuaa

SEQ ID NO: 20040 - RNA, 621 nt, Artificial Sequence
  MRPL40__Homo_sapiens__NP_003767
augaccgccagcgugcugagaagcaucagccuggcccugagacccaccagcggccugcugggcaccuggcagacccagcugagagagacccaccagagagccagccugcugagcuucugggagcugauccccaugagaagcgagccccugagaaagaagaagaagguggaccccaagaaggaccaggaggccaaggagagacugaagagaaagaucagaaagcuggagaaggccacccaggagcugauccccaucgaggacuucaucaccccccugaaguuccuggacaaggccagagagagaccccagguggagcugaccuucgaggagaccgagagaagagcccugcugcugaagaaguggagccuguacaagcagcaggagagaaagauggagagagacaccaucagagccaugcuggaggcccagcaggaggcccuggaggagcugcagcuggagagccccaagcugcacgccgaggccaucaagagagaccccaaccuguuccccuucgagaaggagggcccccacuacaccccccccauccccaacuaccagccccccgagggcagauacaacgacaucaccaagguguacacccagguggaguucaagagauaa

SEQ ID NO: 20041 - RNA, 414 nt, Artificial Sequence
  MRPL41__Homo_sapiens__NP_115866
augggcgugcuggccgccgccgccagaugccuggugagaggcgccgacagaaugagcaaguggaccagcaagagaggccccagaagcuucagaggcagaaagggcagaggcgccaagggcaucggcuuccugaccagcggcuggagauucgugcagaucaaggagauggugcccgaguucguggugcccgaccugaccggcuucaagcugaagcccuacgugagcuaccuggcccccgagagcgaggagaccccccugaccgccgcccagcuguucagcgaggccguggcccccgccaucgagaaggacuucaaggacggcaccuucgaccccgacaaccuggagaaguacggcuucgagcccacccaggagggcaagcuguuccagcuguaccccagaaacuuccugagauaa

SEQ ID NO: 20042 - RNA, 999 nt, Artificial Sequence
  MRPL44__Homo_sapiens__NP_075066
auggccagcggccuggugagacugcugcagcagggccacagaugccugcuggcccccguggcccccaagcuggugccccccgugagaggcgugaagaagggcuucagagccgccuucagauuccagaaggagcuggagagacagagacugcugagaugcccccccccccccgugagaagaagcgagaagcccaacugggacuaccacgccgagauccaggccuucggccacagacugcaggagaacuucagccuggaccugcugaagaccgccuucgugaacagcugcuacaucaagagcgaggaggccaagagacagcagcugggcaucgagaaggaggccgugcugcugaaccugaagagcaaccaggagcugagcgagcagggcaccagcuucagccagaccugccugacccaguuccuggaggacgaguaccccgacaugcccaccgagggcaucaagaaccugguggacuuccugaccggcgaggagguggugugccacguggccagaaaccuggccguggagcagcugacccugagcgaggaguuccccgugccccccgccgugcugcagcagaccuucuucgccgugaucggcgcccugcugcagagcagcggccccgagagaaccgcccuguucaucagagacuuccugaucacccagaugaccggcaaggagcuguucgagauguggaagaucaucaaccccaugggccugcugguggaggagcugaagaagagaaacgugagcgcccccgagagcagacugaccagacagagcggcggcaccaccgcccugccccuguacuucgugggccuguacugcgacaagaagcugaucgccgagggccccggcgagaccgugcugguggccgaggaggaggccgccagaguggcccugagaaagcuguacggcuucaccgagaacagaagacccuggaacuacagcaagcccaaggagacccugagagccgagaagagcaucaccgccagcuaa

SEQ ID NO: 20043 - RNA, 501 nt, Artificial Sequence
  MRPL49__Homo_sapiens__NP_004918
auggccgccaccauguucagagccacccugagaggcuggagaaccggcgugcagagaggcugcggccugagacugcugagccagacccagggcccccccgacuaccccagauucguggagagcguggacgaguaccaguucguggagagacugcugcccgccaccagaauccccgacccccccaagcacgagcacuaccccacccccagcggcuggcagccccccagagaccccccccccaaccugcccuacuucgugagaagaagcagaaugcacaacauccccguguacaaggacaucacccacggcaacagacagaugaccgugaucagaaagguggagggcgacaucugggcccugcagaaggacguggaggacuuccugagcccccugcugggcaagacccccgugacccaggugaacgaggugaccggcacccugagaaucaagggcuacuucgaccaggagcugaaggccuggcugcuggagaagggcuucuaa

SEQ ID NO: 20044 - RNA, 372 nt, Artificial Sequence
  MRPL52__Homo_sapiens__NP_848026
auggccgcccugggcaccgugcuguucaccggcgugagaagacugcacugcagcguggccgccugggccggcggccaguggagacugcagcagggccuggccgccaaccccagcggcuacggcccccugaccgagcugcccgacuggagcuacgccgacggcagacccgccccccccaugaagggccagcugagaagaaaggccgagagagagaccuucgccagaagaguggugcugcugagccaggagauggacgccggccugcaggccuggcagcugagacagcagaagcugcaggaggagcagagaaagcaggagaacgcccugaagcccaagggcgccagccugaagagcccccugcccagccaguaa

SEQ ID NO: 20045 - RNA, 702 nt, Artificial Sequence
  MRPL9__Homo_sapiens__NP_001287662
auggccgcccccguggugaccgcccccggcagagcccugcugagagccggcgccggcagacugcugagaggcggcgugcaggagcugcugagacccagacacgagggcaacgcccccgaccuggccugcaacuucagccugagccagaacagaggcaccgugaucguggagagaugguggaaggugccccuggccggcgagggcagaaagcccagacugcacagaagacacagaguguacaagcugguggaggacaccaagcacagacccaaggagaaccuggagcugauccugacccagagcguggagaacgugggcgugagaggcgaccuggugagcgugaagaagagccugggcagaaacagacugcugccccagggccuggccguguacgccagccccgagaacaagaagcuguucgaggaggagaagcugcugagacaggagggcaagcuggagaagauccagaccaaggccggcgaggcccugggcguggugguggccccccacacccugaagcugcccgaggagcccaucaccagauggggcgaguacuggugcgaggugaccgugaacggccuggacaccgugagagugcccaugagcguggugaacuucgagaagcccaagaccaagagauacaaguacuggcuggcccagcaggccgccaaggccauggcccccaccagcccccagaucuaa

SEQ ID NO: 20046 - RNA, 585 nt, Artificial Sequence
  MRPS11__Homo_sapiens__NP_073750
augcaggccgugagaaacgccggcagcagauuccugagaagcuggaccuggccccagaccgccggcagagugguggccagaacccccgccggcaccaucugcaccggcgccagacagcugcaggacgccgccgccaagcagaagguggagcagaacgccgcccccagccacaccaaguucagcaucuacccccccauccccggcgaggagagcagccugagaugggccggcaagaaguucgaggagauccccaucgcccacaucaaggccagccacaacaacacccagauccagguggugagcgccagcaacgagccccuggccuucgccagcugcggcaccgagggcuucagaaacgccaagaagggcaccggcaucgccgcccagaccgccggcaucgccgccgccgccagagccaagcagaagggcgugauccacaucagagugguggugaagggccugggccccggcagacugagcgccaugcacggccugaucaugggcggccuggaggugaucagcaucaccgacaacacccccaucccccacaacggcugcagacccagaaaggccagaaagcuguaa

SEQ ID NO: 20047 - RNA, 417 nt, Artificial Sequence
  MRPS12__Homo_sapiens__NP_203527
augagcuggagcggccugcugcacggccugaacaccagccugaccugcggccccgcccuggugcccagacugugggccaccugcagcauggccacccugaaccagaugcacagacugggcccccccaagagaccccccagaaagcugggccccaccgagggcagaccccagcugaagggcguggugcugugcaccuucaccagaaagcccaagaagcccaacagcgccaacagaaagugcugcagagugagacugagcaccggcagagaggccgugugcuucauccccggcgagggccacacccugcaggagcaccagaucgugcugguggagggcggcagaacccaggaccugcccggcgugaagcugaccguggugagaggcaaguacgacugcggccacgugcagaagaaguaa

SEQ ID NO: 20048 - RNA, 414 nt, Artificial Sequence
  MRPS16__Homo_sapiens__NP_057149
auggugcaccugaccacccugcugugcaaggccuacagaggcggccaccugaccaucagacuggcccugggcggcugcaccaacagacccuucuacagaaucguggccgcccacaacaagugccccagagacggcagauucguggagcagcugggcagcuacgacccccugcccaacagccacggcgagaagcugguggcccugaaccuggacagaaucagacacuggaucggcugcggcgcccaccugagcaagcccauggagaagcugcugggccuggccggcuucuucccccugcaccccaugaugaucaccaacgccgagagacugagaagaaagagagccagagaggugcugcuggccagccagaagaccgacgccgaggccaccgacaccgaggccaccgagaccuaa

SEQ ID NO: 20049 - RNA, 777 nt, Artificial Sequence
  MRPS18B__Homo_sapiens__NP_054765
auggccgccagcgugcugaacaccgugcugagaagacugcccaugcugagccuguucagaggcagccacagagugcaggugccccugcagacccugugcaccaaggcccccagcgaggaggacagccugagcagcgugcccaucagccccuacaaggacgagcccuggaaguaccuggagagcgaggaguaccaggagagauacggcagcagacccgugugggccgacuacagaagaaaccacaagggcggcgugcccccccagagaaccagaaagaccugcaucagaagaaacaagguggugggcaaccccugccccaucugcagagaccacaagcugcacguggacuucagaaacgugaagcugcuggagcaguucgugugcgcccacaccggcaucaucuucuacgcccccuacaccggcgugugcgugaagcagcacaagagacugacccaggccauccagaaggccagagaccacggccugcugaucuaccacaucccccagguggagcccagagaccuggacuucagcaccagccacggcgccgugagcgccaccccccccgcccccacccuggugagcggcgaccccugguaccccugguacaacuggaagcagccccccgagagagagcugagcagacugagaagacuguaccagggccaccugcaggaggagagcggccccccccccgagagcaugcccaagaugccccccagaacccccgccgaggccagcagcaccggccagaccggcccccagagcgcccuguaa

SEQ ID NO: 20050 - RNA, 1083 nt, Artificial Sequence
  MRPS22__Homo_sapiens__NP_064576
auggccccccugggcaccaccgugcugcuguggagccugcugagaagcagccccggcguggagagagugugcuucagagccagaauccagcccuggcacggcggccugcugcagccccugcccugcagcuucgagaugggccugcccagaagaagauucagcagcgaggccgccgagagcggcagccccgagaccaagaagcccaccuucauggacgaggaggugcagagcauccugaccaagaugaccggccugaaccugcagaagaccuucaagcccgccauccaggagcugaagccccccaccuacaagcugaugacccaggcccagcuggaggaggccaccagacaggccguggaggccgccaaggugagacugaagaugccccccgugcuggaggagagagugcccaucaacgacgugcuggccgaggacaagauccuggagggcaccgagaccaccaaguacguguucaccgacaucagcuacagcaucccccacagagagagauucaucguggugagagagcccagcggcacccugagaaaggccagcugggaggagagagacagaaugauccagguguacuuccccaaggagggcagaaagauccugacccccaucaucuucaaggaggagaaccugagaaccauguacagccaggacagacacguggacgugcugaaccugugcuucgcccaguucgagcccgacagcaccgaguacaucaaggugcaccacaagaccuacgaggacaucgacaagagaggcaaguacgaccugcugagaagcaccagauacuucggcggcauggugugguacuucgugaacaacaagaagaucgacggccugcugaucgaccagauccagagagaccugaucgacgacgccaccaaccuggugcagcuguaccacgugcugcaccccgacggccagagcgcccagggcgccaaggaccaggccgccgagggcaucaaccugaucaagguguucgccaagaccgaggcccagaagggcgccuacaucgagcugacccugcagaccuaccaggaggcccugagcagacacagcgccgccagcuaa

SEQ ID NO: 20051 - RNA, 573 nt, Artificial Sequence
  MRPS23__Homo_sapiens__NP_057154
auggccggcagcagacuggagaccgugggcagcaucuucagcagaaccagagaccuggugagagccggcgugcugaaggagaagccccugugguucgacguguacgacgccuuccccccccugagagagcccguguuccagagacccagagugagauacggcaaggccaaggcccccauccaggacaucugguaccacgaggacagaaucagagccaaguucuacagcguguacggcagcggccagagagccuucgaccuguucaaccccaacuucaagagcaccugccagagauucguggagaaguacaccgagcugcagaagcugggcgagaccgacgaggagaagcuguucguggagaccggcaaggcccugcuggccgagggcgugauccugagaagagugggcgaggccagaacccagcacggcggcagccacgugagcagaaagagcgagcaccugagcgugagaccccagaccgcccuggaggagaacgagacccagaaggaggugccccaggaccagcaccuggaggcccccgccgaccagagcaagggccugcugccccccuaa

SEQ ID NO: 20052 - RNA, 564 nt, Artificial Sequence
  MRPS28__Homo_sapiens__NP_054737
auggccgcccugugcagaaccagagccguggccgccgagagccacuuccugagaguguuccuguucuucagacccuucagaggcgugggcaccgagagcggcagcgagagcggcagcagcaacgccaaggagcccaagaccagagccggcggcuucgccagcgcccuggagagacacagcgagcugcugcagaagguggagccccugcagaagggcagccccaagaacguggagagcuucgccagcaugcugagacacagcccccugacccagaugggccccgccaaggacaagcuggugaucggcagaaucuuccacaucguggagaacgaccuguacaucgacuucggcggcaaguuccacugcgugugcagaagacccgagguggacggcgagaaguaccagaagggcaccagagugagacugagacugcuggaccuggagcugaccagcagauuccugggcgccaccaccgacaccaccgugcuggaggccaacgccgugcugcugggcauccaggagagcaaggacagcagaagcaaggaggagcaccacgagaaguaa

SEQ ID NO: 20053 - RNA, 1320 nt, Artificial Sequence
  MRPS30__Homo_sapiens__NP_057724
auggccgccgccagaugcuggagaccccugcugagaggccccagacugagccugcacaccgccgccaacgccgccgccaccgccaccgagaccaccugccaggacguggccgccacccccguggccagauacccccccaucguggccagcaugaccgccgacagcaaggccgccagacugagaagaaucgagagauggcaggccaccgugcacgccgccgagagcguggacgagaagcugagaauccugaccaagaugcaguucaugaaguacaugguguacccccagaccuucgcccugaacgccgacagaugguaccaguacuucaccaagaccguguuccugagcggccugccccccccccccgccgagcccgagcccgagcccgagcccgagcccgagcccgcccuggaccuggccgcccugagagccguggccugcgacugccugcugcaggagcacuucuaccugagaagaagaagaagagugcacagauacgaggagagcgaggugaucagccugcccuuccuggaccagcuggugagcacccuggugggccugcugagcccccacaaccccgcccuggccgccgccgcccuggacuacagaugccccgugcacuucuacugggugagaggcgaggagaucauccccagaggccacagaagaggcagaaucgacgaccugagauaccagaucgacgacaagcccaacaaccagaucagaaucagcaagcagcuggccgaguucgugccccuggacuacagcgugcccaucgagauccccaccaucaagugcaagcccgacaagcugccccuguucaagagacaguacgagaaccacaucuucgugggcagcaagaccgccgaccccugcugcuacggccacacccaguuccaccugcugcccgacaagcugagaagagagagacugcugagacagaacugcgccgaccagaucgaggugguguucagagccaacgccaucgccagccuguucgccuggaccggcgcccaggccauguaccagggcuucuggagcgaggccgacgugaccagacccuucgugagccaggccgugaucaccgacggcaaguacuucagcuucuucugcuaccagcugaacacccuggcccugaccacccaggccgaccagaacaaccccagaaagaacaucugcuggggcacccagagcaagccccuguacgagaccaucgaggacaacgacgugaagggcuucaacgacgacgugcugcugcagaucgugcacuuccugcugaacagacccaaggaggagaagagccagcugcuggagaacuaa

SEQ ID NO: 20054 - RNA, 1188 nt, Artificial Sequence
  MRPS31__Homo_sapiens__NP_005821
auguuccccagagugagcaccuuccugccccugagaccccugagcagacacccccugagcagcggcagccccgagaccagcgccgccgccaucaugcugcugaccgugagacacggcaccgugagauacagaagcagcgcccugcuggccagaaccaagaacaacauccagagauacuucggcaccaacagcgugaucugcagcaagaaggacaagcagagcgugagaaccgaggagaccagcaaggagaccagcgagagccaggacagcgagaaggagaacaccaagaaggaccugcugggcaucaucaagggcaugaagguggagcugagcaccgugaacgugagaaccaccaagccccccaagagaagaccccugaagagccuggaggccacccugggcagacugagaagagccaccgaguacgcccccaagaagagaaucgagccccugagccccgagcugguggccgccgccagcgccguggccgacagccugcccuucgacaagcagaccaccaagagcgagcugcugagccagcugcagcagcacgaggaggagagcagagcccagagagacgccaagagacccaagaucagcuucagcaacaucaucagcgacaugaagguggccagaagcgccaccgccagagugagaagcagacccgagcugagaauccaguucgacgagggcuacgacaacuaccccggccaggagaagaccgacgaccugaagaagagaaagaacaucuucaccggcaagagacugaacaucuucgacaugauggccgugaccaaggaggcccccgagaccgacaccagccccagccugugggacguggaguucgccaagcagcuggccaccgugaacgagcagccccugcagaacggcuucgaggagcugauccaguggaccaaggagggcaagcugugggaguuccccaucaacaacgaggccggcuucgacgacgacggcagcgaguuccacgagcacaucuuccuggagaagcaccuggagagcuuccccaagcagggccccaucagacacuucauggagcuggugaccugcggccugagcaagaaccccuaccugagcgugaagcagaagguggagcacaucgagugguucagaaacuacuucaacgagaagaaggacauccugaaggagagcaacauccaguucaacuaa

SEQ ID NO: 20055 - RNA, 321 nt, Artificial Sequence
  MRPS33__Homo_sapiens__NP_444263
augagcagccugagcgaguacgccuucagaaugagcagacugagcgccagacuguucggcgaggugaccagacccaccaacagcaagagcaugaagguggugaagcuguucagcgagcugccccuggccaagaagaaggagaccuacgacugguaccccaaccaccacaccuacgccgagcugaugcagacccugagauuccugggccuguacagagacgagcaccaggacuucauggacgagcagaagagacugaagaagcugagaggcaaggagaagcccaagaagggcgagggcaagagagccgccaagagaaaguaa

SEQ ID NO: 20056 - RNA, 378 nt, Artificial Sequence
  MRPS6__Homo_sapiens__NP_115865
augcccagauacgagcuggcccugauccugaaggccaugcagagacccgagaccgccgccacccugaagagaaccaucgaggcccugauggacagaggcgccaucgugagagaccuggagaaccugggcgagagagcccugcccuacagaaucagcgcccacagccagcagcacaacagaggcggcuacuuccugguggacuucuacgcccccaccgccgccguggagagcaugguggagcaccugagcagagacaucgacgugaucagaggcaacaucgugaagcacccccugacccaggagcugaaggagugcgagggcaucgugcccgugccccuggccgagaagcuguacagcaccaagaagagaaagaaguaa

SEQ ID NO: 20057 - RNA, 729 nt, Artificial Sequence
  MRPS7__Homo_sapiens__NP_057055
auggccgcccccgccgugaagguggccagaggcuggagcggccuggcccugggcgugagaagagccgugcugcagcugcccggccugacccaggugagauggagcagauacagccccgaguucaaggacccccugaucgacaaggaguacuacagaaagcccguggaggagcugaccgaggaggagaaguacgugagagagcugaagaagacccagcugaucaaggccgcccccgccggcaagaccagcagcguguucgaggaccccgugaucagcaaguucaccaacaugaugaugaucggcggcaacaaggugcuggccagaagccugaugauccagacccuggaggccgugaagagaaagcaguucgagaaguaccacgccgccagcgccgaggagcaggccaccaucgagagaaaccccuacaccaucuuccaccaggcccugaagaacugcgagcccaugaucggccuggugcccauccugaagggcggcagauucuaccaggugcccgugccccugcccgacagaagaagaagauuccuggccaugaaguggaugaucaccgagugcagagacaagaagcaccagagaacccugaugcccgagaagcugagccacaagcugcuggaggccuuccacaaccagggccccgugaucaagagaaagcacgaccugcacaagauggccgaggccaacagagcccuggcccacuacagauggugguaa

SEQ ID NO: 20058 - RNA, 1191 nt, Artificial Sequence
  MRPS9__Homo_sapiens__NP_872578
auggccgcccccugcgugagcuacggcggcgccgugagcuacagacugcugcuguggggcagaggcagccuggccagaaagcagggccuguggaagaccgccgcccccgagcugcagaccaacgugagaagccagauccugagacugagacacaccgccuucgugauccccaagaagaacgugcccaccagcaagagagagaccuacaccgaggacuucaucaagaagcagaucgaggaguucaacaucggcaagagacaccuggccaacaugaugggcgaggaccccgagaccuucacccaggaggacaucgacagagccaucgccuaccuguuccccagcggccuguucgagaagagagccagacccgugaugaagcaccccgagcagaucuuccccagacagagagccauccaguggggcgaggacggcagacccuuccacuaccuguucuacaccggcaagcagagcuacuacagccugaugcacgacguguacggcaugcugcugaaccuggagaagcaccagagccaccugcaggccaagagccugcugcccgagaagaccgugaccagagacgugaucggcagcagauggcugaucaaggaggagcuggaggagaugcugguggagaagcugagcgaccuggacuacaugcaguucaucagacugcuggagaagcugcugaccagccagugcggcgccgccgaggaggaguucgugcagagauucagaagaagcgugacccuggagagcaagaagcagcugaucgagcccgugcaguacgacgagcagggcauggccuucagcaagagcgagggcaagagaaagaccgccaaggccgaggccaucguguacaagcacggcagcggcagaaucaaggugaacggcaucgacuaccagcuguacuuccccaucacccaggacagagagcagcugauguuccccuuccacuucguggacagacugggcaagcacgacgugaccugcaccgugagcggcggcggcagaagcgcccaggccggcgccaucagacuggccauggccaaggcccugugcagcuucgugaccgaggacgagguggaguggaugagacaggccggccugcugaccaccgaccccagagugagagagagaaagaagcccggccaggagggcgccagaagaaaguucaccuggaagaagagauaa

SEQ ID NO: 20059 - RNA, 633 nt, Artificial Sequence
  MRRF__Homo_sapiens__NP_001166983
auggcccugggccugaagugcuucagaauggugcaccccaccuucagaaacuaccuggccgccagcaucagacccgugagcgaggugacccugaagaccgugcacgagagacagcacggccacagacaguacauggccuacagcgccgugcccgugagacacuucgccaccaagaaggccaagggcagccuggacaagaucgccguggugaccgccgacggcaagcuggcccugaaccagaucagccagaucagcaugaagagcccccagcugauccuggugaacauggccagcuuccccgagugcaccgccgccgccaucaaggccaucagagagagcggcaugaaccugaaccccgagguggagggcacccugaucagagugcccaucccccaggugaccagagagcacagagagaugcuggugaagcuggccaagcagaacaccaacaaggccaaggacagccugagaaaggugagaaccaacagcaugaacaagcugaagaagagcaaggacaccgugagcgaggacaccaucagacugaucgagaagcagaucagccagauggccgacgacaccguggccgagcuggacagacaccuggccgugaagaccaaggagcugcugggcuaa

SEQ ID NO: 20060 - RNA, 1341 nt, Artificial Sequence
  MRS2__Homo_sapiens__NP_001273193
auggagugccugagaagccugcccugccugcugcccagagccaugagacugcccagaagaacccugugcgcccuggcccuggacgugaccagcgugggcccccccguggccgccugcggcagaagagccaaccugaucggcagaagcagagccgcccagcugugcggccccgacagacugagaguggccggcgaggugcacagauucagaaccagcgacgugagccaggccacccuggccagcguggcccccguguucaccgugaccaaguucgacaagcagggcaacgugaccagcuucgagagaaagaagaccgagcuguaccaggagcugggccugcaggccagagaccugagauuccagcacgugaugagcaucaccgugagaaacaacagaaucaucaugagaauggagaaguacagccugcugcuggagagcguggccagcauccugcagaacagcgugagcuucauggagagacagaccgagcaguggcuguucagagagcugcccagccagcugagcggcgagggccagcuggugaccuacccccugcccuucgaguucagagccaucgaggcccugcugcaguacuggaucaacacccugcagggcaagcugagcauccugcagccccugauccuggagacccuggacgcccugguggaccccaagcacagcagcguggacagaagcaagcugcacauccugcugcagaacggcaagagccugagcgagcuggagaccgacaucaagaucuucaaggagagcauccuggagauccuggacgaggaggagcugcuggaggagcugugcgugagcaaguggagcgacccccagguguucgagaagagcagcgccggcaucgaccacgccgaggagauggagcugcugcuggagaacuacuacagacuggccgacgaccugagcaacgccgccagagagcugagagugcugaucgacgacagccagagcaucaucuucaucaaccuggacagccacagaaacgugaugaugagacugaaccugcagcugaccaugggcaccuucagccugagccuguucggccugaugggcguggccuucggcaugaaccuggagagcagccuggaggaggaccacagaaucuucuggcugaucaccggcaucauguucaugggcagcggccugaucuggagaagacugcugagcuuccugggcagacagcuggaggccccccugccccccaugauggccagccugcccaagaagacccugcuggccgacagaagcauggagcugaagaacagccugagacuggacggccugggcagcggcagaagcauccugaccaacagauaa

SEQ ID NO: 20061 - RNA, 2715 nt, Artificial Sequence
  MRVI1__Homo_sapiens__NP_001092049
augggcauggaccugaccugccccuucggcaucagccccgccugcggcgcccaggccagcuggagcaucuucggcgccgacgccgccgaggugcccggcaccagaggccacagccagcaggaggccgccaugccccacauccccgaggacgaggagccccccggcgagccccaggccgcccagagccccgccggccagggcccccccgccgccggcgugagcugcagccccacccccaccaucgugcugaccggcgacgccaccagccccgagggcgagaccgacaagaaccuggccaacagagugcacagcccccacaagagacugagccacagacaccugaaggugagcaccgccagccugaccagcguggaccccgccggccacaucaucgaccuggugaacgaccagcugcccgacaucagcaucagcgaggaggacaagaagaagaaccuggcccugcuggaggaggccaagcuggugagcgagagauuccugaccagaagaggcagaaagagcagaagcagccccggcgacagccccagcgccgugagccccaaccugagccccagcgccagccccaccagcagcagaagcaacagccugaccgugcccaccccccccggccuggacgugugcagcggcccccccagcccccugcccggcgcccccccccagcagaagggcgacgaggccgacgugagcagcccccaccccggcgagcccaacgugcccaagggccuggccgacagaaagcagaacgaccagagaaaggugagccagggcagacuggcccccagacccccccccguggagaagagcaaggagaucgccaucgagcagaaggagaacuucgacccccugcaguaccccgagaccacccccaagggccuggcccccgugaccaacagcagcggcaagauggcccugaacagcccccagcccggccccguggagagcgagcugggcaagcagcugcugaagaccggcugggagggcagcccccugcccagaagccccacccaggacgccgccggcgugggcccccccgccagccagggcagaggccccgccggcgagcccaugggccccgaggccggcagcaaggccgagcugccccccaccgugagcagacccccccugcugagaggccugagcugggacagcggccccgaggagcccggccccagacugcagaaggugcuggccaagcugccccuggccgaggaggagaagagauucgccggcaaggccggcggcaagcuggccaaggcccccggccugaaggacuuccagauccaggugcagcccgugagaaugcagaagcugaccaagcugagagaggagcacauccugaugagaaaccagaaccuggugggccugaagcugcccgaccugagcgaggccgccgagcaggagaagggccugcccagcgagcugagccccgccaucgaggaggaggagagcaagagcggccuggacgugaugcccaacaucagcgacgugcugcugagaaagcugagagugcacagaagccugcccggcagcgcccccccccugaccgagaaggagguggagaacguguucgugcagcugagccuggccuucagaaacgacagcuacacccuggagagcagaaucaaccaggccgagagagagagaaaccugaccgaggagaacaccgagaaggagcuggagaacuucaaggccagcaucaccagcagcgccagccuguggcaccacugcgagcacagagagaccuaccagaagcugcuggaggacaucgccgugcugcacagacuggccgccagacugagcagcagagccgagguggugggcgccgugagacaggagaagagaaugagcaaggccaccgaggugaugaugcaguacguggagaaccugaagagaaccuacgagaaggaccacgccgagcugauggaguucaagaagcuggccaaccagaacagcagcagaagcugcggccccagcgaggacggcgugcccagaaccgccagaagcaugagccugacccugggcaagaacaugcccagaagaagagugagcguggccguggugcccaaguucaacgcccugaaccugcccggccagacccccagcagcagcagcauccccagccugcccgcccugagcgagagccccaacggcaagggcagccugcccgugaccagcgcccugcccgcccugcuggagaacggcaagaccaacggcgaccccgacugcgaggccagcgcccccgcccugacccugagcugccuggaggagcugagccaggagaccaaggccagaauggaggaggaggccuacagcaagggcuuccaggagggccugaagaagaccaaggagcugcaggaccugaaggaggaggaggaggagcagaagagcgagagccccgaggagcccgaggagguggaggagaccgaggaggaggagaagggccccagaagcagcaagcuggaggagcuggugcacuuccugcaggugauguaccccaagcugugccagcacuggcaggugaucuggaugauggccgccgugaugcuggugcugaccguggugcugggccuguacaacagcuacaacagcugcgccgagcaggccgacggcccccugggcagaagcaccugcagcgccgcccagagagacagcugguggagcagcggccugcagcacgagcagcccaccgagcaguaa

SEQ ID NO: 20062 - RNA, 666 nt, Artificial Sequence
  MS4A12__Homo_sapiens__NP_001157942
augaugagcagcaagcccaccagccacgccgaggugaacgagaccauccccaaccccuacccccccagcagcuucauggcccccggcuuccagcagccccugggcagcaucaaccuggagaaccaggcccagggcgcccagagagcccagcccuacggcaucaccagccccggcaucuucgccagcagccagcccggccagggcaacauccagaugaucaaccccagcgugggcaccgccgugaugaacuucaaggaggaggccaaggcccugggcuucaucaucagcggcagccugagcgugagcgccagcaaggagcugagcagaugccuggugaagggcagccugggcaugaacaucgugagcagcauccuggccuucaucggcgugauccugcugcugguggacaugugcaucaacggcguggccggccaggacuacugggccgugcugagcggcaagggcaucagcgccacccugaugaucuucagccugcuggaguucuucguggccugcgccaccgcccacuucgccaaccaggccaacaccaccaccaacaugagcgugcuggugauccccaacauguacgagagcaaccccgugacccccgccagcagcagcgccccccccagaugcaacaacuacagcgccaacgcccccaaguaa

SEQ ID NO: 20063 - RNA, 894 nt, Artificial Sequence
  MS4A1__Homo_sapiens__NP_068769
augaccacccccagaaacagcgugaacggcaccuuccccgccgagcccaugaagggccccaucgccaugcagagcggccccaagccccuguucagaagaaugagcagccuggugggccccacccagagcuucuucaugagagagagcaagacccugggcgccgugcagaucaugaacggccuguuccacaucgcccugggcggccugcugaugauccccgccggcaucuacgcccccaucugcgugaccgugugguacccccuguggggcggcaucauguacaucaucagcggcagccugcuggccgccaccgagaagaacagcagaaagugccuggugaagggcaagaugaucaugaacagccugagccuguucgccgccaucagcggcaugauccugagcaucauggacauccugaacaucaagaucagccacuuccugaagauggagagccugaacuucaucagagcccacacccccuacaucaacaucuacaacugcgagcccgccaaccccagcgagaagaacagccccagcacccaguacugcuacagcauccagagccuguuccugggcauccugagcgugaugcugaucuucgccuucuuccaggagcuggugaucgccggcaucguggagaacgaguggaagagaaccugcagcagacccaagagcaacaucgugcugcugagcgccgaggagaagaaggagcagaccaucgagaucaaggaggagguggugggccugaccgagaccagcagccagcccaagaacgaggaggacaucgagaucauccccauccaggaggaggaggaggaggagaccgagaccaacuuccccgagcccccccaggaccaggagagcagccccaucgagaacgacagcagccccuaa

SEQ ID NO: 20064 - RNA, 600 nt, Artificial Sequence
  MS4A2__Homo_sapiens__NP_001243845
auggacaccgagagcaacagaagagccaaccuggcccugccccaggagcccagcagcgugcccgccuucgaggugcuggagaucagcccccaggaggugagcagcggcagacugcugaagagcgccagcagccccccccugcacaccuggcugaccgugcugaagaaggagcaggaguuccugggcuucagcaucagcggcaugcugagcaucaucagcgagagaagaaacgccaccuaccuggugagaggcagccugggcgccaacaccgccagcagcaucgccggcggcaccggcaucaccauccugaucaucaaccugaagaagagccuggccuacauccacauccacagcugccagaaguucuucgagaccaagugcuucauggccagcuucagcaccgagaucguggugaugaugcuguuccugaccauccugggccugggcagcgccgugagccugaccaucugcggcgccggcgaggagcugaagggcaacaaggugcccgaggacagaguguacgaggagcugaacaucuacagcgccaccuacagcgagcuggaggaccccggcgagaugagcccccccaucgaccuguaa

SEQ ID NO: 20065 - RNA, 276 nt, Artificial Sequence
  MS4A3__Homo_sapiens__NP_001026836
augaacaucgccagcgccaccaucgcccuggugggcaccgccuuccugagccugaacaucgccgugaacauccagagccugagaagcugccacagcagcagcgagagccccgaccugugcaacuacaugggcagcaucagcaacggcauggugagccugcugcugauccugacccugcuggagcugugcgugaccaucagcaccaucgccauguggugcaacgccaacugcugcaacagcagagaggagaucagcagcccccccaacagcguguaa

SEQ ID NO: 20066 - RNA, 561 nt, Artificial Sequence
  MS4A4A__Homo_sapiens__NP_001230195
augcaccagaccuacagcagacacugcagacccgaggagagcaccuucagcgccgccaugaccaccaugcagggcauggagcaggccaugcccggcgccggccccggcgugccccagcugggcaacauggccgugauccacagccaccuguggaagggccugcaggagaaguuccugaagggcgagcccaaggugcugggcguggugcagauccugaccgcccugaugagccugagcaugggcaucaccaugaugugcauggccagcaacaccuacggcagcaaccccaucagcguguacaucggcuacaccaucuggggcagcgugauguucaucaucagcggcagccugagcaucgccgccggcaucagaaccaccaagggccugggccuggacggcauggugcugcugcugagcgugcuggaguucugcaucgccgugagccugagcgccuucggcugcaaggugcugugcugcacccccggcggcguggugcugauccugcccagccacagccacauggccgagaccgccagccccaccccccugaacgagguguaa

SEQ ID NO: 20067 - RNA, 762 nt, Artificial Sequence
  MS4A6A__Homo_sapiens__NP_001234928
auggugcugcugaagcugcuggagguguacagaaagggcagcgccggcaccuuccacaagagcaccaucuucggcaacaccaucaugaccagccagcccgugcccaacgagaccaucaucgugcugcccagcaacgugaucaacuucagccaggccgagaagcccgagcccaccaaccagggccaggacagccugaagaagcaccugcacgccgagaucaaggugaucggcaccauccagauccugugcggcaugauggugcugagccugggcaucauccuggccagcgccagcuucagccccaacuucacccaggugaccagcacccugcugaacagcgccuaccccuucaucggccccuucuucuucaucaucagcggcagccugagcaucgccaccgagaagagacugaccaagcugcuggugcacagcagccuggugggcagcauccugagcgcccugagcgcccuggugggcuucaucauccugagcgugaagcaggccacccugaaccccgccagccugcagugcgagcuggacaagaacaacauccccaccagaagcuacgugagcuacuucuaccacgacagccuguacaccaccgacugcuacaccgccaaggccagccuggccggcacccugagccugaugcugaucugcacccugcuggaguucugccuggccgugcugaccgccgugcugagauggaagcaggccuacagcgacuuccccggcgugagcgugcuggccggcuucaccuaa

SEQ ID NO: 20068 - RNA, 753 nt, Artificial Sequence
  MS4A8__Homo_sapiens__NP_113645
augaacagcaugaccagcgccgugcccguggccaacagcgugcuggugguggccccccacaacggcuaccccgugacccccggcaucaugagccacgugccccuguaccccaacagccagccccaggugcaccuggugcccggcaacccccccagccuggugagcaacgugaacggccagcccgugcagaaggcccugaaggagggcaagacccugggcgccauccagaucaucaucggccuggcccacaucggccugggcagcaucauggccaccgugcuggugggcgaguaccugagcaucagcuucuacggcggcuuccccuucuggggcggccugugguucaucaucagcggcagccugagcguggccgccgagaaccagcccuacagcuacugccugcugagcggcagccugggccugaacaucgugagcgccaucugcagcgccgugggcgugauccuguucaucaccgaccugagcaucccccaccccuacgccuaccccgacuacuaccccuacgccuggggcgugaaccccggcauggccaucagcggcgugcugcugguguucugccugcuggaguucggcaucgccugcgccagcagccacuucggcugccagcuggugugcugccagagcagcaacgugagcgugaucuaccccaacaucuacgccgccaaccccgugaucacccccgagcccgugaccagcccccccagcuacagcagcgagauccaggccaacaaguaa

SEQ ID NO: 20069 - RNA, 1365 nt, Artificial Sequence
  MSANTD3-TMEFF1__Homo_sapiens__NP_001185741
augcagaacaacgagaucaucaagcccgccaaguacuucagcgagcuggagaagagcauccugcuggcccugguggagaaguacaaguacgugcuggagugcaagaagagcgacgccagaaccaucgcccugaagcagagaaccuggcaggcccuggcccacgaguacaacagccagcccagcgugagccugagagacuucaagcagcugaagaagugcugggagaacaucaaggccagaaccaagaagaucauggcccacgagagaagagagaaggugaagagaagcgugagcccccugcugagcacccacgugcugggcaaggagaagaucgccagcaugcugcccgagcagcuguacuuccugcagagcccccccgaggaggagcccgaguaccaccccgacgccagcgcccaggagcugaacgugagagagagcgacgugagagugugcgacgagagcagcugcaaguacggcggcgugugcaaggaggacggcgacggccugaagugcgccugccaguuccagugccacaccaacuacauccccgugugcggcagcaacggcgacaccuaccagaacgagugcuuccugagaagagccgccugcaagcaccagaaggagaucaccgugaucgccagaggccccugcuacagcgacaacggcagcggcagcggcgagggcgaggaggagggcagcggcgccgaggugcacagaaagcacagcaagugcggccccugcaaguacaaggccgagugcgacgaggacgccgagaacgugggcugcgugugcaacaucgacugcagcggcuacagcuucaaccccgugugcgccagcgacggcagcagcuacaacaaccccugcuucgugagagaggccagcugcaucaagcaggagcagaucgacaucagacaccugggccacugcaccgacaccgacgacaccagccugcugggcaagaaggacgacggccugcaguacagacccgacgugaaggacgccagcgaccagagagaggacguguacaucggcaaccacaugcccugccccgagaaccugaacggcuacugcauccacggcaagugcgaguucaucuacagcacccagaaggccagcugcagaugcgagagcggcuacaccggccagcacugcgagaagaccgacuucagcauccuguacguggugcccagcagacagaagcugacccacgugcugaucgccgccaucaucggcgccgugcagaucgccaucaucguggccaucgugaugugcaucaccagaaagugccccaagaacaacagaggcagaagacagaagcagaaccugggccacuucaccagcgacaccagcagcagaaugguguaa

SEQ ID NO: 20070 - RNA, 621 nt, Artificial Sequence
  MSC__Homo_sapiens__NP_005089
augagcaccggcagcgugagcgaccccgaggagauggagcugagaggccugcagagagaguaccccgugcccgccagcaagagacccccccugagaggcguggagagaagcuacgccagccccagcgacaacagcagcgccgaggaggaggaccccgacggcgaggaggagagaugcgcccugggcaccgccggcagcgccgagggcugcaagagaaagagacccagaguggccggcggcggcggcgccggcggcagcgccggcggcggcggcaagaagccccugcccgccaagggcagcgccgccgagugcaagcagagccagagaaacgccgccaacgccagagagagagccagaaugagagugcugagcaaggccuucagcagacugaagaccagccugcccugggugccccccgacaccaagcugagcaagcuggacacccugagacuggccagcagcuacaucgcccaccugagacagcugcugcaggaggacagauacgagaacggcuacgugcaccccgugaaccugaccuggcccuucguggugagcggcagacccgacagcgacaccaaggaggugagcgccgccaacagacugugcggcaccaccgccuaa

SEQ ID NO: 20071 - RNA, 582 nt, Artificial Sequence
  MSGN1__Homo_sapiens__NP_001099039
auggacaaccugagagagaccuuccugagccuggaggacggccugggcagcagcgacagccccggccugcugagcagcugggacuggaaggacagagccggccccuucgagcugaaccaggccagccccagccagagccugagccccgcccccagccuggagagcuacagcagcagccccugccccgccguggccggccugcccugcgagcacggcggcgccagcagcggcggcagcgagggcugcagcgugggcggcgccagcggccugguggagguggacuacaacaugcuggccuuccagcccacccaccugcagggcggcggcggccccaaggcccagaagggcaccaaggugagaaugagcgugcagagaagaagaaaggccagcgagagagagaagcugagaaugagaacccuggccgacgcccugcacacccugagaaacuaccugccccccguguacagccagagaggccagccccugaccaagauccagacccugaaguacaccaucaaguacaucggcgagcugaccgaccugcugaacagaggcagagagcccagagcccagagcgccuaa

SEQ ID NO: 20072 - RNA, 2805 nt, Artificial Sequence
  MSH2__Homo_sapiens__NP_000242
auggccgugcagcccaaggagacccugcagcuggagagcgccgccgaggugggcuucgugagauucuuccagggcaugcccgagaagcccaccaccaccgugagacuguucgacagaggcgacuucuacaccgcccacggcgaggacgcccugcuggccgccagagagguguucaagacccagggcgugaucaaguacaugggccccgccggcgccaagaaccugcagagcguggugcugagcaagaugaacuucgagagcuucgugaaggaccugcugcuggugagacaguacagaguggagguguacaagaacagagccggcaacaaggccagcaaggagaacgacugguaccuggccuacaaggccagccccggcaaccugagccaguucgaggacauccuguucggcaacaacgacaugagcgccagcaucggcguggugggcgugaagaugagcgccguggacggccagagacaggugggcgugggcuacguggacagcauccagagaaagcugggccugugcgaguuccccgacaacgaccaguucagcaaccuggaggcccugcugauccagaucggccccaaggagugcgugcugcccggcggcgagaccgccggcgacaugggcaagcugagacagaucauccagagaggcggcauccugaucaccgagagaaagaaggccgacuucagcaccaaggacaucuaccaggaccugaacagacugcugaagggcaagaagggcgagcagaugaacagcgccgugcugcccgagauggagaaccagguggccgugagcagccugagcgccgugaucaaguuccuggagcugcugagcgacgacagcaacuucggccaguucgagcugaccaccuucgacuucagccaguacaugaagcuggacaucgccgccgugagagcccugaaccuguuccagggcagcguggaggacaccaccggcagccagagccuggccgcccugcugaacaagugcaagaccccccagggccagagacuggugaaccaguggaucaagcagccccugauggacaagaacagaaucgaggagagacugaaccugguggaggccuucguggaggacgccgagcugagacagacccugcaggaggaccugcugagaagauuccccgaccugaacagacuggccaagaaguuccagagacaggccgccaaccugcaggacugcuacagacuguaccagggcaucaaccagcugcccaacgugauccaggcccuggagaagcacgagggcaagcaccagaagcugcugcuggccguguucgugaccccccugaccgaccugagaagcgacuucagcaaguuccaggagaugaucgagaccacccuggacauggaccagguggagaaccacgaguuccuggugaagcccagcuucgaccccaaccugagcgagcugagagagaucaugaacgaccuggagaagaagaugcagagcacccugaucagcgccgccagagaccugggccuggaccccggcaagcagaucaagcuggacagcagcgcccaguucggcuacuacuucagagugaccugcaaggaggagaaggugcugagaaacaacaagaacuucagcaccguggacauccagaagaacggcgugaaguucaccaacagcaagcugaccagccugaacgaggaguacaccaagaacaagaccgaguacgaggaggcccaggacgccaucgugaaggagaucgugaacaucagcagcggcuacguggagcccaugcagacccugaacgacgugcuggcccagcuggacgccguggugagcuucgcccacgugagcaacggcgcccccgugcccuacgugagacccgccauccuggagaagggccagggcagaaucauccugaaggccagcagacacgccugcguggaggugcaggacgagaucgccuucauccccaacgacguguacuucgagaaggacaagcagauguuccacaucaucaccggccccaacaugggcggcaagagcaccuacaucagacagaccggcgugaucgugcugauggcccagaucggcugcuucgugcccugcgagagcgccgaggugagcaucguggacugcauccuggccagagugggcgccggcgacagccagcugaagggcgugagcaccuucauggccgagaugcuggagaccgccagcauccugagaagcgccaccaaggacagccugaucaucaucgacgagcugggcagaggcaccagcaccuacgacggcuucggccuggccugggccaucagcgaguacaucgccaccaagaucggcgccuucugcauguucgccacccacuuccacgagcugaccgcccuggccaaccagauccccaccgugaacaaccugcacgugaccgcccugaccaccgaggagacccugaccaugcuguaccaggugaagaagggcgugugcgaccagagcuucggcauccacguggccgagcuggccaacuuccccaagcacgugaucgagugcgccaagcagaaggcccuggagcuggaggaguuccaguacaucggcgagagccagggcuacgacaucauggagcccgccgccaagaagugcuaccuggagagagagcagggcgagaagaucauccaggaguuccugagcaaggugaagcagaugcccuucaccgagaugagcgaggagaacaucaccaucaagcugaagcagcugaaggccgaggugaucgccaagaacaacagcuucgugaacgagaucaucagcagaaucaaggugaccaccuaa

SEQ ID NO: 20073 - RNA, 3414 nt, Artificial Sequence
  MSH3__Homo_sapiens__NP_002430
augagcagaagaaagcccgccagcggcggccuggccgccagcagcagcgcccccgccagacaggccgugcugagcagauucuuccagagcaccggcagccugaagagcaccagcagcagcaccggcgccgccgaccagguggaccccggcgccgccgccgccgccgccgccgccgccgccgccgccccccccgccccccccgcccccgccuuccccccccagcugcccccccacaucgccaccgagaucgacagaagaaagaagagaccccuggagaacgacggccccgugaagaagaaggugaagaaggugcagcagaaggagggcggcagcgaccugggcaugagcggcaacagcgagcccaagaagugccugagaaccagaaacgugagcaagagccuggagaagcugaaggaguucugcugcgacagcgcccugccccagagcagagugcagaccgagagccugcaggagagauucgccgugcugcccaagugcaccgacuucgacgacaucagccugcugcacgccaagaacgccgugagcagcgaggacagcaagagacagaucaaccagaaggacaccacccuguucgaccugagccaguucggcagcagcaacaccagccacgagaaccugcagaagaccgccagcaagagcgccaacaagagaagcaagagcaucuacaccccccuggagcugcaguacaucgagaugaagcagcagcacaaggacgccgugcugugcguggagugcggcuacaaguacagauucuucggcgaggacgccgagaucgccgccagagagcugaacaucuacugccaccuggaccacaacuucaugaccgccagcauccccacccacagacuguucgugcacgugagaagacugguggccaagggcuacaaggugggcguggugaagcagaccgagaccgccgcccugaaggccaucggcgacaacagaagcagccuguucagcagaaagcugaccgcccuguacaccaagagcacccugaucggcgaggacgugaacccccugaucaagcuggacgacgccgugaacguggacgagaucaugaccgacaccagcaccagcuaccugcugugcaucagcgagaacaaggagaacgugagagacaagaagaagggcaacaucuucaucggcaucgugggcgugcagcccgccaccggcgaggugguguucgacagcuuccaggacagcgccagcagaagcgagcuggagaccagaaugagcagccugcagcccguggagcugcugcugcccagcgcccugagcgagcagaccgaggcccugauccacagagccaccagcgugagcgugcaggacgacagaaucagaguggagagaauggacaacaucuacuucgaguacagccacgccuuccaggccgugaccgaguucuacgccaaggacaccguggacaucaagggcagccagaucaucagcggcaucgugaaccuggagaagcccgugaucugcagccuggccgccaucaucaaguaccugaaggaguucaaccuggagaagaugcugagcaagcccgagaacuucaagcagcugagcagcaagauggaguucaugaccaucaacggcaccacccugagaaaccuggagauccugcagaaccagaccgacaugaagaccaagggcagccugcugugggugcuggaccacaccaagaccagcuucggcagaagaaagcugaagaagugggugacccagccccugcugaagcugagagagaucaacgccagacuggacgccgugagcgaggugcugcacagcgagagcagcguguucggccagaucgagaaccaccugagaaagcugcccgacaucgagagaggccugugcagcaucuaccacaagaagugcagcacccaggaguucuuccugaucgugaagacccuguaccaccugaagagcgaguuccaggccaucauccccgccgugaacagccacauccagagcgaccugcugagaaccgugauccuggagauccccgagcugcugagccccguggagcacuaccugaagauccugaacgagcaggccgccaaggugggcgacaagaccgagcuguucaaggaccugagcgacuucccccugaucaagaagagaaaggacgagauccagggcgugaucgacgagaucagaaugcaccugcaggagaucagaaagauccugaagaaccccagcgcccaguacgugaccgugagcggccaggaguucaugaucgagaucaagaacagcgccgugagcugcauccccaccgacugggugaaggugggcagcaccaaggccgugagcagauuccacagccccuucaucguggagaacuacagacaccugaaccagcugagagagcagcuggugcuggacugcagcgccgaguggcuggacuuccuggagaaguucagcgagcacuaccacagccugugcaaggccgugcaccaccuggccaccguggacugcaucuucagccuggccaagguggccaagcagggcgacuacugcagacccaccgugcaggaggagagaaagaucgugaucaagaacggcagacaccccgugaucgacgugcugcugggcgagcaggaccaguacgugcccaacaacaccgaccugagcgaggacagcgagagagugaugaucaucaccggccccaacaugggcggcaagagcagcuacaucaagcagguggcccugaucaccaucauggcccagaucggcagcuacgugcccgccgaggaggccaccaucggcaucguggacggcaucuucaccagaaugggcgccgccgacaacaucuacaagggccagagcaccuucauggaggagcugaccgacaccgccgagaucaucagaaaggccaccagccagagccuggugauccuggacgagcugggcagaggcaccagcacccacgacggcaucgccaucgccuacgccacccuggaguacuucaucagagacgugaagagccugacccuguucgugacccacuacccccccgugugcgagcuggagaagaacuacagccaccaggugggcaacuaccacaugggcuuccuggugagcgaggacgagagcaagcuggaccccggcgccgccgagcaggugcccgacuucgugaccuuccuguaccagaucaccagaggcaucgccgccagaagcuacggccugaacguggccaagcuggccgacgugcccggcgagauccugaagaaggccgcccacaagagcaaggagcuggagggccugaucaacaccaagagaaagagacugaaguacuucgccaagcuguggaccaugcacaacgcccaggaccugcagaaguggaccgaggaguucaacauggaggagacccagaccagccugcugcacuaa

SEQ ID NO: 20074 - RNA, 2469 nt, Artificial Sequence
  MSH5__Homo_sapiens__NP_079535
auggccagccugggcgccaaccccagaagaaccccccagggccccagacccggcgccgccagcagcggcuuccccagccccgcccccgugcccggccccagagaggccgaggaggaggagguggaggaggaggaggagcuggccgagauccaccugugcgugcuguggaacagcggcuaccugggcaucgccuacuacgacaccagcgacagcaccauccacuucaugcccgacgcccccgaccacgagagccugaagcugcugcagagagugcuggacgagaucaacccccagagcguggugaccagcgccaagcaggacgagaacaugaccagauuccugggcaagcuggccagccaggagcacagagagcccaagagacccgagaucaucuuccugcccagcguggacuucggccuggagaucagcaagcagagacugcugagcggcaacuacagcuucauccccgacgccaugaccgccaccgagaagauccuguuccugagcagcaucauccccuucgacugccugcugaccccccccggcgaccugagauucacccccaucccccugcugauccccagccaggugagagcccugggcggccugcugaaguuccugggcagaagaagaaucggcguggagcuggaggacuacaacgugagcgugcccauccugggcuucaagaaguucaugcugacccaccuggugaacaucgaccaggacaccuacagcgugcugcagaucuucaagagcgagagccaccccagcguguacaagguggccagcggccugaaggagggccugagccuguucggcauccugaacagaugccacugcaaguggggcgagaagcugcugagacugugguucaccagacccacccacgaccugggcgagcugagcagcagacuggacgugauccaguucuuccugcugccccagaaccuggacauggcccagaugcugcacagacugcugggccacaucaagaacgugccccugauccugaagagaaugaagcugagccacaccaaggugagcgacuggcaggugcuguacaagaccguguacagcgcccugggccugagagacgccugcagaagccugccccagagcauccagcuguucagagacaucgcccaggaguucagcgacgaccugcaccacaucgccagccugaucggcaaggugguggacuucgagggcagccuggccgagaacagauucaccgugcugcccaacaucgaccccgagaucgacgagaagaagagaagacugaugggccugcccagcuuccugaccgagguggccagaaaggagcuggagaaccuggacagcagaauccccagcugcagcgugaucuacaucccccugaucggcuuccugcugagcauccccagacugcccagcaugguggaggccagcgacuucgagaucaacggccuggacuucauguuccugagcgaggagaagcugcacuacagaagcgccagaaccaaggagcuggacgcccugcugggcgaccugcacugcgagaucagagaccaggagacccugcugauguaccagcugcagugccaggugcuggccagagccgccgugcugaccagagugcuggaccuggccagcagacuggacgugcugcuggcccuggccagcgccgccagagacuacggcuacagcagacccagauacagcccccaggugcugggcgugagaauccagaacggcagacacccccugauggagcugugcgccagaaccuucgugcccaacagcaccgagugcggcggcgacaagggcagagugaaggugaucaccggccccaacagcagcggcaagagcaucuaccugaagcaggugggccugaucaccuucauggcccuggugggcagcuucgugcccgccgaggaggccgagaucggcgccguggacgccaucuucaccagaauccacagcugcgagagcaucagccugggccugagcaccuucaugaucgaccugaaccagcagguggccaaggccgugaacaacgccaccgcccagagccuggugcugaucgacgaguucggcaagggcaccaacaccguggacggccuggcccugcuggccgccgugcugagacacuggcuggccagaggccccaccugcccccacaucuucguggccaccaacuuccugagccuggugcagcugcagcugcugccccagggcccccuggugcaguaccugaccauggagaccugcgaggacggcaacgaccugguguucuucuaccaggugagcgaccugaucagaagcggcaagcccaucaagcccgugaaggaccugcugaagaagaaccagauggagaacugccagacccugguggacaaguucaugaagcuggaccuggaggaccccaaccuggaccugaacguguucaugagccaggaggugcugcccgccgccaccagcauccuguaa

SEQ ID NO: 20075 - RNA, 4083 nt, Artificial Sequence
  MSH6__Homo_sapiens__NP_000170
augagcagacagagcacccuguacagcuucuuccccaagagccccgcccugagcgacgccaacaaggccagcgccagagccagcagagagggcggcagagccgccgccgcccccggcgccagccccagccccggcggcgacgccgccuggagcgaggccggccccggccccagaccccuggccagaagcgccagcccccccaaggccaagaaccugaacggcggccugagaagaagcguggcccccgccgcccccaccagcugcgacuucagccccggcgaccuggugugggccaagauggagggcuaccccugguggcccugccugguguacaaccaccccuucgacggcaccuucaucagagagaagggcaagagcgugagagugcacgugcaguucuucgacgacagccccaccagaggcugggugagcaagagacugcugaagcccuacaccggcagcaagagcaaggaggcccagaagggcggccacuucuacagcgccaagcccgagauccugagagccaugcagagagccgacgaggcccugaacaaggacaagaucaagagacuggagcuggccgugugcgacgagcccagcgagcccgaggaggaggaggagauggaggugggcaccaccuacgugaccgacaagagcgaggaggacaacgagaucgagagcgaggaggaggugcagcccaagacccagggcagcagaagaagcagcagacagaucaagaagagaagagugaucagcgacagcgagagcgacaucggcggcagcgacguggaguucaagcccgacaccaaggaggagggcagcagcgacgagaucagcagcggcgugggcgacagcgagagcgagggccugaacagccccgugaagguggccagaaagagaaagagaauggugaccggcaacggcagccugaagagaaagagcagcagaaaggagacccccagcgccaccaagcaggccaccagcaucagcagcgagaccaagaacacccugagagccuucagcgccccccagaacagcgagagccaggcccacgugagcggcggcggcgacgacagcagcagacccaccgugugguaccacgagacccuggaguggcugaaggaggagaagagaagagacgagcacagaagaagacccgaccaccccgacuucgacgccagcacccuguacgugcccgaggacuuccugaacagcugcacccccggcaugagaaagugguggcagaucaagagccagaacuucgaccuggugaucugcuacaaggugggcaaguucuacgagcuguaccacauggacgcccugaucggcgugagcgagcugggccugguguucaugaagggcaacugggcccacagcggcuuccccgagaucgccuucggcagauacagcgacagccuggugcagaagggcuacaagguggccagaguggagcagaccgagacccccgagaugauggaggccagaugcagaaagauggcccacaucagcaaguacgacagaguggugagaagagagaucugcagaaucaucaccaagggcacccagaccuacagcgugcuggagggcgaccccagcgagaacuacagcaaguaccugcugagccugaaggagaaggaggaggacagcagcggccacaccagagccuacggcgugugcuucguggacaccagccugggcaaguucuucaucggccaguucagcgacgacagacacugcagcagauucagaacccugguggcccacuacccccccgugcaggugcuguucgagaagggcaaccugagcaaggagaccaagaccauccugaagagcagccugagcugcagccugcaggagggccugauccccggcagccaguucugggacgccagcaagacccugagaacccugcuggaggaggaguacuucagagagaagcugagcgacggcaucggcgugaugcugccccaggugcugaagggcaugaccagcgagagcgacagcaucggccugacccccggcgagaagagcgagcuggcccugagcgcccugggcggcugcguguucuaccugaagaagugccugaucgaccaggagcugcugagcauggccaacuucgaggaguacaucccccuggacagcgacaccgugagcaccaccagaagcggcgccaucuucaccaaggccuaccagagaauggugcuggacgccgugacccugaacaaccuggagaucuuccugaacggcaccaacggcagcaccgagggcacccugcuggagagaguggacaccugccacacccccuucggcaagagacugcugaagcaguggcugugcgccccccugugcaaccacuacgccaucaacgacagacuggacgccaucgaggaccugaugguggugcccgacaagaucagcgaggugguggagcugcugaagaagcugcccgaccuggagagacugcugagcaagauccacaacgugggcagcccccugaagagccagaaccaccccgacagcagagccaucauguacgaggagaccaccuacagcaagaagaagaucaucgacuuccugagcgcccuggagggcuucaaggugaugugcaagaucaucggcaucauggaggagguggccgacggcuucaagagcaagauccugaagcaggugaucagccugcagaccaagaaccccgagggcagauuccccgaccugaccguggagcugaacagaugggacaccgccuucgaccacgagaaggccagaaagaccggccugaucacccccaaggccggcuucgacagcgacuacgaccaggcccuggccgacaucagagagaacgagcagagccugcuggaguaccuggagaagcagagaaacagaaucggcugcagaaccaucguguacuggggcaucggcagaaacagauaccagcuggagauccccgagaacuucaccaccagaaaccugcccgaggaguacgagcugaagagcaccaagaagggcugcaagagauacuggaccaagaccaucgagaagaagcuggccaaccugaucaacgccgaggagagaagagacgugagccugaaggacugcaugagaagacuguucuacaacuucgacaagaacuacaaggacuggcagagcgccguggagugcaucgccgugcuggacgugcugcugugccuggccaacuacagcagaggcggcgacggccccaugugcagacccgugauccugcugcccgaggacaccccccccuuccuggagcugaagggcagcagacaccccugcaucaccaagaccuucuucggcgacgacuucauccccaacgacauccugaucggcugcgaggaggaggagcaggagaacggcaaggccuacugcgugcuggugaccggccccaacaugggcggcaagagcacccugaugagacaggccggccugcuggccgugauggcccagaugggcugcuacgugcccgccgaggugugcagacugacccccaucgacagaguguucaccagacugggcgccagcgacagaaucaugagcggcgagagcaccuucuucguggagcugagcgagaccgccagcauccugaugcacgccaccgcccacagccuggugcugguggacgagcugggcagaggcaccgccaccuucgacggcaccgccaucgccaacgccguggugaaggagcuggccgagaccaucaagugcagaacccuguucagcacccacuaccacagccugguggaggacuacagccagaacguggccgugagacugggccacauggccugcaugguggagaacgagugcgaggaccccagccaggagaccaucaccuuccuguacaaguucaucaagggcgccugccccaagagcuacggcuucaacgccgccagacuggccaaccugcccgaggaggugauccagaagggccacagaaaggccagagaguucgagaagaugaaccagagccugagacuguucagagaggugugccuggccagcgagagaagcaccguggacgccgaggccgugcacaagcugcugacccugaucaaggagcuguaa

SEQ ID NO: 20076 - RNA, 1089 nt, Artificial Sequence
  MSI1__Homo_sapiens__NP_002433
auggagaccgacgccccccagcccggccuggccagccccgacagcccccacgaccccugcaagauguucaucggcggccugagcuggcagaccacccaggagggccugagagaguacuucggccaguucggcgaggugaaggagugccuggugaugagagacccccugaccaagagaagcagaggcuucggcuucgugaccuucauggaccaggccggcguggacaaggugcuggcccagagcagacacgagcuggacagcaagaccaucgaccccaagguggccuuccccagaagagcccagcccaagauggugaccagaaccaagaagaucuucgugggcggccugagcgugaacaccaccguggaggacgugaagcaguacuucgagcaguucggcaagguggacgacgccaugcugauguucgacaagaccaccaacagacacagaggcuucggcuucgugaccuucgagagcgaggacaucguggagaaggugugcgagauccacuuccacgagaucaacaacaagaugguggagugcaagaaggcccagcccaaggaggugaugagccccaccggcagcgccagaggcagaagcagagugaugcccuacggcauggacgccuucaugcugggcaucggcaugcugggcuaccccggcuuccaggccaccaccuacgccagcagaagcuacaccggccuggcccccggcuacaccuaccaguuccccgaguucagaguggagagaaccccccugcccagcgcccccgugcugcccgagcugaccgccaucccccugaccgccuacggccccauggccgccgccgccgccgccgccgccguggugagaggcaccggcagccaccccuggaccauggcccccccccccggcagcacccccagcagaaccggcggcuuccugggcaccaccagccccggccccauggccgagcuguacggcgccgccaaccaggacagcggcgugagcagcuacaucagcgccgccagccccgcccccagcaccggcuucggccacagccugggcggcccccugaucgccaccgccuucaccaacggcuaccacuaa

SEQ ID NO: 20077 - RNA, 987 nt, Artificial Sequence
  MSI2__Homo_sapiens__NP_620412
auggaggccaacggcagccagggcaccagcggcagcgccaacgacagccagcacgaccccggcaagauguucaucggcggccugagcuggcagaccagccccgacagccugagagacuacuucagcaaguucggcgagaucagagagugcauggugaugagagaccccaccaccaagagaagcagaggcuucggcuucgugaccuucgccgaccccgccagcguggacaaggugcugggccagccccaccacgagcuggacagcaagaccaucgaccccaagguggccuuccccagaagagcccagcccaagauggugaccagaaccaagaagaucuucgugggcggccugagcgccaacaccgugguggaggacgugaagcaguacuucgagcaguucggcaagguggaggacgccaugcugauguucgacaagaccaccaacagacacagaggcuucggcuucgugaccuucgagaacgaggacgugguggagaaggugugcgagauccacuuccacgagaucaacaacaagaugguggagugcaagaaggcccagcccaaggaggugauguucccccccggcaccagaggcagagccagaggccugcccuacaccauggacgccuucaugcugggcaugggcaugcugggcuaccccaacuucguggccaccuacggcagaggcuaccccggcuucgcccccagcuacggcuaccaguuccccggcuuccccgccgccgccuacggccccguggccgccgccgccguggccgccgccagaggcagcggcagcaaccccgccagacccggcggcuuccccggcgccaacagccccggccccguggccgaccuguacggccccgccagccaggacagcggcgugggcaacuacaucagcgccgccagcccccagcccggcagcggcuucggccacggcaucgccggcccccugaucgccaccgccuucaccaacggcuaccacuaa

SEQ ID NO: 20078 - RNA, 1866 nt, Artificial Sequence
  MSLN__Homo_sapiens__XP_005255091
auggcccugcccaccgccagaccccugcugggcagcugcggcacccccgcccugggcagccugcuguuccugcuguucagccugggcugggugcagcccagcagaacccuggccggcgagaccggccaggccgccccccuggacggcgugcuggccaacccccccaacaucagcagccugagccccagacagcugcugggcuuccccugcgccgaggugagcggccugagcaccgagagagugagagagcuggccguggcccuggcccagaagaacgugaagcugagcaccgagcagcugagaugccuggcccacagacugagcgagccccccgaggaccuggacgcccugccccuggaccugcugcuguuccugaaccccgacgccuucagcggcccccaggccugcaccagauucuucagcagaaucaccaaggccaacguggaccugcugcccagaggcgcccccgagagacagagacugcugcccgccgcccuggccugcuggggcgugagaggcagccugcugagcgaggccgacgugagagcccugggcggccuggccugcgaccugcccggcagauucguggccgagagcgccgaggugcugcugcccagacuggugagcugccccggcccccuggaccaggaccagcaggaggccgccagagccgcccugcagggcggcggcccccccuacggcccccccagcaccuggagcgugagcaccauggacgcccugagaggccugcugcccgugcugggccagcccaucaucagaagcaucccccagggcaucguggccgccuggagacagagaagcagcagagaccccagcuggagacagcccgagagaaccauccugagacccagauucagaagagagguggagaagaccgccugccccagcggcaagaaggccagagagaucgacgagagccugaucuucuacaagaagugggagcuggaggccugcguggacgccgcccugcuggccacccagauggacagagugaacgccauccccuucaccuacgagcagcuggacgugcugaagcacaagcuggacgagcuguacccccagggcuaccccgagagcgugauccagcaccugggcuaccuguuccugaagaugagccccgaggacaucagaaaguggaacgugaccagccuggagacccugaaggcccugcuggaggugaacaagggccacgagaugagcccccagguggccacccugaucgacagauucgugaagggcagaggccagcuggacaaggacacccuggacacccugaccgccuucuaccccggcuaccugugcagccugagccccgaggagcugagcagcgugccccccagcagcaucugggccgugagaccccaggaccuggacaccugcgaccccagacagcuggacgugcuguaccccaaggccagacuggccuuccagaacaugaacggcagcgaguacuucgugaagauccagagcuuccugggcggcgcccccaccgaggaccugaaggcccugagccagcagaacgugagcauggaccuggccaccuucaugaagcugagaaccgacgccgugcugccccugaccguggccgaggugcagaagcugcugggcccccacguggagggccugaaggccgaggagagacacagacccgugagagacuggauccugagacagagacaggacgaccuggacacccugggccugggccugcagggcggcauccccaacggcuaccuggugcuggaccugagcaugcaggaggcccugagcggcacccccugccugcugggccccggccccgugcugaccgugcuggcccugcugcuggccagcacccuggccuaa

SEQ ID NO: 20079 - RNA, 345 nt, Artificial Sequence
  MSMB__Homo_sapiens__NP_002434
augaacgugcugcugggcagcguggugaucuucgccaccuucgugacccugugcaacgccagcugcuacuucauccccaacgagggcgugcccggcgacagcaccagaaagugcauggaccugaagggcaacaagcaccccaucaacagcgaguggcagaccgacaacugcgagaccugcaccugcuacgagaccgagaucagcugcugcacccuggugagcacccccgugggcuacgacaaggacaacugccagagaaucuucaagaaggaggacugcaaguacaucgugguggagaagaaggaccccaagaagaccugcagcgugagcgaguggaucaucuaa

SEQ ID NO: 20080 - RNA, 489 nt, Artificial Sequence
  MSMO1__Homo_sapiens__NP_001017369
augcccagaugguacuuccugcuggccagaugcuucggcugcgccgugaucgaggacaccuggcacuacuuccugcacagacugcugcaccacaagagaaucuacaaguacauccacaaggugcaccacgaguuccaggcccccuucggcauggaggccgaguacgcccacccccuggagacccugauccugggcaccggcuucuucaucggcaucgugcugcugugcgaccacgugauccugcugugggccugggugaccaucagacugcuggagaccaucgacgugcacagcggcuacgacaucccccugaacccccugaaccugauccccuucuacgccggcagcagacaccacgacuuccaccacaugaacuucaucggcaacuacgccagcaccuucaccuggugggacagaaucuucggcaccgacagccaguacaacgccuacaacgagaagagaaagaaguucgagaagaagaccgaguaa

SEQ ID NO: 20081 - RNA, 420 nt, Artificial Sequence
  MSMP__Homo_sapiens__NP_001037729
auggcccugagaaugcugugggccggccaggccaagggcauccugggcggcuggggcaucaucugccuggugaugagccugcugcugcagcaccccggcguguacagcaagugcuacuuccaggcccaggcccccugccacuacgagggcaaguacuucacccugggcgagagcuggcugagaaaggacugcuuccacugcaccugccugcaccccgugggcgugggcugcugcgacaccagccagcaccccaucgacuuccccgccggcugcgaggugagacaggaggccggcaccugccaguucagccuggugcagaagagcgaccccagacugcccugcaagggcggcggccccgaccccgaguggggcagcgccaacacccccgugcccggcgcccccgccccccacagcagcuaa

SEQ ID NO: 20082 - RNA, 1734 nt, Artificial Sequence
  MSN__Homo_sapiens__NP_002435
augcccaagaccaucagcgugagagugaccaccauggacgccgagcuggaguucgccauccagcccaacaccaccggcaagcagcuguucgaccagguggugaagaccaucggccugagagaggugugguucuucggccugcaguaccaggacaccaagggcuucagcaccuggcugaagcugaacaagaaggugaccgcccaggacgugagaaaggagagcccccugcuguucaaguucagagccaaguucuaccccgaggacgugagcgaggagcugauccaggacaucacccagagacuguucuuccugcaggugaaggagggcauccugaacgacgacaucuacugcccccccgagaccgccgugcugcuggccagcuacgccgugcagagcaaguacggcgacuucaacaaggaggugcacaagagcggcuaccuggccggcgacaagcugcugccccagagagugcuggagcagcacaagcugaacaaggaccagugggaggagagaauccagguguggcacgaggagcacagaggcaugcugagagaggacgccgugcuggaguaccugaagaucgcccaggaccuggagauguacggcgugaacuacuucagcaucaagaacaagaagggcagcgagcuguggcugggcguggacgcccugggccugaacaucuacgagcagaacgacagacugacccccaagaucggcuuccccuggagcgagaucagaaacaucagcuucaacgacaagaaguucgugaucaagcccaucgacaagaaggcccccgacuucguguucuacgcccccagacugagaaucaacaagagaauccuggcccugugcaugggcaaccacgagcuguacaugagaagaagaaagcccgacaccaucgaggugcagcagaugaaggcccaggccagagaggagaagcaccagaagcagauggagagagccaugcuggagaacgagaagaagaagagagagauggccgagaaggagaaggagaagaucgagagagagaaggaggagcugauggagagacugaagcagaucgaggagcagaccaagaaggcccagcaggagcuggaggagcagaccagaagagcccuggagcuggagcaggagagaaagagagcccagagcgaggccgagaagcuggccaaggagagacaggaggccgaggaggccaaggaggcccugcugcaggccagcagagaccagaagaagacccaggagcagcuggcccuggagauggccgagcugaccgccagaaucagccagcuggagauggccagacagaagaaggagagcgaggccguggaguggcagcagaaggcccagauggugcaggaggaccuggagaagaccagagccgagcugaagaccgccaugagcaccccccacguggccgagcccgccgagaacgagcaggacgagcaggacgagaacggcgccgaggccagcgccgaccugagagccgacgccauggccaaggacagaagcgaggaggagagaaccaccgaggccgagaagaacgagagagugcagaagcaccugaaggcccugaccagcgagcuggccaacgccagagacgagagcaagaagaccgccaacgacaugauccacgccgagaacaugagacugggcagagacaaguacaagacccugagacagaucagacagggcaacaccaagcagagaaucgacgaguucgagagcauguaa

SEQ ID NO: 20083 - RNA, 1077 nt, Artificial Sequence
  MSR1__Homo_sapiens__NP_002436
auggagcagugggaccacuuccacaaccagcaggaggacaccgacagcugcagcgagagcgugaaguucgacgccagaagcaugaccgcccugcugccccccaaccccaagaacagccccagccugcaggagaagcugaagagcuucaaggccgcccugaucgcccuguaccugcugguguucgccgugcugaucccccugaucggcaucguggccgcccagcugcugaagugggagaccaagaacugcagcgugagcagcaccaacgccaacgacaucacccagagccugaccggcaagggcaacgacagcgaggaggagaugagauuccaggagguguucauggagcacaugagcaacauggagaagagaauccagcacauccuggacauggaggccaaccugauggacaccgagcacuuccagaacuucagcaugaccaccgaccagagauucaacgacauccugcugcagcugagcacccuguucagcagcgugcagggccacggcaacgccaucgacgagaucagcaagagccugaucagccugaacaccacccugcuggaccugcagcugaacaucgagaaccugaacggcaagauccaggagaacaccuucaagcagcaggaggagaucagcaagcuggaggagagaguguacaacgugagcgccgagaucauggccaugaaggaggagcaggugcaccuggagcaggagaucaagggcgaggugaaggugcugaacaacaucaccaacgaccugagacugaaggacugggagcacagccagacccugagaaacaucacccugauccagggcccccccggcccccccggcgagaagggcgacagaggccccaccggcgagagcggccccagaggcuuccccggccccaucggcccccccggccugaagggcgacagaggcgccaucggcuuccccggcagcagaggccugcccggcuacgccggcagacccggcaacagcggccccaagggccagaagggcgagaagggcagcggcaacacccugagacccgugcagcugaccgaccacaucagagccggccccagcuaa

SEQ ID NO: 20084 - RNA, 588 nt, Artificial Sequence
  MSRA__Homo_sapiens__NP_001129142
augcugagcgccaccagaagagccugccagcugcugcugcugcacagccuguuccccgugcccagaaugggcaacagcgccagcaacaucgugagcccccaggaggcccugcccggcagaaaggagcagacccccguggccgccaagcaccacgugaacggcaacagaaccguggagcccuuccccgagggcacccagauggccguguucgagaagaccggccacgccgagguggugagagugguguaccagcccgagcacaugagcuucgaggagcugcugaagguguucugggagaaccacgaccccacccagggcaugagacagggcaacgaccacggcacccaguacagaagcgccaucuaccccaccagcgccaagcagauggaggccgcccugagcagcaaggagaacuaccagaaggugcugagcgagcacggcuucggccccaucaccaccgacaucagagagggccagaccuucuacuacgccgaggacuaccaccagcaguaccugagcaagaaccccaacggcuacugcggccugggcggcaccggcgugagcugccccgugggcaucaagaaguaa

SEQ ID NO: 20085 - RNA, 549 nt, Artificial Sequence
  MSRB2__Homo_sapiens__NP_036360
auggccagacugcuguggcugcugagaggccugacccugggcaccgcccccagaagagccgugagaggccaggccggcggcggcggccccggcaccggccccggccugggcgaggccggcagccuggccaccugcgagcugccccuggccaagagcgaguggcagaagaagcugacccccgagcaguucuacgugaccagagagaagggcaccgagccccccuucagcggcaucuaccugaacaacaaggaggccggcauguaccacugcgugugcugcgacagcccccuguucagcagcgagaagaaguacugcagcggcaccggcuggcccagcuucagcgaggcccacggcaccagcggcagcgacgagagccacaccggcauccugagaagacuggacaccagccugggcagcgccagaaccgagguggugugcaagcagugcgaggcccaccugggccacguguuccccgacggccccggccccaacggccagagauucugcaucaacagcguggcccugaaguucaagcccagaaagcacuaa

SEQ ID NO: 20086 - RNA, 558 nt, Artificial Sequence
  MSRB3__Homo_sapiens__NP_001180390
augagcgccuucaaccugcugcaccuggugaccaagagccagcccguggcccugagagccugcggccugcccagcggcagcugcagagacaagaagaacugcaaggugguguucagccagcaggagcugagaaagagacugaccccccugcaguaccacgugacccaggagaagggcaccgagagcgccuucgagggcgaguacacccaccacaaggaccccggcaucuacaagugcguggugugcggcaccccccuguucaagagcgagaccaaguucgacagcggcagcggcuggcccagcuuccacgacgugaucaacagcgaggccaucaccuucaccgacgacuucagcuacggcaugcacagaguggagaccagcugcagccagugcggcgcccaccugggccacaucuucgacgacggccccagacccaccggcaagagauacugcaucaacagcgccgcccugagcuucacccccgccgacagcagcggcaccgccgagggcggcagcggcguggccagccccgcccaggccgacaaggccgagcuguaa

SEQ ID NO: 20087 - RNA, 2178 nt, Artificial Sequence
  MST1__Homo_sapiens__NP_066278
augggccuguggugggugaccgugcagccccccgccagaagaaugggcuggcugccccugcugcugcugcugacccagugccugggcgugcccggccagagaagcccccugaacgacuuccaggugcugagaggcaccgagcugcagcaccugcugcacgccguggugcccggccccuggcaggaggacguggccgacgccgaggagugcgccggcagaugcggcccccugauggacugcagagccuuccacuacaacgugagcagccacggcugccagcugcugcccuggacccagcacagcccccacaccagacugagaagaagcggcagaugcgaccuguuccagaagaaggacuacgugagaaccugcaucaugaacaacggcgugggcuacagaggcaccauggccaccaccgugggcggccugcccugccaggccuggagccacaaguuccccaacgaccacaaguacacccccacccugagaaacggccuggaggagaacuucugcagaaaccccgacggcgaccccggcggccccuggugcuacaccaccgaccccgccgugagauuccagagcugcggcaucaagagcugcagagaggccgccugcguguggugcaacggcgaggaguacagaggcgccguggacagaaccgagagcggcagagagugccagagaugggaccugcagcacccccaccagcaccccuucgagcccggcaaguuccuggaccagggccuggacgacaacuacugcagaaaccccgacggcagcgagagacccuggugcuacaccaccgacccccagaucgagagagaguucugcgaccugcccagaugcggcagcgaggcccagcccagacaggaggccaccaccgugagcugcuucagaggcaagggcgagggcuacagaggcaccgccaacaccaccaccgccggcgugcccugccagagaugggacgcccagaucccccaccagcacagauucacccccgagaaguacgccugcaaggaccugagagagaacuucugcagaaaccccgacggcagcgaggcccccuggugcuucacccugagacccggcaugagagccgccuucugcuaccagaucagaagaugcaccgacgacgugagaccccaggacugcuaccacggcgccggcgagcaguacagaggcaccgugagcaagaccagaaagggcgugcagugccagagauggagcgccgagaccccccacaagccccaguucaccuucaccagcgagccccacgcccagcuggaggagaacuucugcagaaaccccgacggcgacagccacggccccuggugcuacaccauggaccccagaacccccuucgacuacugcgcccugagaagaugcgccgacgaccagccccccagcauccuggacccccccgaccaggugcaguucgagaagugcggcaagagaguggacagacuggaccagagaagaagcaagcugagaguggugggcggccaccccggcaacagccccuggaccgugagccugagaaacagacagggccagcacuucugcggcggcagccuggugaaggagcaguggauccugaccgccagacagugcuucagcagcugccacaugccccugaccggcuacgagguguggcugggcacccuguuccagaacccccagcacggcgagcccagccugcagagagugcccguggccaagauggugugcggccccagcggcagccagcuggugcugcugaagcuggagagaagcgugacccugaaccagagaguggcccugaucugccugccccccgagugguacguggugccccccggcaccaagugcgagaucgccggcuggggcgagaccaagggcaccggcaacgacaccgugcugaacguggcccugcugaacgugaucagcaaccaggagugcaacaucaagcacagaggcagagugagagagagcgagaugugcaccgagggccugcuggcccccgugggcgccugcgagggcgacuacggcggcccccuggccugcuucacccacaacugcugggugcuggagggcaucaucauccccaacagagugugcgccagaagcagauggcccgccguguucaccagagugagcguguucguggacuggauccacaaggugaugagacugggcuaa

SEQ ID NO: 20088 - RNA, 4056 nt, Artificial Sequence
  MST1R__Homo_sapiens__NP_001231866
auggagcugcugcccccccugccccagagcuuccugcugcugcugcugcugcccgccaagcccgccgccggcgaggacuggcagugccccagaacccccuacgccgccagcagagacuucgacgugaaguacguggugcccagcuucagcgccggcggccuggugcaggccauggugaccuacgagggcgacagaaacgagagcgccguguucguggccaucagaaacagacugcacgugcugggccccgaccugaagagcgugcagagccuggccaccggccccgccggcgaccccggcugccagaccugcgccgccugcggccccggcccccacggcccccccggcgacaccgacaccaaggugcuggugcuggaccccgcccugcccgcccuggugagcugcggcagcagccugcagggcagaugcuuccugcacgaccuggagccccagggcaccgccgugcaccuggccgcccccgccugccuguucagcgcccaccacaacagacccgacgacugccccgacugcguggccagcccccugggcaccagagugaccgugguggagcagggccaggccagcuacuucuacguggccagcagccuggacgccgccguggccgccagcuucagccccagaagcgugagcaucagaagacugaaggccgacgccagcggcuucgcccccggcuucguggcccugagcgugcugcccaagcaccuggugagcuacagcaucgaguacgugcacagcuuccacaccggcgccuucguguacuuccugaccgugcagcccgccagcgugaccgacgaccccagcgcccugcacaccagacuggccagacugagcgccaccgagcccgagcugggcgacuacagagagcuggugcuggacugcagauucgcccccaagagaagaagaagaggcgcccccgagggcggccagcccuaccccgugcugagaguggcccacagcgcccccgugggcgcccagcuggccaccgagcugagcaucgccgagggccaggaggugcuguucggcguguucgugaccggcaaggacggcggccccggcgugggccccaacagcguggugugcgccuuccccaucgaccugcuggacacccugaucgacgagggcguggagagaugcugcgagagccccgugcaccccggccugagaagaggccuggacuucuuccagagccccagcuucugccccaacccccccggccuggaggcccugagccccaacaccagcugcagacacuucccccugcuggugagcagcagcuucagcagaguggaccuguucaacggccugcugggccccgugcaggugaccgcccuguacgugaccagacuggacaacgugaccguggcccacaugggcaccauggacggcagaauccugcagguggagcuggugagaagccugaacuaccugcuguacgugagcaacuucagccugggcgacagcggccagcccgugcagagagacgugagcagacugggcgaccaccugcuguucgccagcggcgaccagguguuccaggugcccauccagggccccggcugcagacacuuccugaccugcggcagaugccugagagccuggcacuucaugggcugcggcuggugcggcaacaugugcggccagcagaaggagugccccggcagcuggcagcaggaccacugcccccccaagcugaccgaguuccacccccacagcggcccccugagaggcagcaccagacugacccugugcggcagcaacuucuaccugcaccccagcggccuggugcccgagggcacccaccaggugaccgugggccagagccccugcagaccccugcccaaggacagcagcaagcugagacccgugcccagaaaggacuucguggaggaguucgagugcgagcuggagccccugggcacccaggccgugggccccaccaacgugagccugaccgugaccaacaugccccccggcaagcacuucagaguggacggcaccagcgugcugagaggcuucagcuucauggagcccgugcugaucgccgugcagccccuguucggccccagagccggcggcaccugccugacccuggagggccagagccugagcgugggcaccagcagagccgugcuggugaacggcaccgagugccugcuggccagagugagcgagggccagcugcugugcgccaccccccccggcgccaccguggccagcgugccccugagccugcaggugggcggcgcccaggugcccggcagcuggaccuuccaguacagagaggaccccguggugcugagcaucagccccaacugcggcuacaucaacagccacaucaccaucugcggccagcaccugaccagcgccuggcaccuggugcugagcuuccacgacggccugagagccguggagagcagaugcgagagacagcugcccgagcagcagcugugcagacugcccgaguacguggugagagacccccagggcuggguggccggcaaccugagcgccagaggcgacggcgccgccggcuucacccugcccggcuucagauuccugccccccccccacccccccagcgccaaccuggugccccugaagcccgaggagcacgccaucaaguucgaggugugcguggacggcgagugccacauccugggcagaguggugagacccggccccgacggcgugccccagagcacccugcugggcauccugcugccccugcugcugcugguggccgcccuggccaccgcccugguguucagcuacugguggagaagaaagcagcuggugcugccccccaaccugaacgaccuggccagccuggaccagaccgccggcgccaccccccugcccauccuguacagcggcagcgacuacagaagcggccuggcccugcccgccaucgacggccuggacagcaccaccugcgugcacggcgccagcuucagcgacagcgaggacgagagcugcgugccccugcugagaaaggagagcauccagcugagagaccuggacagcgcccugcuggccgaggugaaggacgugcugaucccccacgagagaguggugacccacagcgacagagugaucggcaagggccacuucggcgugguguaccacggcgaguacaucgaccaggcccagaacagaauccagugcgccaucaagagccugagcagaaucaccgagaugcagcagguggaggccuuccugagagagggccugcugaugagaggccugaaccaccccaacgugcuggcccugaucggcaucaugcugccccccgagggccugccccacgugcugcugcccuacaugugccacggcgaccugcugcaguucaucagaagcccccagagaaaccccaccgugaaggaccugaucagcuucggccugcagguggccagaggcauggaguaccuggccgagcagaaguucgugcacagagaccuggccgccagaaacugcaugcuggacgagagcuucaccgugaagguggccgacuucggccuggccagagacauccuggacagagaguacuacagcgugcagcagcacagacacgccagacugcccgugaaguggauggcccuggagagccugcagaccuacagauucaccaccaagagcgacguguggagcuucggcgugcugcugugggagcugcugaccagaggcgccccccccuacagacacaucgaccccuucgaccugacccacuuccuggcccagggcagaagacugccccagcccgaguacugccccgacagccuguaccaggugaugcagcagugcugggaggccgaccccgccgugagacccaccuucagagugcuggugggcgagguggagcagaucgugagcgcccugcugggcgaccacuacgugcagcugcccgccaccuacaugaaccugggccccagcaccagccacgagaugaacgugagacccgagcagccccaguucagccccaugcccggcaacgugagaagacccagaccccugagcgagccccccagacccaccuaa

SEQ ID NO: 20089 - RNA, 1128 nt, Artificial Sequence
  MSTN__Homo_sapiens__NP_005250
augcagaagcugcagcugugcguguacaucuaccuguucaugcugaucguggccggccccguggaccugaacgagaacagcgagcagaaggagaacguggagaaggagggccugugcaacgccugcaccuggagacagaacaccaagagcagcagaaucgaggccaucaagauccagauccugagcaagcugagacuggagaccgcccccaacaucagcaaggacgugaucagacagcugcugcccaaggcccccccccugagagagcugaucgaccaguacgacgugcagagagacgacagcagcgacggcagccuggaggacgacgacuaccacgccaccaccgagaccaucaucaccaugcccaccgagagcgacuuccugaugcagguggacggcaagcccaagugcugcuucuucaaguucagcagcaagauccaguacaacaagguggugaaggcccagcuguggaucuaccugagacccguggagacccccaccaccguguucgugcagauccugagacugaucaagcccaugaaggacggcaccagauacaccggcaucagaagccugaagcuggacaugaaccccggcaccggcaucuggcagagcaucgacgugaagaccgugcugcagaacuggcugaagcagcccgagagcaaccugggcaucgagaucaaggcccuggacgagaacggccacgaccuggccgugaccuuccccggccccggcgaggacggccugaaccccuuccuggaggugaaggugaccgacacccccaagagaagcagaagagacuucggccuggacugcgacgagcacagcaccgagagcagaugcugcagauacccccugaccguggacuucgaggccuucggcugggacuggaucaucgcccccaagagauacaaggccaacuacugcagcggcgagugcgaguucguguuccugcagaaguacccccacacccaccuggugcaccaggccaaccccagaggcagcgccggccccugcugcacccccaccaagaugagccccaucaacaugcuguacuucaacggcaaggagcagaucaucuacggcaagauccccgccauggugguggacagaugcggcugcagcuaa

SEQ ID NO: 20090 - RNA, 1677 nt, Artificial Sequence
  MSTO1__Homo_sapiens__NP_001243462
auggccggcggcgccagagaggugcugacccugcagcugggccacuucgccggcuucgugggcgcccacugguggaaccagcaggacgccgcccugggcagagccaccgacagcaaggagccccccggcgagcugugccccgacgugcuguacagaaccggcagaacccugcacggccaggagaccuacacccccagacugauccugauggaccugaagggcagccugagcagccugaaggaggagggcggccuguacagagacaagcagcuggacgccgccaucgccuggcagggcaagcugaccacccacaaggaggagcuguaccccaagaaccccuaccugcaggacuuccugagcgccgagggcgugcugagcagcgacggcguguggagagugaagagcauccccaacggcaagggcagcagcccccugcccaccgccaccacccccaagccccugauccccaccgaggccagcaucagaguguggagcgacuuccugagagugcaccugcaccccagaagcaucugcaugauccagaaguacaaccacgacggcgaggccggcagacuggaggccuucggccagggcgagagcgugcugaaggagcccaaguaccaggaggagcuggaggacagacugcacuucuacguggaggagugcgacuaccugcagggcuuccagauccugugcgaccugcacgacggcuucagcggcgugggcgccaaggccgccgagcugcugcaggacgaguacagcggcagaggcaucaucaccuggggccugcugcccggccccuaccacagaggcgaggcccagagaaacaucuacagacugcugaacaccgccuucggccuggugcaccugaccgcccacagcagccuggugugcccccugagccugggcggcagccugggccugagacccgagccccccgugagcuuccccuaccugcacuacgacgccacccugcccuuccacugcagcgccauccuggccaccgcccuggacaccgugaccgugcccuacagacugugcagcagccccgugagcauggugcaccuggccgacaugcugagcuucugcggcaagaagguggugaccgccggcgccaucauccccuucccccuggcccccggccagagccugcccgacagccugaugcaguucggcggcgccacccccuggaccccccugagcgccugcggcgagcccagcggcaccagaugcuucgcccagagcguggugcugagaggcaucgacagagccugccacaccagccagcugacccccggcacccccccccccagcgcccugcacgccugcaccaccggcgaggagauccuggcccaguaccugcagcagcagcagcccggcgugaugagcagcagccaccugcugcugacccccugcagaguggccccccccuacccccaccuguucagcagcugcagcccccccguggagagcauccccguguucggcgcccugugcagcagcagcagccugcaccagacccuggaggcccuggccagagaccugaccaagcuggaccugagaagaugggccagcuucauggacgccggcguggagcacgacgacguggccgagcugcugcaggagcugcagagccuggcccagugcuaccagggcggcgacagccugguggacuaa

SEQ ID NO: 20091 - RNA, 912 nt, Artificial Sequence
  MSX1__Homo_sapiens__NP_002439
auggcccccgccgccgacaugaccagccugccccugggcgugaagguggaggacagcgccuucggcaagcccgccggcggcggcgccggccaggcccccagcgccgccgccgccaccgccgccgccaugggcgccgacgaggagggcgccaagcccaaggugagccccagccugcugcccuucagcguggaggcccugauggccgaccacagaaagcccggcgccaaggagagcgcccuggcccccagcgagggcgugcaggccgccggcggcagcgcccagccccugggcgugccccccggcagccugggcgcccccgacgcccccagcagccccagaccccugggccacuucagcgugggcggccugcugaagcugcccgaggacgcccuggugaaggccgagagccccgagaagcccgagagaacccccuggaugcagagccccagauucagccccccccccgccagaagacugagcccccccgccugcacccugagaaagcacaagaccaacagaaagcccagaacccccuucaccaccgcccagcugcuggcccuggagagaaaguucagacagaagcaguaccugagcaucgccgagagagccgaguucagcagcagccugagccugaccgagacccaggugaagaucugguuccagaacagaagagccaaggccaagagacugcaggaggccgagcuggagaagcugaagauggccgccaagcccaugcugccccccgccgccuucggccugagcuucccccugggcggccccgccgccguggccgccgccgccggcgccagccuguacggcgccagcggccccuuccagagagccgcccugcccguggcccccgugggccuguacaccgcccacgugggcuacagcauguaccaccugaccuaa

SEQ ID NO: 20092 - RNA, 804 nt, Artificial Sequence
  MSX2__Homo_sapiens__NP_002440
auggccagccccagcaagggcaacgaccuguucagccccgacgaggagggccccgccgugguggccggccccggccccggccccggcggcgccgagggcgccgccgaggagagaagagugaaggugagcagccugcccuucagcguggaggcccugaugagcgacaagaagccccccaaggaggccagcccccugcccgccgagagcgccagcgccggcgccacccugagaccccugcugcugagcggccacggcgccagagaggcccacagccccggcccccuggugaagcccuucgagaccgccagcgugaagagcgagaacagcgaggacggcgccgccuggaugcaggagcccggcagauacagccccccccccagacacaugagccccaccaccugcacccugagaaagcacaagaccaacagaaagcccagaacccccuucaccaccagccagcugcuggcccuggagagaaaguucagacagaagcaguaccugagcaucgccgagagagccgaguucagcagcagccugaaccugaccgagacccaggugaagaucugguuccagaacagaagagccaaggccaagagacugcaggaggccgagcuggagaagcugaagauggccgccaagcccaugcugcccagcagcuucagccugcccuuccccaucagcagcccccugcaggccgccagcaucuacggcgccagcuaccccuuccacagacccgugcugcccaucccccccgugggccuguacgccacccccgugggcuacggcauguaccaccugagcuaa

SEQ ID NO: 20093 - RNA, 186 nt, Artificial Sequence
  MT1A__Homo_sapiens__NP_005937
auggaccccaacugcagcugcgccaccggcggcagcugcaccugcaccggcagcugcaagugcaaggagugcaagugcaccagcugcaagaagagcugcugcagcugcugccccaugagcugcgccaagugcgcccagggcugcaucugcaagggcgccagcgagaagugcagcugcugcgccuaa

SEQ ID NO: 20094 - RNA, 186 nt, Artificial Sequence
  MT1B__Homo_sapiens__NP_005938
auggaccccaacugcagcugcaccaccggcggcagcugcgccugcgccggcagcugcaagugcaaggagugcaagugcaccagcugcaagaagugcugcugcagcugcugccccgugggcugcgccaagugcgcccagggcugcgugugcaagggcagcagcgagaagugcagaugcugcgccuaa

SEQ ID NO: 20095 - RNA, 186 nt, Artificial Sequence
  MT1E__Homo_sapiens__NP_783316
auggaccccaacugcagcugcgccaccggcggcagcugcaccugcgccggcagcugcaagugcaaggagugcaagugcaccagcugcaagaagagcugcugcagcugcugccccgugggcugcgccaagugcgcccagggcugcgugugcaagggcgccagcgagaagugcagcugcugcgccuaa

SEQ ID NO: 20096 - RNA, 186 nt, Artificial Sequence
  MT1F__Homo_sapiens__NP_005940
auggaccccaacugcagcugcgccgccggcgugagcugcaccugcgccggcagcugcaagugcaaggagugcaagugcaccagcugcaagaagagcugcugcagcugcugccccgugggcugcagcaagugcgcccagggcugcgugugcaagggcgccagcgagaagugcagcugcugcgacuaa

SEQ ID NO: 20097 - RNA, 189 nt, Artificial Sequence
  MT1G__Homo_sapiens__NP_001288196
auggaccccaacugcagcugcgccgccgccggcgugagcugcaccugcgccagcagcugcaagugcaaggagugcaagugcaccagcugcaagaagagcugcugcagcugcugccccgugggcugcgccaagugcgcccagggcugcaucugcaagggcgccagcgagaagugcagcugcugcgccuaa

SEQ ID NO: 20098 - RNA, 186 nt, Artificial Sequence
  MT1H__Homo_sapiens__NP_005942
auggaccccaacugcagcugcgaggccggcggcagcugcgccugcgccggcagcugcaagugcaagaagugcaagugcaccagcugcaagaagagcugcugcagcugcugcccccugggcugcgccaagugcgcccagggcugcaucugcaagggcgccagcgagaagugcagcugcugcgccuaa

SEQ ID NO: 20099 - RNA, 186 nt, Artificial Sequence
  MT1M__Homo_sapiens__NP_789846
auggaccccaacugcagcugcaccaccggcgugagcugcgccugcaccggcagcugcaagugcaaggagugcaagugcaccagcugcaagaagagcugcugcagcugcugccccgugggcugcgccaagugcgcccacggcugcgugugcaagggcacccuggagaacugcagcugcugcgccuaa

SEQ ID NO: 20100 - RNA, 186 nt, Artificial Sequence
  MT1X__Homo_sapiens__NP_005943
auggaccccaacugcagcugcagccccgugggcagcugcgccugcgccggcagcugcaagugcaaggagugcaagugcaccagcugcaagaagagcugcugcagcugcugccccgugggcugcgccaagugcgcccagggcugcaucugcaagggcaccagcgacaagugcagcugcugcgccuaa

SEQ ID NO: 20101 - RNA, 186 nt, Artificial Sequence
  MT2A__Homo_sapiens__NP_005944
auggaccccaacugcagcugcgccgccggcgacagcugcaccugcgccggcagcugcaagugcaaggagugcaagugcaccagcugcaagaagagcugcugcagcugcugccccgugggcugcgccaagugcgcccagggcugcaucugcaagggcgccagcgacaagugcagcugcugcgccuaa

SEQ ID NO: 20102 - RNA, 207 nt, Artificial Sequence
  MT3__Homo_sapiens__NP_005945
auggaccccgagaccugccccugccccagcggcggcagcugcaccugcgccgacagcugcaagugcgagggcugcaagugcaccagcugcaagaagagcugcugcagcugcugccccgccgagugcgagaagugcgccaaggacugcgugugcaagggcggcgaggccgccgaggccgaggccgagaagugcagcugcugccaguaa

SEQ ID NO: 20103 - RNA, 189 nt, Artificial Sequence
  MT4__Homo_sapiens__NP_116324
auggaccccagagagugcgugugcaugagcggcggcaucugcaugugcggcgacaacugcaagugcaccaccugcaacugcaagaccugcagaaagagcugcugccccugcugcccccccggcugcgccaagugcgccagaggcugcaucugcaagggcggcagcgacaagugcagcugcugccccuaa

SEQ ID NO: 20104 - RNA, 1293 nt, Artificial Sequence
  MTA1__Homo_sapiens__NP_001190187
auggccgccaacauguacagagugggcgacuacguguacuucgagaacagcagcagcaaccccuaccugaucagaagaaucgaggagcugaacaagaccgccaacggcaacguggaggccaagguggugugcuucuacagaagaagagacaucagcagcacccugaucgcccuggccgacaagcacgccacccugagcgugugcuacaaggccggccccggcgccgacaacggcgaggagggcgagaucgaggaggagauggagaaccccgagaugguggaccugcccgagaagcugaagcaccagcugagacacagagagcuguuccugagcagacagcuggagagccugcccgccacccacaucagaggcaagugcagcgugacccugcugaacgagaccgagagccugaagagcuaccuggagagagaggacuucuucuucuacagccugguguacgacccccagcagaagacccugcuggccgacaagggcgagaucagagugggcaacagauaccaggccgacaucaccgaccugcugaaggagggcgaggaggacggcagagaccagagcagacuggagacccaggugugggaggcccacaacccccugaccgacaagcagaucgaccaguuccuggugguggccagaagcgugggcaccuucgccagagcccuggacugcagcagcagcgugagacagcccagccugcacaugagcgccgccgccgccagcagagacaucacccuguuccacgccauggacacccugcacaagaacaucuacgacaucagcaaggccaucagcgcccuggugccccagggcggccccgugcugugcagagacgagauggaggaguggagcgccagcgaggccaaccuguucgaggaggcccuggagaaguacggcaaggacuucaccgacauccagcaggacuuccugcccuggaagagccugaccagcaucaucgaguacuacuacauguggaagaccaccgacagauacgugcagcagaagagacugaaggccgccgaggccgagagcaagcugaagcagguguacauccccaacuacaacaagcccaaccccaaccagaucagcgugaacaacgugaaggccggcguggugaacggcaccggcgcccccggccagagccccggcgccggcagagccugcgagagcugcuacaugagcagccugagaauccugcuggacauccuggaggagaucugguggcuggagaacgccaaccccgugagauggagagaggccagaaccaagccccaguaa

SEQ ID NO: 20105 - RNA, 2007 nt, Artificial Sequence
  MTA2__Homo_sapiens__NP_004730
auggccgccaacauguacagagugggcgacuacguguacuucgagaacagcagcagcaaccccuaccuggugagaagaaucgaggagcugaacaagaccgccaacggcaacguggaggccaagguggugugccuguucagaagaagagacaucagcagcagccugaacagccuggccgacagcaacgccagagaguucgaggaggagagcaagcagcccggcgugagcgagcagcagagacaccagcugaagcacagagagcuguuccugagcagacaguucgagagccugcccgccacccacaucagaggcaagugcagcgugacccugcugaacgagaccgacauccugagccaguaccuggagaaggaggacugcuucuucuacagccugguguucgaccccgugcagaagacccugcuggccgaccagggcgagaucagagugggcugcaaguaccaggccgagauccccgacagacugguggagggcgagagcgacaacagaaaccagcagaagauggagaugaaggugugggaccccgacaacccccugaccgacagacagaucgaccaguuccuggugguggccagagccgugggcaccuucgccagagcccuggacugcagcagcagcaucagacagcccagccugcacaugagcgccgccgccgccagcagagacaucacccuguuccacgccauggacacccugcagagaaacggcuacgaccuggccaaggccaugagcacccuggugccccagggcggccccgugcugugcagagacgagauggaggaguggagcgccagcgaggccaugcuguucgaggaggcccuggagaaguacggcaaggacuucaacgacaucagacaggacuuccugcccuggaagagccuggccagcaucgugcaguucuacuacauguggaagaccaccgacagauacauccagcagaagagacugaaggccgccgaggccgacagcaagcugaagcagguguacauccccaccuacaccaagcccaaccccaaccagaucaucagcgugggcagcaagcccggcaugaacggcgccggcuuccagaagggccugaccugcgagagcugccacaccacccagagcgcccagugguacgccuggggcccccccaacaugcagugcagacugugcgccagcugcuggaucuacuggaagaaguacggcggccugaagacccccacccagcuggagggcgccaccagaggcaccaccgagccccacagcagaggccaccugagcagacccgaggcccagagccugagccccuacaccaccagcgccaacagagccaagcugcuggccaagaacagacagaccuuccugcugcagaccaccaagcugaccagacuggccagaagaaugugcagagaccugcugcagcccagaagagccgccagaagacccuacgcccccaucaacgccaacgccaucaaggccgagugcagcaucagacugcccaaggccgccaagaccccccugaagauccacccccuggugagacugccccuggccaccaucgugaaggaccugguggcccaggccccccugaagcccaagacccccagaggcaccaagacccccaucaacagaaaccagcugagccagaacagaggccugggcggcaucauggugaagagagccuacgagaccauggccggcgccggcgugcccuucagcgccaacggcagaccccuggccagcggcaucagaagcagcagccagcccgccgccaagagacagaagcugaaccccgccgacgcccccaaccccgugguguucguggccaccaaggacaccagagcccugagaaaggcccugacccaccuggagaugagaagagccgccagaagacccaaccugccccugaaggugaagcccacccugaucgccgugagaccccccgugccccugcccgcccccagccaccccgccagcaccaacgagcccaucgugcuggaggacuaa

SEQ ID NO: 20106 - RNA, 1548 nt, Artificial Sequence
  MTA3__Homo_sapiens__NP_065795
auggccgccaacauguacagagugggcgacuacguguacuucgagaacagcagcagcaaccccuaccugaucagaagaaucgaggagcugaacaagaccgccagcggcaacguggaggccaagguggugugcuucuacagaagaagagacaucagcaacacccugaucaugcuggccgacaagcacgccaaggagaucgaggaggagagcgagaccaccguggaggccgaccugaccgacaagcagaagcaccagcugaagcacagagagcuguuccugagcagacaguacgagagccugcccgccacccacaucagaggcaagugcagcguggcccugcugaacgagaccgagagcgugcugagcuaccuggacaaggaggacaccuucuucuacagccugguguacgaccccagccugaagacccugcuggccgacaagggcgagaucagagugggccccagauaccaggccgacauccccgagaugcugcuggagggcgagagcgacgagagagagcagagcaagcuggaggugaaggugugggaccccaacagcccccugaccgacagacagaucgaccaguuccuggugguggccagagccgugggcaccuucgccagagcccuggacugcagcagcagcgugagacagcccagccugcacaugagcgccgccgccgccagcagagacaucacccuguuccacgccauggacacccuguacagacacagcuacgaccugagcagcgccaucagcgugcuggugccccugggcggccccgugcugugcagagacgagauggaggaguggagcgccagcgaggccagccuguucgaggaggcccuggagaaguacggcaaggacuucaacgacaucagacaggacuuccugcccuggaagagccugaccagcaucaucgaguacuacuacauguggaagaccaccgacagauacgugcagcagaagagacugaaggccgccgaggccgagagcaagcugaagcagguguacauccccaccuacagcaagcccaaccccaaccagaucagcaccagcaacggcaagcccggcgccgugaacggcgccgugggcaccaccuuccagccccagaacccccugcugggcagagccugcgagagcugcuacgccacccagagccaccagugguacagcuggggcccccccaacaugcagugcagacugugcgccaucugcuggcuguacuggaagaaguacggcggccugaagaugcccacccagagcgaggaggagaagcugagccccagccccaccaccgaggaccccagagugagaagccacgugagcagacaggccaugcagggcaugcccgugagaaacaccggcagccccaagagcgccgugaagaccagacaggccuucuuccugcacaccaccuacuucaccaaguucgccagacaggugugcaagaacacccugagacugagacaggccgccagaagacccuucguggccaucaacuacgccgccaucagagccgagugcaagaugcugcugaacagcuaa

SEQ ID NO: 20107 - RNA, 852 nt, Artificial Sequence
  MTAP__Homo_sapiens__NP_002442
auggccagcggcaccaccaccaccgccgugaagaucggcaucaucggcggcaccggccuggacgaccccgagauccuggagggcagaaccgagaaguacguggacacccccuucggcaagcccagcgacgcccugauccugggcaagaucaagaacguggacugcgugcugcuggccagacacggcagacagcacaccaucaugcccagcaaggugaacuaccaggccaacaucugggcccugaaggaggagggcugcacccacgugaucgugaccaccgccugcggcagccugagagaggagauccagcccggcgacaucgugaucaucgaccaguucaucgacagaaccaccaugagaccccagagcuucuacgacggcagccacagcugcgccagaggcgugugccacauccccauggccgagcccuucugccccaagaccagagaggugcugaucgagaccgccaagaagcugggccugagaugccacagcaagggcaccauggugaccaucgagggccccagauucagcagcagagccgagagcuucauguucagaaccuggggcgccgacgugaucaacaugaccaccgugcccgagguggugcuggccaaggaggccggcaucugcuacgccagcaucgccauggccaccgacuacgacugcuggaaggagcacgaggaggccgugagcguggacagagugcugaagacccugaaggagaacgccaacaaggccaagagccugcugcugaccaccaucccccagaucggcagcaccgaguggagcgagacccugcacaaccugaagaacauggcccaguucagcgugcugcugcccagacacuaa

SEQ ID NO: 20108 - RNA, 2715 nt, Artificial Sequence
  MTBP__Homo_sapiens__NP_071328
auggacagauaccugcugcuggugaucuggggcgagggcaaguuccccagcgccgccagcagagaggccgagcacggccccgaggugagcagcggcgagggcaccgagaaccagcccgacuucaccgccgccaacguguaccaccugcugaagagaagcaucagcgccagcaucaaccccgaggacagcaccuuccccgccugcagcgugggcggcauccccggcagcaagaagugguucuucgccgugcaggccaucuacggcuucuaccaguucugcagcagcgacuggcaggagauccacuucgacaccgagaaggacaagaucgaggacgugcugcagaccaacaucgaggagugccugggcgccguggagugcuucgaggaggaggacagcaacagcagagagagccugagccuggccgaccuguacgaggaggccgccgagaaccugcaccagcugagcgacaagcugcccgcccccggcagagccaugguggacaucauccugcugcugagcgacaaggacccccccaagcugaaggacuaccugcccaccgugggcgcccugaagcaccugagagagugguacagcgccaagaucaccaucgccggcaaccacugcgagaucaacugccagaagaucgccgaguaccugagcgccaacguggugagccuggaggaccugagaaacgugaucgacagcaaggagcuguggagaggcaagauccagaucugggagagaaaguucggcuucgagaucagcuuccccgaguucugccugaagggcgugacccugaagaacuucagcaccagcaaccugaacaccgacuuccuggccaagaagaucauccccagcaaggacaagaacauccugcccaagguguuccacuacuacggccccgcccuggaguucgugcagaugaucaagcugagcgaccugcccagcugcuacaugagcgacaucgaguucgagcugggccugaccaacagcaccaagcagaacagcgugcugcugcuggagcagaucagcagccugugcagcaaggugggcgcccuguucgugcugcccugcaccaucagcaacauccugauccccccccccaaccagcugagcagcagaaaguggaaggaguacaucgccaagaagcccaagaccaucagcgugcccgacguggaggugaagggcgagugcagcagcuacuaccugcugcugcagggcaacggcaacagaagaugcaaggccacccugauccacagcgccaaccagaucaacggcagcuucgcccugaaccugauccacggcaagaugaagaccaagaccgaggaggccaagcugagcuuccccuucgaccugcugagccugccccacuucagcggcgagcagaucgugcagagagagaagcagcuggccaacgugcaggugcuggcccuggaggagugccugaagagaagaaagcuggccaagcagcccgagaccgugagcguggccgagcugaagagccugcuggugcugaccagaaagcacuuccuggacuacuucgacgccgugauccccaagaugauccugagaaagauggacaagaucaagaccuucaacauccugaacgacuucagccccguggagcccaacagcagcagccugauggagaccaacccccuggaguggcccgagagacacgugcugcagaaccuggagaccuucgagaagaccaagcagaagaugagaaccggcagccugccccacagcagcgagcagcugcugggccacaaggagggccccagagacagcaucacccugcuggacgccaaggagcugcugaaguacuucaccagcgacggccugcccaucggcgaccugcagccccugcccauccagaagggcgagaagaccuucgugcugacccccgagcugagccccggcaagcugcaggugcugcccuucgagaaggccagcgugugccacuaccacggcaucgaguacugccuggacgacagaaaggcccuggagagagacggcggcuucagcgagcugcagagcagacugaucagauacgagacccagaccaccugcaccagagagagcuuccccgugcccaccgugcugagcccccugcccagccccguggugagcagcgaccccggcagcgugcccgacggcgaggugcugcagaacgagcugagaaccgaggugagcagacugaagagaagaagcaaggaccugaacugccuguaccccagaaagagacuggugaagagcgagagcagcgagagccugcugagccagaccaccggcaacagcaaccacuaccaccaccacgugaccagcagaaagccccagaccgagagaagccugcccgugaccugcccccuggugcccauccccagcugcgagacccccaagcuggccaccaagaccagcagcggccagaagagcaugcacgagagcaagaccagcagacagaucaaggagagcagaagccagaagcacaccagaauccugaaggagguggugaccgagacccugaagaagcacagcaucaccgagacccacgagugcuucaccgccugcagccagagacuguucgagaucagcaaguucuaccugaaggaccugaagaccagcagaggccuguucgaggagaugaagaagaccgccaacaacaacgccgugcaggugaucgacugggugcuggagaagaccagcaagaaguaa

SEQ ID NO: 20109 - RNA, 1170 nt, Artificial Sequence
  MTCH1__Homo_sapiens__NP_001258570
augggcgccagcgaccccgagguggcccccugggccagaggcggcgccgccggcauggccggcgccggcgccggcgccggcgccagaggcggcgccgccgccggcguggaggccagagccagagaccccccccccgcccacagagcccaccccagacaccccagacccgccgcccagcccagcgccagaagaauggacggcggcagcggcggccugggcagcggcgacaacgcccccaccaccgaggcccuguucguggcccugggcgccggcgugaccgcccugagccacccccugcuguacgugaagcugcugauccaggugggccacgagcccaugccccccacccugggcaccaacgugcugggcagaaaggugcuguaccugcccagcuucuucaccuacgccaaguacaucgugcagguggacggcaagaucggccuguucagaggccugagccccagacugaugagcaacgcccugagcaccgugaccagaggcagcaugaagaagguguucccccccgacgagaucgagcaggugagcaacaaggacgacaugaagaccagccugaagaagguggugaaggagaccagcuacgagaugaugaugcagugcgugagcagaaugcuggcccacccccugcacgugaucagcaugagaugcauggugcaguucgugggcagagaggccaaguacagcggcgugcugagcagcaucggcaagaucuucaaggaggagggccugcugggcuucuucgugggccugaucccccaccugcugggcgacgugguguuccuguggggcugcaaccugcuggcccacuucaucaacgccuaccugguggacgacagcgugagcgacacccccggcggccugggcaacgaccagaaccccggcagccaguucagccaggcccuggccaucagaagcuacaccaaguucgugaugggcaucgccgugagcaugcugaccuaccccuuccugcuggugggcgaccugauggccgugaacaacugcggccugcaggccggccugccccccuacagccccguguucaagagcuggauccacugcuggaaguaccugagcgugcagggccagcuguucagaggcagcagccugcuguucagaagagugagcagcggcagcugcuucgcccuggaguaa

SEQ ID NO: 20110 - RNA, 912 nt, Artificial Sequence
  MTCH2__Homo_sapiens__NP_055157
auggccgacgccgccagccaggugcugcugggcagcggccugaccauccugagccagccccugauguacgugaaggugcugauccaggugggcuacgagccccugccccccaccaucggcagaaacaucuucggcagacaggugugccagcugcccggccuguucagcuacgcccagcacaucgccagcaucgacggcagaagaggccuguucaccggccugacccccagacugugcagcggcgugcugggcaccguggugcacggcaaggugcugcagcacuaccaggagagcgacaagggcgaggagcugggccccggcaacgugcagaaggaggugagcagcagcuucgaccacgugaucaaggagaccaccagagagaugaucgccagaagcgccgccacccugaucacccaccccuuccacgugaucacccugagaagcauggugcaguucaucggcagagagagcaaguacugcggccugugcgacagcaucaucaccaucuacagagaggagggcauccugggcuucuucgccggccuggugcccagacugcugggcgacauccugagccuguggcugugcaacagccuggccuaccuggugaacaccuacgcccuggacagcggcgugagcaccaugaacgagaugaagagcuacagccaggccgugaccggcuucuucgccagcaugcugaccuaccccuucgugcuggugagcaaccugauggccgugaacaacugcggccuggccggcggcugcccccccuacagccccaucuacaccagcuggaucgacugcuggugcaugcugcagaaggagggcaacaugagcagaggcaacagccuguucuucagaaaggugcccuucggcaagaccuacugcugcgaccugaagaugcugaucuaa

SEQ ID NO: 20111 - RNA, 4761 nt, Artificial Sequence
  MTCL1__Homo_sapiens__NP_056025
auggaggagaugagagacagcuaccuggaggaggacguguaccagcugcaggagcugagaagagagcuggacagagccaacaagaacugcagaauccugcaguacagacugagaaaggccgagcagaagagccugaagguggccgagaccggccagguggacggcgagcugaucagaagccuggagcaggaccugaagguggccaaggacgugagcgugagacugcaccacgagcugaagaccguggaggagaagagagccaaggccgaggacgagaacgagacccugagacagcagaugaucgagguggagaucagcaagcaggcccugcagaacgagcuggagagacugaaggagagcagccugaagagaagaagcaccagagagauguacaaggagaagaagaccuucaaccaggacgacagcgccgaccugagaugccagcugcaguucgccaaggaggaggccuuccugaugagaaagaagauggccaagcugggcagagagaaggacgagcuggagcaggagcugcagaaguacaagagccuguacggcgacguggacagcccccugcccaccggcgaggccggcggcccccccagcaccagagaggccgagcugaagcugagacugaagcugguggaggaggaggccaacauccugggcagaaagaucguggagcuggagguggagaacagaggccugaaggccgagauggaggacaugagaggccagcaggagagagagggccccggcagagaccacgcccccagcauccccaccagccccuucggcgacagccuggagagcagcaccgagcugagaagacaccugcaguucguggaggaggaggccgagcugcugagaagaagcaucagcgagaucgaggaccacaacagacagcugacccacgagcugagcaaguucaaguucgagccccccagagagcccggcuggcugggcgagggcgccagccccggcgccggcggcggcgccccccugcaggaggagcugaagagcgccagacugcagaucagcgagcugagcggcaaggugcugaagcugcagcacgagaaccacgcccugcugagcaacauccagagaugcgaccuggccgcccaccugggccugagagcccccagccccagagacagcgacgccgagagcgacgccggcaagaaggagagcgacggcgaggagagcagacugccccagcccaagagagagggccccgugggcggcgagagcgacagcgaggagauguucgagaagaccagcggcuucggcagcggcaagcccagcgaggccagcgagcccugccccaccgagcugcugaaggccagagaggacagcgaguaccuggugacccugaagcacgaggcccagagacuggagagaaccguggagagacugaucaccgacaccgacagcuuccugcacgacgccggccugagaggcggcgccccccugcccggccccggccugcagggcgaggaggagcagggcgagggcgaccagcaggagccccagcugcugggcaccaucaacgccaagaugaaggccuucaagaaggagcugcaggccuuccuggagcaggugaacagaaucggcgacggccugagcccccugccccaccugaccgagagcagcagcuuccugagcaccgugaccagcgugagcagagacagccccaucggcaaccugggcaaggagcugggccccgaccugcagagcagacugaaggagcagcuggaguggcagcugggccccgccagaggcgacgagagagagagccugagacugagagccgccagagagcugcacagaagagccgacggcgacaccggcagccacggccugggcggccagaccugcuucagccuggagcugagaggcccccccgugcugcccgagcagagcgugagcaucgaggagcugcagggccagcuggugcaggccgccagacugcaccaggaggagaccgagaccuucaccaacaagauccacaagauggaggaggagcaccuguacgcccugagauggaaggagcuggagaugcacagccuggcccugcagaacacccugcacgagagaaccuggagcgacgagaagaaccugaugcagcaggagcugagaagccugaagcagaacaucuuccuguucuacgugaagcugagauggcugcugaagcacuggagacagggcaagcagauggaggaggagggcgaggaguucaccgagggcgagcaccccgagacccugagcagacugggcgagcugggcgugcagggcggccaccaggccgacggccccgaccacgacagcgacagaggcugcggcuuccccgugggcgagcacagcccccacagcagagugcagaucggcgaccacagccugagacugcagaccgccgacagaggccagccccacaagcaggugguggagaaccagcagcuguucagcgccuucaaggcccugcuggaggacuucagagccgagcugagagaggacgagagagccagacugagacugcagcagcaguacgccagcgacaaggccgccugggacguggagugggccgugcugaagugcagacuggagcagcuggaggagaagaccgagaacaagcugggcgagcugggcagcagcgccgagagcaagggcgcccugaagaaggagagagaggugcaccagaagcugcuggccgacagccacagccuggugauggaccugagauggcagauccaccacagcgagaagaacuggaacagagagaagguggagcugcuggacagacuggacagagacagacaggagugggagagacagaagaaggaguuccuguggagaaucgagcagcugcagaaggagaacagccccagaagaggcggcagcuuccugugcgaccagaaggacggcaacgugagacccuucccccaccagggcagccugagaaugcccagacccguggccauguggcccugcgccgacgccgacagcauccccuucgaggacagaccccugagcaagcugaaggagagcgacagaugcagcgccagcgagaaccuguaccuggacgcccugagccuggacgacgagcccgaggagccccccgcccacagacccgagagagaguucagaaacagacugcccgaggaggaggagaaccacaagggcaaccugcagagagccgugagcgugagcagcaugagcgaguuccagagacugauggacaucagccccuuccugcccgagaagggccugcccagcaccagcagcaaggaggacgugacccccccccugagccccgacgaccugaaguacaucgaggaguucaacaagagcugggacuacacccccaacagaggccacaacggcggcggccccgaccugugggccgacagaaccgaggugggcagagccggccacgaggacagcaccgagcccuuccccgacagcagcugguaccugaccaccagcgugaccaugaccaccgacaccaugaccagccccgagcacugccagaagcagccccugagaagccacgugcugaccgagcagagcggccugagagugcugcacagcccccccgccgugagaagaguggacagcaucaccgccgccggcggcgagggccccuuccccaccagcagagccagaggcagccccggcgacaccaagggcggcccccccgagcccaugcugagcagauggcccugcaccagccccagacacagcagagacuacguggagggcgccagaagaccccuggacagcccccugugcaccagccugggcuucgccagcccccugcacagccuggagaugagcaagaaccugagcgacgacaugaaggagguggccuucagcgugagaaacgccaucugcagcggccccggcgagcugcaggugaaggacauggccugccagaccaacggcagcagaaccaugggcacccagaccgugcagaccaucagcgugggccugcagaccgaggcccugagaggcagcggcgugaccagcagcccccacaagugccugacccccaaggccggcggcggcgccacccccgugagcagccccagcagaagccugagaagcagacagguggcccccgccaucgagaaggugcaggccaaguucgagagaaccugcugcagccccaaguacggcagccccaagcugcagagaaagccccugcccaaggccgaccagcccaacaacagaaccagccccggcauggcccagaagggcuacagcgagagcgccugggccagaagcaccaccaccagagagagccccgugcacaccaccaucaacgacggccugagcagccuguucaacaucaucgaccacagccccguggugcaggaccccuuccagaagggccugagagccggcagcagaagcagaagcgccgagcccagacccgagcugggccccggccaggagaccggcaccaacagcagaggcagaagccccagccccaucggcgugggcagcgagaugugcagagaggagggcggcgagggcacccccgugaagcaggaccugagcgccccccccggcuacacccugaccgagaacguggccagaauccugaacaagaagcugcuggagcacgcccugaaggaggagagaagacaggccgcccacggcccccccggccugcacagcgacagccacagccugggcgacaccgccgagcccggccccauggagaaccagaccgugcugcugaccgcccccuggggccuguaa

SEQ ID NO: 20112 - RNA, 324 nt, Artificial Sequence
  MTCP1__Homo_sapiens__NP_001018025
auggccggcgaggacgugggcgccccccccgaccaccugugggugcaccaggagggcaucuacagagacgaguaccagagaaccuggguggccgugguggaggaggagaccagcuuccugagagccagagugcagcagauccaggugccccugggcgacgccgccagacccagccaccugcugaccagccagcugccccugauguggcagcuguaccccgaggagagauacauggacaacaacagcagacuguggcagauccagcaccaccugauggugagaggcgugcaggagcugcugcugaagcugcugcccgacgacuaa

SEQ ID NO: 20113 - RNA, 1749 nt, Artificial Sequence
  MTDH__Homo_sapiens__NP_848927
auggccgccagaagcuggcaggacgagcuggcccagcaggccgaggagggcagcgccagacugagagagaugcugagcgugggccugggcuuccugagaaccgagcugggccuggaccugggccuggagcccaagagauaccccggcugggugauccuggugggcaccggcgcccugggccugcugcugcuguuccugcugggcuacggcugggccgccgccugcgccggcgccagaaagaagagaagaagcccccccagaaagagagaggaggccgccgccgugcccgccgccgcccccgacgaccuggcccugcugaagaaccugagaagcgaggagcagaagaagaagaacagaaagaagcugagcgagaagcccaagcccaacggcagaaccguggagguggccgagggcgaggccgugagaaccccccagagcgugaccgccaagcagccccccgagaucgacaagaagaacgagaagagcaagaagaacaagaagaagagcaagagcgacgccaaggccgugcagaacagcagcagacacgacggcaaggagguggacgagggcgccugggagaccaagaucagccacagagagaagagacagcagagaaagagagacaaggugcugaccgacagcggcagccuggacagcaccauccccggcaucgagaacaccaucaccgugaccaccgagcagcugaccaccgccagcuuccccgugggcagcaagaagaacaagggcgacagccaccugaacgugcaggugagcaacuucaagagcggcaagggcgacagcacccugcaggugagcagcggccugaacgagaaccugaccgugaacggcggcggcuggaacgagaagagcgugaagcugagcagccagaucagcgccggcgaggagaaguggaacagcgugagccccgccagcgccggcaagagaaagaccgagcccagcgccuggagccaggacaccggcgacgccaacaccaacggcaaggacuggggcagaagcuggagcgacagaagcaucuucagcggcaucggcagcaccgccgagcccgugagccagagcaccaccagcgacuaccagugggacgugagcagaaaccagcccuacaucgacgacgaguggagcggccugaacggccugagcagcgccgaccccaacagcgacuggaacgcccccgccgaggaguggggcaacuggguggacgaggagagagccagccugcugaagagccaggagcccauccccgacgaccagaaggugagcgacgacgacaaggagaagggcgagggcgcccugcccaccggcaagagcaagaagaagaagaagaagaagaagaagcagggcgaggacaacagcaccgcccaggacaccgaggagcuggagaaggagaucagagaggaccugcccgugaacaccagcaagaccagacccaagcaggagaaggccuucagccugaagaccaucagcaccagcgaccccgccgaggugcuggugaagaacagccagcccaucaagacccugccccccgccaccagcaccgagcccagcgugauccugagcaagagcgacagcgacaagagcagcagccaggugccccccauccugcaggagaccgacaagagcaagagcaacaccaagcagaacagcgugccccccagccagaccaagagcgagaccagcugggagagccccaagcagaucaagaagaagaagaaggccagaagagagaccuaa

SEQ ID NO: 20114 - RNA, 1200 nt, Artificial Sequence
  MTERF1__Homo_sapiens__XP_006716189
augcagagccugagccugggccagaccagcaucagcaagggccugaacuaccugaccaucauggcccccggcaaccuguggcacaugagaaacaacuuccuguucggcagcagaugcuggaugaccagauucagcgccgagaacaucuucaagagcgugagcuucagacuguucggcgugaagugccacaacaccgacagcgagccccugaagaacgaggaccugcugaagaaccugcugaccaugggcguggacaucgacauggccagaaagagacagcccggcguguuccacagaaugaucaccaacgagcaggaccugaagauguuccugcugagcaagggcgccagcaaggaggugaucgccagcaucaucagcagauaccccagagccaucaccagaacccccgagaaccugagcaagagaugggaccuguggagaaagaucgugaccagcgaccuggagaucgugaacauccuggagagaagccccgagagcuucuucagaagcaacaacaaccugaaccuggagaacaacaucaaguuccuguacagcgugggccugaccagaaagugccugugcagacugcugaccaacgcccccagaaccuucagcaacagccuggaccugaacaagcagaugguggaguuccugcaggccgccggccugagccugggccacaacgaccccgccgacuucgugagaaagaucaucuucaagaaccccuucauccugauccagagcaccaagagagugaaggccaacaucgaguuccugagaagcaccuucaaccugaacagcgaggagcugcuggugcugaucugcggccccggcgccgagauccuggaccugagcaacgacuacgccagaagaagcuacgccaacaucaaggagaagcuguucagccugggcugcaccgaggaggaggugcagaaguucgugcugagcuaccccgacgugaucuuccuggccgagaagaaguucaacgacaagaucgacugccugauggaggagaacaucagcaucagccagaucaucgagaaccccagagugcuggacagcagcaucagcacccugaagagcagaaucaaggagcuggugaacgccggcugcaaccugagcacccugaacaucacccugcugagcuggagcaagaagagauacgaggccaagcugaagaagcugagcagauucgccuaa

SEQ ID NO: 20115 - RNA, 2262 nt, Artificial Sequence
  MTF1__Homo_sapiens__XP_011539794
augggcgagcacagccccgacaacaacaucaucuacuucgaggccgaggaggacgagcugacccccgacgacaagaugcugagauucguggacaagaacggccuggugcccagcagcagcggcaccguguacgacagaaccaccgugcugaucgagcaggaccccggcacccuggaggacgaggacgacgacggccagugcggcgagcaccugcccuuccuggugggcggcgaggagggcuuccaccugaucgaccacgaggccaugagccagggcuacgugcagcacaucaucagccccgaccagauccaccugaccaucaaccccggcagcacccccaugcccagaaacaucgagggcgccacccugacccugcagagcgagugccccgagaccaagagaaaggaggugaagagauaccagugcaccuucgagggcugccccagaaccuacagcaccgccggcaaccugagaacccaccagaagacccacagaggcgaguacaccuucgugugcaaccaggagggcugcggcaaggccuuccugaccagcuacagccugagaauccacgugagagugcacaccaaggagaagcccuucgagugcgacgugcagggcugcgagaaggccuucaacacccuguacagacugaaggcccaccagagacugcacaccggcaagaccuucaacugcgagagcgagggcugcagcaaguacuucaccacccugagcgaccugagaaagcacaucagaacccacaccggcgagaagcccuucagaugcgaccacgacggcugcggcaaggccuucgccgccagccaccaccugaagacccacgugagaacccacaccggcgagagacccuucuucugccccagcaacggcugcgagaagaccuucagcacccaguacagccugaagagccacaugaagggccacgacaacaagggccacagcuacaacgcccugccccagcacaacggcagcgaggacaccaaccacagccugugccugagcgaccugagccugcugagcaccgacagcgagcugagagagaacagcagcaccacccagggccaggaccugagcaccaucagccccgccaucaucuucgagagcauguuccagaacagcgacgacaccgccauccaggaggacccccagcagaccgccagccugaccgagagcuucaacggcgacgccgagagcgugagcgacgugccccccagcaccggcaacagcgccagccugagccugccccuggugcugcagcccggccugagcgagcccccccagccccugcugcccgccagcgcccccagcgcccccccccccgcccccagccugggccccggcagccagcaggccgccuucggcaacccccccgcccugcugcagccccccgaggugcccgugccccacagcacccaguucgccgccaaccaccaggaguuccugccccacccccaggccccccagcccaucgugcccggccugagcgugguggccggcgccagcgccagcgccgccgccguggccagcgccguggccgcccccgcccccccccagagcaccaccgagccccugcccgccauggugcagacccugccccugggcgccaacagcgugcugaccaacaaccccaccaucaccaucacccccacccccaacaccgccauccugcagagcagccuggugaugggcgagcagaaccugcaguggauccugaacggcgccaccagcagcccccagaaccaggagcagauccagcaggccagcaagguggagaagguguucuucaccaccgccgugcccguggccagcagccccggcagcagcgugcagcagaucggccugagcgugcccgugaucaucaucaagcaggaggaggccugccagugccagugcgccugcagagacagcgccaaggagagagccagcagcagaagaaagggcugcagcagcccccccccccccgagcccagcccccaggcccccgacggccccagccugcagcugcccgcccagaccuucagcagcgcccccgugcccggcagcagcagcagcacccugcccagcagcugcgagcagagcagacaggccgagacccccagcgacccccagaccgagacccugagcgccauggacgugagcgaguuccugagccugcagagccuggacacccccagcaaccugauccccaucgaggcccugcugcagggcgaggaggagaugggccugaccagcagcuucagcaaguaa

SEQ ID NO: 20116 - RNA, 1170 nt, Artificial Sequence
  MTFMT__Homo_sapiens__NP_640335
augagagugcuggugagaagaugcuggggccccccccuggcccacggcgccagaagaggcagacccagcccccaguggagagcccuggccagacugggcugggaggacugcagagacagcagagugagagagaagccccccuggagagugcuguucuucggcaccgaccaguucgccagagaggcccugagagcccugcacgccgccagagagaacaaggaggaggagcugaucgacaagcuggagguggugaccaugcccagccccagccccaagggccugcccgugaagcaguacgccgugcagagccagcugcccguguacgaguggcccgacgugggcagcggcgaguacgacgugggcgugguggccagcuucggcagacugcugaacgaggcccugauccugaaguuccccuacggcauccugaacgugcaccccagcugccugcccagauggagaggccccgcccccgugauccacaccgugcugcacggcgacaccgugaccggcgugaccaucaugcagaucagacccaagagauucgacgugggccccauccugaagcaggagaccgugcccgugccccccaagagcaccgccaaggagcuggaggccgugcugagcagacugggcgccaacaugcugaucagcgugcugaagaaccugcccgagagccugagcaacggcagacagcagcccauggagggcgccaccuacgcccccaagaucagcgccggcaccagcugcaucaagugggaggagcagaccagcgagcagaucuucagacuguacagagccaucggcaacaucaucccccugcagacccuguggauggccaacaccaucaagcugcuggaccugguggaggugaacagcagcgugcuggccgaccccaagcugaccggccaggcccugauccccggcagcgugaucuaccacaagcagagccagauccugcugguguacugcaaggacggcuggaucggcgugagaagcgugaugcugaagaagagccugaccgccaccgacuucuacaacggcuaccugcaccccugguaccagaagaacagccaggcccagcccagccagugcagauuccagacccugagacugcccaccaagaagaagcagaagaagaccguggccaugcagcagugcaucgaguaa

SEQ ID NO: 20117 - RNA, 408 nt, Artificial Sequence
  MTFP1__Homo_sapiens__NP_001003704
augagcgagccccagcccagaggcgccgagagagaccuguacagagacaccugggugagauaccugggcuacgccaacgaggugggcgaggccuucagaagccuggugcccgccgccgugguguggcugagcuacggcguggccagcagcuacgugcuggccgacgccaucgacaagggcaagaaggccggcgaggugggcggcuucccccccggccugcagcccgcccaggcccugcccaacagcggcgaggcccagcugcugcugaucauccugugguaccuggccugcgccagcgccagcugcuucaugagcaccagcuacagcugccagggcauguggacccccggcagccuggugagcaaggaccccggcaccugggugggccugagcuggaccgaggccuaa

SEQ ID NO: 20118 - RNA, 1005 nt, Artificial Sequence
  MTG1__Homo_sapiens__NP_612393
augagacugacccccagagcccugugcagcgccgcccaggccgccuggagagagaacuucccccugugcggcagagacguggccagaugguuccccggccacauggccaagggccugaagaagaugcagagcagccugaagcugguggacugcaucaucgaggugcacgacgccagaaucccccugagcggcagaaacccccuguuccaggagacccugggccugaagccccaccugcuggugcugaacaagauggaccuggccgaccugaccgagcagcagaagaucaugcagcaccuggagggcgagggccugaagaacgugaucuucaccaacugcgugaaggacgagaacgugaagcagaucauccccauggugaccgagcugaucggcagaagccacagauaccacagaaaggagaaccuggaguacugcaucauggugaucggcgugcccaacgugggcaagagcagccugaucaacagccugagaagacagcaccugagaaagggcaaggccaccagagugggcggcgagcccggcaucaccagagccgugaugagcaagauccaggugagcgagagaccccugauguuccugcuggacacccccggcgugcuggcccccagaaucgagagcguggagaccggccugaagcuggcccugugcggcaccgugcuggaccaccuggugggcgaggagaccauggccgacuaccugcuguacacccugaacaagcaccagagauucggcuacgugcagcacuacggccugggcagcgccugcgacaacguggagagagugcugaagagcguggccgugaagcugggcaagacccagaaggugaaggugcugaccggcaccggcaacgugaacaucauccagcccaacuaccccgccgccgccagagacuuccugcagaccuucagaagaggccugcugggcagcgugaugcuggaccuggacgugcugagaggccacccccccgccgagacccugcccuaa

SEQ ID NO: 20119 - RNA, 2808 nt, Artificial Sequence
  MTHFD1__Homo_sapiens__NP_005947
auggcccccgccgagauccugaacggcaaggagaucagcgcccagaucagagccagacugaagaaccaggugacccagcugaaggagcaggugcccggcuucacccccagacuggccauccugcaggugggcaacagagacgacagcaaccuguacaucaacgugaagcugaaggccgccgaggagaucggcaucaaggccacccacaucaagcugcccagaaccaccaccgagagcgaggugaugaaguacaucaccagccugaacgaggacagcaccgugcacggcuuccuggugcagcugccccuggacagcgagaacagcaucaacaccgaggaggugaucaacgccaucgcccccgagaaggacguggacggccugaccagcaucaacgccggcaagcuggccagaggcgaccugaacgacugcuucauccccugcacccccaagggcugccuggagcugaucaaggagaccggcgugcccaucgccggcagacacgccgugguggugggcagaagcaagaucgugggcgcccccaugcacgaccugcugcuguggaacaacgccaccgugaccaccugccacagcaagaccgcccaccuggacgaggaggugaacaagggcgacauccuggugguggccaccggccagcccgagauggugaagggcgaguggaucaagcccggcgccaucgugaucgacugcggcaucaacuacgugcccgacgacaagaagcccaacggcagaaagguggugggcgacguggccuacgacgaggccaaggagagagccagcuucaucacccccgugcccggcggcgugggccccaugaccguggccaugcugaugcagagcaccguggagagcgccaagagauuccuggagaaguucaagcccggcaaguggaugauccaguacaacaaccugaaccugaagacccccgugcccagcgacaucgacaucagcagaagcugcaagcccaagcccaucggcaagcuggccagagagaucggccugcugagcgaggagguggagcuguacggcgagaccaaggccaaggugcugcugagcgcccuggagagacugaagcacagacccgacggcaaguacgugguggugaccggcaucacccccaccccccugggcgagggcaagagcaccaccaccaucggccuggugcaggcccugggcgcccaccuguaccagaacguguucgccugcgugagacagcccagccagggccccaccuucggcaucaagggcggcgccgccggcggcggcuacagccaggugauccccauggaggaguucaaccugcaccugaccggcgacauccacgccaucaccgccgccaacaaccugguggccgccgccaucgacgccagaaucuuccacgagcugacccagaccgacaaggcccuguucaacagacuggugcccagcgugaacggcgugagaagauucagcgacauccagaucagaagacugaagagacugggcaucgagaagaccgaccccaccacccugaccgacgaggagaucaacagauucgccagacuggacaucgaccccgagaccaucaccuggcagagagugcuggacaccaacgacagauuccugagaaagaucaccaucggccaggcccccaccgagaagggccacaccagaaccgcccaguucgacaucagcguggccagcgagaucauggccgugcuggcccugaccaccagccuggaggacaugagagagagacugggcaagauggugguggccagcagcaagaagggcgagcccgugagcgccgaggaccugggcgugagcggcgcccugaccgugcugaugaaggacgccaucaagcccaaccugaugcagacccuggagggcacccccguguucgugcacgccggccccuucgccaacaucgcccacggcaacagcagcaucaucgccgacagaaucgcccugaagcuggugggccccgagggcuucguggugaccgaggccggcuucggcgccgacaucggcauggagaaguucuucaacaucaagugcagauacagcggccugugcccccacgugguggugcugguggccaccgugagagcccugaagaugcacggcggcggccccaccgugaccgccggccugccccugcccaaggccuacauccaggagaaccuggagcugguggagaagggcuucagcaaccugaagaagcagaucgagaacgccagaauguucggcauccccguggugguggccgugaacgccuucaagaccgacaccgagagcgagcuggaccugaucagcagacugagcagagagcacggcgccuucgacgccgugaagugcacccacugggccgagggcggcaagggcgcccuggcccuggcccaggccgugcagagagccgcccaggcccccagcagcuuccagcugcuguacgaccugaagcugcccguggaggacaagaucagaaucaucgcccagaagaucuacggcgccgacgacaucgagcugcugcccgaggcccagcacaaggccgagguguacaccaagcagggcuucggcaaccugcccaucugcauggccaagacccaccugagccugagccacaaccccgagcagaagggcgugcccaccggcuucauccugcccaucagagacaucagagccagcgugggcgccggcuuccuguacccccuggugggcaccaugagcaccaugcccggccugcccaccagacccugcuucuacgacaucgaccuggaccccgagaccgagcaggugaacggccuguucuaa

SEQ ID NO: 20120 - RNA, 2940 nt, Artificial Sequence
  MTHFD1L__Homo_sapiens__NP_001229696
augggcaccagacugccccuggugcugagacagcugagaagacccccccagccccccggcccccccagaagacugagagugcccugcagagccagcagcggcggcggcggcggcggcggcggcggcagagagggccugcugggccagagaagaccccaggacggccaggccagaagcagcugcagccccggcggcagaacccccgccgccagagacagcaucgugagagaggugauccagaacagcaaggaggugcugagccugcugcaggagaagaaccccgccuucaagcccgugcuggccaucauccaggccggcgacgacaaccugaugcaggagaucaaccagaaccuggccgaggaggccggccugaacaucacccacaucugccugccccccgacagcagcgaggccgagaucaucgacgagauccugaagaucaacgaggacaccagagugcacggccuggcccugcagaucagcgagaaccuguucagcaacaaggugcugaacgcccugaagcccgagaaggacguggacggcgugaccgacaucaaccugggcaagcuggugagaggcgacgcccacgagugcuucgugagccccguggccaaggccgugaucgagcugcuggagaagagcgugggcgugaaccuggacggcaagaagauccugguggugggcgcccacggcagccuggaggccgcccugcagugccuguuccagagaaagggcagcaugaccaugagcauccaguggaagaccagacagcugcagagcaagcugcacgaggccgacaucguggugcugggcagccccaagcccgaggagaucccccugaccuggauccagcccggcaccaccgugcugaacugcagccacgacuuccugagcggcaaggugggcugcggcagccccagaauccacuucggcggccugaucgaggaggacgacgugauccugcuggccgccgcccugagaauccagaacauggugagcagcggcagaagauggcugagagagcagcagcacagaagauggagacugcacugccugaagcugcagccccugagccccgugcccagcgacaucgagaucagcagaggccagacccccaaggccguggacgugcuggccaaggagaucggccugcuggccgacgagaucgagaucuacggcaagagcaaggccaaggugagacugagcgugcuggagagacugaaggaccaggccgacggcaaguacgugcugguggccggcaucacccccaccccccugggcgagggcaagagcaccgugaccaucggccuggugcaggcccugaccgcccaccugaacgugaacagcuucgccugccugagacagcccagccagggccccaccuucggcgugaagggcggcgccgccggcggcggcuacgcccaggugauccccauggaggaguucaaccugcaccugaccggcgacauccacgccaucaccgccgccaacaaccugcuggccgccgccaucgacaccagaauccugcacgagaacacccagaccgacaaggcccuguacaacagacuggugccccuggugaacggcgugagagaguucagcgagauccagcuggccagacugaagaagcugggcaucaacaagaccgaccccagcacccugaccgaggaggaggugagcaaguucgccagacuggacaucgaccccagcaccaucaccuggcagagagugcuggacaccaacgacagauuccugagaaagaucaccaucggccagggcaacaccgagaagggccacuacagacaggcccaguucgacaucgccguggccagcgagaucauggccgugcuggcccugaccgacagccuggccgacaugaaggccagacugggcagaauggugguggccagcgacaagagcggccagcccgugaccgccgacgaccugggcgugaccggcgcccugaccgugcugaugaaggacgccaucaagcccaaccugaugcagacccuggagggcacccccguguucgugcacgccggccccuucgccaacaucgcccacggcaacagcagcgugcuggccgacaagaucgcccugaagcuggugggcgaggagggcuucguggugaccgaggccggcuucggcgccgacaucggcauggagaaguucuucaacaucaagugcagagccagcggccuggugcccaacgugguggugcugguggccaccgugagagcccugaagaugcacggcggcggccccagcgugaccgccggcgugccccugaagaaggaguacaccgaggagaacauccagcugguggccgacggcugcugcaaccugcagaagcagauccagaucacccagcuguucggcgugcccguggugguggcccugaacguguucaagaccgacaccagagccgagaucgaccuggugugcgagcuggccaagagagccggcgccuucgacgccgugcccugcuaccacuggagcgugggcggcaagggcagcguggaccuggccagagccgugagagaggccgccagcaagagaagcagauuccaguuccuguacgacgugcaggugcccaucguggacaagaucagaaccaucgcccaggccguguacggcgccaaggacaucgagcugagccccgaggcccaggccaagaucgacagauacacccagcagggcuucggcaaccugcccaucugcauggccaagacccaccugagccugagccaccagcccgacaagaagggcgugcccagagacuucauccugcccaucagcgacgugagagccagcaucggcgccggcuucaucuacccccuggugggcaccaugagcaccaugcccggccugcccaccagacccugcuucuacgacaucgaccuggacaccgagaccgagcaggugaagggccuguucuaa

SEQ ID NO: 20121 - RNA, 1053 nt, Artificial Sequence
  MTHFD2__Homo_sapiens__NP_006627
auggccgccaccagccugaugagcgcccuggccgccagacugcugcagcccgcccacagcugcagccugagacugagacccuuccaccuggccgccgugagaaacgaggccguggugaucagcggcagaaagcuggcccagcagaucaagcaggaggugagacaggagguggaggaguggguggccagcggcaacaagagaccccaccugagcgugauccuggugggcgagaaccccgccagccacagcuacgugcugaacaagaccagagccgccgccguggugggcaucaacagcgagaccaucaugaagcccgccagcaucagcgaggaggagcugcugaaccugaucaacaagcugaacaacgacgacaacguggacggccugcuggugcagcugccccugcccgagcacaucgacgagagaagaaucugcaacgccgugagccccgacaaggacguggacggcuuccacgugaucaacgugggcagaaugugccuggaccaguacagcaugcugcccgccacccccuggggcgugugggagaucaucaagagaaccggcauccccacccugggcaagaacguggugguggccggcagaagcaagaacgugggcaugcccaucgccaugcugcugcacaccgacggcgcccacgagagacccggcggcgacgccaccgugaccaucagccacagauacacccccaaggagcagcugaagaagcacaccauccuggccgacaucgugaucagcgccgccggcauccccaaccugaucaccgccgacaugaucaaggagggcgccgccgugaucgacgugggcaucaacagagugcacgaccccgugaccgccaagcccaagcuggugggcgacguggacuucgagggcgugagacagaaggccggcuacaucacccccgugcccggcggcgugggccccaugaccguggccaugcugaugaagaacaccaucaucgccgccaagaaggugcugagacuggaggagagagaggugcugaagagcaaggagcugggcguggccaccaacuaa

SEQ ID NO: 20122 - RNA, 2091 nt, Artificial Sequence
  MTHFR__Homo_sapiens__XP_011539797
auggaccacagaaaggccagagugcugcccgccggccacuacugccccagccugggcaucugggccagccaggugggcagcgugagaagcagcgugccccccagcaucagaaaccccgccauggugaacgaggccagaggcaacagcagccugaaccccugccuggagggcagcgccagcagcggcagcgagagcagcaaggacagcagcagaugcagcacccccggccuggaccccgagagacacgagagacugagagagaagaugagaagaagacuggagagcggcgacaagugguucagccuggaguucuucccccccagaaccgccgagggcgccgugaaccugaucagcagauucgacagaauggccgccggcggcccccuguacaucgacgugaccuggcaccccgccggcgaccccggcagcgacaaggagaccagcagcaugaugaucgccagcaccgccgugaacuacugcggccuggagaccauccugcacaugaccugcugcagacagagacuggaggagaucaccggccaccugcacaaggccaagcagcugggccugaagaacaucauggcccugagaggcgaccccaucggcgaccagugggaggaggaggagggcggcuucaacuacgccguggaccuggugaagcacaucagaagcgaguucggcgacuacuucgacaucugcguggccggcuaccccaagggccaccccgaggccggcagcuucgaggccgaccugaagcaccugaaggagaaggugagcgccggcgccgacuucaucaucacccagcuguucuucgaggccgacaccuucuucagauucgugaaggccugcaccgacaugggcaucaccugccccaucgugcccggcaucuuccccauccagggcuaccacagccugagacagcuggugaagcugagcaagcuggaggugccccaggagaucaaggacgugaucgagcccaucaaggacaacgacgccgccaucagaaacuacggcaucgagcuggccgugagccugugccaggagcugcuggccagcggccuggugcccggccugcacuucuacacccugaacagagagauggccaccaccgaggugcugaagagacugggcauguggaccgaggaccccagaagaccccugcccugggcccugagcgcccaccccaagagaagagaggaggacgugagacccaucuucugggccagcagacccaagagcuacaucuacagaacccaggagugggacgaguuccccaacggcagauggggcaacagcagcagccccgccuucggcgagcugaaggacuacuaccuguucuaccugaagagcaagagccccaaggaggagcugcugaagauguggggcgaggagcugaccagcgaggagagcguguucgagguguucgugcuguaccugagcggcgagcccaacagaaacggccacaaggugaccugccugcccuggaacgacgagccccuggccgccgagaccagccugcugaaggaggagcugcugagagugaacagacagggcauccugaccaucaacagccagcccaacaucaacggcaagcccagcagcgaccccaucgugggcuggggccccagcggcggcuacguguuccagaaggccuaccuggaguucuucaccagcagagagaccgccgaggcccugcugcaggugcugaagaaguacgagcugagagugaacuaccaccuggugaacgugaagggcgagaacaucaccaacgcccccgagcugcagcccaacgccgugaccuggggcaucuuccccggcagagagaucauccagcccaccgugguggaccccgugagcuucauguucuggaaggacgaggccuucgcccuguggaucgagagauggggcaagcuguacgaggaggagagccccagcagaaccaucauccaguacauccacgacaacuacuuccuggugaaccugguggacaacgacuucccccuggacaacugccuguggcaggugguggaggacacccuggagcugcugaacagacccacccagaacgccagagagaccgaggcccccuaa

SEQ ID NO: 20123 - RNA, 612 nt, Artificial Sequence
  MTHFS__Homo_sapiens__NP_006432
auggccgccgccgccgugagcagcgccaagagaagccugagaggcgagcugaagcagagacugagagccaugagcgccgaggagagacugagacagagcagagugcugagccagaaggugaucgcccacagcgaguaccagaagagcaagagaaucagcaucuuccugagcaugcaggacgagaucgagaccgaggagaucaucaaggacaucuuccagagaggcaagaucugcuucauccccagauacagauuccagagcaaccacauggacauggugagaaucgagagccccgaggagaucagccugcugcccaagaccagcuggaacaucccccagcccggcgagggcgacgugagagaggaggcccugagcaccggcggccuggaccugaucuucaugcccggccugggcuucgacaagcacggcaacagacugggcagaggcaagggcuacuacgacgccuaccugaagagaugccugcagcaccaggaggugaagcccuacacccuggcccuggccuucaaggagcagaucugccugcaggugcccgugaacgagaacgacaugaagguggacgaggugcuguacgaggacagcagcaccgccuaa

SEQ ID NO: 20124 - RNA, 2184 nt, Artificial Sequence
  MTIF2__Homo_sapiens__NP_001005369
augaaccagaagcugcugaagcuggagaaccugcugagauuccacaccaucuacagacagcugcacagccugugccagagaagagcccugagacaguggagacacggcuucagcagcgccuaccccguguggaccgcccagcugugcgccuggcccuggcccaccgacgugcugaccggcgccgcccugagccaguacagacugcuggugaccaagaaggaggagggccccuggaagagccagcugagcagcaccaagagcaagaaggugguggagguguggaucggcaugaccaucgaggagcuggccagagccauggagaagaacaccgacuacguguacgaggcccugcugaacaccgacaucgacaucgacagccuggaggccgacagccaccuggacgagguguggaucaaggaggugaucaccaaggccggcaugaagcugaaguggagcaagcugaagcaggacaaggugagaaagaacaaggacgccgugagaagaccccaggccgaccccgcccugcugacccccagaagccccguggugaccaucaugggccacguggaccacggcaagaccacccugcuggacaaguucagaaagacccagguggccgccguggagaccggcggcaucacccagcacaucggcgccuuccuggugagccugcccagcggcgagaagaucaccuuccuggacacccccggccacgccgccuucagcgccaugagagccagaggcgcccaggugaccgacaucguggugcuggugguggccgccgacgacggcgugaugaagcagaccguggagagcauccagcacgccaaggacgcccaggugcccaucauccuggccgugaacaagugcgacaaggccgaggccgaccccgagaaggugaagaaggagcugcuggccuacgacguggugugcgaggacuacggcggcgacgugcaggccgugcccgugagcgcccugaccggcgacaaccugauggcccuggccgaggccaccguggcccuggccgagaugcuggagcugaaggccgaccccaacggccccguggagggcaccgugaucgagagcuucaccgacaagggcagaggccuggugaccaccgccaucauccagagaggcacccugagaaagggcagcgugcugguggccggcaagugcugggccaaggugagacugauguucgacgagaacggcaagaccaucgacgaggccuaccccagcaugcccgugggcaucaccggcuggagagaccugcccagcgccggcgaggagauccuggagguggagagcgagcccagagccagagaggugguggacuggagaaaguacgagcaggagcaggagaagggccaggaggaccugaagaucaucgaggagaagagaaaggagcacaaggaggcccaccagaaggccagagagaaguacggccaccugcuguggaagaagagaagcauccugagauuccuggagagaaaggagcagaucccccugaagcccaaggagaagagagagagagacagcaacgugcugagcgugaucaucaagggcgacguggacggcagcguggaggccauccugaacaucaucgacaccuacgacgccagccacgagugcgagcuggagcuggugcacuucggcgugggcgacgugagcgccaacgacgugaaccuggccgagaccuucgacggcgugaucuacggcuucaacgugaacgccggcaacgugauccagcagagcgccgccaagaagggcgugaagaucaagcugcacaagaucaucuacagacugguggaggaccugcaggaggagcugagcagcagacugcccugcgccguggaggagcaccccgugggcgaggccagcauccuggccaccuucagcgugaccgagggcaagaagaaggugcccguggccggcugcagagugcagaagggccagcuggagaagcagaagaaguucaagcugaccagaaacggccacgugaucuggaagggcagccugaccagccugaagcaccacaaggacgacaucagcaucgugaagaccggcauggacugcggccugagccuggacgaggacaacauggaguuccaggugggcgacagaaucgugugcuacgaggagaagcagauccaggccaagaccagcugggaccccggcuucuaa

SEQ ID NO: 20125 - RNA, 837 nt, Artificial Sequence
  MTIF3__Homo_sapiens__XP_011533265
auggccgcccuguuccugaagagacugacccugcagaccgugaagagcgagaacagcugcaucagaugcuucggcaagcacauccugcagaagaccgcccccgcccagcugagccccaucgccagcgcccccagacugagcuuccugauccacgccaaggccuucagcaccgccgaggacacccagaacgagggcaagaagaccaagaagaacaagaccgccuucagcaacgugggcagaaagaucagccagagagugauccaccuguucgacgagaagggcaacgaccugggcaacaugcacagagccaacgugaucagacugauggacgagagagaccugagacuggugcagagaaacaccagcaccgagcccgccgaguaccagcugaugaccggccugcagauccugcaggagagacagagacugagagagauggagaaggccaaccccaagaccggccccacccugagaaaggagcugauccugagcagcaacaucggccagcacgaccuggacaccaagaccaagcagauccagcaguggaucaagaagaagcaccuggugcagaucaccaucaagaagggcaagaacguggacgugagcgagaacgagauggaggagaucuuccaccagauccugcagaccaugcccggcaucgccaccuucagcagcagaccccaggccgugcagggcggcaaggcccugaugugcgugcugagagccuucagcaagaacgaggagaaggccuacaaggagacccaggagacccaggagagagacacccugaacaaggaccacggcaacgacaaggagagcaacgugcugcaccaguaa

SEQ ID NO: 20126 - RNA, 921 nt, Artificial Sequence
  MTL5__Homo_sapiens__NP_001034745
auggaggagggcccccugcccggcggccugcccagccccgaggacgccauggugaccgagcugcugagccccgagggccccuucgccagcgagaacaucggccugaaggcccccgugaaguacgaggaggacgaguuccacguguucaaggaggccuaccugggccccgccgaccccaaggagcccgugcugcacgccuucaaccccgcccugggcgccgacugcaagggccaggugaaggccaagcuggccggcggcgacagcgacggcggcgagcugcugggcgaguaccccggcauccccgagcugagcgcccuggaggacguggcccugcugcaggccccccagccccccgccugcaacgugcacuuccugagcagccugcugcccgcccacagaagccccgccgugcugccccugggcgccugggugcuggagggcgccagccaccccggcgugagaaugauccccguggagaucaaggaggccggcggcaccaccaccagcaacaaccccgaggaggccacccugcagaaccugcuggcccaggagagcugcugcaaguuccccagcagccaggagcuggaggacgccagcugcugcagccugaagaaggacagcaaccccauggugaucugccagcugaagggcggcacccagaugcugugcaucgacaacagcagaaccagagagcugaaggcccugcaccuggugccccaguaccaggaccagaacaacuaccugcagagcgacgugcccaagcccaugaccgcccuggugggcagauuccugcccgccagcaccaagcugaaccugaucacccagcagcuggagggcgcccugcccagcguggugaacggcagcgccuuccccagcggcagcacccugcccggcccccccaagaucacccuggccggcuaa

SEQ ID NO: 20127 - RNA, 1812 nt, Artificial Sequence
  MTM1__Homo_sapiens__XP_011529475
auggccagcgccagcaccagcaaguacaacagccacagccuggagaacgagagcaucaagagaaccagcagagacggcgugaacagagaccugaccgaggccgugcccagacugcccggcgagacccugaucaccgacaaggaggugaucuacaucugccccuucaacggccccaucaagggcagaguguacaucaccaacuacagacuguaccugagaagccuggagaccgacagcagccugauccuggacgugccccugggcgugaucagcagaaucgagaagaugggcggcgccaccagcagaggcgagaacagcuacggccuggacaucaccugcaaggacaugagaaaccugagauucgcccugaagcaggagggccacagcagaagagacauguucgagauccugaccagauacgccuucccccuggcccacagccugccccuguucgccuuccugaacgaggagaaguucaacguggacggcuggaccguguacaaccccguggaggaguacagaagacagggccugcccaaccaccacuggagaaucaccuucaucaacaagugcuacgagcugugcgacaccuaccccgcccugcugguggugcccuacagagccagcgacgacgaccugagaagaguggccaccuucagaagcagaaacagaauccccgugcugagcuggauccaccccgagaacaagaccgugaucgugagaugcagccagccccuggugggcaugagcggcaagagaaacaaggacgacgagaaguaccuggacgugaucagagagaccaacaagcagaucagcaagcugaccaucuacgacgccagacccagcgugaacgccguggccaacaaggccaccggcggcggcuacgagagcgacgacgccuaccacaacgccgagcuguucuuccuggacauccacaacauccacgugaugagagagagccugaagaaggugaaggacaucguguaccccaacguggaggagagccacuggcugagcagccuggagagcacccacuggcuggagcacaucaagcuggugcugaccggcgccauccagguggccgacaaggugagcagcggcaagagcagcgugcuggugcacugcagcgacggcugggacagaaccgcccagcugaccagccuggccaugcugaugcuggacagcuucuacagaagcaucgagggcuucgagauccuggugcagaaggaguggaucagcuucggccacaaguucgccagcagaaucggccacggcgacaagaaccacaccgacgccgacagaagccccaucuuccugcaguucaucgacugcguguggcagaugagcaagcaguuccccaccgccuucgaguucaacgagcaguuccugaucaucauccuggaccaccuguacagcugcagauucggcaccuuccuguucaacugcgagagcgccagagagagacagaaggugaccgagagaaccgugagccuguggagccugaucaacagcaacaaggagaaguucaagaaccccuucuacaccaaggagaucaacagagugcuguaccccguggccagcaugagacaccuggagcugugggugaacuacuacaucagauggaaccccagaaucaagcagcagcagcccaaccccguggagcagagauacauggagcugcuggcccugagagacgaguacaucaagagacuggaggagcugcagcuggccaacagcgccaagcugagcgacccccccaccagccccagcagccccagccagaugaugccccacgugcagacccacuucuaa

SEQ ID NO: 20128 - RNA, 1239 nt, Artificial Sequence
  MTMR11__Homo_sapiens__XP_011507401
augugguggggcggcagaggccagagcuucaacaucgccccccagaaggaggagcccgagaugggcagcgugcaggagaacagaaugcccgagcccagaagcagacagcccagcagcugccuggccagcagaugccugcccggcgagcagauccuggccugggcccccggcgugagaaagggccuggagcccgagcugagcggcacccugaucugcaccaacuucagagugaccuuccagcccugcggcuggcaguggaaccaggacaccccccugaacagcgaguacgacuucgcccuggugaacaucggcagacuggaggccgugagcggccugagcagagugcagcugcugagacccggcagccugcacaaguucauccccgaggagauccugauccacggcagagacuucagacugcugagagugggcuucgaggccggcggccuggagccccaggccuuccaggugaccauggccaucgugcaggccagagcccagagcaaccaggcccagcaguacagcggcaucacccugagcaaggccggccagggcagcggcagcagaaagccccccaucccccugauggagaccgccgaggacugggagaccgagagaaagaagcaggccgccagaggcuggagagugagcaccgugaacgagagauucgacguggccaccagccugcccagauacuucugggugcccaacagaauccuggacagcgaggugagaagagccuucggccacuuccaccagggcagaggccccagacugagcuggcaccaccccggcggcagcgaccugcugagaugcggcggcuucuacaccgccagcgaccccaacaaggaggacaucagagccguggagcugaugcugcaggccggccacagcgacguggugcugguggacaccauggacgagcugcccagccuggccgacgugcagcuggcccaccugagacugagagcccugugccugcccgacagcagcguggccgaggacaaguggcugagcgcccuggagggcaccagauggcuggacuacgugagagccugccugagaaaggccagcgacaucagcgugcuggugaccagcagagugagaagcgugauccugcaggccgccuucagccccagaagccccaacaccguguggcugcccaucaccagcaccgccagagugggcggcagcuggaccagccugcccgacagcgccuggggcaacuggggccaguaa

SEQ ID NO: 20129 - RNA, 2244 nt, Artificial Sequence
  MTMR12__Homo_sapiens__NP_001035536
augcugggcaagggcguggugggcggcggcggcggcaccaaggcccccaagcccagcuucgugagcuacgugagacccgaggagauccacaccaacgagaaggaggugaccgagaaggaggugacccugcaccugcugcccggcgagcagcugcugugcgaggccagcaccgugcugaaguacgugcaggaggacagcugccagcacggcguguacggcagacuggugugcaccgacuucaagaucgccuuccugggcgacgacgagagcgcccuggacaacgacgagacccaguucaagaacaaggugaucggcgagaacgacaucacccugcacugcguggaccagaucuacggcguguucgacgagaagaagaagacccuguucggccagcugaagaaguaccccgagaagcugaucauccacugcaaggaccugagaguguuccaguucugccugagauacaccaaggaggaggaggugaagagaaucgugagcggcaucauccaccacacccaggcccccaagcugcugaagagacuguuccuguucagcuacgccaccgccgcccagaacaacaccgugaccgaccccaagaaccacaccgugauguucgacacccugaaggacuggugcugggagcuggagagaaccaagggcaacaugaaguacaaggccgugagcgugaacgagggcuacaaggugugcgagagacugcccgccuacuucguggugcccaccccccugcccgaggagaacgugcagagauuccagggccacggcauccccaucuggugcuggagcugccacaacggcagcgcccugcugaagaugagcgcccugcccaaggagcaggacgacggcauccugcagauccagaagagcuuccuggacggcaucuacaagaccauccacagaccccccuacgagaucgugaagaccgaggaccugagcagcaacuuccugagccugcaggagauccagaccgccuacagcaaguucaagcagcuguuccugaucgacaacagcaccgaguucugggacaccgacaucaagugguucagccugcuggagagcagcagcuggcuggacaucaucagaagaugccugaagaaggccaucgagaucaccgagugcauggaggcccagaacaugaacgugcugcugcuggaggagaacgccagcgaccugugcugccugaucagcagccuggugcagcugaugauggacccccacugcagaaccagaaucggcuuccagagccugauccagaaggagugggugaugggcggccacugcuuccuggacagaugcaaccaccugagacagaacgacaaggaggaggugcccguguuccugcuguuccuggacugcguguggcagcuggugcaccagcacccccccgccuucgaguucaccgagaccuaccugaccgugcugagcgacagccuguacauccccaucuucagcaccuucuucuucaacagcccccaccagaaggacaccaacaugggcagagagggccaggacacccagagcaagccccugaaccugcugaccgugugggacuggagcgugcaguucgagcccaaggcccagacccugcugaagaacccccuguacguggagaagcccaagcuggacaagggccagagaaagggcaugagauucaagcaccagagacagcugagccugccccugacccagagcaagagcagccccaagagaggcuucuucagagaggagaccgaccaccugaucaagaaccugcugggcaagagaaucagcaagcugaucaacagcagcgacgagcugcaggacaacuucagagaguucuacgacagcuggcacagcaagagcaccgacuaccacggccugcugcugccccacaucgagggccccgagaucaaggugugggcccagagauaccugagauggauccccgaggcccagauccugggcggcggccagguggccacccugagcaagcugcuggagaugauggaggaggugcagagccugcaggagaagaucgacgagagacaccacagccagcaggccccccaggccgaggcccccugccugcugagaaacagcgccagacugagcagccuguuccccuucgcccugcugcagagacacagcagcaagcccgugcugcccaccagcggcuggaaggcccugggcgacgaggacgaccuggccaagagagaggacgaguucguggaccugggcgacguguaa

SEQ ID NO: 20130 - RNA, 1953 nt, Artificial Sequence
  MTMR14__Homo_sapiens__NP_001070993
auggccggcgccagagccgccgccgccgccgccagcgccggcagcagcgccagcagcggcaaccagcccccccaggagcugggccugggcgagcugcuggaggaguucagcagaacccaguacagagccaaggacggcagcggcaccggcggcagcaagguggagagaaucgagaagagaugccuggagcuguucggcagagacuacugcuucagcgugauccccaacaccaacggcgacaucugcggccacuaccccagacacaucguguuccuggaguacgagagcagcgagaaggagaaggacaccuucgagagcaccgugcaggugagcaagcugcaggaccugauccacagaagcaagauggccagaugcagaggcagauucgugugccccgugauccuguucaagggcaagcacaucugcagaagcgccacccuggccggcuggggcgagcuguacggcagaagcggcuacaacuacuucuucagcggcggcgccgacgacgccugggccgacguggaggacgugaccgaggaggacugcgcccugagaagcggcgacacccaccuguucgacaaggugagaggcuacgacaucaagcugcugagauaccugagcgugaaguacaucugcgaccugaugguggagaacaagaaggugaaguucggcaugaacgugaccagcagcgagaagguggacaaggcccagagauacgccgacuucacccugcugagcauccccuaccccggcugcgaguucuucaaggaguacaaggacagagacuacauggccgagggccugaucuucaacuggaagcaggacuacguggacgccccccugagcauccccgacuuccugacccacagccugaacaucgacuggagccaguaccagugcugggaccuggugcagcagacccagaacuaccugaagcugcugcugagccuggugaacagcgacgacgacagcggccugcuggugcacugcaucagcggcugggacagaaccccccuguucaucagccugcugagacugagccugugggccgacggccugauccacaccagccugaagcccaccgagauccuguaccugaccguggccuacgacugguuccuguucggccacaugcugguggacagacugagcaagggcgaggagaucuucuucuucugcuucaacuuccugaagcacaucaccagcgaggaguucagcgcccugaagacccagagaagaaagagccugcccgccagagacggcggcuucacccuggaggacaucugcaugcugagaagaaaggacagaggcagcaccaccagccugggcagcgacuucagccuggugauggagagcagccccggcgccaccggcagcuucaccuacgaggccguggagcuggugcccgccggcgcccccacccaggccgccuggagaaagagccacagcagcagcccccagagcgugcuguggaacagaccccagcccagcgaggacagacugcccagccagcagggccuggccgaggccagaagcagcagcagcagcagcagcaaccacagcgacaacuucuucagaaugggcagcagcccccuggaggugcccaagcccagaagcguggaccacccccugcccggcagcagccugagcaccgacuacggcagcuggcagauggugaccggcugcggcagcauccaggagagagccgugcugcacaccgacagcagccugcccuucagcuuccccgacgagcugcccaacagcugccugcuggccgcccugagcgacagagagaccagacugcaggaggugagaagcgccuuccuggccgccuacagcagcaccgugggccugagagccguggcccccagccccagcggcgccaucggcggccugcuggagcaguucgccagaggcgugggccugagaagcaucagcagcaacgcccuguaa

SEQ ID NO: 20131 - RNA, 1998 nt, Artificial Sequence
  MTMR1__Homo_sapiens__NP_003819
auggacagacccgccgccgccgccgccgccggcugcgagggcggcggcggccccaaccccggccccgccggcggcagaagaccccccagagccgccggcggcgccaccgccggcagcagacagcccagcguggagacccuggacagccccaccggcagccacguggaguggugcaagcagcugaucgccgccaccaucagcagccagaucagcggcagcgugaccagcgagaacgugagcagagacuacaaggcccugagagacggcaacaagcuggcccagauggaggaggccccccuguuccccggcgagagcaucaaggccaucgugaaggacgugauguacaucugccccuucaugggcgccgugagcggcacccugaccgugaccgacuucaagcuguacuucaagaacguggagagagacccccacuucauccuggacgugccccugggcgugaucagcagaguggagaagaucggcgcccagagccacggcgacaacagcugcggcaucgagaucgugugcaaggacaugagaaaccugagacuggccuacaagcaggaggagcagagcaagcugggcaucuucgagaaccugaacaagcacgccuucccccugagcaacggccaggcccuguucgccuucagcuacaaggagaaguuccccaucaacggcuggaagguguacgaccccgugagcgaguacaagagacagggccugcccaacgagagcuggaagaucagcaagaucaacagcaacuacgaguucugcgacaccuaccccgccaucaucguggugcccaccagcgugaaggacgacgaccugagcaagguggccgccuucagagccaagggcagagugcccgugcugagcuggauccaccccgagagccaggccaccaucaccagaugcagccagccccuggugggccccaacgacaagagaugcaaggaggacgagaaguaccugcagaccaucauggacgccaacgcccagagccacaagcugaucaucuucgacgccagacagaacagcguggccgacaccaacaagaccaagggcggcggcuacgagagcgagagcgccuaccccaacgccgagcugguguuccuggagauccacaacauccacgugaugagagagagccugagaaagcugaaggagaucguguaccccagcaucgacgaggccagauggcugagcaacguggacggcacccacuggcuggaguacaucagaaugcugcuggccggcgccgugagaaucgccgacaagaucgagagcggcaagaccagcgugguggugcacugcagcgacggcugggacagaaccgcccagcugaccagccuggccaugcugaugcuggacagcuacuacagaaccaucaagggcuucgagacccugguggagaaggaguggaucagcuucggccacagauucgcccugagagugggccacggcaacgacaaccacgccgacgccgacagaagccccaucuuccugcaguucguggacugcguguggcagaugaccagacaguuccccagcgccuucgaguucaacgagcuguuccugaucaccauccuggaccaccuguacagcugccuguucggcaccuuccugugcaacugcgagcagcagagauucaaggaggacguguacaccaagaccaucagccuguggagcuacaucaacagccagcuggacgaguucagcaaccccuucuucgugaacuacgagaaccacgugcuguaccccguggccagccugagccaccuggagcugugggugaacuacuacgugagauggaaccccagaaugagaccccagaugcccauccaccagaaccugaaggagcugcuggccgugagagccgagcugcagaagagaguggagggccugcagagagagguggccaccagagccgugagcagcagcagcgagagaggcagcagccccagccacagcgccaccagcgugcacaccagcguguaa

SEQ ID NO: 20132 - RNA, 1932 nt, Artificial Sequence
  MTMR2__Homo_sapiens__NP_057240
auggagaagagcagcagcugcgagagccugggcagccagcccgccgccgccagaccccccagcguggacagccugagcagcgccagcaccagccacagcgagaacagcgugcacaccaagagcgccagcguggugagcagcgacagcaucagcaccagcgccgacaacuucagccccgaccugagagugcugagagagagcaacaagcuggccgagauggaggagcccccccugcugcccggcgagaacaucaaggacauggccaaggacgugaccuacaucugccccuucaccggcgccgugagaggcacccugaccgugaccaacuacagacuguacuucaagagcauggagagagacccccccuucgugcuggacgccagccugggcgugaucaacagaguggagaagaucggcggcgccagcagcagaggcgagaacagcuacggccuggagaccgugugcaaggacaucagaaaccugagauucgcccacaagcccgagggcagaaccagaagaagcaucuucgagaaccugaugaaguacgccuuccccgugagcaacaaccugccccuguucgccuucgaguacaaggagguguuccccgagaacggcuggaagcuguacgacccccugcuggaguacagaagacagggcauccccaacgagagcuggagaaucaccaagaucaacgagagauacgagcugugcgacaccuaccccgcccugcugguggugcccgccaacauccccgacgaggagcugaagagaguggccagcuucagaagcagaggcagaauccccgugcugagcuggauccaccccgagagccaggccaccaucaccagaugcagccagcccauggugggcgugagcggcaagagaagcaaggaggacgagaaguaccugcaggccaucauggacagcaacgcccagagccacaagaucuucaucuucgacgccagacccagcgugaacgccguggccaacaaggccaagggcggcggcuacgagagcgaggacgccuaccagaacgccgagcugguguuccuggacauccacaacauccacgugaugagagagagccugagaaagcugaaggagaucguguaccccaacaucgaggagacccacuggcugagcaaccuggagagcacccacuggcuggagcacaucaagcugauccuggccggcgcccugagaaucgccgacaagguggagagcggcaagaccagcgugguggugcacugcagcgacggcugggacagaaccgcccagcugaccagccuggccaugcugaugcuggacggcuacuacagaaccaucagaggcuucgaggugcugguggagaaggaguggcugagcuucggccacagauuccagcugagagugggccacggcgacaagaaccacgccgacgccgacagaagccccguguuccugcaguucaucgacugcguguggcagaugaccagacaguuccccaccgccuucgaguucaacgaguacuuccugaucaccauccuggaccaccuguacagcugccuguucggcaccuuccugugcaacagcgagcagcagagaggcaaggagaaccugcccaagagaaccgugagccuguggagcuacaucaacagccagcuggaggacuucaccaacccccuguacggcagcuacagcaaccacgugcuguaccccguggccagcaugagacaccuggagcugugggugggcuacuacaucagauggaaccccagaaugaagccccaggagcccauccacaacagauacaaggagcugcuggccaagagagccgagcugcagaagaagguggaggagcugcagagagagaucagcaacagaagcaccagcagcagcgagagagccagcagccccgcccagugcgugacccccgugcagaccgugguguaa

SEQ ID NO: 20133 - RNA, 3597 nt, Artificial Sequence
  MTMR3__Homo_sapiens__NP_066576
auggacgaggagaccagacacagccuggagugcauccaggccaaccagaucuuccccagaaagcagcugaucagagaggacgagaaccugcaggugcccuuccuggagcugcacggcgagagcaccgaguucgugggcagagccgaggacgccaucaucgcccugagcaacuacagacugcacaucaaguucaaggagagccuggugaacgugccccugcagcugaucgagagcguggagugcagagacaucuuccagcugcaccugaccugcaaggacugcaaggugaucagaugccaguucagcaccuucgagcagugccaggaguggcugaagagacugaacaacgccaucagaccccccgccaagaucgaggaccuguucagcuucgccuaccacgccuggugcauggagguguacgccagcgagaaggagcagcacggcgaccugugcagacccggcgagcacgugaccagcagauucaagaacgagguggagagaaugggcuucgacaugaacaacgccuggagaaucagcaacaucaacgagaaguacaagcugugcggcagcuacccccaggagcugaucgugcccgccuggaucaccgacaaggagcuggagagcgugagcagcuucagaagcuggaagagaauccccgccgugaucuacagacaccagagcaacggcgccgugaucgccagaugcggccagcccgaggugagcugguggggcuggagaaacgccgacgacgagcaccuggugcagagcguggccaaggccugcgccagcgacagcagaagcagcggcagcaagcugagcaccagaaacaccagcagagacuuccccaacggcggcgaccugagcgacguggaguucgacagcagccugagcaacgccagcggcgccgagagccuggccauccagccccagaagcugcugauccuggacgccagaagcuacgccgccgccguggccaacagagccaagggcggcggcugcgagugccccgaguacuaccccaacugcgaggugguguucaugggcauggccaacauccacagcaucagaagaagcuuccagagccugagacugcugugcacccagaugcccgaccccggcaacuggcugagcgcccuggagagcaccaaguggcugcaccaccugagcgugcugcugaagagcgcccugcugguggugcacgccguggaccaggaccagagacccgugcuggugcacugcagcgacggcugggacagaaccccccagaucguggcccuggccaagcugcugcuggaccccuacuacagaaccaucgagggcuuccaggugcugguggagauggaguggcuggacuucggccacaaguucgccgacagaugcggccacggcgagaacagcgacgaccugaacgagagaugccccguguuccugcaguggcuggacugcgugcaccagcugcagagacaguuccccugcagcuucgaguucaacgaggccuuccuggugaagcuggugcagcacaccuacagcugccuguucggcaccuuccugugcaacaacgccaaggagagaggcgagaagcacacccaggagagaaccugcagcguguggagccugcugagagccggcaacaaggccuucaagaaccugcuguacagcagccagagcgaggccgugcuguaccccgugugccacgugagaaaccugaugcuguggagcgccguguaccugcccugccccagccccaccacccccguggacgacagcugcgcccccuaccccgcccccggcaccagccccgacgaccccccccugagcagacugcccaagaccagaagcuacgacaaccugaccaccgccugcgacaacaccgugccccuggccagcagaagaugcagcgaccccagccugaacgagaaguggcaggagcacagaagaagccuggagcugagcagccuggccggccccggcgaggacccccugagcgccgacagccugggcaagcccaccagagugcccggcggcgccgagcugagcguggccgccggcguggccgagggccagauggagaacauccugcaggaggccaccaaggaggagagcggcguggaggagcccgcccacagagccggcaucgagauccaggagggcaaggaggacccccugcuggagaaggagagcagaagaaagacccccgaggccagcgccaucggccugcaccaggaccccgagcugggcgacgccgcccugagaagccaccuggacaugagcuggccccuguucagccagggcaucagcgagcagcagagcggccugagcgugcugcugagcagccugcaggugccccccagaggcgaggacagccuggaggugcccguggagcaguucagaaucgaggagaucgccgagggcagagaggaggccgugcugcccauccccguggacgccaaggugggcuacggcaccagccagagcugcagccugcugcccagccaggugcccuucgagaccagaggccccaacguggacagcagcaccgacaugcugguggaggacaaggugaagagcgugagcggcccccagggccaccacagaagcugccuggugaacagcggcaaggacagacugccccagaccauggagcccagccccagcgagaccagccugguggagagaccccaggugggcagcguggugcacagaaccagccugggcagcacccugagccugaccagaagccccugcgcccugccccuggccgagugcaaggagggccuggugugcaacggcgcccccgagaccgagaacagagccagcgagcagccccccggccugagcacccugcagauguaccccacccccaacggccacugcgccaacggcgaggccggcagaagcaaggacagccugagcagacagcugagcgccaugagcugcagcagcgcccaccugcacagcagaaaccugcaccacaaguggcugcacagccacagcggcagacccagcgccaccagcagccccgaccagcccagcagaagccaccuggacgacgacggcaugagcguguacaccgacaccauccagcagagacugagacagaucgagagcggccaccagcaggagguggagacccugaagaagcaggugcaggagcugaagagcagacuggagagccaguaccugaccagcagccugcacuucaacggcgacuucggcgacgaggugaccagcauccccgacagcgagagcaaccuggaccagaacugccugagcagaugcagcaccgagaucuucagcgaggccagcugggagcagguggacaagcaggacaccgagaugaccagauggcugcccgaccaccuggccgcccacugcuacgccugcgacagcgccuucuggcuggccagcagaaagcaccacugcagaaacugcggcaacguguucugcagcagcugcugcaaccagaaggugcccgugcccagccagcagcuguucgagcccagcagagugugcaagagcugcuacagcagccugcaccccaccagcagcagcaucgaccuggagcuggacaagcccaucgccgccaccagcaacuaa

SEQ ID NO: 20134 - RNA, 3588 nt, Artificial Sequence
  MTMR4__Homo_sapiens__XP_006722231
augggcgaggagggcccccccagccuggaguacauccaggccaaggaccuguucccccccaaggagcuggugaaggaggaggagaaccugcaggugcccuucaccgugcugcagggcgagggcguggaguuccugggcagagccgccgacgcccugaucgccaucagcaacuacagacugcacaucaaguucaaggacagcgugaucaacgugccccugagaaugaucgacagcguggagagcagagacauguuccagcugcacaucagcugcaaggacagcaagguggugagaugccacuucagcaccuucaagcagugccaggaguggcugagcagacugagcagagccaccgccagacccgccaagcccgaggaccuguucgccuucgccuaccacgccuggugccugggccugaccgaggaggaccagcacacccaccugugccagcccggcgagcacaucagaugcagacaggaggccgagcuggccagaaugggcuucgaccugcagaacguguggagagugagccacaucaacagcaacuacaagcugugccccagcuacccccagaagcugcuggugcccguguggaucaccgacaaggagcuggagaacguggccagcuucagaagcuggaagagaauccccguggugguguacagacaccugagaaacggcgccgccaucgccagaugcagccagcccgagaucagcugguggggcuggagaaacgccgacgacgaguaccuggugaccagcaucgccaaggccugcgcccuggaccccggcaccagagccaccggcggcagccugagcaccggcaacaacgacaccagcgaggccugcgacgccgacuucgacagcagccugaccgccugcagcggcguggagagcaccgccgccccccagaagcugcugauccuggacgccagaagcuacaccgccgccguggccaacagagccaagggcggcggcugcgagugcgaggaguacuaccccaacugcgaggugguguucaugggcauggccaacauccacgccaucagaaacagcuuccaguaccugagagccgugugcagccagaugcccgaccccagcaacuggcugagcgcccuggagagcaccaaguggcugcagcaccugagcgugaugcugaaggccgccgugcugguggccaacaccguggacagagagggcagacccgugcuggugcacugcagcgacggcugggacagaaccccccagaucguggcccuggccaagauccugcuggaccccuacuacagaacccuggagggcuuccaggugcugguggagagcgacuggcuggacuucggccacaaguucggcgacagaugcggccaccaggagaacguggaggaccagaacgagcagugccccguguuccugcaguggcuggacagcgugcaccagcugcugaagcaguuccccugccuguucgaguucaacgaggccuuccuggugaagcuggugcagcacaccuacagcugccuguacggcaccuuccuggccaacaaccccugcgagagagagaagagaaacaucuacaagagaaccugcagcgugugggcccugcugagagccggcaacaagaacuuccacaacuuccuguacacccccagcagcgacauggugcugcaccccgugugccacgugagagcccugcaccuguggaccgccguguaccugcccgccagcagccccugcacccugggcgaggagaacauggaccuguaccugagccccguggcccagagccaggaguucagcggcagaagccuggacagacugcccaagaccagaagcauggacgaccugcugagcgccugcgacaccagcagcccccugaccagaaccagcagcgaccccaaccugaacaaccacugccaggaggugagagugggccuggagcccuggcacagcaaccccgagggcagcgagaccagcuucguggacagcggcgugggcggcccccagcagaccgugggcgaggugggccugccccccccccugcccagcagccagaaggacuaccugagcaacaagcccuucaagagccacaagagcugcagccccagcuacaagcugcugaacaccgccgugcccagagagaugaagagcaacaccagcgaccccgagaucaaggugcuggaggagaccaagggccccgcccccgaccccagcgcccaggacgagcugggcagaacccuggacggcaucggcgagccccccgagcacugccccgagaccgaggccgugagcgcccugagcaaggugaucagcaacaagugcgacggcgugugcaacuuccccgagagcagccagaacagccccaccggcaccccccagcaggcccagcccgacagcaugcugggcgugcccagcaagugcgugcuggaccacagccugagcaccgugugcaacccccccagcgccgccugccagaccccccuggaccccagcaccgacuuccugaaccaggaccccagcggcagcguggccagcaucagccaccaggagcagcugagcagcgugcccgaccugacccacggcgaggaggacaucggcaagagaggcaacaacagaaacggccagcugcuggagaaccccagauucggcaagaugccccuggagcuggugagaaagcccaucagccagagccagaucagcgaguucagcuuccugggcagcaacugggacagcuuccagggcauggugaccagcuuccccagcggcgaggccacccccagaagacugcugagcuacggcugcugcagcaagagacccaacagcaagcagaugagagccaccggccccugcuucggcggccagugggcccagagagagggcgugaagagccccgugugcagcagccacagcaacggccacugcaccggccccggcggcaagaaccagauguggcugagcagccaccccaagcaggugagcagcaccaagcccgugccccugaacugccccagccccgugcccccccuguaccuggacgacgacggccugcccuuccccaccgacgugauccagcacagacugagacagaucgaggccggcuacaagcaggagguggagcagcugagaagacaggugagagagcugcagaugagacuggacaucagacacugcugcgccccccccgccgagccccccauggacuacgaggacgacuucaccugccugaaggagagcgacggcagcgacaccgaggacuucggcagcgaccacagcgaggacugccugagcgaggccagcugggagcccguggacaagaaggagaccgaggugaccagaugggugcccgaccacauggccagccacugcuacaacugcgacugcgaguucuggcuggccaagagaagacaccacugcagaaacugcggcaacguguucugcgccggcugcugccaccugaagcugcccauccccgaccagcagcuguacgaccccgugcuggugugcaacagcugcuacgagcacauccaggugagcagagccagagagcugaugagccagcagcugaagaagcccaucgccaccgccagcagcuaa

SEQ ID NO: 20135 - RNA, 1866 nt, Artificial Sequence
  MTMR6__Homo_sapiens__NP_004676
auggagcacaucagaaccaccaagguggagcaggugaagcugcuggacagauucagcaccagcaacaagagccugaccggcacccuguaccugaccgccacccaccugcuguucaucgacagccaccagaaggagaccuggauccugcaccaccacaucgccagcguggagaagcuggcccugaccaccagcggcugcccccuggugauccagugcaagaacuucagaaccgugcacuucaucgugcccagagagagagacugccacgacaucuacaacagccugcugcagcugagcaagcaggccaaguacgaggaccuguacgccuucagcuacaaccccaagcagaacgacagcgagagacugcagggcuggcagcugaucgaccuggccgaggaguacaagagaaugggcgugcccaacagccacuggcagcugagcgacgccaacagagacuacaagaucugcgagaccuaccccagagagcuguacgugcccagaaucgccagcaagcccaucaucgugggcagcagcaaguucagaagcaagggcagauuccccgugcugagcuacuaccaccaggacaaggaggccgccaucugcagaugcagccagccccugagcggcuucagcgccagaugccuggaggacgagcaccugcugcaggccaucagcaaggccaaccccgugaacagauacauguacgugauggacaccagacccaagcugaacgccauggccaacagagccgccggcaagggcuacgagaacgaggacaacuacagcaacaucagauuccaguucgugggcaucgagaacauccacgugaugagaagcagccugcagaagcugcuggaggugaacggcaccaagggccugagcgugaacgacuucuacagcggccuggagagcagcggcuggcugagacacaucaaggccgugauggacgccgccaucuuccuggccaaggccaucaccguggagaacgccagcgugcuggugcacugcagcgacggcugggacagaaccagccaggugugcagccugggcagccugcugcuggacagcuacuacagaaccaucaagggcuucauggugcugaucgagaaggacuggaucagcuucggccacaaguucagcgagagaugcggccagcuggacggcgaccccaaggaggugagccccguguucacccaguuccuggagugcguguggcaccugaccgagcaguucccccaggccuucgaguucagcgaggccuuccugcugcagauccacgagcacauccacagcugccaguucggcaacuuccugggcaacugccagaaggagagagaggagcugaagcugaaggagaagaccuacagccuguggcccuuccugcuggaggaccagaagaaguaccugaacccccuguacagcagcgagagccacagauucaccgugcuggagcccaacaccgugagcuucaacuucaaguucuggagaaacauguaccaccaguucgacagaacccugcaccccagacagagcguguucaacaucaucaugaacaugaacgagcagaacaagcagcuggagaaggacaucaaggaccuggagagcaagaucaagcagagaaagaacaagcagaccgacggcauccugaccaaggagcugcugcacagcgugcaccccgagagccccaaccugaagaccagccugugcuucaaggagcagacccugcugcccgugaacgacgcccugagaaccaucgagggcagcagccccgccgacaacagauacagcgaguacgccgaggaguucagcaagagcgagcccgccguggugagccuggaguacggcguggccagaaugaccugcuaa

SEQ ID NO: 20136 - RNA, 1983 nt, Artificial Sequence
  MTMR7__Homo_sapiens__NP_004677
auggagcacaucagaacccccaagguggagaacgugagacugguggacagagugagccccaagaaggccgcccugggcacccuguaccugaccgccacccacgugaucuucguggagaacagccccgaccccagaaaggagaccuggauccugcacagccagaucagcaccaucgagaagcaggccaccaccgccaccggcugcccccugcugaucagaugcaagaacuuccagaucauccagcugaucaucccccaggagagagacugccacgacguguacaucagccugaucagacuggccagacccgugaaguacgaggagcuguacugcuucagcuucaaccccaugcuggacaaggaggagagagagcagggcugggugcugaucgaccugagcgaggaguacaccagaaugggccugcccaaccacuacuggcagcugagcgacgugaacagagacuacagagugugcgacagcuaccccaccgagcuguacgugcccaagagcgccaccgcccacaucaucgugggcagcagcaaguucagaagcagaagaagauuccccgugcugagcuacuacuacaaggacaaccacgccagcaucugcagaagcagccagccccugagcggcuucagcgccagaugccuggaggacgagcagaugcugcaggccaucagaaaggccaaccccggcagcgacuucguguacgugguggacaccagacccaagcugaacgccauggccaacagagccgccggcaagggcuacgagaacgaggacaacuacagcaacaucaaguuccaguucaucggcaucgagaacauccacgugaugagaaacagccugcagaagaugcuggaggugugcgagcugaagagccccagcaugagcgacuuccuguggggccuggagaacagcggcuggcugagacacaucaaggccaucauggacgccggcaucuucaucgccaaggccgugagcgaggagggcgccagcgugcuggugcacugcagcgacggcugggacagaaccgcccaggugugcagcguggccagccugcugcuggacccccacuacagaacccugaagggcuucauggugcugaucgagaaggacuggaucagcuucggccacaaguucaaccacagauacggcaaccuggacggcgaccccaaggagaucagccccgugaucgaccaguucaucgagugcguguggcagcugauggagcaguuccccugcgccuucgaguucaacgagagauuccugauccacauccagcaccacaucuacagcugccaguucggcaacuuccugugcaacagccagaaggagagaagagagcugaagauccaggagagaaccuacagccugugggcccaccuguggaagaacagagccgacuaccugaacccccuguucagagccgaccacagccagacccagggcacccugcaccugcccaccacccccugcaacuucauguacaaguucuggagcggcauguacaacagauucgagaagggcaugcagcccagacagagcgugaccgacuaccugauggccgugaaggaggagacccagcagcuggaggaggagcuggaggcccuggaggagagacuggagaagauccagaaggugcagcugaacugcaccaaggugaagagcaagcagagcgagcccagcaagcacagcggcuucagcaccagcgacaacagcaucgccaacaccccccaggacuacagcggcaacaugaagagcuuccccagcagaagccccagccagggcgacgaggacagcgcccugauccugacccaggacaaccugaagagcagcgaccccgaccugagcgccaacagcgaccaggagagcggcguggaggaccugagcugcagaagccccagcggcggcgagcacgcccccagcgaggacagcggcaaggacagagacagcgacgaggccguguuccugaccgccuaa

SEQ ID NO: 20137 - RNA, 2115 nt, Artificial Sequence
  MTMR8__Homo_sapiens__NP_060147
auggaccacaucaccgugcccaagguggagaacgugaagcugguggacagauacgugagcaagaagcccgccaacggcauccuguaccugaccgccacccaccugaucuacguggaggccagcggcgccgccagaaaggagaccuggaucgcccugcaccacaucgccaccguggagaagcugcccaucaccagccugggcugcccccugacccugagaugcaagaacuucagaguggcccacuucgugcuggacagcgaccuggugugccacgagguguacaucagccugcugaagcugagccagcccgcccugcccgaggaccuguacgccuucagcuacaaccccaagagcagcaaggagaugagagagagcggcuggaagcugaucgaccccaucagcgacuucggcagaaugggcauccccaacagaaacuggaccaucaccgacgccaacagaaacuacgagaucugcagcaccuacccccccgagaucguggugcccaagagcgugacccugggcaccguggugggcagcagcaaguucagaagcaaggagagagugcccgugcugagcuaccuguacaaggagaacaacgccgccaucugcagaugcagccagccccugagcggcuucuacaccagaugcguggacgacgagcugcugcuggaggccaucagccagaccaaccccggcagccaguucauguacgugguggacaccagacccaagcugaacgccauggccaacagagccgccggcaagggcuacgagaacgaggacaacuacgccaacaucagauucagauucaugggcaucgagaacauccacgugaugagaagcagccugcagaagcugcuggaggugugcgagcugaagacccccaccaugagcgaguuccugagcggccuggagagcagcggcuggcugagacacaucaaggccaucauggacgccggcaucuucaucaccaaggccgugaagguggagaaggccagcgugcuggugcacugcagcgacggcugggacagaaccgcccaggugugcagcguggccagcauccugcuggaccccuucuacagaaccuucaagggccugaugauccugaucgagaaggaguggaucagcaugggccacaaguucagccagagaugcggccaccuggacggcgacagcaaggaggugagccccaucuucacccaguuccuggacugcaucuggcagcugauggagcaguuccccugcgccuucgaguucaacgagaacuuccugcuggagauccacgaccacguguucagcugccaguucggcaacuuccugggcaacugccagaaggacagagaggaccugagaguguacgagaagacccacagcguguggcccuuccuggugcagagaaagcccgacuucagaaacccccuguacaagggcuucaccauguacggcgugcugaaccccagcaccgugcccuacaacauccaguucuggugcggcauguacaacagauucgacaagggccugcagcccaagcagagcaugcuggagagccugcuggagaucaagaagcagagagccaugcuggagaccgacgugcacgagcuggagaagaagcugaaggugagagacgagccccccgaggagaucugcaccugcagccagcugggcaacauccugagccagcaccugggcagcccccugaccaacccccugggcuucaugggcaucaacggcgaccugaacacccugauggagaacggcacccugagcagagagggcggccugagagcccagauggaccaggugaagagccagggcgccgaccugcaccacaacugcugcgagaucgugggcagccugagagccaucaacaucagcggcgacgugggcaucagcgaggccaugggcaucagcggcgacaugugcaccuucgaggccaccggcuucagcaaggaccugggcaucugcggcgccauggacaucagcgaggccaccggcaucagcggcaaccugggcaucagcgaggccagaggcuucagcggcgacaugggcauccugggcgacaccggcaucagcaaggccagcaccaaggaggccgacuacagcaagcaccaguaa

SEQ ID NO: 20138 - RNA, 1650 nt, Artificial Sequence
  MTMR9__Homo_sapiens__NP_056273
auggaguucgccgagcugaucaagacccccagaguggacaacguggugcugcacagacccuucuaccccgccguggagggcacccugugccugaccggccaccaccugauccugagcagcagacaggacaacaccgaggagcuguggcugcugcacagcaacaucgacgccaucgacaagagauucgugggcagccugggcaccaucaucaucaagugcaaggacuucagaaucauccagcuggacauccccggcauggaggagugccugaacaucgccagcagcaucgaggcccugagcacccuggacagcaucacccugauguaccccuucuucuacagacccauguucgaggugaucgaggacggcuggcacagcuuccugcccgagcaggaguucgagcuguacagcagcgccaccagcgaguggagacugagcuacgugaacaaggaguucgccgugugccccagcuacccccccaucgugaccgugcccaagagcaucgacgacgaggcccugagaaagguggccaccuucagacacggcggcagauuccccgugcugagcuacuaccacaagaagaacggcauggugaucaugagaagcggccagccccugaccggcaccaacggcagaagaugcaaggaggacgagaagcugaucaacgccacccugagagccggcaagagaggcuacaucaucgacaccagaagccugaacguggcccagcagaccagagccaagggcggcggcuucgagcaggaggcccacuacccccaguggagaagaauccacaagagcaucgagagauaccacauccugcaggagagccugaucaagcugguggaggccugcaacgaccagacccacaacauggacagauggcugagcaagcuggaggccagcaacuggcugacccacaucaaggagauccugaccaccgccugccuggccgcccagugcaucgacagagagggcgccagcauccugauccacggcaccgagggcaccgacagcacccugcaggugaccagccuggcccagaucauccuggagcccagaagcagaaccaucagaggcuucgaggcccugaucgagagagaguggcugcaggccggccaccccuuccagcagagaugcgcccagagcgccuacugcaacaccaagcagaagugggaggcccccguguuccugcuguuccuggacugcguguggcagauccugagacaguuccccugcagcuucgaguucaacgagaacuuccugaucaugcuguucgagcacgccuacgccagccaguucggcaccuuccugggcaacaacgagagcgagagaugcaagcugaagcugcagcagaagaccaugagccuguggagcugggugaaccagcccagcgagcugagcaaguucaccaacccccuguucgaggccaacaaccuggugaucuggcccagcguggccccccagagccugccccugugggagggcaucuuccugagauggaacagaagcagcaaguaccuggacgaggccuacgaggagauggugaacaucaucgaguacaacaaggagcugcaggccaaggugaacauccugagaagacagcuggccgagcuggagaccgaggacggcaugcaggagagccccuaa

SEQ ID NO: 20139 - RNA, 1053 nt, Artificial Sequence
  MTNR1A__Homo_sapiens__NP_005949
augcagggcaacggcagcgcccugcccaacgccagccagcccgugcugagaggcgacggcgccagacccagcuggcuggccagcgcccuggccugcgugcugaucuucaccaucgugguggacauccugggcaaccugcuggugauccugagcguguacagaaacaagaagcugagaaacgccggcaacaucuucguggugagccuggccguggccgaccuggugguggccaucuaccccuacccccuggugcugaugagcaucuucaacaacggcuggaaccugggcuaccugcacugccaggugagcggcuuccugaugggccugagcgugaucggcagcaucuucaacaucaccggcaucgccaucaacagauacugcuacaucugccacagccugaaguacgacaagcuguacagcagcaagaacagccugugcuacgugcugcugaucuggcugcugacccuggccgccgugcugcccaaccugagagccggcacccugcaguacgaccccagaaucuacagcugcaccuucgcccagagcgugagcagcgccuacaccaucgccguggugguguuccacuuccuggugcccaugaucaucgugaucuucugcuaccugagaaucuggauccuggugcugcaggugagacagagagugaagcccgacagaaagcccaagcugaagccccaggacuucagaaacuucgugaccauguucgugguguucgugcuguucgccaucugcugggccccccugaacuucaucggccuggccguggccagcgaccccgccagcauggugcccagaauccccgaguggcuguucguggccagcuacuacauggccuacuucaacagcugccugaacgccaucaucuacggccugcugaaccagaacuucagaaaggaguacagaagaaucaucgugagccugugcaccgccagaguguucuucguggacagcagcaacgacguggccgacagagugaaguggaagcccagcccccugaugaccaacaacaacguggugaagguggacagcguguaa

SEQ ID NO: 20140 - RNA, 1089 nt, Artificial Sequence
  MTNR1B__Homo_sapiens__NP_005950
augagcgagaacggcagcuucgccaacugcugcgaggccggcggcugggccgugagacccggcuggagcggcgccggcagcgccagacccagcagaacccccagaccccccuggguggcccccgcccugagcgccgugcugaucgugaccaccgccguggacguggugggcaaccugcuggugauccugagcgugcugagaaacagaaagcugagaaacgccggcaaccuguuccuggugagccuggcccuggccgaccuggugguggccuucuaccccuacccccugauccugguggccaucuucuacgacggcugggcccugggcgaggagcacugcaaggccagcgccuucgugaugggccugagcgugaucggcagcguguucaacaucaccgccaucgccaucaacagauacugcuacaucugccacagcauggccuaccacagaaucuacagaagauggcacaccccccugcacaucugccugaucuggcugcugaccgugguggcccugcugcccaacuucuucgugggcagccuggaguacgaccccagaaucuacagcugcaccuucauccagaccgccagcacccaguacaccgccgccgugguggugauccacuuccugcugcccaucgccguggugagcuucugcuaccugagaaucugggugcuggugcugcaggccagaagaaaggccaagcccgagagcagacugugccugaagcccagcgaccugagaagcuuccugaccauguucgugguguucgugaucuucgccaucugcugggccccccugaacugcaucggccuggccguggccaucaacccccaggagauggccccccagauccccgagggccuguucgugaccagcuaccugcuggccuacuucaacagcugccugaacgccaucguguacggccugcugaaccagaacuucagaagagaguacaagagaauccugcuggcccuguggaaccccagacacugcauccaggacgccagcaagggcagccacgccgagggccugcagagccccgccccccccaucaucggcgugcagcaccaggccgacgcccuguaa

SEQ ID NO: 20141 - RNA, 2199 nt, Artificial Sequence
  MTO1__Homo_sapiens__NP_001116698
auguucuacuucagaggcugcggcagauggguggccgugagcuucaccaagcagcaguucccccuggccagacugagcagcgacagcgccgcccccagaaccccccacuucgacgugaucgugaucggcggcggccacgccggcaccgaggccgccaccgccgccgccagaugcggcagcagaacccugcugcugacccacagaguggacaccaucggccagaugagcugcaaccccagcuucggcggcaucggcaagggccaccugaugagagagguggacgcccuggacggccugugcagcagaaucugcgaccagagcggcgugcacuacaaggugcugaacagaagaaagggccccgccguguggggccugagagcccagaucgacagaaagcuguacaagcagaacaugcagaaggagauccugaacaccccccugcugaccgugcaggagggcgccguggaggaccugauccugaccgagcccgagcccgagcacaccggcaagugcagagugagcggcguggugcugguggacggcagcaccguguacgccgagagcgugauccugaccaccggcaccuuccugagaggcaugaucgugaucggccuggagacccaccccgccggcagacugggcgaccagcccagcaucggccuggcccagacccuggagaagcugggcuucguggugggcagacugaagaccggcaccccccccagaaucgccaaggagagcaucaacuucagcauccugaacaagcacauccccgacaaccccagcauccccuucagcuucaccaacgagaccguguggaucaagcccgaggaccagcugcccugcuaccugacccacaccaaccccagaguggacgagaucgugcugaagaaccugcaccugaacagccacgugaaggagaccaccagaggccccagauacugccccagcaucgagagcaaggugcugagauuccccaacagacugcaccagguguggcuggagcccgagggcauggacagcgaccugaucuacccccagggccugagcaugacccugcccgccgagcugcaggagaagaugaucaccugcaucagaggccuggagaaggccaaggugauccagcccggcuacggcgugcaguacgacuaccuggaccccagacagaucacccccagccuggagacccaccuggugcagagacuguucuucgccggccagaucaacggcaccaccggcuacgaggaggccgccgcccagaccgagugcugcagcguggccagacuggagugcagcgacaugaucagccagcugcaggccauccugcugccccagcccagccugguggccggcaccgccggcaugcaccacaacacccagggcgugaucgccggcaucaacgccagccugagagugagcagaaagccccccuucguggugagcagaaccgagggcuacaucggcgugcugaucgacgaccugaccacccugggcaccagcgagcccuacagaauguucaccagcagaguggaguucagacugagccugagacccgacaacgccgacagcagacugacccugagaggcuacaaggacgccggcugcgugagccagcagagauacgagagagccugcuggaugaagagcagccuggaggagggcaucagcgugcugaagagcaucgaguuccugagcagcaaguggaagaagcugauccccgaggccagcaucagcaccagcagaagccugcccgugagagcccuggacgugcugaaguacgaggagguggacauggacagccuggccaaggccgugcccgagccccugaagaaguacaccaagugcagagagcuggccgagagacugaagaucgaggccaccuacgagagcgugcuguuccaccagcugcaggagaucaagggcgugcagcaggacgaggcccugcagcugcccaaggaccuggacuaccugaccaucagagacgugagccugagccacgaggugagagagaagcugcacuucagcagaccccagaccaucggcgccgccagcagaauccccggcgugacccccgccgccaucaucaaccugcugagauucgugaagaccacccagagaagacagagcgccaugaacgagagcagcaagaccgaccaguaccugugcgacgccgacagacugcaggagagagagcuguaa

SEQ ID NO: 20142 - RNA, 1749 nt, Artificial Sequence
  MTPAP__Homo_sapiens__NP_060579
auggccgugcccggcgugggccugcugaccagacugaaccugugcgccagaagaagaaccagagugcagagacccaucgugagacugcugagcugccccggcaccguggccaaggaccugagaagagacgagcagcccagcggcagcguggagaccggcuucgaggacaagauccccaagagaagauucagcgagaugcagaacgagagaagagagcaggcccagagaaccgugcugauccacugccccgagaagaucagcgagaacaaguuccugaaguaccugagccaguucggccccaucaacaaccacuucuucuacgagagcuucggccuguacgccgugguggaguucugccagaaggagagcaucggcagccugcagaacggcacccacacccccagcaccgccauggagaccgccauccccuucagaagcagauucuucaaccugaagcugaagaaccagaccagcgagagaagcagagugagaagcagcaaccagcugcccagaagcaacaagcagcuguucgagcugcugugcuacgccgagagcaucgacgaccagcugaacacccugcugaaggaguuccagcugaccgaggagaacaccaagcugagauaccugaccugcagccugaucgaggacauggccgccgccuacuuccccgacugcaucgugagacccuucggcagcagcgugaacaccuucggcaagcugggcugcgaccuggacauguuccuggaccuggacgagaccagaaaccugagcgcccacaagaucagcggcaacuuccugauggaguuccaggugaagaacgugcccagcgagagaaucgccacccagaagauccugagcgugcugggcgagugccuggaccacuucggccccggcugcgugggcgugcagaagauccugaacgccagaugcccccuggugagauucagccaccaggccagcggcuuccagugcgaccugaccaccaacaacagaaucgcccugaccagcagcgagcugcuguacaucuacggcgcccuggacagcagagugagagcccugguguucagcgugagaugcugggccagagcccacagccugaccagcagcauccccggcgccuggaucaccaacuucagccugaccaugauggugaucuucuuccugcagagaagaagcccccccauccugcccacccuggacagccugaagacccuggccgacgccgaggacaagugcgugaucgagggcaacaacugcaccuucgugagagaccugagcagaaucaagcccagccagaacaccgagacccuggagcugcugcugaaggaguucuucgaguacuucggcaacuucgccuucgacaagaacagcaucaacaucagacagggcagagagcagaacaagcccgacagcagcccccuguacauccagaaccccuucgagaccagccugaacaucagcaagaacgugagccagagccagcugcagaaguucguggaccuggccagagagagcgccuggauccugcagcaggaggacaccgacagacccagcaucagcagcaacagacccuggggccuggugagccugcugcugcccagcgcccccaacagaaagagcuucaccaagaagaagagcaacaaguucgccaucgagaccgugaagaaccugcuggagagccugaagggcaacagaaccgagaacuucaccaagaccagcggcaagagaaccaucagcacccagaccuaa

SEQ ID NO: 20143 - RNA, 357 nt, Artificial Sequence
  MTPN__Homo_sapiens__NP_665807
augugcgacaaggaguucaugugggcccugaagaacggcgaccuggacgaggugaaggacuacguggccaagggcgaggacgugaacagaacccuggagggcggcagaaagccccugcacuacgccgccgacugcggccagcuggagauccuggaguuccugcugcugaagggcgccgacaucaacgcccccgacaagcaccacaucaccccccugcugagcgccguguacgagggccacgugagcugcgugaagcugcugcugagcaagggcgccgacaagaccgugaagggccccgacggccugaccgccuucgaggccaccgacaaccaggccaucaaggcccugcugcaguaa

SEQ ID NO: 20144 - RNA, 1338 nt, Artificial Sequence
  MTRF1__Homo_sapiens__XP_006719963
augaacagacaccugugcguguggcuguucagacaccccagccugaacggcuaccugcagugccacauccagcugcacagccaccaguucagacagauccaccuggacaccagacugcagguguucagacagaacagaaacugcauccugcaccugcugagcaagaacuggagcagaagauacugccaccaggacaccaagaugcuguggaagcacaaggcccugcagaaguacauggagaaccugagcaaggaguaccagacccuggagcagugccugcagcacauccccgugaacgaggagaacagaagaagccugaacagaagacacgccgagcuggccccccuggccgccaucuaccaggagauccaggagaccgagcaggccaucgaggagcuggagagcaugugcaagagccugaacaagcaggacgagaagcagcugcaggagcuggcccuggaggagagacagaccaucgaccagaagaucaacaugcuguacaacgagcuguuccagagccuggugcccaaggagaaguacgacaagaacgacgugauccuggaggugaccgccggcagaaccaccggcggcgacaucugccagcaguucaccagagagaucuucgacauguaccagaacuacagcugcuacaagcacuggcaguucgagcugcugaacuacacccccgccgacuacggcggccugcaccacgccgccgccagaaucagcggcgacggcguguacaagcaccugaaguacgagggcggcauccacagagugcagagaauccccgaggugggccugagcagcagaaugcagagaauccacaccggcaccaugagcgugaucgugcugccccagcccgacgagguggacgugaagcuggaccccaaggaccugagaaucgacaccuucagagccaagggcgccggcggccagcacgugaacaagaccgacagcgccgugagacuggugcacauccccaccggccuggugguggagugccagcaggagagaagccagaucaagaacaaggagaucgccuucagagugcugagagccagacuguaccagcagaucaucgagaaggacaagagacagcagcagagcgccagaaagcugcaggugggcaccagagcccagagcgagagaaucagaaccuacaacuucacccaggacagagugagcgaccacagaaucgccuacgaggugagagacaucaaggaguuccugugcggcggcaagggccuggaccagcugauccagagacugcugcagagcgccgacgaggaggccaucgccgagcugcuggacgagcaccugaagagcgccaaguaa

SEQ ID NO: 20145 - RNA, 3798 nt, Artificial Sequence
  MTR__Homo_sapiens__NP_000245
augagccccgcccugcaggaccugagccagcccgagggccugaagaagacccugagagacgagaucaacgccauccugcagaagagaaucauggugcuggacggcggcaugggcaccaugauccagagagagaagcugaacgaggagcacuucagaggccaggaguucaaggaccacgccagaccccugaagggcaacaacgacauccugagcaucacccagcccgacgugaucuaccagauccacaaggaguaccugcuggccggcgccgacaucaucgagaccaacaccuucagcagcaccagcaucgcccaggccgacuacggccuggagcaccuggccuacagaaugaacaugugcagcgccggcguggccagaaaggccgccgaggaggugacccugcagaccggcaucaagagauucguggccggcgcccugggccccaccaacaagacccugagcgugagccccagcguggagagacccgacuacagaaacaucaccuucgacgagcugguggaggccuaccaggagcaggccaagggccugcuggacggcggcguggacauccugcugaucgagaccaucuucgacaccgccaacgccaaggccgcccuguucgcccugcagaaccuguucgaggagaaguacgcccccagacccaucuucaucagcggcaccaucguggacaagagcggcagaacccugagcggccagaccggcgagggcuucgugaucagcgugagccacggcgagccccugugcaucggccugaacugcgcccugggcgccgccgagaugagacccuucaucgagaucaucggcaagugcaccaccgccuacgugcugugcuaccccaacgccggccugcccaacaccuucggcgacuacgacgagacccccagcaugauggccaagcaccugaaggacuucgccauggacggccuggugaacaucgugggcggcugcugcggcagcacccccgaccacaucagagagaucgccgaggccgugaagaacugcaagcccagagugccccccgccaccgccuucgagggccacaugcugcugagcggccuggagcccuucagaaucggccccuacaccaacuucgugaacaucggcgagagaugcaacguggccggcagcagaaaguucgccaagcugaucauggccggcaacuacgaggaggcccugugcguggccaaggugcagguggagaugggcgcccaggugcuggacgugaacauggacgacggcaugcuggacggccccagcgccaugaccagauucugcaaccugaucgccagcgagcccgacaucgccaaggugccccugugcaucgacagcagcaacuucgccgugaucgaggccggccugaagugcugccagggcaagugcaucgugaacagcaucagccugaaggagggcgaggacgacuuccuggagaaggccagaaagaucaagaaguacggcgccgccaugguggugauggccuucgacgaggagggccaggccaccgagaccgacaccaagaucagagugugcaccagagccuaccaccugcuggugaagaagcugggcuucaaccccaacgacaucaucuucgaccccaacauccugaccaucggcaccggcauggaggagcacaaccuguacgccaucaacuucauccacgccaccaaggugaucaaggagacccugcccggcgccagaaucagcggcggccugagcaaccugagcuucagcuucagaggcauggaggccaucagagaggccaugcacggcguguuccuguaccacgccaucaagagcggcauggacaugggcaucgugaacgccggcaaccugcccguguacgacgacauccacaaggagcugcugcagcugugcgaggaccugaucuggaacaaggaccccgaggccaccgagaagcugcugagauacgcccagacccagggcaccggcggcaagaaggugauccagaccgacgaguggagaaacggccccguggaggagagacuggaguacgcccuggugaagggcaucgagaagcacaucaucgaggacaccgaggaggccagacugaaccagaagaaguaccccagaccccugaacaucaucgagggcccccugaugaacggcaugaagaucgugggcgaccuguucggcgccggcaagauguuccugccccaggugaucaagagcgccagagugaugaagaaggccgugggccaccugauccccuucauggagaaggagagagaggagaccagagugcugaacggcaccguggaggaggaggaccccuaccagggcaccaucgugcuggccaccgugaagggcgacgugcacgacaucggcaagaacaucgugggcguggugcugggcugcaacaacuucagagugaucgaccugggcgugaugacccccugcgacaagauccugaaggccgcccuggaccacaaggccgacaucaucggccugagcggccugaucacccccagccuggacgagaugaucuucguggccaaggagauggagagacuggccaucagaaucccccugcugaucggcggcgccaccaccagcaagacccacaccgccgugaagaucgcccccagauacagcgcccccgugauccacgugcuggacgccagcaagagcgugguggugugcagccagcugcuggacgagaaccugaaggacgaguacuucgaggagaucauggaggaguacgaggacaucagacaggaccacuacgagagccugaaggagagaagauaccugccccugagccaggccagaaagagcggcuuccagauggacuggcugagcgagccccaccccgugaagcccaccuucaucggcacccagguguucgaggacuacgaccugcagaagcugguggacuacaucgacuggaagcccuucuucgacguguggcagcugagaggcaaguaccccaacagaggcuuccccaagaucuucaacgacaagaccgugggcggcgaggccagaaagguguacgacgacgcccacaacaugcugaacacccugaucagccagaagaagcugagagccagaggcguggugggcuucuggcccgcccagagcauccaggacgacauccaccuguacgccgaggccgccgugccccaggccgccgagcccaucgccaccuucuacggccugagacagcaggccgagaaggacagcgccagcaccgagcccuacuacugccugagcgacuucaucgccccccugcacagcggcaucagagacuaccugggccuguucgccguggccugcuucggcguggaggagcugagcaaggccuacgaggacgacggcgacgacuacagcagcaucauggugaaggcccugggcgacagacuggccgaggccuucgccgaggagcugcacgagagagugagaagagagcugugggccuacugcggcagcgagcagcuggacguggccgaccugagaagacugagauacaagggcaucagacccgcccccggcuaccccagccagcccgaccacaccgagaagcugaccauguggagacuggccgacaucgagcagagcaccggcaucagacugaccgagagccuggccauggcccccgccagcgccgugagcggccuguacuucagcaaccugaagagcaaguacuucgccgugggcaagaucagcaaggaccagguggaggacuacgcccugagaaagaacaucagcguggccgagguggagaaguggcugggccccauccugggcuacgacaccgacuaa

SEQ ID NO: 20146 - RNA, 75 nt, Artificial Sequence
  MTRNR2L7__Homo_sapiens__NP_001177418
auggccaccggcggcuucggcugccugcugcugcugaucagagagaucgaccugagcgugaagagacagaucuaa

SEQ ID NO: 20147 - RNA, 2097 nt, Artificial Sequence
  MTRR__Homo_sapiens__NP_002445
augagaagauuccugcugcuguacgccacccagcagggccaggccaaggccaucgccgaggagaucugcgagcaggccguggugcacggcuucagcgccgaccugcacugcaucagcgagagcgacaaguacgaccugaagaccgagaccgccccccugguggugguggugagcaccaccggcaccggcgacccccccgacaccgccagaaaguucgugaaggagauccagaaccagacccugcccguggacuucuucgcccaccugagauacggccugcugggccugggcgacagcgaguacaccuacuucugcaacggcggcaagaucaucgacaagagacugcaggagcugggcgccagacacuucuacgacaccggccacgccgacgacugcgugggccuggagcuggugguggagcccuggaucgccggccuguggcccgcccugagaaagcacuucagaagcagcagaggccaggaggagaucagcggcgcccugcccguggccagccccgccagcagcagaaccgaccuggugaagagcgagcugcugcacaucgagagccagguggagcugcugagauucgacgacagcggcagaaaggacagcgaggugcugaagcagaacgccgugaacagcaaccagagcaacguggugaucgaggacuucgagagcagccugaccagaagcgugcccccccugagccaggccagccugaacauccccggccugccccccgaguaccugcaggugcaccugcaggagagccugggccaggaggagagccaggugagcgugaccagcgccgaccccguguuccaggugcccaucagcaaggccgugcagcugaccaccaacgacgccaucaagaccacccugcugguggagcuggacaucagcaacaccgacuucagcuaccagcccggcgacgccuucagcgugaucugccccaacagcgacagcgaggugcagagccugcugcagagacugcagcuggaggacaagagagagcacugcgugcugcugaagaucaaggccgacaccaagaagaagggcgccacccugccccagcacauccccgccggcugcagccugcaguucaucuucaccuggugccuggagaucagagccauccccaagaaggccuuccugagagcccugguggacuacaccagcgacagcgccgagaagagaagacugcaggagcugugcagcaagcagggcgccgccgacuacagcagauucgugagagacgccugcgccugccugcuggaccugcugcuggccuuccccagcugccagcccccccugagccugcugcuggagcaccugcccaagcugcagcccagacccuacagcugcgccagcagcagccuguuccaccccggcaagcugcacuucguguucaacaucguggaguuccugagcaccgccaccaccgaggugcugagaaagggcgugugcaccggcuggcuggcccugcugguggccagcgugcugcagcccaacauccacgccagccacgaggacagcggcaaggcccuggcccccaagaucagcaucagccccagaaccaccaacagcuuccaccugcccgacgaccccagcauccccaucaucauggugggccccggcaccggcaucgcccccuucaucggcuuccugcagcacagagagaagcugcaggagcagcaccccgacggcaacuucggcgccauguggcuguucuucggcugcagacacaaggacagagacuaccuguucagaaaggagcugagacacuuccugaagcacggcauccugacccaccugaaggugagcuucagcagagacgcccccgugggcgaggaggaggcccccgccaaguacgugcaggacaacauccagcugcacggccagcagguggccagaauccugcugcaggagaacggccacaucuacgugugcggcgacgccaagaacauggccaaggacgugcacgacgcccuggugcagaucaucagcaaggaggugggcguggagaagcuggaggccaugaagacccuggccacccugaaggaggagaagagauaccugcaggacaucuggagcuaa

SEQ ID NO: 20148 - RNA, 2193 nt, Artificial Sequence
  MTSS1__Homo_sapiens__NP_001269903
auggaggccgugaucgagaaggagugcagcgcccugggcggccuguuccagaccaucaucagcgacaugaagggcagcuaccccgugugggaggacuucaucaacaaggccggcaagcugcagagccagcugagaaccaccgugguggccgccgccgccuuccuggacgccuuccagaagguggccgacauggccaccaacaccagaggcggcaccagagagaucggcagcgcccugaccagaaugugcaugagacacagaagcaucgaggccaagcugagacaguucagcagcgcccugaucgacugccugaucaacccccugcaggagcagauggaggaguggaagaagguggccaaccagcuggacaaggaccacgccaaggaguacaagaaggccagacaggagaucaagaagaagagcagcgacacccugaagcugcagaagaaggccaagaagggcagaggcgacauccagccccagcuggacagcgcccugcaggacgugaacgacaaguaccugcugcuggaggagaccgagaagcaggccgugagaaaggcccugaucgaggagagaggcagauucugcaccuucaucagcaugcugagacccgugaucgaggaggagaucagcaugcugggcgagaucacccaccugcagaccaucagcgaggaccugaagagccugaccauggacccccacaagcugcccagcagcagcgagcaggugauccuggaccugaagggcagcgacuacagcuggagcuaccagaccccccccagcagccccagcaccaccaugagcagaaagagcagcgugugcagcagccugaacagcgugaacagcagcgacagcagaagcagcggcagccacagccacagccccagcagccacuacagauacagaagcagcaaccuggcccagcaggcccccgugagacugagcagcgugagcagccacgacagcggcuucaucagccaggacgccuuccagagcaagagccccagccccaugccccccgaggcccccaaccagaacagcagcagcagcgccagcagcgaggccagcgagaccugccagagcgugagcgagugcagcagccccaccagcgugagcagcggcagcaccaugggcgccugggugagcaccgagaaggacugggccaagcccggccccuacgaccagccccuggugaacacccugcagagaagaaaggagaagagagagcccgaccccaacggcggcggccccaccaccgccagcggcccccccgccgccgccgaggaggcccagagacccagaagcaugaccgugagcgccgccaccagacccggcgaggagauggaggccugcgaggagcuggcccuggcccugagcagaggccugcagcuggacacccagagaagcagcagagacagccugcagugcagcagcggcuacagcacccagaccaccacccccugcugcagcgaggacaccauccccagccaggugagcgacuacgacuacuucagcgugagcggcgaccaggaggccgaccagcaggaguucgacaagagcagcaccauccccagaaacagcgacaucagccagagcuacagaagaauguuccaggccaagagacccgccagcaccgccggccugcccaccacccugggccccgccauggugacccccggcguggccaccaucagaagaacccccagcaccaagcccagcgugagaagaggcaccaucggcgccggccccauccccaucaagacccccgugauccccgugaagacccccaccgugcccgaccugcccggcgugcugcccgccccccccgacggccccgaggagagaggcgagcacagccccgagagccccagcgugggcgagggcccccagggcgugaccagcaugcccagcagcauguggagcggccaggccagcgugaaccccccccugcccggccccaagcccagcauccccgaggagcacagacaggccauccccgagagcgaggccgaggaccaggagagagagccccccagcgccaccgugagccccggccagauccccgagagcgaccccgccgaccugagccccagagacaccccccagggcgaggacaugcugaacgccaucagaagaggcgugaagcugaagaagaccaccaccaacgacagaagcgcccccagauucagcuaa

SEQ ID NO: 20149 - RNA, 2685 nt, Artificial Sequence
  MTTP__Homo_sapiens__NP_000244
augauccugcuggccgugcuguuccugugcuucaucagcagcuacagcgccagcgugaagggccacaccaccggccugagccugaacaacgacagacuguacaagcugaccuacagcaccgaggugcugcuggacagaggcaagggcaagcugcaggacagcgugggcuacagaaucagcagcaacguggacguggcccugcuguggagaaaccccgacggcgacgacgaccagcugauccagaucaccaugaaggacgugaacguggagaacgugaaccagcagagaggcgagaagagcaucuucaagggcaagagccccagcaagaucaugggcaaggagaaccuggaggcccugcagagacccacccugcugcaccugauccacggcaaggugaaggaguucuacagcuaccagaacgaggccguggccaucgagaacaucaagagaggccuggccagccuguuccagacccagcugagcagcggcaccaccaacgagguggacaucagcggcaacugcaaggugaccuaccaggcccaccaggacaaggugaucaagaucaaggcccuggacagcugcaagaucgccagaagcggcuucaccacccccaaccaggugcugggcgugagcagcaaggccaccagcgugaccaccuacaagaucgaggacagcuucgugaucgccgugcuggccgaggagacccacaacuucggccugaacuuccugcagaccaucaagggcaagaucgugagcaagcagaagcuggagcugaagaccaccgaggccggccccagacugaugagcggcaagcaggccgccgccaucaucaaggccguggacagcaaguacaccgccauccccaucgugggccagguguuccagagccacugcaagggcugccccagccugagcgagcuguggagaagcaccagaaaguaccugcagcccgacaaccugagcaaggccgaggccgugagaaacuuccuggccuucauccagcaccugagaaccgccaagaaggaggagauccugcagauccugaagauggagaacaaggaggugcugccccagcugguggacgccgugaccagcgcccagaccagcgacagccuggaggccauccuggacuuccuggacuucaagagcgacagcagcaucauccugcaggagagauuccuguacgccugcggcuucgccagccaccccaacgaggagcugcugagagcccugaucagcaaguucaagggcagcaucggcagcagcgacaucagagagaccgugaugaucaucaccggcacccuggugagaaagcugugccagaacgagggcugcaagcugaaggccgugguggaggccaagaagcugauccugggcggccuggagaaggccgagaagaaggaggacaccagaauguaccugcuggcccugaagaacgcccugcugcccgagggcauccccagccugcugaaguacgccgaggccggcgagggccccaucagccaccuggccaccaccgcccugcagagauacgaccugcccuucaucaccgacgaggugaagaagacccugaacagaaucuaccaccagaacagaaaggugcacgagaagaccgugagaaccgccgccgccgccaucauccugaacaacaaccccagcuacauggacgugaagaacauccugcugagcaucggcgagcugccccaggagaugaacaaguacaugcuggccaucgugcaggacauccugagauucgagaugcccgccagcaagaucgugagaagagugcugaaggagaugguggcccacaacuacgacagauucagcagaagcggcagcagcagcgccuacaccggcuacaucgagagaagccccagaagcgccagcaccuacagccuggacauccuguacagcggcagcggcauccugagaagaagcaaccugaacaucuuccaguacaucggcaaggccggccugcacggcagccagguggugaucgaggcccagggccuggaggcccugaucgccgccacccccgacgagggcgaggagaaccuggacagcuacgccggcaugagcgccauccuguucgacgugcagcugagacccgugaccuucuucaacggcuacagcgaccugaugagcaagaugcugagcgccagcggcgaccccaucagcguggugaagggccugauccugcugaucgaccacagccaggagcugcagcugcagagcggccugaaggccaacaucgaggugcagggcggccuggccaucgacaucagcggcgccauggaguucagccugugguacagagagagcaagaccagagugaagaacagagugaccguggugaucaccaccgacaucaccguggacagcagcuucgugaaggccggccuggagaccagcaccgagaccgaggccggccuggaguucaucagcaccgugcaguucagccaguaccccuuccuggugugcaugcagauggacaaggacgaggcccccuucagacaguucgagaagaaguacgagagacugagcaccggcagaggcuacgugagccagaagagaaaggagagcgugcuggccggcugcgaguucccccugcaccaggagaacagcgagaugugcaaggugguguucgccccccagcccgacagcaccagcagcggcugguucuaa

SEQ ID NO: 20150 - RNA, 396 nt, Artificial Sequence
  MTURN__Homo_sapiens__NP_690006
auggacuuccagcagcuggccgacguggccgagaaguggugcagcaacacccccuucgagcugaucgccaccgaggagaccgagagaagaauggacuucuacgccgaccccggcgugagcuucuacgugcugugccccgacaacggcugcggcgacaacuuccacguguggagcgagagcgaggacugccugcccuuccugcagcuggcccaggacuacaucagcagcugcggcaagaagacccugcacgaggugcuggagaagguguucaagagcuucagaccccugcugggccugcccgacgccgacgacgacgccuucgaggaguacagcgccgacguggaggaggaggagcccgaggccgaccacccccagaugggcgugagccagcaguaa

SEQ ID NO: 20151 - RNA, 1554 nt, Artificial Sequence
  MTUS1__Homo_sapiens__NP_001001931
augaccgugcccggcggcuucagaagcugcaccgagaccgacaucagcagcaagaucuucaucaacagcacccugaccccccccgccggcagcgagagacacuacgacgccacccugcugacccugcugguggugggcagcuacagccugugcaucaucccccugcuggccaccuucaccggcaagaagaccggcaacgccgccgugaucaaguacgaggagaagccccccaagcccgccuuccagaacggcagcagcggcagcuucuaccugaagccccuggugagcagagcccacgugcaccugaugaagaccccccccaagggccccagcagaaagaaccuguucaccgcccugaacgccguggagaagagcagacagaagaaccccagaagccugugcauccagccccagaccgcccccgacgcccugccccccgagaagacccuggagcugacccaguacaagaccaagugcgagaaccagagcggcuucauccugcagcugaagcagcugcuggccugcggcaacaccaaguucgaggcccugaccguggugauccagcaccugcugagcgagagagaggaggcccugaagcagcacaagacccugagccaggagcuggugaaccugagaggcgagcuggugaccgccagcaccaccugcgagaagcuggagaaggccagaaacgagcugcagaccguguacgaggccuucgugcagcagcaccaggccgagaagaccgagagagagaacagacugaaggaguucuacaccagagaguacgagaagcugagagacaccuacaucgaggaggccgagaaguacaagaugcagcugcaggagcaguucgacaaccugaacgccgcccacgagaccagcaagcuggagaucgaggccagccacagcgagaagcuggagcugcugaagaaggccuacgaggccagccugagcgagaucaagaagggccacgagaucgagaagaagagccuggaggaccugcugagcgagaagcaggagagccuggagaagcagaucaacgaccugaagagcgagaacgacgcccugaacgagaagcugaagagcgaggagcagaagagaagagccagagagaaggccaaccugaagaacccccagaucauguaccuggagcaggagcuggagagccugaaggccgugcuggagaucaagaacgagaagcugcaccagcaggacaucaagcugaugaagauggagaagcugguggacaacaacaccgcccugguggacaagcugaagagauuccagcaggagaacgaggagcugaaggccagaauggacaagcacauggccaucagcagacagcugagcaccgagcaggccgugcugcaggagagccuggagaaggagagcaaggugaacaagagacugagcauggagaacgaggagcugcuguggaagcugcacaacggcgaccugugcagccccaagagaagccccaccagcagcgccaucccccugcagagccccagaaacagcggcagcuuccccagccccagcaucagccccagauaa

SEQ ID NO: 20152 - RNA, 4140 nt, Artificial Sequence
  MTUS2__Homo_sapiens__NP_001028774
auggccagcagccccaccaagggccugaccaugagcgugcccguggcccccaagaagagcugcuacacccagcugagagacaacagaaacgccgccagaaacaacaacgagagcauccugagccugggcgacaccaacgccaaccagaucaugcuggaggugagcagcagccacgacgagagcaagaccugcgaccugggcgacgagaucggcaacaccaacagcagcgagcccgagaacagaacccacuuccacaaggaguuccaccagcugcagggcuucggcaagggcagccaggccggcagcgccagccugaaggacuucagacugagcagcaccauccagagagagcugaacgaggagcacaccguggagagaggcaccgacagccugcagaccaccagaagcauccagggccccagccugagcagcuggagaaacgugaugagcgaggccagccuggacgugcuggccaagagagacgccgagauccccagacacgugcccaaggacaagcuggccaagacccuggacaacgaggagcugagaagacacagccuggagagagccagcagcagcguggccgccgugggcagccugaccccccagcacccccagccccugagccuggacagcagagaggccagaggccagauccccggcggcggcgagggcccccagaagacccugcccgaccacgccgugcccgccgccuuccccgccaccgacagcaccagcgagggcaagagcgugagacaccccaagcccagcaccagcgagagcaagcagagcacccccagcgagacccagaccgugggcgcccacgugcugcaggugugcagcgagcacaccagccacagcgcccaccccgagcccgcccugaaccugacccuggccagcaaggagauccccagcaagcuggaggcccagcugggccagggcaagggcgaggccaagcuggaccugaaguacgugccccccagaagaguggagcaggagggcaaggccgcccaggagggcuaccugggcugccacaaggaggagaaccugagcgcccuggagggcagagaccccugcggcgaggcccaccccgaggccaccgacgcccugggccaccugcugaacagcgaccugcaccaccugggcgugggcagaggcaacugcgaggagaagagaggcgugaaccccggcgagcaggacagccugcacaccacccccaagcagggcagcgccagccugggcggcgccgacaaccagcccaccggcaagaucagccccugcgccggcgagaagcugggcgagagaaccagcagcagcuucagccccggcgacagccacguggccuucauccccaacaaccugaccgacagcaagccccuggacgugaucgaggaggagagaagacugggcagcggcaacaaggacagcgugauggugcugguguucaaccccagcgugggcgagaacaagaccgaggugcccgagccccuggacccccagagcggcagaagcgaggccagagagagcaaggaggugaccaccagcguggccgagaacagaaaccugcuggagaacgccgacaagaucgagagcaccagcgccagagccgacagcgugcugaacauccccgccccccugcaccccgagaccaccgugaacaugaccuaccagcccaccacccccagcagcagcuuccaggacgugagcguguucggcauggacgccggcagcccccugguggugcccccccccaccgacagcgccagacugcugaacaccagccccaaggugcccgacaagaacaccugccccagcggcauccccaagcccguguucacccacagcaaggacacccccagcagccaggagggcauggagaacuaccagguggagaagaccgaggagagaaccgagaccaagcccaucaucaugcccaagcccaagcacgugagacccaagaucaucaccuacaucagaagaaacccccaggcccugggccagguggacgccagccuggugcccgugggccugcccuacgccccccccaccugcaccaugccccugccccacgaggagaaggccgccggcggcgaccugaagcccagcgccaaccuguacgagaaguucaagcccgaccugcagaagcccagaguguucagcagcggccugauggugagcggcaucaagccccccggccaccccuucagccagaugagcgagaaguuccugcaggaggugaccgaccaccccggcaaggaggaguucugcagcccccccuacgcccacuacgaggugccccccaccuucuacagaagcgccaugcugcugaagccccagcugggccugggcgccaugagcagacugcccagcgccaagagcagaauccugaucgccagccagagaagcagcgccagcgccauccacccccccggccccaucaccaccgccaccagccuguacagcagcgaccccagcgccgaccugaagaaggccagcagcagcaacgccgccaagagcaaccugcccaagagcggccugagaccccccggcuacagcagacugcccgccgccaagcuggccgccuucggcuucgugagaagcagcagcgugagcagcgugagcagcacccagagcggcgacagcgcccagcccgagcagggcagacccgccaccagaagcaccuucggcaacgaggagcagcccgugcugaaggccagccugcccagcaaggacacccccaagggcgccggcagaguggccccccccgccagcagcagcgugaccgcccccagaagaagccugcugcccgcccccaagagcaccagcacccccgccggcaccaagaaggacgcccagaaggaccaggacaccaacaagcccgccgugagcagccccaagagaguggccgccagcaccaccaagcugcacagccccggcuaccccaagcagagaaccgccgccgccagaaacggcuucccccccaagcccgacccccaggccagagaggccgagagacagcuggugcugagacugaaggagagaugcgagcagcagaccagacagcugggcguggcccagggcgagcugaagagagccaucugcggcuucgacgcccuggccguggccacccagcacuucuucagaaagaacgagagcgcccuggugaaggagaaggagcugagcaucgagcuggccaacaucagagacgagguggccuuccacaccgccaagugcgagaagcugcagaaggagaaggaggagcuggagagaagauucgaggacgaggugaagagacugggcuggcagcagcaggccgagcugcaggagcuggaggagagacugcagcugcaguucgaggccgagauggccagacugcaggaggagcacggcgaccagcugcugagcaucagaugccagcaccaggagcagguggaggaccugaccgccagccacgacgccgcccugcuggagauggagaacaaccacaccguggccaucaccauccugcaggacgaccacgaccacaaggugcaggagcugaugagcacccacgagcuggagaagaaggagcuggaggagaacuucgagaagcugagacugagccugcaggaccagguggacacccugaccuuccagagccagagccugagagacagagccagaagauucgaggaggcccugagaaagaacaccgaggagcagcuggagaucgcccuggcccccuaccagcaccuggaggaggacaugaagagccugaagcaggugcuggagaugaagaaccagcagauccacgagcaggagaagaagauccuggagcuggagaagcuggccgagaagaacaucauccuggaggagaagauccaggugcugcagcagcagaacgaggaccugaaggccagaaucgaccagaacaccguggugaccagacagcugagcgaggagaacgccaaccugcaggaguacguggagaaggagacccaggagaagaagagacugagcagaaccaacgaggagcugcuguggaagcugcagaccggcgaccccaccagccccaucaagcugagccccaccagccccguguacagaggcagcagcagcggccccagcagccccgccagagugagcaccacccccagauaa

SEQ ID NO: 20153 - RNA, 1401 nt, Artificial Sequence
  MTX1__Homo_sapiens__NP_002446
augcugcugggcggcccccccagaagccccagaagcggcaccagccccaagggccccuggagcagcaccggccacgugcaguucggcaagagcccccagaccuggcccagaagaaccagacccagaagccccgagcccgccgcccccagcggcgugagaggcagcaccuggaccagaagaagagacagccccagaagagccggccccaccgcccugagcagauacgugggccaccuguggaugggcagaagaccccccagccccgaggccagaggccccgugcccagaagcagcgccgccagcagagccagaagaagccuggccagccccggcaucagccccggcccccugaccgccaccaucggcggcgccguggccggcggcggccccagacagggcagagccgaggcccacaaggagguguuccccggccagagagugggcaagauggccgcccccauggagcuguucugcuggagcggcggcuggggccugcccagcguggaccuggacagccuggccgugcugaccuacgccagauucaccggcgccccccugaaggugcacaagaucagcaaccccuggcagagccccagcggcacccugcccgcccugagaaccagccacggcgaggugaucagcgugccccacaagaucaucacccaccugagaaaggagaaguacaacgccgacuacgaccugagcgccagacagggcgccgacacccuggccuucaugagccugcuggaggagaagcugcugcccgugcuggugcacaccuucuggaucgacaccaagaacuacguggaggugaccagaaagugguacgccgaggccaugcccuucccccugaacuucuuccugcccggcagaaugcagagacaguacauggagagacugcagcugcugaccggcgagcacagacccgaggacgaggaggagcuggagaaggagcuguacagagaggccagagagugccugacccugcugagccagagacugggcagccagaaguucuucuucggcgacgcccccgccagccuggacgccuucguguucagcuaccuggcccugcugcugcaggccaagcugcccagcggcaagcugcaggugcaccugagaggccugcacaaccugugcgccuacugcacccacauccugagccuguacuuccccugggacggcgccgaggugcccccccagagacagacccccgccggccccgagaccgaggaggagcccuacagaagaagaaaccagauccugagcgugcuggccggccuggccgccauggugggcuacgcccugcugagcggcaucgugagcauccagagagccacccccgccagagcccccggcaccagaacccugggcauggccgaggaggacgaggaggaguaa

SEQ ID NO: 20154 - RNA, 792 nt, Artificial Sequence
  MTX2__Homo_sapiens__NP_006545
augagccugguggccgaggccuucgugagccagaucgccgccgccgagcccuggcccgagaacgccacccuguaccagcagcugaagggcgagcagauccugcugagcgacaacgccgccagccuggccgugcaggccuuccugcagaugugcaaccugcccaucaagguggugugcagagccaacgccgaguacaugagccccagcggcaaggugcccuucauccacgugggcaaccagguggugagcgagcugggccccaucgugcaguucgugaaggccaagggccacagccugagcgacggccuggaggaggugcagaaggccgagaugaaggccuacauggagcuggugaacaacaugcugcugaccgccgagcuguaccugcaguggugcgacgaggccaccgugggcgagaucacccacgccagauacggcagccccuaccccuggccccugaaccacauccuggccuaccagaagcagugggaggugaagagaaagaugaaggccaucggcuggggcaagaagacccuggaccaggugcuggaggacguggaccagugcugccaggcccugagccagagacugggcacccagcccuacuucuucaacaagcagcccaccgagcuggacgcccugguguucggccaccuguacaccauccugaccacccagcugaccaacgacgagcugagcgagaaggugaagaacuacagcaaccugcuggccuucugcagaagaaucgagcagcacuacuucgaggacagaggcaagggcagacugagcuaa

SEQ ID NO: 20155 - RNA, 16008 nt, Artificial Sequence
  MUC12__Homo_sapiens__NP_001157934
augcuggugaucuggauccugacccuggcccugagacugugcgccagcgugaccaccgugacccccggcagcaccgugaacaccagcaucggcggcaacaccaccagcgccagcacccccagcagcagcgaccccuucaccaccuucagcgacuacggcgugagcgugaccuucaucaccggcagcaccgccaccaagcacuuccuggacagcagcaccaacagcggccacagcgaggagagcaccgugagccacagcggccccggcgccaccggcaccacccuguuccccagccacagcgccaccagcguguucgugggcgagcccaagaccagccccaucaccagcgccagcauggagaccaccgcccugcccggcagcaccaccaccgccggccugagcgagaagagcaccaccuucuacagcagccccagaagccccgacagaacccugagccccgccagaaccaccagcagcggcgugagcgagaagagcaccaccagccacagcagacccggccccacccacaccaucgccuuccccgacagcaccaccaugcccggcgugagccaggagagcaccgccagccacagcauccccggcagcaccgacaccacccugagccccggcaccaccacccccagcagccugggccccgagagcaccaccuuccacagcagccccggcuacaccaagaccaccagacugcccgacaacaccaccaccagcggccugcuggaggccagcacccccgugcacagcagcaccggcagcccccacaccacccugagccccagcagcagcaccacccacgagggcgagcccaccaccuuccagagcuggcccagcagcaaggacaccagccccgcccccagcggcaccaccagcgccuucgugaagcugagcaccaccuaccacagcagccccagcagcacccccaccacccacuucagcgccagcagcaccacccugggccacagcgaggagagcacccccgugcacagcagccccguggccaccgccaccacccccccccccgccagaagcgccaccagcggccacguggaggagagcaccgccuaccacagaagccccggcagcacccagaccaugcacuuccccgagagcagcaccaccagcggccacagcgaggagagcgccaccuuccacggcagcaccacccacaccaagagcagcacccccagcaccaccgccgcccuggcccacaccagcuaccacagcagccugggcagcaccgagaccacccacuucagagacagcagcaccaucagcggcagaagcgaggagagcaaggccagccacagcagccccgacgccauggccaccaccgugcugcccgccggcagcacccccagcgugcuggugggcgacagcacccccagccccaucagcagcggcagcauggagaccaccgcccugcccggcagcaccaccaagcccggccugagcgagaagagcaccaccuucuacagcagccccagaagccccgacaccacccaccugcccgccagcaugaccagcagcggcgugagcgaggagagcaccaccagccacagcagacccggcagcacccacaccaccgccuuccccggcagcaccaccaugcccggccugagccaggagagcaccgccagccacagcagccccggccccaccgacaccacccugagccccggcagcaccaccgccagcagccugggccccgaguacaccaccuuccacagcagacccggcagcaccgagaccacccugcugcccgacaacaccaccgccagcggccugcuggaggccagcaugcccgugcacagcagcaccagaagcccccacaccacccugagccccgccggcagcaccaccagacagggcgagagcaccaccuuccacagcuggcccagcagcaaggacaccagacccgccccccccaccaccaccagcgccuucguggagcccagcaccaccagccacggcagccccagcagcauccccaccacccacaucagcgccagaagcaccaccagcggccugguggaggagagcaccaccuaccacagcagccccggcagcacccagaccaugcacuuccccgagagcgacaccaccagcggcagaggcgaggagagcaccaccagccacagcagcaccacccacaccaucagcagcgcccccagcaccaccagcgcccugguggaggagcccaccagcuaccacagcagccccggcagcaccgccaccacccacuuccccgacagcagcaccaccagcggcagaagcgaggagagcaccgccagccacagcagccaggacgccaccggcaccaucgugcugcccgccagaagcaccaccagcgugcugcugggcgagagcaccaccagccccaucagcagcggcagcauggagaccaccgcccugcccggcagcaccaccacccccggccugagcgagagaagcaccaccuuccacagcagccccagaagccccgccaccacccugagccccgccagcaccaccagcagcggcgugagcgaggagagcaccaccagcagaagcagacccggcagcacccacaccaccgccuuccccgacagcaccaccacccccggccugagcagacacagcaccaccagccacagcagccccggcagcaccgacaccacccugcugcccgccagcaccaccaccagcggccccagccaggagagcaccaccagccacagcagcagcggcagcaccgacaccgcccugagccccggcagcaccaccgcccugagcuucggccaggagagcaccaccuuccacagcaaccccggcagcacccacaccacccuguuccccgacagcaccaccagcagcggcaucguggaggccagcaccagagugcacagcagcaccggcagccccagaaccacccugagccccgccagcagcaccagccccggccugcagggcgagagcaccgccuuccagacccaccccgccagcacccacaccacccccagcccccccagcaccgccaccgcccccguggaggagagcaccaccuaccacagaagccccggcagcacccccaccacccacuuccccgccagcagcaccaccagcggccacagcgagaagagcaccaucuuccacagcagccccgacgccagcggcaccacccccagcagcgcccacagcaccaccagcggcagaggcgagagcaccaccagcagaaucagccccggcagcaccgagaucaccacccugcccggcagcaccaccacccccggccugagcgaggccagcaccaccuucuacagcagccccagaagccccaccaccacccugagccccgccagcaugaccagccugggcgugggcgaggagagcaccaccagcagaagccagcccggcagcacccacagcaccgugagccccgccagcaccaccacccccggccugagcgaggagagcaccaccguguacagcagcagcagaggcagcaccgagaccaccguguucccccacagcaccaccaccagcgugcacggcgaggagcccaccaccuuccacagcagacccgccagcacccacaccacccuguucaccgaggacagcaccaccagcggccugaccgaggagagcaccgccuuccccggcagccccgccagcacccagaccggccugcccgccacccugaccaccgccgaccugggcgaggagagcaccaccuuccccagcagcagcggcagcaccggcaccaagcugagccccgccagaagcaccaccagcggccuggugggcgagagcacccccagcagacugagccccagcagcaccgagaccaccacccugcccggcagccccaccacccccagccugagcgagaagagcaccaccuucuacaccagccccagaagccccgacgccacccugagccccgccaccaccaccagcagcggcgugagcgaggagagcagcaccagccacagccagcccggcagcacccacaccaccgccuuccccgacagcaccaccaccagcgaccugagccaggagcccaccaccagccacagcagccagggcagcaccgaggccacccugagccccggcagcaccaccgccagcagccugggccagcagagcaccaccuuccacagcagccccggcgacaccgagaccacccugcugcccgacgacaccaucaccagcggccugguggaggccagcacccccacccacagcagcaccggcagccugcacaccacccugacccccgccagcagcaccagcgccggccugcaggaggagagcaccaccuuccagagcuggcccagcagcagcgacaccacccccagcccccccggcaccaccgccgcccccguggaggugagcaccaccuaccacagcagacccagcagcacccccaccacccacuucagcgccagcagcaccacccugggcagaagcgaggagagcaccaccgugcacagcagccccggcgccaccggcaccgcccuguuccccaccagaagcgccaccagcgugcuggugggcgagcccaccaccagccccaucagcagcggcagcaccgagaccaccgcccugcccggcagcaccaccaccgccggccugagcgagaagagcaccaccuucuacagcagccccagaagccccgacaccacccugagccccgccagcaccaccagcagcggcgugagcgaggagagcaccaccagccacagcagacccggcagcacccacaccaccgccuuccccggcagcaccaccaugcccggcgugagccaggagagcaccgccagccacagcagccccggcagcaccgacaccacccugagccccggcagcaccaccgccagcagccugggccccgagagcaccaccuuccacagcagccccggcagcaccgagaccacccugcugcccgacaacaccaccgccagcggccugcuggaggccagcacccccgugcacagcagcaccggcagcccccacaccacccugagccccgccggcagcaccaccagacagggcgagagcaccaccuuccagagcuggcccagcagcaaggacaccaugcccgccccccccaccaccaccagcgccuucguggagcugagcaccaccagccacggcagccccagcagcacccccaccacccacuucagcgccagcagcaccacccugggcagaagcgaggagagcaccaccgugcacagcagccccguggccaccgccaccacccccagccccgccagaagcaccaccagcggccugguggaggagagcaccgccuaccacagcagccccggcagcacccagaccaugcacuuccccgagagcagcaccgccagcggcagaagcgaggagagcagaaccagccacagcagcaccacccacaccaucagcagcccccccagcaccaccagcgcccugguggaggagcccaccagcuaccacagcagccccggcagcaccgccaccacccacuuccccgacagcagcaccaccagcggcagaagcgaggagagcaccgccagccacagcagccaggacgccaccggcaccaucgugcugcccgccagaagcaccaccagcgugcugcugggcgagagcaccaccagccccaucagcagcggcagcauggagaccaccgcccugcccggcagcaccaccacccccggccugagcgagaagagcaccaccuuccacagcagccccagaagccccgccaccacccugagccccgccagcaccaccagcagcggcgugagcgaggagagcaccaccagccacagcagacccggcagcacccacaccaccgccuuccccgacagcaccaccacccccggccugagcagacacagcaccaccagccacagcagccccggcagcaccgacaccacccugcugcccgccagcaccaccaccagcggccccagccaggagagcaccaccagccacagcagccccggcagcaccgacaccgcccugagccccggcagcaccaccgcccugagcuucggccaggagagcaccaccuuccacagcagccccggcagcacccacaccacccuguuccccgacagcaccaccagcagcggcaucguggaggccagcaccagagugcacagcagcaccggcagccccagaaccacccugagccccgccagcagcaccagccccggccugcagggcgagagcaccgccuuccagacccaccccgccagcacccacaccacccccagcccccccagcaccgccaccgcccccguggaggagagcaccaccuaccacagaagccccggcagcacccccaccacccacuuccccgccagcagcaccaccagcggccacagcgagaagagcaccaucuuccacagcagccccgacgccagcggcaccacccccagcagcgcccacagcaccaccagcggcagaggcgagagcaccaccagcagaaucagccccggcagcaccgagaucaccacccugcccggcagcaccaccacccccggccugagcgaggccagcaccaccuucuacagcagccccagaagccccaccaccacccugagccccgccagcaugaccagccugggcgugggcgaggagagcaccaccagcagaagccagcccggcagcacccacagcaccgugagccccgccagcaccaccacccccggccugagcgaggagagcaccaccguguacagcagcagccccggcagcaccgagaccaccguguuccccagaacccccaccaccagcgugagaggcgaggagcccaccaccuuccacagcagacccgccagcacccacaccacccuguucaccgaggacagcaccaccagcggccugaccgaggagagcaccgccuuccccggcagccccgccagcacccagaccggccugcccgccacccugaccaccgccgaccugggcgaggagagcaccaccuuccccagcagcagcggcagcaccggcaccacccugagccccgccagaagcaccaccagcggccuggugggcgagagcacccccagcagacugagccccagcagcaccgagaccaccacccugcccggcagccccaccacccccagccugagcgagaagagcaccaccuucuacaccagccccagaagccccgacgccacccugagccccgccaccaccaccagcagcggcgugagcgaggagagcagcaccagccacagccagcccggcagcacccacaccaccgccuuccccgacagcaccaccacccccggccugagcagacacagcaccaccagccacagcagccccggcagcaccgacaccacccugcugcccgccagcaccaccaccagcggccccagccaggagagcaccaccagccacagcagccccggcagcaccgacaccgcccugagccccggcagcaccaccgcccugagcuucggccaggagagcaccaccuuccacagcagccccggcagcacccacaccacccuguuccccgacagcaccaccagcagcggcaucguggaggccagcaccagagugcacagcagcaccggcagccccagaaccacccugagccccgccagcagcaccagccccggccugcagggcgagagcaccaccuuccagacccaccccgccagcacccacaccacccccagcccccccagcaccgccaccgcccccguggaggagagcaccaccuaccacagaagccccggcagcacccccaccacccacuuccccgccagcagcaccaccagcggccacagcgagaagagcaccaucuuccacagcagccccgacgccagcggcaccacccccagcagcgcccacagcaccaccagcggcagaggcgagagcaccaccagcagaaucagccccggcagcaccgagaucaccacccugcccggcagcaccaccacccccggccugagcgaggccagcaccaccuucuacagcagccccagaagccccaccaccacccugagccccgccagcaugaccagccugggcgugggcgaggagagcaccaccagcagaagccagcccggcagcacccacagcaccgugagccccgccagcaccaccacccccggccugagcgaggagagcaccaccguguacagcagcagccccggcagcaccgagaccaccguguuccccagaagcaccaccaccagcgugagaggcgaggagcccaccaccuuccacagcagacccgccagcacccacaccacccuguucaccgaggacagcaccaccagcggccugaccgaggagagcaccgccuuccccggcagccccgccagcacccagaccggccugcccgccacccugaccaccgccgaccugggcgaggagagcaccaccuuccccagcagcagcggcagcaccggcaccacccugagccccgccagaagcaccaccagcggccuggugggcgagagcacccccagcagacugagccccagcagcaccgagaccaccacccugcccggcagccccaccacccccagccugagcgagaagagcaccaccuucuacaccagccccagaagccccgacgccacccugagccccgccaccaccaccagcagcggcgugagcgaggagagcagcaccagccacagccagcccggcagcacccacaccaccgccuuccccgacagcaccaccaccagcggccugagccaggagcccaccgccagccacagcagccagggcagcaccgaggccacccugagccccggcagcaccaccgccagcagccugggccagcagagcaccaccuuccacagcagccccggcgacaccgagaccacccugcugcccgacgacaccaucaccagcggccugguggaggccagcacccccacccacagcagcaccggcagccugcacaccacccugacccccgccagcagcaccagcgccggccugcaggaggagagcaccaccuuccagagcuggcccagcagcagcgacaccacccccagcccccccggcaccaccgccgcccccguggaggugagcaccaccuaccacagcagacccagcagcacccccaccacccacuucagcgccagcagcaccacccugggcagaagcgaggagagcaccaccgugcacagcagccccggcgccaccggcaccgcccuguuccccaccagaagcgccaccagcgugcuggugggcgagcccaccaccagccccaucagcagcggcagcaccgagaccaccgcccugcccggcagcaccaccaccgccggccugagcgagaagagcaccaccuucuacagcagccccagaagccccgacaccacccugagccccgccagcaccaccagcagcggcgugagcgaggagagcaccaccagccacagcagacccggcagcacccacaccaccgccuuccccggcagcaccaccaugcccggcgugagccaggagagcaccgccagccacagcagccccggcagcaccgacaccacccugagccccggcagcaccaccgccagcagccugggccccgagagcaccaccuuccacagcggccccggcagcaccgagaccacccugcugcccgacaacaccaccgccagcggccugcuggaggccagcacccccgugcacagcagcaccggcagcccccacaccacccugagccccgccggcagcaccaccagacagggcgagagcaccaccuuccagagcuggcccaacagcaaggacaccacccccgccccccccaccaccaccagcgccuucguggagcugagcaccaccagccacggcagccccagcagcacccccaccacccacuucagcgccagcagcaccacccugggcagaagcgaggagagcaccaccgugcacagcagccccguggccaccgccaccacccccagccccgccagaagcaccaccagcggccugguggaggagagcaccaccuaccacagcagccccggcagcacccagaccaugcacuuccccgagagcgacaccaccagcggcagaggcgaggagagcaccaccagccacagcagcaccacccacaccaucagcagcgcccccagcaccaccagcgcccugguggaggagcccaccagcuaccacagcagccccggcagcaccgccaccacccacuuccccgacagcagcaccaccagcggcagaagcgaggagagcaccgccagccacagcagccaggacgccaccggcaccaucgugcugcccgccagaagcaccaccagcgugcugcugggcgagagcaccaccagccccaucagcagcggcagcauggagaccaccgcccugcccggcagcaccaccacccccggccugagcgagaagagcaccaccuuccacagcagccccagaagccccgccaccacccugagccccgccagcaccaccagcagcggcgugagcgaggagagcaccaccagccacagcagacccggcagcacccacaccaccgccuuccccgacagcaccaccacccccggccugagcagacacagcaccaccagccacagcagccccggcagcaccgacaccacccugcugcccgccagcaccaccaccagcggcagcagccaggagagcaccaccagccacagcagcagcggcagcaccgacaccgcccugagccccggcagcaccaccgcccugagcuucggccaggagagcaccaccuuccacagcagccccggcagcacccacaccacccuguuccccgacagcaccaccagcagcggcaucguggaggccagcaccagagugcacagcagcaccggcagccccagaaccacccugagccccgccagcagcaccagccccggccugcagggcgagagcaccgccuuccagacccaccccgccagcacccacaccacccccagcccccccagcaccgccaccgcccccguggaggagagcaccaccuaccacagaagccccggcagcacccccaccacccacuuccccgccagcagcaccaccagcggccacagcgagaagagcaccaucuuccacagcagccccgacgccagcggcaccacccccagcagcgcccacagcaccaccagcggcagaggcgagagcaccaccagcagaaucagccccggcagcaccgagaucaccacccugcccggcagcaccaccacccccggccugagcgaggccagcaccaccuucuacagcagccccagaagccccaccaccacccugagccccgccagcaugaccagccugggcgugggcgaggagagcaccaccagcagaagccagcccggcagcacccacagcaccgugagccccgccagcaccaccacccccggccugagcgaggagagcaccaccguguacagcagcagccccggcagcaccgagaccaccguguuccccagaagcaccaccaccagcgugagaagagaggagcccaccaccuuccacagcagacccgccagcacccacaccacccuguucaccgaggacagcaccaccagcggccugaccgaggagagcaccgccuuccccggcagccccgccagcacccagaccggccugcccgccacccugaccaccgccgaccugggcgaggagagcaccaccuuccccagcagcagcggcagcaccggcaccaagcugagccccgccagaagcaccaccagcggccuggugggcgagagcacccccagcagacugagccccagcagcaccgagaccaccacccugcccggcagccccaccacccccagccugagcgagaagagcaccaccuucuacaccagccccagaagccccgacgccacccugagccccgccaccaccaccagcagcggcgugagcgaggagagcagcaccagccacagccagcccggcagcacccacaccaccgccuuccccgacagcaccaccaccagcggccugagccaggagcccaccaccagccacagcagccagggcagcaccgaggccacccugagccccggcagcaccaccgccagcagccugggccagcagagcaccaccuuccacagcagccccggcgacaccgagaccacccugcugcccgacgacaccaucaccagcggccugguggaggccagcacccccacccacagcagcaccggcagccugcacaccacccugacccccgccagcagcaccagcaccggccugcaggaggagagcaccaccuuccagagcuggcccagcagcagcgacaccacccccagcccccccagcaccaccgccgugcccguggaggugagcaccaccuaccacagcagacccagcagcacccccaccacccacuucagcgccagcagcaccacccugggcagaagcgaggagagcaccaccgugcacagcagccccggcgccaccggcaccgcccuguuccccaccagaagcgccaccagcgugcuggugggcgagcccaccaccagccccaucagcagcggcagcaccgagaccaccgcccugcccggcagcaccaccaccgccggccugagcgagaagagcaccaccuucuacagcagccccagaagccccgacaccacccugagccccgccagcaccaccagcagcggcgugagcgaggagagcaccaccagccacagcagacccggcagcaugcacaccaccgccuuccccagcagcaccaccaugcccggcgugagccaggagagcaccgccagccacagcagccccggcagcaccgacaccacccugagccccggcagcaccaccgccagcagccugggccccgagagcaccaccuuccacagcagccccggcagcaccgagaccacccugcugcccgacaacaccaccgccagcggccugcuggaggccagcacccccgugcacagcagcaccggcagcccccacaccacccugagccccgccggcagcaccaccagacagggcgagagcaccaccuuccagagcuggcccaacagcaaggacaccacccccgccccccccaccaccaccagcgccuucguggagcugagcaccaccagccacggcagccccagcagcacccccaccacccacuucagcgccagcagcaccacccugggcagaagcgaggagagcaccaccgugcacagcagccccguggccaccgccaccacccccagccccgccagaagcaccaccagcggccugguggaggagagcaccaccuaccacagcagccccggcagcacccagaccaugcacuuccccgagagcaacaccaccagcggcagaggcgaggagagcaccaccagccacagcagcaccacccacaccaucagcagcgcccccagcaccaccagcgcccugguggaggagcccaccagcuaccacagcagccccggcagcaccgccaccacccacuuccccgacagcagcaccaccagcggcagaagcgaggagagcaccgccagccacagcagccaggacgccaccggcaccaucgugcugcccgccagaagcaccaccagcgugcugcugggcgagagcaccaccagccccaucagcagcggcagcauggagaccaccgcccugcccggcagcaccaccacccccggccugagcgagaagagcaccaccuuccacagcagccccagcagcacccccaccacccacuucagcgccagcagcaccacccugggcagaagcgaggagagcaccaccgugcacagcagccccguggccaccgccaccacccccagccccgccagaagcaccaccagcggccugguggaggagagcaccgccuaccacagcagccccggcagcacccagaccaugcacuuccccgagagcagcaccgccagcggcagaagcgaggagagcagaaccagccacagcagcaccacccacaccaucagcagcccccccagcaccaccagcgcccugguggaggagcccaccagcuaccacagcagccccggcagcaucgccaccacccacuuccccgagagcagcaccaccagcggcagaagcgaggagagcaccgccagccacagcagccccgacaccaacggcaucaccccccugcccgcccacuucaccaccagcggcagaaucgccgagagcaccaccuucuacaucagccccggcagcauggagaccacccuggccagcaccgccaccacccccggccugagcgccaagagcaccauccuguacagcagcagcagaagccccgaccagacccugagccccgccagcaugaccagcagcagcaucagcggcgagcccaccagccuguacagccaggccgagagcacccacaccaccgccuuccccgccagcaccaccaccagcggccugagccaggagagcaccaccuuccacagcaagcccggcagcaccgagaccacccugagccccggcagcaucaccaccagcagcuucgcccaggaguucaccaccccccacagccagcccggcagcgcccugagcaccgugagccccgccagcaccaccgugcccggccugagcgaggagagcaccaccuucuacagcagccccggcagcaccgagaccaccgccuucagccacagcaacaccaugagcauccacagccagcagagcacccccuuccccgacagccccggcuucacccacaccgugcugcccgccacccugaccaccaccgacaucggccaggagagcaccgccuuccacagcagcagcgacgccaccggcaccaccccccugcccgccagaagcaccgccagcgaccuggugggcgagcccaccaccuucuacaucagccccagccccaccuacaccacccuguuccccgccagcagcagcaccagcggccugaccgaggagagcaccaccuuccacaccagccccagcuucaccagcaccaucgugagcaccgagagccuggagacccuggcccccggccugugccaggagggccagaucuggaacggcaagcagugcgugugcccccagggcuacgugggcuaccagugccugagcccccuggagagcuuccccguggagacccccgagaagcugaacgccacccugggcaugaccgugaaggugaccuacagaaacuucaccgagaagaugaacgacgccagcagccaggaguaccagaacuucagcacccuguucaagaacagaauggacguggugcugaagggcgacaaccugccccaguacagaggcgugaacaucagaagacugcugaacggcagcaucguggugaagaacgacgugauccuggaggccgacuacacccuggaguacgaggagcuguucgagaaccuggccgagaucgugaaggccaagaucaugaacgagaccagaaccacccugcuggaccccgacagcugcagaaaggccauccugugcuacagcgaggaggacaccuucguggacagcagcgugacccccggcuucgacuuccaggagcagugcacccagaaggccgccgagggcuacacccaguucuacuacguggacgugcuggacggcaagcuggccugcgugaacaagugcaccaagggcaccaagagccagaugaacugcaaccugggcaccugccagcugcagagaagcggccccagaugccugugccccaacaccaacacccacugguacuggggcgagaccugcgaguucaacaucgccaagagccugguguacggcaucgugggcgccgugauggccgugcugcugcuggcccugaucauccugaucauccuguucagccugagccagagaaagagacacagagagcaguacgacgugccccaggaguggagaaaggagggcacccccggcaucuuccagaagaccgccaucugggaggaccagaaccugagagagagcagauucggccuggagaacgccuacaacaacuucagacccacccuggagaccguggacagcggcaccgagcugcacauccagagacccgagaugguggccagcaccguguaa

SEQ ID NO: 20156 - RNA, 1539 nt, Artificial Sequence
  MUC13__Homo_sapiens__NP_149038
augaaggccaucauccaccugacccugcuggcccugcugagcgugaacaccgccaccaaccagggcaacagcgccgacgccgugaccaccaccgagaccgccaccagcggccccaccguggccgccgccgacaccaccgagaccaacuuccccgagaccgccagcaccaccgccaacacccccagcuuccccaccgccaccagccccgccccccccaucaucagcacccacagcagcagcaccauccccacccccgccccccccaucaucagcacccacagcagcagcaccauccccauccccaccgccgccgacagcgagagcaccaccaacgugaacagccuggccaccagcgacaucaucaccgccagcagccccaacgacggccugaucaccauggugcccagcgagacccagagcaacaacgagaugagccccaccaccgaggacaaccagagcagcggcccccccaccggcaccgcccugcuggagaccagcacccugaacagcaccggccccagcaaccccugccaggacgaccccugcgccgacaacagccugugcgugaagcugcacaacaccagcuucugccugugccuggagggcuacuacuacaacagcagcaccugcaagaagggcaagguguuccccggcaagaucagcgugaccgugagcgagaccuucgaccccgaggagaagcacagcauggccuaccaggaccugcacagcgagaucaccagccuguucaaggacguguucggcaccagcguguacggccagaccgugauccugaccgugagcaccagccugagccccagaagcgagaugagagccgacgacaaguucgugaacgugaccaucgugaccauccuggccgagaccaccagcgacaacgagaagaccgugaccgagaagaucaacaaggccaucagaagcagcagcagcaacuuccugaacuacgaccugacccugagaugcgacuacuacggcugcaaccagaccgccgacgacugccugaacggccuggccugcgacugcaagagcgaccugcagagacccaacccccagagccccuucugcguggccagcagccugaagugccccgacgccugcaacgcccagcacaagcagugccugaucaagaagagcggcggcgcccccgagugcgccugcgugcccggcuaccaggaggacgccaacggcaacugccagaagugcgccuucggcuacagcggccuggacugcaaggacaaguuccagcugauccugaccaucgugggcaccaucgccggcaucgugauccugagcaugaucaucgcccugaucgugaccgccagaagcaacaacaagaccaagcacaucgaggaggagaaccugaucgacgaggacuuccagaaccugaagcugagaagcaccggcuucaccaaccugggcgccgagggcagcguguuccccaaggugagaaucaccgccagcagagacagccagaugcagaaccccuacagcagacacagcagcaugcccagacccgacuacuaa

SEQ ID NO: 20157 - RNA, 1086 nt, Artificial Sequence
  MUC15__Homo_sapiens__NP_001128563
augggcaucauccagagcauccuggccaccagcagagacugcuacagcuucaagaagaagcccauccccaagaagcccaccaugcuggcccuggccaagauccugcugaucagcacccuguucuacagccugcugagcggcagccacggcaaggagaaccaggacaucaacaccacccagaacaucgccgagguguucaagaccauggagaacaagcccaucagccuggagagcgaggccaaccugaacagcgacaaggagaacaucaccaccagcaaccugaaggccagccacagccccccccugaaccugcccaacaacagccacggcaucaccgacuucagcagcaacagcagcgccgagcacagccugggcagccugaagcccaccagcaccaucagcaccagccccccccugauccacagcuucgugagcaaggugcccuggaacgcccccaucgccgacgaggaccugcugcccaucagcgcccaccccaacgccacccccgcccugagcagcgagaacuucaccuggagccuggugaacgacaccgugaagacccccgacaacagcagcaucaccgugagcauccugagcagcgagcccaccagccccagcgugaccccccugaucguggagcccagcggcuggcugaccaccaacagcgacagcuucaccggcuucacccccuaccaggagaagaccacccugcagcccacccugaaguucaccaacaacagcaagcuguuccccaacaccagcgacccccagaaggagaacagaaacaccggcaucguguucggcgccauccugggcgccauccugggcgugagccugcugacccuggugggcuaccugcugugcggcaagagaaagaccgacagcuucagccacagaagacuguacgacgacagaaacgagcccgugcugagacuggacaacgcccccgagcccuacgacgugagcuucggcaacagcagcuacuacaaccccacccugaacgacagcgccaugcccgagagcgaggagaacgccagagacggcauccccauggacgacauccccccccugagaaccagcguguaa

SEQ ID NO: 20158 - RNA, 13482 nt, Artificial Sequence
  MUC17__Homo_sapiens__NP_001035194
augcccagacccggcaccauggcccugugccugcugacccuggugcugagccugcugcccccccaggccgccgccgagcaggaccugagcgugaacagagccgugugggacggcggcggcugcaucagccagggcgacgugcugaacagacagugccagcagcugagccagcacgugagaaccggcagcgccgccaacaccgccaccggcaccaccagcaccaacgugguggagcccagaauguaccugagcugcagcaccaaccccgagaugaccagcaucgagagcagcgugaccagcgacacccccggcgugagcagcaccagaaugacccccaccgagagcagaaccaccagcgagagcaccagcgacagcaccacccuguuccccagcagcaccgaggacaccagcagccccaccacccccgagggcaccgacgugcccaugagcacccccagcgaggagagcaucagcagcaccauggccuucgugagcaccgccccccugcccagcuucgaggccuacaccagccugaccuacaagguggacaugagcaccccccugaccaccagcacccaggccagcagcagccccaccacccccgagagcaccaccauccccaagagcaccaacagcgagggcagcaccccccugaccagcaugcccgccagcaccaugaagguggccagcagcgaggccaucacccugcugaccacccccguggagaucagcacccccgugaccaucagcgcccaggccagcagcagccccaccaccgccgagggccccagccugagcaacagcgcccccagcggcggcagcaccccccugaccagaaugccccugagcgugaugcugguggugagcagcgaggccagcacccugagcaccacccccgccgccaccaacauccccgugaucaccagcaccgaggccagcagcagccccaccaccgccgagggcaccagcauccccaccagcaccuacaccgagggcagcaccccccugaccagcacccccgccagcaccaugcccguggccaccagcgagaugagcacccugagcaucacccccguggacaccagcacccuggugaccaccagcaccgagcccagcagccugcccaccaccgccgaggccaccagcaugcugaccagcacccugagcgagggcagcaccccccugaccaacaugcccgugagcaccauccugguggccagcagcgaggccagcaccaccagcaccauccccguggacagcaagaccuucgugaccaccgccagcgaggccagcagcagccccaccaccgccgaggacaccagcaucgccaccagcacccccagcgagggcagcaccccccugaccagcaugcccgugagcaccacccccguggccagcagcgaggccagcaaccugagcaccacccccguggacagcaagacccaggugaccaccagcaccgaggccagcagcagcccccccaccgccgaggugaacagcaugcccaccagcacccccagcgagggcagcaccccccugaccagcaugagcgugagcaccaugcccguggccagcagcgaggccagcacccugagcaccacccccguggacaccagcacccccgugaccaccagcagcgaggccagcagcagcagcaccacccccgagggcaccagcauccccaccagcacccccagcgagggcagcaccccccugaccaacaugcccgugagcaccagacugguggugagcagcgaggccagcaccaccagcaccacccccgccgacagcaacaccuucgugaccaccagcagcgaggccagcagcagcagcaccaccgccgagggcaccagcaugcccaccagcaccuacagcgagagaggcaccaccaucaccagcaugagcgugagcaccacccugguggccagcagcgaggccagcacccugagcaccacccccguggacagcaacacccccgugaccaccagcaccgaggccaccagcagcagcaccaccgccgagggcaccagcaugcccaccagcaccuacaccgagggcagcaccccccugaccagcaugcccgugaacaccacccugguggccagcagcgaggccagcacccugagcaccacccccguggacaccagcacccccgugaccaccagcaccgaggccagcagcagccccaccaccgccgacggcgccagcaugcccaccagcacccccagcgagggcagcaccccccugaccagcaugcccgugagcaagacccugcugaccagcagcgaggccagcacccugagcaccaccccccuggacaccagcacccacaucaccaccagcaccgaggccagcugcagccccaccaccaccgagggcaccagcaugcccaucagcacccccagcgagggcagcccccugcugaccagcauccccgugagcaucacccccgugaccagccccgaggccagcacccugagcaccacccccguggacagcaacagccccgugaccaccagcaccgaggugagcagcagccccacccccgccgagggcaccagcaugcccaccagcaccuacagcgagggcagaaccccccugaccagcaugcccgugagcaccacccugguggccaccagcgccaucagcacccugagcaccacccccguggacaccagcacccccgugaccaacagcaccgaggccagaagcagccccaccaccagcgagggcaccagcaugcccaccagcacccccggcgagggcagcaccccccugaccagcaugcccgacagcaccacccccguggugagcagcgaggccagaacccugagcgccacccccguggacaccagcacccccgugaccaccagcaccgaggccaccagcagccccaccaccgccgagggcaccagcauccccaccagcacccccagcgagggcaccaccccccugaccagcacccccgugagccacacccugguggccaacagcgaggccagcacccugagcaccacccccguggacagcaacaccccccugaccaccagcaccgaggccagcagccccccccccaccgccgagggcaccagcaugcccaccagcacccccagcgagggcagcaccccccugaccagaaugcccgugagcaccaccaugguggccagcagcgagaccagcacccugagcaccacccccgccgacaccagcacccccgugaccaccuacagccaggccagcagcagcagcaccaccgccgacggcaccagcaugcccaccagcaccuacagcgagggcagcaccccccugaccagcgugcccgugagcaccagacugguggugagcagcgaggccagcacccugagcaccacccccguggacaccagcauccccgugaccaccagcaccgaggccagcagcagccccaccaccgccgagggcaccagcauccccaccagcccccccagcgagggcaccaccccccuggccagcaugcccgugagcaccacccugguggugagcagcgaggccaacacccugagcaccacccccguggacagcaagacccagguggccaccagcaccgaggccagcagccccccccccaccgccgaggugaccagcaugcccaccagcacccccggcgagagaagcaccccccugaccagcaugcccgugagacacacccccguggccagcagcgaggccagcacccugagcaccagccccguggacaccagcacccccgugaccaccagcgccgagaccagcagcagccccaccaccgccgagggcaccagccugcccaccagcaccaccagcgagggcagcacccugcugaccagcauccccgugagcaccacccuggugaccagccccgaggccagcacccugcugaccacccccguggacaccaagggccccguggugaccagcaacgaggugagcagcagccccacccccgccgagggcaccagcaugcccaccagcaccuacagcgagggcagaaccccccugaccagcauccccgugaacaccacccugguggccagcagcgccaucagcauccugagcaccacccccguggacaacagcacccccgugaccaccagcaccgaggccugcagcagccccaccaccagcgagggcaccagcaugcccaacagcaaccccagcgagggcaccaccccccugaccagcauccccgugagcaccacccccguggugagcagcgaggccagcacccugagcgccacccccguggacaccagcacccccggcaccaccagcgccgaggccaccagcagccccaccaccgccgagggcaucagcauccccaccagcacccccagcgagggcaagaccccccugaagagcauccccgugagcaacacccccguggccaacagcgaggccagcacccugagcaccacccccguggacagcaacagccccguggugaccagcaccgccgugagcagcagccccacccccgccgagggcaccagcaucgccaucagcacccccagcgagggcagcaccgcccugaccagcauccccgugagcaccaccaccguggccagcagcgagaucaacagccugagcaccacccccgccgugaccagcacccccgugaccaccuacagccaggccagcagcagccccaccaccgccgacggcaccagcaugcagaccagcaccuacagcgagggcagcaccccccugaccagccugcccgugagcaccaugcugguggugagcagcgaggccaacacccugagcaccacccccaucgacagcaagacccaggugaccgccagcaccgaggccagcagcagcaccaccgccgagggcagcagcaugaccaucagcacccccagcgagggcagcccccugcugaccagcauccccgugagcaccacccccguggccagccccgaggccagcacccugagcaccacccccguggacagcaacagccccgugaucaccagcaccgaggugagcagcagccccacccccgccgagggcaccagcaugcccaccagcaccuacaccgagggcagaaccccccugaccagcaucaccgugagaaccacccccguggccagcagcgccaucagcacccugagcaccacccccguggacaacagcacccccgugaccaccagcaccgaggccagaagcagccccaccaccagcgagggcaccagcaugcccaacagcacccccagcgagggcaccaccccccugaccagcauccccgugagcaccacccccgugcugagcagcgaggccagcacccugagcgccacccccaucgacaccagcacccccgugaccaccagcaccgaggccaccagcagccccaccaccgccgagggcaccagcauccccaccagcacccugagcgagggcaugaccccccugaccagcacccccgugagccacacccugguggccaacagcgaggccagcacccugagcaccacccccguggacagcaacagccccguggugaccagcaccgccgugagcagcagccccacccccgccgagggcaccagcaucgccaccagcacccccagcgagggcagcaccgcccugaccagcauccccgugagcaccaccaccguggccagcagcgagaccaacacccugagcaccacccccgccgugaccagcacccccgugaccaccuacgcccaggugagcagcagccccaccaccgccgacggcagcagcaugcccaccagcacccccagagagggcagacccccccugaccagcauccccgugagcaccaccaccguggccagcagcgagaucaacacccugagcaccacccuggccgacaccagaacccccgugaccaccuacagccaggccagcagcagccccaccaccgccgacggcaccagcaugcccacccccgccuacagcgagggcagcaccccccugaccagcaugccccugagcaccacccugguggugagcagcgaggccagcacccugagcaccacccccguggacaccagcacccccgccaccaccagcaccgagggcagcagcagccccaccaccgccggcggcaccagcauccagaccagcacccccagcgagagaaccaccccccuggccggcaugcccgugagcaccacccugguggugagcagcgagggcaacacccugagcaccacccccguggacagcaagacccaggugaccaacagcaccgaggccagcagcagcgccaccgccgagggcagcagcaugaccaucagcgcccccagcgagggcagcccccugcugaccagcaucccccugagcaccacccccguggccagccccgaggccagcacccugagcaccacccccguggacagcaacagccccgugaucaccagcaccgaggugagcagcagccccauccccaccgagggcaccagcaugcagaccagcaccuacagcgacagaagaaccccccugaccagcaugcccgugagcaccaccgugguggccagcagcgccaucagcacccugagcaccacccccguggacaccagcacccccgugaccaacagcaccgaggccagaagcagccccaccaccagcgagggcaccagcaugcccaccagcacccccagcgagggcagcacccccuucaccagcaugcccgugagcaccaugcccguggugaccagcgaggccagcacccugagcgccacccccguggacaccagcacccccgugaccaccagcaccgaggccaccagcagccccaccaccgccgagggcaccagcauccccaccagcacccugagcgagggcaccaccccccugaccagcauccccgugagccacacccugguggccaacagcgaggugagcacccugagcaccacccccguggacagcaacacccccuucaccaccagcaccgaggccagcagccccccccccaccgccgagggcaccagcaugcccaccagcaccagcagcgagggcaacaccccccugaccagaaugcccgugagcaccaccaugguggccagcuucgagaccagcacccugagcaccacccccgccgacaccagcacccccgugaccaccuacagccaggccggcagcagccccaccaccgccgacgacaccagcaugcccaccagcaccuacagcgagggcagcaccccccugaccagcgugcccgugagcaccaugcccguggugagcagcgaggccagcacccacagcaccacccccguggacaccagcacccccgugaccaccagcaccgaggccagcagcagccccaccaccgccgagggcaccagcauccccaccagcccccccagcgagggcaccaccccccuggccagcaugcccgugagcaccacccccguggugagcagcgaggccggcacccugagcaccacccccguggacaccagcacccccaugaccaccagcaccgaggccagcagcagccccaccaccgccgaggacaucguggugcccaucagcaccgccagcgagggcagcacccugcugaccagcauccccgugagcaccacccccguggccagccccgaggccagcacccugagcaccacccccguggacagcaacagccccguggugaccagcaccgagaucagcagcagcgccaccagcgccgagggcaccagcaugcccaccagcaccuacagcgagggcagcaccccccugagaagcaugcccgugagcaccaagccccuggccagcagcgaggccagcacccugagcaccacccccguggacaccagcauccccgugaccaccagcaccgagaccagcagcagccccaccaccgccaaggacaccagcaugcccaucagcacccccagcgaggugagcaccagccugaccagcauccuggugagcaccaugcccguggccagcagcgaggccagcacccugagcaccacccccguggacaccagaacccuggugaccaccagcaccggcaccagcagcagccccaccaccgccgagggcagcagcaugcccaccagcacccccggcgagagaagcaccccccugaccaacauccuggugagcaccacccugcuggccaacagcgaggccagcacccugagcaccacccccguggacaccagcacccccgugaccaccagcgccgaggccagcagcagccccaccaccgccgagggcaccagcaugagaaucagcacccccagcgacggcagcaccccccugaccagcauccuggugagcacccugcccguggccagcagcgaggccagcaccgugagcaccaccgccguggacaccagcauccccgugaccaccagcaccgaggccagcagcagccccaccaccgccgaggugaccagcaugcccaccagcacccccagcgagaccagcaccccccugaccagcaugcccgugaaccacacccccguggccagcagcgaggccggcacccugagcaccacccccguggacaccagcacccccgugaccaccagcaccaaggccagcagcagccccaccaccgccgagggcaucguggugcccaucagcaccgccagcgagggcagcacccugcugaccagcauccccgugagcaccacccccguggccagcagcgaggccagcacccugagcaccacccccguggacaccagcauccccgugaccaccagcaccgagggcagcagcagccccaccaccgccgagggcaccagcaugcccaucagcacccccagcgaggugagcaccccccugaccagcauccuggugagcaccgugcccguggccggcagcgaggccagcacccugagcaccacccccguggacaccagaacccccgugaccaccagcgccgaggccagcagcagccccaccaccgccgagggcaccagcaugcccaucagcacccccggcgagagaagaaccccccugaccagcaugagcgugagcaccaugcccguggccagcagcgaggccagcacccugagcagaacccccgccgacaccagcacccccgugaccaccagcaccgaggccagcagcagccccaccaccgccgagggcaccggcauccccaucagcacccccagcgagggcagcaccccccugaccagcauccccgugagcaccacccccguggccauccccgaggccagcacccugagcaccacccccguggacagcaacagccccguggugaccagcaccgaggugagcagcagccccacccccgccgagggcaccagcaugcccaucagcaccuacagcgagggcagcaccccccugaccggcgugcccgugagcaccacccccgugaccagcagcgccaucagcacccugagcaccacccccguggacaccagcacccccgugaccaccagcaccgaggcccacagcagccccaccaccagcgagggcaccagcaugcccaccagcacccccagcgagggcagcaccccccugaccuacaugcccgugagcaccaugcugguggugagcagcgaggacagcacccugagcgccacccccguggacaccagcacccccgugaccaccagcaccgaggccaccagcagcaccaccgccgagggcaccagcauccccaccagcacccccagcgagggcaugaccccccugaccagcgugcccgugagcaacacccccguggccagcagcgaggccagcauccugagcaccacccccguggacagcaacaccccccugaccaccagcaccgaggccagcagcagcccccccaccgccgagggcaccagcaugcccaccagcacccccagcgagggcagcaccccccugaccagcaugcccgugagcaccaccaccguggccagcagcgagaccagcacccugagcaccacccccgccgacaccagcacccccgugaccaccuacagccaggccagcagcagcccccccaucgccgacggcaccagcaugcccaccagcaccuacagcgagggcagcaccccccugaccaacaugagcuucagcaccacccccguggugagcagcgaggccagcacccugagcaccacccccguggacaccagcacccccgugaccaccagcaccgaggccagccugagccccaccaccgccgagggcaccagcauccccaccagcagccccagcgagggcaccaccccccuggccagcaugcccgugagcaccacccccguggugagcagcgaggugaacacccugagcaccacccccguggacagcaacacccuggugaccaccagcaccgaggccagcagcagccccaccaucgccgagggcaccagccugcccaccagcaccaccagcgagggcagcaccccccugagcaucaugccccugagcaccacccccguggccagcagcgaggccagcacccugagcaccacccccguggacaccagcacccccgugaccaccagcagccccaccaacagcagccccaccaccgccgaggugaccagcaugcccaccagcaccgccggcgagggcagcaccccccugaccaacaugcccgugagcaccacccccguggccagcagcgaggccagcacccugagcaccacccccguggacagcaacaccuucgugaccagcagcagccaggccagcagcagccccgccacccugcaggugaccaccaugagaaugagcacccccagcgagggcagcagcagccugaccaccaugcugcugagcagcaccuacgugaccagcagcgaggccagcacccccagcacccccagcguggacagaagcacccccgugaccaccagcacccagagcaacagcacccccaccccccccgaggugaucacccugcccaugagcacccccagcgaggugagcaccccccugaccaucaugcccgugagcaccaccagcgugaccaucagcgaggccggcaccgccagcacccugcccguggacaccagcacccccgugaucaccagcacccaggugagcagcagccccgugacccccgagggcaccaccaugcccaucuggacccccagcgagggcagcaccccccugaccaccaugcccgugagcaccaccagagugaccagcagcgagggcagcacccugagcacccccagcguggugaccagcacccccgugaccaccagcaccgaggccaucagcagcagcgccacccuggacagcaccaccaugagcgugagcaugcccauggagaucagcacccugggcaccaccauccuggugagcaccacccccgugaccagauuccccgagagcagcacccccagcauccccagcguguacaccagcaugagcaugaccaccgccagcgagggcagcagcagccccaccacccuggagggcaccaccaccaugcccaugagcaccaccagcgagagaagcacccugcugaccaccgugcugaucagccccaucagcgugaugagccccagcgaggccagcacccugagcaccccccccggcgacaccagcaccccccugcugaccagcaccaaggccggcagcuucagcauccccgccgaggugaccaccaucagaaucagcaucaccagcgagagaagcaccccccugaccacccugcuggugagcaccacccugcccaccagcuuccccggcgccagcaucgccagcacccccccccuggacaccagcaccaccuucacccccagcaccgacaccgccagcacccccaccauccccguggccaccaccaucagcgugagcgugaucaccgagggcagcacccccggcaccaccaucuucauccccagcacccccgugaccagcagcaccgccgacguguuccccgccaccaccggcgccgugagcacccccgugaucaccagcaccgagcugaacacccccagcaccagcagcagcagcaccaccaccagcuucagcaccaccaaggaguucaccacccccgccaugaccaccgccgccccccugaccuacgugaccaugagcaccgcccccagcacccccagaaccaccagcagaggcugcaccaccagcgccagcacccugagcgccaccagcaccccccacaccagcaccagcgugaccaccagacccgugacccccagcagcgagagcagcagacccagcaccaucaccagccacaccaucccccccaccuucccccccgcccacagcagcaccccccccaccaccagcgccagcagcaccaccgugaaccccgaggccgugaccaccaugaccaccagaaccaagcccagcaccagaaccaccagcuuccccaccgugaccaccaccgccgugcccaccaacaccaccaucaagagcaaccccaccagcacccccaccgugcccagaaccaccaccugcuucggcgacggcugccagaacaccgccagcagaugcaagaacggcggcaccugggacggccugaagugccagugccccaaccuguacuacggcgagcugugcgaggagguggugagcagcaucgacaucggcccccccgagaccaucagcgcccagauggagcugaccgugaccgugaccagcgugaaguucaccgaggagcugaagaaccacagcagccaggaguuccaggaguucaagcagaccuucaccgagcagaugaacaucguguacagcggcauccccgaguacgugggcgugaacaucaccaagcugagacugggcagcguggugguggagcacgacgugcugcugagaaccaaguacacccccgaguacaagaccgugcuggacaacgccaccgagguggugaaggagaagaucaccaaggugaccacccagcagaucaugaucaacgacaucugcagcgacaugaugugcuucaacaccaccggcacccaggugcagaacaucaccgugacccaguacgaccccgaggaggacugcagaaagauggccaaggaguacggcgacuacuucgugguggaguacagagaccagaagcccuacugcaucagccccugcgagcccggcuucagcgugagcaagaacugcaaccugggcaagugccagaugagccugagcggcccccagugccugugcgugaccaccgagacccacugguacagcggcgagaccugcaaccagggcacccagaagagccugguguacggccuggugggcgccggcguggugcugaugcugaucauccugguggcccugcugaugcugguguucagaagcaagagagaggugaagagacagaaguacagacugagccagcuguacaaguggcaggaggaggacagcggccccgcccccggcaccuuccagaacaucggcuucgacaucugccaggacgacgacagcauccaccuggagagcaucuacagcaacuuccagcccagccugagacacaucgaccccgagaccaagaucagaauccagagaccccaggugaugaccaccagcuucuaa

SEQ ID NO: 20159 - RNA, 25155 nt, Artificial Sequence
  MUC19__Homo_sapiens__NP_775871
augaagcugauccugugguaccuggugguggcccuguggugcuucuucaaggacguggaggcccugcuguacagacagaagagcgacggcaagaucgccgccagcagaagcggcggcuucagcuacggcagcagcagcagcggcgaccuggacagaaagaagccccuguucagccuggaguucggcagccccggcgagaccgaggacaagagcagacagagacaggacgccggcagccccaagagcgaggacacccccgccggcggcuucuucaacagcagcagcagcagcggcgacagcgacagaaccaagcccuucuucagccugggccugggcgcccccggcaaggccgaggacaagagcggcgacagccaggacgccggcggcagcaagagcgaggacaccccccccggcggcuucuucuacggcagcagcagcagcggcgacagcgacaagaagaagccccuguucagcuucgaguucggcgccaccggcgaggacgaggacaagagcagagagagaugggacgccggcaacagcagaagcgaggacagccccgccgacagcaccaacaccagauacggcgccggcuucagcagcagcggcgccagccuggacgugggcuucggcuggggcaucagcgacgagaagggccuggaggugagcaaggccgacggcagagagaccagaggcagcggcagcgccggcggcgagaccaucguguucggccccgacgccggcagcagcgugggcaccggcagcagcggccugaagcugggcgccggcaagggcgacgccgccuucggcuucgaggugagcgacagcaacagcuucggcgacaccggcaucagcagcaagaccguggagggcaaccagaccagcagcagcggcggcagcgugagcaucgaccugggcgacaccagcuucagaagcgagaaccaguucgugggcggcggcagccugaacagcaucagcaaccugugggacagcggccaggagggcuucggcaucaacgagaucggcggcaacggcaugagcggcagcgugagcgccgaggccggcuucaagggcuucggcagcgacagcagcagcagcggcgacagcagcgccagaaacggcuucgagaacagcagcggcaucagcgaggacagcggcgugauccugggcagcagcgaccagcacgagguggagcugagcagaaccggcggcaacagaaagagaagcagcgaccccgacgaggccggcaaccugagccccggcagcgacgugagcgacagcggcggcaacaccuggagcagcgacagcggcagcggcggcggcggcgugaccagcagcagcgaguacagcaccagcggcccccugaacacccccgagaagggcagccacauccccgaggccacccccaaguacagcgagaccaacgccaucaucggcgagaucagcaccuggagcaagggcgccuacaagagcuucaacggcagaaucuucuucuucgagagcagcugccccuacaccuucugcagacacugcaucgagagcggcggcgacuucaacaucgagaucaagagaaacaacgacagcgagaucgagaagaucaccgugcugaucgacaacaacgacgugagcaucuucggcgacaccauccuggugaacggcgagagcgugcagauccccuacaacaacaagcugauccacaucaagaaguacggcgagcacaacgugcugaacagcagaagaggcauccugacccugaugugggacaagaacaacaagcugagccugacccugcacaagcaguaccccaccugcggccugugcggcaacuucaacagcacccccggccaggacaucaacgagcacaucgccaacagcaagauccccggcgacugccccaacgccgugggcaagagcuacgaggugugcgaggacggcauccagcacugcaacaagaucaucggcaccuacuucgagaagugcggcaagguggccgcccugagcaacgacuacaagaugaucugcaucgacgaguacugccagaccagagacaagaccagcaccugcgacaccuacagcgagcugagcagacugugcgccagcgacggccccggcaccuucgagagcuggagaagcgacagcgacguggugugcggcacccagagaugccccgagcagcacaucuacaaggagugcggccccagcaaccccgccaccugcagcaacguggcccccuuccaggacagcgagugcgugagcggcugcaccugccccgagggcuaccugcuggacgacaucggcgagaagggcaagugcgugcugaaggccgagugccccugcgagagcagcggcaccguguaccagcccggcgaggugagagagggccccugcggcagccagugcaccugccaggacgccaaguggagcugcaccgaggcccugugccccggcagaugcaagguggagggcagcagccugaccaccuucgacggcgugaaguacaacuuccccggcaacugccacuuccuggccgugcacaacgaggacuggagcaucagcguggagcugagacccugccccagcggccagaccggcaccugccugaacagcgugacccugcugcugaacagcagcgugcccguggacaaguacguguucaacagcgacggcaccgugaccaacgacaagaucagaaaccagggcuacuacuacagcgacaagauccagaucuucaacgccagcagcagcuaccugcagguggagaccuacuuccacgugaagcugcagauccagaucgugcccgugaugcagcuguacgugagcaugccccccaaccaguucaccgacaccgugggccugugcggcagcuacaacaacaaggccgaggacgacuucaugagcagccagaacauccuggagaagaccagccaggccuucgccaacagcugggagaugaugagcugccccaagggcaaccccagcagcugcaucagcaucgagaaggagaaguucgccgagagacacugcggcauccugcuggacagcagcggcccccuggccagcugccaccccaucgugaaccccaagcccuaccacgaggagugcaagaaguacaccugcaccugcgagaacagccaggacugccugugcaccauccugggcaacuacgugaaggccugcgccgagaaggagaccuacaucgugggcuggagaaccggccugugcgagcacagcugccccagcggccugguguucaaguacaacgugaaggccugcaacagcagcugcagaagccugagcgagagagacagaagcugcgacguggaggacgugcccguggacggcugcaccugccccgacgccauguaccagaacaacgagggcaacugcgugcugaagagccagugcgacugcuacaucaacgacgaggugaugcagcccggcaagcugauccacaucgacgacaacaagugcgugugcagagacggcauccugcugugccagauccccaucgaccugacccugcagaacugcagcggcggcgccgaguacguggacugcagcgaccccaaggcccagagaagaaccaacagaaccugcagcaccagaaacauccccguguucgacgagaaccugcccugcaagagaggcugcuucugccccgagggcauggugagaaacagcaagggcaucugcguguuccccaacgacugccccugcagcuucggcggcagagaguacgacgagggcagcgugaccagcgugggcugcaacgagugcaccugcaucaagggcagcuggagcugcacccagaacgagugccagaccaucugccacaucuacggcgagggccacgugagaaccuucgacggcaagagcuacagcuucgacggccugugccaguacagcuuccuggaggacuacugcggccacgagaacggcaccuucagaauccugaccgagagcgugcccugcugcgaggacggccugaccugcagcagaaagaucaucguggccuuccaggaccagaacaucgugcugcaggacggcaaggugaccgccgugaagagcaccgagagcaagaagugcgagcugaacgccaacgccuacagcauccacaccgugggccuguaccugauccugaaguuccagaacggcaucaucgugaucugggacaagaacaccagacugagcgugauccuggaccccaacuggaacggcaaggugugcggccugugcggcaacaacaacggcgaccugaaggacgacuucaccaccagauacagcagcguggccagcggcgcccuggaguucggcaacagcuggaagaccagccaggagugcagcgacaccguggcccagaccuuccccugcgacagcaaccccuacugcaaggccugggccgugagaaagugcgagauccugagagacagcaccuucagagacugccacaacaagguggaccccagcgccuaccacgacgccugcaucgaggaggccugcgccugcgacauggagggcaaguaccugggcuucugcaccgccguggccauguacgccgaggccugcagcgccgugggcgugugcgugagcuggagaaagcccaaccugugccccguguacugcgacuacuacaacgcccccggcgagugcagauggcacuacgagcccugcggcaccgugaccgccaagaccugcaaggaccagcuggugggccagaaguucagcagccugcuggagggcugcuacgccaagugccccgacagcgcccccuaccuggacgagaacaccaugaagugcgugagccugagcgagugcagcugcuucuacaacgacgugauccccgccggcggcgugaucgaggacaacugcggcagaaccugcuacugcaucgccggccagcuggagugcagcgagaccgcccccaccaacagcaccuucgccgugagcaccaccaccgccaccaccauccugagcaccggcgccgccaucacccuggugaccggcggccccagcaccgccgccagcauccccgccaucaccaccagcagcagcgagaccaccggcaccacccugggcccccugaccgagcccuucaccaccggcaucaccgagaccagcgugcccaucaucagcaccagcggcaacgccggcaugaccggcguggugagccccaccgugaccggcgccagcggcauggccggcaccaccggcggcguggacgccgccaccaccggcgccgccagcgagaacaccagcgagagagccggcacccccagagugagcggcgagacccccgccgugggcggcggcagcacccccggcgaggccggccccggcgccaccgugagcggcagcaccggcgugagcgccggcagcaucaccgccagccccggcgccagcgccaccagcagcgagagcagcaagagcggcaccaccggccccagcgugggcggcaagaccggcgccaccagcagcgaggccaccagcagcgagggcaugagcggcgugaccggccagagccugggcagcaccgccggcagcgacagcgagaucaccgccaagaccagcuucaccggcagcagcccccccggcaagcugaccagacccagccccggcagccccggccacuucagcggcggcaccaccgaguggggcaacguggccaccaccggcgccgccggcgagaacaccagcggcgcccugggcagcaccgagggcagcguggaggccaccaccagcgccggcagcggcaacaccgccggcaccagcggcaccggcgacaccggccccggcaacaccgccgugagcggcacccccguggugagccccggcgccacccccggcgcccccggcagcagcacccccggcgaggccgacaucggcaacaccagcuucggcaagagcggcacccccaccgugagcgccgccagcaccaccagcagccccgugagcaagcacaccgacgccgccagcgccaccgccgugaccaucagcggcagcaagcccggcacccccggcacccccggcggcgccaccagcggcggcaagaucaccagcggcuggagcagcagcggcaccagcaccggcgccagcaacacccccggcgccaccggcagcagcaccggccagaccgacaccagcggccccagcgccaaggugaccggcaacuacggccagagcagcgagauccccggcaccaucaagagcagcagcgacgugagcggcaccaugggccagagcgacaccaccagcggccccagcguggccgugaccagaaccagcgagcagagcagcggcgugaccguggccagcgagcccagcgugggcgugagcggcaccaccggcccccuggccgagaucagcggcaccaccagaccccuggugagcggccugagaaccaccggcagcagcgccgagggcagcggcaccaccggccccagcagcagagagagcgugaccaccagaccccuggccgagggcagcggcaccagcggccagagcgugaccggcagcagagccaccggccugagcgccaccgagcugggcaccaccgugagcuucaccggcggccugggcaccagcagaagcagcgccagagagaccagaaccaccggccccagcgccgacggcagcggcaccaccggccccagcguggugagaagcggcaccaccagacugagcgugggcgugaccagagccaccgagagcagccccggcgugaccggcaccaccacccccagcgccgaggagagcagaaccaccggccccagcgugcuggugaccggcaccaccggccagagcggccagggcagcggcaccaccggcaagagcuucaucgagagcggccccagcguggugggcagcggcaccaccggccccaccagcgccggccugggcaccaccgcccccagcaccagaagaagcagcaccaccaagcccagcgugggcagaaccggcaccaccggccagagcggcgccgagagcggcaccaccgagcccagcgccagaguggccggcgugaccggcaccagcgccgaggugagcggcagaaucgagcccagcgccaccgagagcagcaccagcagaccccugggcgagaccaccggcaccaccauccccagcauggagggcagcgaggccaccggccccagcgugaucggcagcgagaccaccagacugagcgugaucggcagcggcaccaccggcaccagcagcggcggcagcggcgccaccagaagcagcggcggcggcaugggcaccaccggccagagcaccgccagaagcgagaccaccggcccccuguucggccugaccggcaccuucggccagagcgccaccgugaccggcaccagcagcaacagcgccggcgugaccacccccgagaagagccccggcguggccaugaccaccggccugcugguggagggcagcgccaccacccagcccagaauccuggagagcgagaccaccgagagcagcgccggcgugaucgugaccagcggccagagcgccagagugaccggcgccaccggccccagcgccggcgagaccggcaccaccgagcccagcaccgagggcagcguggccgccgugcuguucgugaucggcagcgagaccaccagaccccuggacaucggcagcggcaccaccggcacccugagcggcggcagcagcaccaccagaagcagcgacggcaccaccggcaccaccagaaagagcaccgccagaagcgagaccaccggccugagcggccugaccggcaccagcggccagcuggccggcgugaccggcaccagcagcaagagcgccggcgugaccgugaccagcgagaagagcgccggcguggccgugaucaccggcagcuucguggagagacccgugaccaccggccccccccugcuggagagcgagaccaccagacccagcggcggcgugaccgugaccagcggccagagcgccagagugaccgagaccgugggcgccagcgccggcgugaccggcaccaccggccccagcaccgagggcagcggcgccaccggccccagcguggugggcagcggcaccaccagaccccuggccggcgagagcggcaccaccgagagcagcgccggcgugaccggcaccagacccagcagcagcagagagagcgccaccaccggccccagcgacgagggcagcggcaccaccggccugagcgccggcgugaccgugaccagcggccagagcgugagaaagaccggcaccaccggcgcccccgccggcgugaccgagaccaccagacccagcguggugaagagcggcaccaccggccccagcgugaucggcaccagaaccaccggcaccagcagcggcggcagcggcgccaccagaagcagcggcggcgagaccgagaccaccggccagagcgccgugaagagcggcaccaccgagagcuucaccagacugaccagaaccagcggccagagcgccggcaugaccggcaccagcgcccagagcgccggcguggcccugaccagccccuucguggagggccuggugaccaccggcagcagcaccgugggccuggagaccaccagacccagcgccgugggcagcggcaagaccggcccccccguggugaaggcccagaccaccggccccagcgccggcgugaccgugaccagcggccagagcgccagaaugaccggcgccagcggccccagcgugggcgugaccggcaccaccggccccgccagcaagggccugggcaccaucagacccagcguggugggccuggagaccaccgagcugagcgccgagggcagcggcaccaccggcccccccaucgugggcgagaccaccgugcccagcgccggcgugaccgugaccagcggcuacagcgacagagugaccggcgccaccgagccccuggccggcgugaccggcaccaucaagcccagcguggccggcagcgugaccaccggccccagcgugaccggcguggagaccaccgccaagaccaccagcggcggccugagcaccaccaucagcagcgugggcggcaccggcaccaccggccagagccccgagagaagcggcaccaccggccccuucaccggccugaccggcaccagcgcccagagcgccggcgugaccaugaccagcauccagagcgccggcgugcuggugaccaccggccugaacguggacggccugggcaccaccggcaaggcccugaucggcagcggcaccaccggccugagcgccgaggccaccggcaccaucggccccagcaccgagggccuggagaagaccggccccagcaucaccggcagcggcaccaccagaccccuggugaccgagagcuggaccgccggcaccagcagcggcggccacagcaccaccagccccagcgugagaggcaccgagaccaccggccagagcgccgccgagagcgugaccaccggccccgugaccggcuacaccgagaccagcggccccagcgccggcgugaccgugacccccagacagagccccaccgugacccagaccaccggcagcagcgccgccgugagcggcaccaccgugcagagccugaccgugagcggcaccaccagacccagcagcggccagaccgagaucaccggcagcagcgugaaggagagcggcaccaccgagagcagcgccgugagaagcggcaccaccggccccaccgccggcgugaccggcaccaacggccccagcagcgccggcgugaccggcaucaccggcagcagccccggcgugaccggcaccaccggcagcagccccggcgugaccggcaccaccggcagcagcgccagaagcggcaccagcauccccagcgugggcaagaccggcaccaccagaaccagcguggaggagagcagaaccaccagacccagcgccggcaucaccggcaccaacggccugagcgccgaggugaccggcaccaccggcccccuggccggcgugaccggcaccaccggccccagcgccggcgugaccagaaccaccggccugagcgccggcgagaccggcaccaccggccugagccccggcgugaccagaaccaccagaagcagcgccggccugaccggcaagaccggccugagcgccggcgugaccggcaagaccggccugagcgccgaggugaccggcaccaccagacugagcgccggcgugaccggcaccaccggccccagccccggcgugaccggcaccaccggcacccccgccggcgugaccggcaccaccgagcugagcgccggcgugaccggcaagaccggccugagcagcgaggugaccgagaccaccggccugagcuacggcgugaagagaaccaucggccugagcgccggcagcaccggcaccagcggccagagcgccggcguggccggcaccaccacccugagcgccgaggugaccggcaccaccagacccagcgccggcgugaccggcaccaccggccugagcgccgaggugaccgagaucaccggcaucagcgccguggugaccggcaccaccggccccagcgccggcgugaccgagaccaccggcagcagcgccggcguggccggcaccaccagacugagcgccggcgugaccggcaucaccggccugagcgccggcgugaccggcaccaccggccugagcaccgaggugaccggcaccaccggccccagcgccggcgccaccggcaccaccggccugagcgugggcgugaccggcaucaccggccugagcgacguggugaccgagaccaccggcagcagcgccagaagcggcaccggcauccccagcgugggcgagaccagaaccaccagcaccagcguggaggagagcagaaccaccagacccagcgccggcaucaugggcaccaacggccugcccgccgaggugaccggcaccaccgagccccuggccggcggcaccggcaccaccggcauccuggccggcgugaccggcaccaccggccugagcgccggcgagaccggcaagaucggcagcagcgccggcgugaccggcaagaccggcagcagcgccagagugaccggcaagaccggccccagcgccgaggugaccggcaagaccggccugagcgccggcgugaccggcaccaccggccugagccccggcgugaccggcaccagcggccugagcgccgaggugaccggcaccaccggccccagcgccgaggccaccggccugcccggcgugagcgccggcgugaccggcaccaccggcagccuggccggcggcaccggcaccaucggccugagcgccggcgugaccggcaccaccggcagcagcgccggcgugaccggcaccaccggccugagcgccggcgugaccggcaucgccggccugagcgccggcgugaccggcaucaccggccccagcgccggcgugaccggcaccaccaccgugagcgccggcgugaccggcaccaccggccugagcgccgaggccaccgagaucaccggccugagcgccggcgugaccggcaccaccggccugagcgccggcgugaccgagaccaucagacugagcgccggcgugaccggcaccaucagaagcagcgccggcgugaccggcaucaccggccugagcgccggcgugaccggcaccaccggccccagcgccggcgugaccggcagcaccggccugcuggccggcgugaccgagaccaccggccagagcgccaaggugaccggcaccaccggccagagcgugggcgugaccggcaccaccagaagcagcggcggcgugaccggcaucaccggccugagcgccggcgugaccggcaccaacggccugagcgccgugaccggcaugaccggccugagcgccgaggugaccggcaccaccggccugagcgugggcgugaccggcaucgccggccugagcgccggcgugaccggcaucaccggccccagcgccggcaucaccggcaccaccaccaucagcgccggcgugaccggcaccagcggccugagcgccgaggccaccggcaucaccggccugagcgccggcgugaccggcaagaccggccugagcgccggcgugaccgagaccaucggccugagcgccgaggccaccggcaccaucggcagcagccccggcgugaccggcaccaccggcagcagcaccggcgugaccggcaucaccggccugagcgccggcgugaccggcaccaccggccugagcaccgaggugaccggcaccaccggccccagcgccggcgugaccagaaccaccggccugagcgccggcgugaccggcaucaccggccugagcgccaucgugaccgagaccaccggcagcagcgccagaagcggcaccagcauccccagcgugggcgagaccggcaccaccagaaccagcguggaggagagcagaaccaccagacccagcgccggcaucaccggcaccaacggccugagcgccgaggugaccggcaccaucggcccccuggccggcggcaccggcaccaccggccugagcgccggcgugaccggcaccgugggcagcagcgccguggugaccggcaccaccggccugagcgccggcgugaccggcaccaccggccccagcgccgaggagaccggcgccaccggccccagcgccgaggugaccgagaccaccggccccagcgccggcgugaccggcaccggcagacugagcgccgaggugaccggcaccaccggccccagcgccgaggugaccggccugcccggcgagagcgccgaggugaccggcaccaucggcagccccgccggcgugaccggcaccacccagcugagcgccguggugaccggcaucaccggccugagcgccgaggugaccggcaccaccggccugagcgccggcgugaccggcaucaccggccugagcgccgaggugaccagaaccaccggccugagcgccggcgugaccggcaccaucggccugagcgccggcgugaccggcaccaccagacccagcgccggcgugaccggcaccaccggccagagcgccgaggugaccggcaccaccgagcccagcgccggccugaccgagaccaccggcagcagcaccggcgugaccggcgccaccggcccccuggccggcgugaccggcaccaccggcaucagcaccgaggugaccggcaccaccggccccagcgccagagugaccggcaccaccgugcugagcgccggcgugaccggcaucaccggccugagcgccaucgugaccgagaccaccggcagcagcgccagaagcggcaccagcacccccagcgugggcgagaccggcaccaccagaaccagcguggaggagagcagagccaccagacccagcgccggcaucaccggcaccaacggccagagcgccgaggugaccuggaucaccggcccccuggccggcgugaccggcaccaccggcaucagcgccggcgugaccggcaccaccggccugagcgccggcgugaccggcaccaucggcagcagcgccguggugaccggcaucaacggccugagcgccggcgugaccggcaccaccggccccagcgccgaggagaccggcgccaccggccccagcgccgaggugaccggcaccaccggccccagcgccgaggagaccggcgccaccggccccagcgccgaggugaccggcaccaccggccccagcggcggcgugaccggcaccaacggccugagcgccgaggugaccggcaccaccggccccagcgccgaggugaccggccugcccggcgugagcgccggcgugaccggcaccaucggcagccccgccgccgugaccggcaccaucagacccagcgccguggugaccggcaucaccggccugagcgccgaggugaccggcaccaccggccugagcgccugggugaccggcaucgccggccugagcgccggcgugaccgagaccaucggcagcagcgccggcgugaccggcaccaacggccugagcgccgaggccaccggcaccaccggccccagcgccggcgugaccggcaccaccggccugagcgccggcgugaccggcaccgccggccugagcgccagagugaccgagagcaccggccugagcgccggcgugaccggcaccaccggccugagcgccggcgugaccggcaccaccggccccagcgccggcaucaccggcaccaacggccugagcgccgaggugaccggcaccaccggcccccuggccggcgugaccggcaccaucggccugagcgccggcgugaccggcaucgccggccugagcgccggcgugaccgagagcaccggccugagcgccggcgugaccggcaccaucagaagcagcgccguggugaccggcaucaacggccugagcgccggcgugaccggcaccaccggccccagcgccgaggagaccggcgccaccggccccagcgccgaggugaccggcaccaccggccccagcggcggcgugaccggcaccagcggcaucagcgccgaggugaccggcaccaccggccccagcgccgaggugaccggccugcccggcgugagcgccggcgugaccggcaccaucggcagccccgccgccgugaccggcaccaccagacccagcgccguggugaccggcaucagcggccugagcgccgaggugaccggcaccaccggccugagcgccggcgugaccgagaccaucggcagcagcgccggcgugaccggcaccaacggccugagcgccgaggccaccgagaccaccggccccagcgccggcgugaccggcaccaccggccugagcgccggcgugaccggcaccaccggccccagcgccggcaucgccggcaccaacggccugagcgccggcgugaccggcaccaccggccugagcgccagagugaccgagagcaccggccugagcgccggcgugaccggcaccaucggcagcagcgccguggugaccgagaccaccagacugagcagcggcgugaccggcaccaucggccccagcgccgaggagaccggcgccaccggccugagcgccgaggugaccggcaccaccggcagccuggccgaggugaccggcaccaccggccugagcgccggcgugaccggcaccaucggcagcagcgccguggugaccggcaccaccggccugagcgccggcaucaccggcaccaacggccugagcgccgaggugaccggcaccgccggcccccuggccggcgugaccggcaccaccggccugagcgccggcgugaccggcaccaccggccugagcgccggcgugaccgagaccaccggccagagcgccggcgugaccgagagcaccggccugagccccggcgugaccggcaccaucggcagcagcgccguggugaccggcaucaagggccugagcgccggcgugaccggcaccaccggccccagcgccgaggagaccggcgccaccggccccagcgccgaggugaccggcaccaccggccccagcggcggcgugaccggcaccagcgugcugagcguggaggugaccggcaccaccggccccagcgccgaggugaccggccugcccggcgugagcgccggccugaccggcaccaucggcagccccgccgccgugagaggcaccaccuggcccagcgccguggugaccggcaucagcggccugagcggcgaggugaccggcaccaccggccugagcgccggcgugaccggcaucggcggccugagcgccggcgugaccggcaccaucggcagcagcgccggcgugaccggcaccaacgcccugagcgccgaggccaccggcaccaccggccccagcgccggcgugaccggcaccaccggccugagcgccggcgugaccggcaccaccggccugagcgccggcgugaccggcaccaucagaagcagcgccguggugaccgagaccaccggccugagcgccggcgugaccggcaccaccggccccagcgccggcaucgccggcaccaacggccugagcgccgaggugaccggcaccaccggccugagcgccggcaugaccggcaccaccggccugagcgccagagugaccgagagcaccggccugagcgccggcgugaccggcaccaucggcagcagcgccguggugaccgagaccaccagacugagcgccggcgugaccggcaccaucggccccagcgccgaggagaccggcgccaccggccugagcgccgaggugaccagaaccaccggcagccuggccggcgugaccggcaccaccggccccagcgccguggugaccggcaagaccgagcugagcgccgaggugaccggcaccaccgagcugagcgccgaggugaccgagaagaccggccccagcgccgaggugaccggcaagaccggccugagcgccggcgugauggagaccaccggccccagcgccgaggugaccggcaccaccggcagcagcgccggcgugaccggcaccaccggccccagcgccggcgugaccggcaccaccggccccagcgccgaggccaccggccugcccggcgugagcgccggcgugaccggcaccaucggcagccccgccggcgugaccggcaccgccagacugagcgccguggugaccggcaucagcggccugagcgccgaggugaccggcaccaccggccugagcaccggcgugaccggcaucgccggccacagcgccgccgugaccggcaucaccagacccagcgccggcgugaccggcaccaccaccgugagcgccggcgugaccggcaccaucggccugagcgccgaggccaccggcaucacccugcccagcgccggcgugaccgagaccaccggccugagcgccggcgugaccgagaccaucggccugagcgccggcgugaccggcaccaucggcagcagcgccggcgugaccgagaucaccggccugagcgccggcgugaccggcaccaccggccccagcgccggcgugaccggcagcaccgugcugagcgccggcgugaccgccaccaccggccagagcgugggcgugaccggcaccaccggccccagcgccggcgugaccggcaccaccggccugagcgccggcgugaccggcaucgccggccugagcgccggcgugaccggcaucaccggccccagcgccggcgugaccggcaccaccaccgugagcgccggcgugaccggcaccaccggccugagcgccgaggccaccgagaucaccggccugagcgccggcgugaccggcaccaccggccugagcgccggcgugaccggcaucgccggccugagcgccggcgugaccgagaccaucggcagcagcgccggcgugaccggcaccaacggccugagcgccgaggccaccggcaagaccggccccagcgccggcgugaccggcaccaccggccugagcgccggcgugaccggcaccaccggccugagcgccggcgugaccgagaccaucggccugagcgccggcgugaccggcaccaucggcagcagcgccggcgugaagggcaccaccggccagagcgccgaggugaccggcgccaccggccagagcgugggcgugaccggcaccaccagaagcagcggcggcgugaccggcaucaccggccugagcgccggccugagaggcaccaccgugagcagcgccaaggccggcaccagcaucccccugaccggcaagaccggcaccaccagaaccagcguggaggagagcaccaccaccggccccagcgccggcaucaccggcaccaacggccugagcgccgagaugaccggcaccaacgagcugagcgccggcgugaccggcaccaucggcagcagcgccggcgugaccggcaccaccggccugagcguggaggccaccgugaccaccggccugagcgccggcgugaccggcaccaccgugccccuggccggcgugaccuggacccccggccccagcgccggcgugaccggcaucgccgcccugagcgccggcgugaccggcaagagcggccugagcgccggcgugaccggcaagaccggccugagcgccggcgugaccggcaccaccggccccagcgccgaggccaccggcaagaccggccugagcgccggcgugaccggcaucaccggccccuucgccgaggugaccggcaccaccggccugagcgccggcgugaucggcaccaccggcagcagcgccgaggugaccggcaucaccggccugagcgccggcgugaccggcaagaccagaagcagcgccggcgugaccggcaccaccggccugagcgccaagagcggcaccagcauccccagcgccggcaagaccggcaccaccaagaccagcguggaggagagcagaaccaccagacccagcgccggcaucaccgccaccaccggcgugcccgccgccaccagccccggcgccgagggcgagagcaucgccagcaccagcguggccaccggcgccauccccagaagcaccaucgcccccggcagcaccaccaccggcaccaccggcgugaccaccggcaccacccuggcccccagaagcuucaacaucggcaccagcggcggcaucagcggcaagacccugaagcccggcagcuacgugagcgaggccaccaccgccaccggcacccccggcgccggccccagcggcggcaccaccaucagcagccccgaggugagcaccaucagcgaggugagcaacaccggcaucaccggcgugggcagcgagaccagcaucgagaccggcaucagcaacaccgccaccaccggcguggcccccggcaccacccuggcccccggcagcagcagcaccgaggccaccaccagcaucggcggcagcgccagcaccagaggcggcaucgccaccgaggccaccggcagcaccagaggcgugagaaccaccggcagcgaggcccccgagggcaccagcggcgaguucagcggcaccaccaucagcagcggcggcuuccacaccgaggccaccacccugaccggcggcagaggcagcaucggcaccgagagcagagccgagagcaccaccagccugccccagagcgccaagaccagaggcggcauccugaccgaggccaccagcagcaccggcagaaucagagccaccggcagcgaggcccccggcggcaccagcagaaaguucagcggcaccaccaucagcagcggcggcagccacaccgaggccaccacccuggccggcggcagagacagcaccgagagcgaguucagaaccgccaccaucggcguggugcccgccaccaccguggcccccggcagcagcaagaccgaggccaccaccuuccugggcgugagcggcaccaccagcgugggcagagccaccggcgccaccaccagcaucgccggcagcgacaccagccaggccgagcaccccggcggcaccagcggcgaguuccccggcaccaccaucaccagcggcgacagccacaccgaggccaccgcccugaccggcagcagaggcagcaucggcaccgagagcaccguggagaccaccaccuacaucggcgagagcggcaccaccagaggcggccuggccaccgccaccaccggcgccuucagcggcaagacccuggagcccggcaacgacaacaccgaggccaccggcagcaccggcggcaucagagccaccagaaccgaggcccccggcggcaccagcggcgaguuccccggcaccaccuucaccagcggcggcagccacaccgaggccaccaccuucaccggcggcaagggcagcaccggcaccgagagcagagccgccaccaccagagccgcccccggcaccacccuggugcccggcagcagcaacaccggcgccaccgccagccccggcggcagcgccaccaccagaggcagaaucaccaccgccaccaccggcgccuucagcggcaagacccuggagagcgagaacgacaacaccgaggccaccagcagcaccagaggcgugagaaccaccagaagcgaggcccccggcggcaccagcggcgaguuccccggcaccagaaucaccagcggcggcagcuacaccgccaccaccagagccgcccccggcaccacccuggcccccggcagcagcaacaccggcgccaccgccagccugggcggcagcgccaugaccagaggcagaaucaccaccgccaccaccggcgccuucagcggcaagacccuggagcccggcaacaacaacaccgaggccaccagcagcaccagaggcgugagaaccaccagaagcgaggcccccggcgaggccaccacccugaccggcgacagaagcagcaccggcagcgagagcagaaccgccaccaccggcguggcccccggcaccaccguggcccccggcagcagcaagaccgaggccaccaccuuccugggcgugagcggcaccaccaacaucggcagagccaccggcgccaccaccagcaucgugggcagcgacaccagccaggccgagagacccggcggcaccaccguggugagccccggcgccagcagcaccagccagagcagcagacccggcaccagcgugacccccgacagcagcgccagcgagagcgagaccgugaccaccaaggaguucagcggcaccaccgccaucagcagaaccagccacaccggcacccccgccgccagcggcggccaggccaccggcagccugaccgccaccaccggcguggcccccggcaccaccguggcccccggcagcagcaacaccgaggccaccaccagcgugggcgagagagagaccaccaaggccgagaucaucaccggcgacaccggcgagcugagcggcaccaccaucaucagcgagaacagcaccaccgccggcaucaccgccgccaccggcaagcaggccggcaccagcgagguggcccccagcaccaccguggcccccggcagcuucagcaccgccgccaccaccagccccggcgccagcggcaccaccggcgugaccaccaccaccaagaccaccaccagccugggcggcagcggcaccaccggcgccgagaucaagagcgccaccaccggcgcccccggcagcagaaccggcaccgccggcgugcccagcgccaccaccgugagccccggcagcagcaacagcgaggccaccaccagcgugggcgagagcggcaagaccggcgccgagaccaucaccgaggccaccaccagcaccgagggcaccggcaccagcggcaccggcuucaagaccggcaccagcgagguggcccccgccaccaccguggcccccggcagcuucagcaccgccgccaccaccagccccggcgccagcggcaugaccggcgugaccaccaccaccaagaccaccaccagccugggcggcagcggcaccaccggcgccaagaucaagcuggugggcaccaccaccaccgcccccgagagcagaaccgccggcgugcccagcggcaccagagugacccccggcagcagcaacagcgaggccaccaccagcguggaggagagcagaaucaccagagccgaggugaucaccgaggccaccaccuucagcggcggcagcggcgccaccagagccggccugcccagaggcaccaccggcgaguucagcggcaccaacuucaucagcggcagcagcaacaccgaggccaccaccagcaccgagggcaccggcaccagcggcaccggcuucaagaucgccggcaucaccagcgcccccggcaagcaggccggcaccagcggcgugagccuggccaccaccguggcccccggcagcuucagcaccgccaccaccagcagcggcgccagcggcaucaccagagccggccccaccagcgagaccaccaccagccugggcggcagcggcaccaccggcgccgagaucaagagcgccgccgugcccagcggcaccaccguggcccccggcagcagcaacagcgaggccaccaccagcgugggcgagaacggcaagaccagaggcgagaucaucaccgacaccaccgagggcaccagcggcaaggugcuggagcccggcagcgcccacaccgaggccaccaccuuccccggcggcagcggcaccaccagagccggcccccccggcggcaccaccggcgagcugagcagaaugaccaucauccccggcagcagcaacaccgaggccaccaccagcaccaagggcaccggcaccagcggcaccggcuucaagaccggcaccagcuggguggcccccggcaccaccgugagccccggcagcuucagcaccgccaccaucagccccggcgccagcagaaccaccggcgccgcccccgccgccgagaccaccaccagccuggagggcggcggcaccaccggcgccgagaucaagagcggcgccaccagcggcgugcccggcagcaagaccggcaccgccggcgugcccagcgccaccaccaucgcccccggcagcagcaacagcgaggccaccaccagccugggcgagagcggcaagaccagaguggagaccaucaccggcaccaccgagggcaagacccuggccgccggcagcgcccacaccgaggccaccaccuucagcggcggcagcggcagcaccagagccggcccccugggcggcgccagcggcaccagcggcggcuacgugcccggcagagagaccgagcccaccaccagcaucgaggagaccggcaccagcagaaccaucuucaagaccgugggcaucaccagcgcccccggcagacaggccggcaccagcgugguggcccccagcaccaccguggcccccggcagcuucagcaccgccgccaccaccagccccggcgccagcggcaugaccggcgugagaaccaccagcaagaccaccaccagccugggcggcaccggcaccaccagaaccgagaucaagagcggcgccaccaccggcgcccccggcaucaagaccgacaucaugggcgagagcagcagaaccaccauccugagcggcagcagcaacaccgaggccaccaacagcaucgaggagaccggcaccagcggcaccggcuucaagaccgccggcaucaccgccgcccccggcaagcaggccggcaccagcggcguggcccccggcaccaccguggcccccggcagcuucagcaccgccgccaccaccagccccggcgccagcggcgugaccggcaccggccccaccgccgagaccaccaccuuccugggcggcagcagcaccaccggcgccgagaucaagagcggcgccaccaccggcgcccccggcagcaagaccggcaccgccaaggugcugagcggcaccaccguggccagcggcagcagcaacagcgaggccaccaccuucagcggcaucaccgaggccgugaccgugcccagcaagaacggcagcaugaccaccgcccugggcagccagcugagcagcagccagaccgugauccccggcagcagcggcaccaucagccacaccaccguggcccccggcagcagcgugaccggcaccaccaccggcgccagcgacgaccaggugaccggcagcaagaccggcaccaccggcguggcccugagcaccaccguggcccccggcagcagcagcaccgaggccaccaccagcaccggcgugcacagaaccaccguggugggccagaagaccggcgccaccaccagaggcagcgccaagcagggcaccagaagcaccaucgaggccaccaccagcuucagaggcaccggcaccaccggcagcggcaugaacaccggcaccaccggcguggugagcggcaacaccaucagccccagcagcuucaacaccgaggccaccagcggcaccagcgagagacccaaccccggcagcgagaucggcaccaccggcaucgugagcggcaccaccguggcccccggcagcagcaacaccgaggccaccaccagccugggcaacggcggcaccaccgaggccggcagcaagaucgugaccaccggcaucaccaccggcaccaccaucgugcccggcagcuucaacaccaaggccaccaccagcaccgacgugggcguggccaccggcgugggcauggccaccggcaucaccaacaucaucagcggcagaagccagcccaccggcagcaagaccggcuacaccgugaccggcagcggcaccaccgcccugcccggcggcuucagaaccggcaacacccccggcagcaccggcgugaccagcagccaggagggcaccaccguggugagcagcggcaucaccggcauccccgagaccagcaucagcggccccagcaaggaggccagcgacaagaccaccgcccccggcccccccaccaccgugaccgccagcaccggcgugaaggagaccagcgagaccggcgugcagaccggcagcacccuggugaccgccggcgugcccaccagaccccaggugagccagcccgagaccaccgugguggccaccagagagguggagaccgagaacaagaccgagugccuggccagccugccccccgcccccgugugccacggcccccugggcgaggagaagagccccggcgacaucuggaccgccaacugccacagaggcaccugcaccgacgccaagaccaucgacugcaagcccgaggagugccccagcccccccaccugcaagaccggcgagaagcuggugaaguuccagagcaacgacaccugcugcgagaucggcuacugcgagcccagaaccugccuguucaacaacaccgacuacgagaucggcgccagcuucgacgaccccagcaaccccugcgugagcuacagcugcaaggacaccggcuucgccgccguggugcaggacugccccaagcagaccuggugcgccgaggccaacagaaucuacgacagcaagaagugcugcuacaccugcaagaacaacugcagaagcagccuggugaacgugaccgugaucuacagcggcugcaagaagagagugcagauggccaagugcaccggcgagugcgagaagaccgccaaguacaacuacgacauccugcugcuggagcacagcugccugugcugcagagaggagaacuacgagcugagagacaucgugcuggacugccccgacggcagcaccauccccuaccaguacaagcacaucaccaccugcagcugccuggacaucugccagcuguacaccaccuucauguacagcuaa

SEQ ID NO: 20160 - RNA, 795 nt, Artificial Sequence
  MUC1__Homo_sapiens__NP_001018016
augacccccggcacccagagccccuucuuccugcugcugcugcugaccgugcugaccgccaccaccgcccccaagcccgccaccguggugaccggcagcggccacgccagcagcacccccggcggcgagaaggagaccagcgccacccagagaagcagcgugcccagcagcaccgagaagaacgccuucaacagcagccuggaggaccccagcaccgacuacuaccaggagcugcagagagacaucagcgagauguuccugcagaucuacaagcagggcggcuuccugggccugagcaacaucaaguucagacccggcagcgugguggugcagcugacccuggccuucagagagggcaccaucaacgugcacgacguggagacccaguucaaccaguacaagaccgaggccgccagcagauacaaccugaccaucagcgacgugagcgugagcgacgugcccuuccccuucagcgcccagagcggcgccggcgugcccggcuggggcaucgcccugcuggugcuggugugcgugcugguggcccuggccaucguguaccugaucgcccuggccgugugccagugcagaagaaagaacuacggccagcuggacaucuuccccgccagagacaccuaccaccccaugagcgaguaccccaccuaccacacccacggcagauacgugccccccagcagcaccgacagaagccccuacgagaaggugagcgccggcaacggcggcagcagccugagcuacaccaaccccgccguggccgccaccagcgccaaccuguaa

SEQ ID NO: 20161 - RNA, 2130 nt, Artificial Sequence
  MUC20__Homo_sapiens__NP_001269435
augggcugccuguggggccuggcccugccccuguucuucuucugcugggaggugggcgugagcggcagcagcgccggccccagcaccagaagagccgacaccgccaugaccaccgacgacaccgaggugcccgccaugacccuggcccccggccacgccgcccuggagacccagacccugagcgccgagaccagcagcagagccagcacccccgccggccccauccccgaggccgagaccagaggcgccaagagaaucagccccgccagagagaccagaagcuucaccaagaccagccccaacuucauggugcugaucgccaccagcguggagaccagcgccgccagcggcagccccgagggcgccggcaugaccaccgugcagaccaucaccggcagcgaccccagagaggccaucuucgacacccugugcaccgacgacagcagcgaggaggccaagacccugaccauggacauccugacccuggcccacaccagcaccgaggccaagggccugagcagcgagagcagcgccagcagcgacagcccccaccccgugaucacccccagcagagccagcgagagcagcgccagcagcgacggcccccaccccgugaucacccccagcagagccagcgagagcagcgccagcagcgacggcccccaccccgugaucacccccagcagagccagcgagagcagcgccagcagcgacggcccccaccccgugaucacccccagcagagccagcgagagcagcgccagcagcgacggcccccaccccgugaucacccccagcagagccagcgagagcagcgccagcagcgacggcccccaccccgugaucacccccagcagagccagcgagagcagcgccagcagcgacggcccccaccccgugaucacccccagcagagccagcgagagcagcgccagcagcgacggcccccaccccgugaucacccccagcagagccagcgagagcagcgccagcagcgacggcccccaccccgugaucacccccagcagagccagcgagagcagcgccagcagcgacggccugcaccccgugaucacccccagcagagccagcgagagcagcgccagcagcgacggcccccaccccgugaucacccccagcagagccagcgagagcagcgccagcagcgacggcccccaccccgugaucacccccagcuggagccccggcagcgacgugacccugcuggccgaggcccuggugaccgugaccaacaucgaggugaucaacugcagcaucaccgagaucgagaccaccaccagcagcauccccggcgccagcgacaccgaccugauccccaccgagggcgugaaggccagcagcaccagcgacccccccgcccugcccgacagcaccgaggccaagccccacaucaccgaggugaccgccagcgccgagacccugagcaccgccggcaccaccgagagcgccgcccccgacgccaccgugggcaccccccugcccaccaacagcgccaccgagagagaggugaccgcccccggcgccaccacccugagcggcgcccuggugaccgugagcagaaacccccuggaggagaccagcgcccugagcguggagacccccagcuacgugaaggugagcggcgccgcccccgugagcaucgaggccggcagcgccgugggcaagaccaccagcuucgccggcagcagcgccagcagcuacagccccagcgaggccgcccugaagaacuucacccccagcgagacccccaccauggacaucgccaccaagggccccuuccccaccagcagagacccccugcccagcgugccccccaccaccaccaacagcagcagaggcaccaacagcacccuggccaagaucaccaccagcgccaagaccaccaugaagccccccaccgccacccccaccaccgccagaaccagacccaccaccgacgugagcgccggcgagaacggcggcuuccugcugcugagacugagcguggccagccccgaggaccugaccgaccccagaguggccgagagacugaugcagcagcugcacagagagcugcacgcccacgccccccacuuccaggugagccugcugagagugagaagaggcuaa

SEQ ID NO: 20162 - RNA, 1701 nt, Artificial Sequence
  MUC21__Homo_sapiens__NP_001010909
augaagaugcagaagggcaacgugcugcugauguucggccugcugcugcaccuggaggccgccaccaacagcaacgagaccagcaccagcgccaacaccggcagcagcgugaucagcagcggcgccagcaccgccaccaacagcggcagcagcgugaccagcagcggcgugagcaccgccaccaucagcggcagcagcgugaccagcaacggcgugagcaucgugaccaacagcgaguuccacaccaccagcagcggcaucagcaccgccaccaacagcgaguucagcaccgugagcagcggcaucagcaucgccaccaacagcgagagcagcaccaccagcagcggcgccagcaccgccaccaacagcgagagcagcacccccagcagcggcgccagcaccgccaccaacagcgacagcagcaccaccagcagcggcgccagcaccgccaccaacagcgacagcagcaccaccagcagcgaggccagcaccgccaccaacagcgagagcagcaccaccagcagcggcgccagcaccgccaccaacagcgagagcagcaccgugagcagcagagccagcaccgccaccaacagcgagagcagcaccaccagcagcggcgccagcaccgccaccaacagcgagagcagaaccaccagcaacggcgccggcaccgccaccaacagcgagagcagcaccaccagcagcggcgccagcaccgccaccaacagcgagagcagcacccccagcagcggcgccggcaccgccaccaacagcgagagcagcaccaccagcagcggcgccggcaccgccaccaacagcgagagcagcaccgugagcagcggcaucagcaccgugaccaacagcgagagcagcacccccagcagcggcgccaacaccgccaccaacagcgagagcagcaccaccagcagcggcgccaacaccgccaccaacagcgacagcagcaccaccagcagcggcgccagcaccgccaccaacagcgagagcagcaccaccagcagcggcgccagcaccgccaccaacagcgagagcagcaccaccagcagcggcgccagcaccgccaccaacagcggcagcagcaccaccagcagcggcaccagcaccgccaccaacagcgagagcagcaccgugagcagcggcgccagcaccgccaccaccagcgagagcagcaccaccagcagcggcgccagcaccgccaccaacagcgagagcagcaccgugagcagcggcgccagcaccgccaccaacagcgagagcagcaccaccagcagcggcgccaacaccgccaccaacagcggcagcagcgugaccagcgccggcagcggcaccgccgcccugaccggcaugcacaccaccagccacagcgccagcaccgccgugagcgaggccaagcccggcggcagccuggugcccugggagaucuuccugaucacccuggugagcgugguggccgccgugggccuguucgccggccuguucuucugcgugagaaacagccugagccugagaaacaccuucaacaccgccguguaccacccccacggccugaaccacggccugggccccggccccggcggcaaccacggcgccccccacagacccagauggagccccaacugguucuggagaagacccgugagcagcaucgccauggagaugagcggcagaaacagcggccccuaa

SEQ ID NO: 20163 - RNA, 5322 nt, Artificial Sequence
  MUC22__Homo_sapiens__NP_001185744
augagaagaggcaacaucagccccgccuucugguuccuguggcugcugcuguucggccugcugggccccagcagcgagaacaccaccgccuucaccaagggcagcgacaccaccaccgccagcaucaccggcagcgagaccaccauggccagcaccauggccagcaccagcgcccugaccaccggcagcaagaucaccaccgacagcaccaccggcagcgagaccaccagcgccagcaccauggccagcaccgccgccuucaccaccggcagcgagaccaacaccgccagcaccaccgacagcggcaccaccaucgccagcaccagaaccuucaccaccggcagcgacaccaccaccggcagcaccgccggcagcgagaccaucguggccagcaccaccgugagcggcaccaccaccaccuucaccaucgccagcaccaccgugcccgagaccaccauggccagcagcaccaccagcaccgccggcagcgagaagaccauggccagcagcaucaucagcgagaccaccauggccagcaccaccggcagcgagaccgccaccgugagcaccaccggcagcgagaccaccaccaccagcaccgccagcagcgaggccaccaaggugagcaccaccggcagcgagaccaccaccgccagcaccgccggcagcgagaccaccaccaccagcaccagcauggccggcagcgaggccaccaccaccagcaccgccgacagcaaggugaucaccgccagcagcaugagcagcgagaccaccguggcccccgccgccggcagcaacaccaccaccgccagcaccaccggcagcgagaccaccaccauccugaucaaggccagcgagaccaccaccgccagcaccgccggcagcgagaccaccacccccagccccaccggcagccagaccaccaucgugagcaucagcggcagcgagaucaccaccaccagcaccgccggcagcgagaacaccaccgugagcagcgccggcagcggcaccaccaccgccagcauggccggcagcgagaccaccgugagcaccgccggcagcgagaccaccaccgugagcaucaccggcaccgagaccaccauggugagcgccaugggcagcgagaccaccaccaacagcaccaccagcagcgagaccaccgugaccagcaccgccggcagcgagaccaccaccgugagcaccgugggcagcgagaccaccaccgccuacaccgccgacagcgagaccaccgccgccagcaccaccggcagcgagaugaccaccguguucaccgccggcagcgagaccaucacccccagcaccgccggcagcgagaccaccaccgugagcaccgccggcagcgagaccaccaccgugagcaccaccggcagcgagaccaccaccgccagcaccgcccacagcgagaccaccgccgccagcaccaugggcagcgagaccaccaaggugagcaccgccggcagcgagaccaccgugagcaccgccggcagcgagaccaccgccgccagcaccgaggacagcgagaccaacaccgccuucaccgaggacagcaagaccaccaccgccagcaccaccggcuucgagaccaccgccgccagcaccaccggcagcgagcccaccauggccagcaccaugggcagcgagaccaccauggccagcaccaucggccccgagaccaccaaggugagcaccgccagcagcgaggugaccaccguguucgccgccggcagcgagaccaucagagccagcaccgugggcagcgagaccaccaccgugagcaccaccggcagcgagaccaccaccgccagcaucaugggcagcgagaccagcaccgacagcaccaccggcagcgagaccaccaccgccagcaccgagggcagcgagaccaccaccgccagcaccgagggcagcgaggccaccaccgugagcaccaccggcagcgagaccaccaccgugagcaucaccgacagcgagaccaccaccaccugcaccgagggcagcgagaugaccgccgugagcaccaccguguucgagaccaccaccgccagcaccgagggcagcgagaucaccaucgccagcaccagcgacagcgagaccaccaccgccagcaccgagggcagcgagaccaccaccgugaccaccgccggcagcgagaccaagaccgccuacaccaccggcagcgagaccaccaccgccagcaacaccggccuggagaccaccaccguguucaccaucggcagcgacaccaccaccgccagcaccgagggcagcgagaccaccgccgugagcgccaccggcagcgagaugaccaccgugagcaccgagggcagcgagaacaccaccgugagcaccaccggcagcgagaccaccaccgugagcaccaccggccuggagaccaccaccaccagcaccgagggcagcgagaugaccaccgugagcaccaccggcgccgagaccaccaccgacagcaccgagggcagcggcaccaccgccgccagcaccgccggcagcgagaccaccaccgugagcaccgccgacagcgagaacaccaccgccagcaccgccgacagcgagaccaccagcgccagcaccaccggcagcgagaccaccaccgccagcaccaccagcagcgagaccaccaccgccagcaccgagggcagcgagaccaccaccgugagcaccaccgacagcgagaccaccauggugagcaccaccggcagcgagagaaccaucaccagcaccgagggcagcgagaccaccaccgugagcgccaccggcagcgagaccaccgugagcaccgagggcagcggcaccaccaccgugagcaucaccggcagcgagaccaccaaggugagcaccaccggcagcgagaccaccaccaccagcaccgagggcagcgagaucaccaccgccagcaucaccggcagcgagaccaccaccgccagcaccgagggcagcgagaccaccaccgccagcaccgagggcagcgagaccaccagcgccagcaccaccggcagcgagaccaccaccgccagcaccaccagcagcgagaccaccauggccagcaucaugggcagcgagaccaccauggccagcaccaucggcagcgagaccaccaaggugagcaccgccagcagcaagaugaccaccguguucaccgagaacagcgagaccaccaucgccagcaccaccgccagcgagaccaccaccgugagcaccgccggcagcgagaccauccccgccagcaccgccggcagcgagaccaccaccaccaccagcaccgagggcagcgagaccaccaccgccagcaccgagggcagcgagaccaccaccgccagcaccgagagcagcgagaccaccaccgccaccaccaucggcagcgagaccaccaccgccagcaccgagggcagcgagaccaccaccaccagcaccgagggcagcgagaccaccaccgccagcaccgagggcagcgagaucaccaccgugagcaccaccggcagcgagaccaccaccgccagcaccgagggcagcgagaccaccaccgccagcaccgagggcagcgagcugaccaccgugagcaccaccggcagcgagaccaucaccgugagcgccgagggcagcgagaccaccaccgugaccaccaugggcagcgagaccaccaccgccagcaccgccggcagcgagaccaccaccgugagcaccgccggcagcgagaccaccaccgccagcaucgagggcagcgagaccaccaccgugagcagcaccggcagcgagaccaccaccgugagcaccaccggcaccgagaccaccaucaccagcaccgagggcagcgagaccaccaccgugaccaccgccggcagcgagaccaccgccguguacaccaccggcagcgagaccaccaccaccagcaccgagggcagcgagaccaccaccgugagcaccaccggcagcgagaccaccaccgccagcaccgccgaccuggagaccaccaccgugagcaccagcggcagcggcaccaccaccgccagcaccgccggcagcgagaccaccaccguguacaucaccggcagcaagaccaccaccgccagcaccgagggcagcgaggccaccaccgugagcaccaccagcagcgagaccaccaccgccagcaccaccggcagcgagaugaccaccguguucaccaccgugagcgagaccaccaccgugagcaccaucggcagcgaggccaccaccagcagcgccgccggcagcgaggccaccaccaccagcaccgagggcagcgagaccaccaccgccagcaccgccggcagcgagaccaccaccgccagcaccgccggcagcgagaccaccaccgccagcaccagcggcagcgagaccaacaccgccugcaccaccggcagcgagaccagcacccccagcagcgccggcagcgagaccaacaccgccuucaucaucggcagcgagagcaccaucgccagcaccgccagccuggagcccaccgccaccagccugaccggcagcgagaccaccaccgugagcaucaccgccagcggcgccaccgccgccagcaccaccgugagcagcaccaccuucgugcugaccaaggccaccgacgugagcauccagcccaucaccaacacccccaugagcggcaccagaaccaccggcaccagacugaccgccagcagcagcgugaccauggcccccggcauggacuucaccgccagcgccgccagccacaccgugcccggcaucgugcugaacaccagcggccugggcaccagcaccaugggcgccagcagcaccaccagcgcccacggcgugagaaccaccaccggcagcaccagagagcccaccagcagcaccuuccaggagaccggccccgugagcaugggcaccaacaccgugagcaugagccacacccccaccaacgugaucaagcccagcggcuaccugcagcccugggccaucauccugaucagccuggccgccgugguggccgccgugggccugagcgugggccugagcuucugccugagaaaccuguucuucccccugagauacugcggcaucuacuacccccacggccacagccacagccugggccuggaccugaaccugggccugggcagcggcaccuuccacagccugggcaacgcccuggugcacggcggcgagcuggagaugggccacggcggcacccacggcuucggcuacggcgugggccacggccugagccacauccacggcgacggcuacggcgugaaccacggcggccacuacggccacggcggcggccacuaa

SEQ ID NO: 20164 - RNA, 15540 nt, Artificial Sequence
  MUC2__Homo_sapiens__NP_002448
augggccugccccuggccagacuggccgccgugugccuggcccugagccuggccggcggcagcgagcugcagaccgagggcagaaccagaaaccacggccacaacgugugcagcaccuggggcaacuuccacuacaagaccuucgacggcgacguguucagauuccccggccccugcgacuacaacuucgccagcgacugcagaggcagcuacaaggaguucgccgugcaccugaagagaggccccggccaggccgaggcccccgccggcguggagagcauccugcugaccaucaaggacgacaccaucuaccugaccagacaccuggccgugcugaacggcgccguggugagcaccccccacuacagccccggccugcugaucgagaagagcgacgccuacaccaagguguacagcagagccggccugacccugauguggaacagagaggacgcccugaugcuggagcuggacaccaaguucagaaaccacaccugcggccugugcggcgacuacaacggccugcagagcuacagcgaguuccugagcgacggcgugcuguucagcccccuggaguucggcaacaugcagaagaucaaccagcccgacguggugugcgaggaccccgaggaggagguggcccccgccagcugcagcgagcacagagccgagugcgagagacugcugaccgccgaggccuucgccgacugccaggaccuggugccccuggagcccuaccugagagccugccagcaggacagaugcagaugccccggcggcgacaccugcgugugcagcaccguggccgaguucagcagacagugcagccacgccggcggcagacccggcaacuggagaaccgccacccugugccccaagaccugccccggcaaccugguguaccuggagagcggcagccccugcauggacaccugcagccaccuggaggugagcagccugugcgaggagcacagaauggacggcugcuucugccccgagggcaccguguacgacgacaucggcgacagcggcugcgugcccgugagccagugccacugcagacugcacggccaccuguacacccccggccaggagaucaccaacgacugcgagcagugcgugugcaacgccggcagaugggugugcaaggaccugcccugccccggcaccugcgcccuggagggcggcagccacaucaccaccuucgacggcaagaccuacaccuuccacggcgacugcuacuacgugcuggccaagggcgaccacaacgacagcuacgcccugcugggcgagcuggcccccugcggcagcaccgacaagcagaccugccugaagaccguggugcugcuggccgacaagaagaagaacguggugguguucaagagcgacggcagcgugcugcugaacgagcugcaggugaaccugccccacgugaccgccagcuucagcguguucagacccagcagcuaccacaucauggugagcauggccaucggcgugagacugcaggugcagcuggcccccgugaugcagcuguucgugacccuggaccaggccagccagggccaggugcagggccugugcggcaacuucaacggccuggagggcgacgacuucaagaccgccagcggccugguggaggccaccggcgccggcuucgccaacaccuggaaggcccagagcaccugccacgacaagcuggacuggcuggacgaccccugcagccugaacaucgagagcgccaacuacgccgagcacuggugcagccugcugaagaagaccgagacccccuucggcagaugccacagcgccguggaccccgccgaguacuacaagagaugcaaguacgacaccugcaacugccagaacaacgaggacugccugugcgccgcccugagcagcuacgccagagccugcaccgccaagggcgugaugcuguggggcuggagagagcacgugugcaacaaggacgugggcagcugccccaacagccagguguuccuguacaaccugaccaccugccagcagaccugcagaagccugagcgaggccgacagccacugccuggagggcuucgcccccguggacggcugcggcugccccgaccacaccuuccuggacgagaagggcagaugcgugccccuggccaagugcagcugcuaccacagaggccuguaccuggaggccggcgacgugguggugagacaggaggagagaugcgugugcagagacggcagacugcacugcagacagaucagacugaucggccagagcugcaccgcccccaagauccacauggacugcagcaaccugaccgcccuggccaccagcaagcccagagcccugagcugccagacccuggccgccggcuacuaccacaccgagugcgugagcggcugcgugugccccgacggccugauggacgacggcagaggcggcugcgugguggagaaggagugccccugcgugcacaacaacgaccuguacagcagcggcgccaagaucaagguggacugcaacaccugcaccugcaagagaggcagaugggugugcacccaggccgugugccacggcaccugcagcaucuacggcagcggccacuacaucaccuucgacggcaaguacuacgacuucgacggccacugcagcuacguggccgugcaggacuacugcggccagaacagcagccugggcagcuucagcaucaucaccgagaacgugcccugcggcaccaccggcgugaccugcagcaaggccaucaagaucuucaugggcagaaccgagcugaagcuggaggacaagcacagaguggugauccagagagacgagggccaccacguggccuacaccaccagagaggugggccaguaccuggugguggagagcagcaccggcaucaucgugaucugggacaagagaaccaccguguucaucaagcuggcccccagcuacaagggcaccgugugcggccugugcggcaacuucgaccacagaagcaacaacgacuucaccaccagagaccacaugguggugagcagcgagcuggacuucggcaacagcuggaaggaggcccccaccugccccgacgugagcaccaaccccgagcccugcagccugaacccccacagaagaagcugggccgagaagcagugcagcauccugaagagcagcguguucagcaucugccacagcaagguggaccccaagcccuucuacgaggccugcgugcacgacagcugcagcugcgacaccggcggcgacugcgagugcuucugcagcgccguggccagcuacgcccaggagugcaccaaggagggcgccugcguguucuggagaacccccgaccugugccccaucuucugcgacuacuacaaccccccccacgagugcgaguggcacuacgagcccugcggcaacagaagcuucgagaccugcagaaccaucaacggcauccacagcaacaucagcgugagcuaccuggagggcugcuaccccagaugccccaaggacagacccaucuacgaggaggaccugaagaagugcgugaccgccgacaagugcggcugcuacguggaggacacccacuacccccccggcgccagcgugcccaccgaggagaccugcaagagcugcgugugcaccaacagcagccagguggugugcagacccgaggagggcaagauccugaaccagacccaggacggcgccuucugcuacugggagaucugcggccccaacggcaccguggagaagcacuucaacaucugcagcaucaccaccagacccagcacccugaccaccuucaccaccaucacccugcccaccacccccaccaccuucaccaccaccaccaccaccaccacccccaccagcagcaccgugcugagcaccacccccaagcugugcugccuguggagcgacuggaucaacgaggaccaccccagcagcggcagcgacgacggcgacagagagaccuucgacggcgugugcggcgcccccgaggacaucgagugcagaagcgugaaggacccccaccugagccuggagcagcugggccagaaggugcagugcgacgugagcgugggcuucaucugcaagaacgaggaccaguucggcaacggccccuucggccugugcuacgacuacaagaucagagugaacugcugcuggcccauggacaagugcaucaccacccccagcccccccaccaccacccccagccccccccccaccagcaccaccacccugccccccaccaccacccccagcccccccaccaccaccaccaccacccccccccccaccaccacccccagcccccccaucaccaccaccaccacccccccccccaccaccacccccagcccccccaucagcaccaccaccacccccccccccaccaccacccccagcccccccaccaccacccccagcccccccaccaccacccccagcccccccaccaccaccaccaccacccccccccccaccaccacccccagcccccccaccaccacccccaucaccccccccgccagcaccaccacccugccccccaccaccacccccagcccccccaccaccaccaccaccacccccccccccaccaccacccccagcccccccaccaccacccccaucaccccccccaccagcaccaccacccugccccccaccaccacccccagccccccccccaccaccaccaccacccccccccccaccaccacccccagcccccccaccaccaccacccccagcccccccaccaucaccaccaccacccccccccccaccaccacccccagcccccccaccaccaccaccaccacccccccccccaccaccacccccagcccccccaccaccacccccaucaccccccccaccagcaccaccacccugccccccaccaccacccccagccccccccccaccaccaccaccacccccccccccaccaccacccccagcccccccaccaccaccacccccagcccccccaucaccaccaccaccacccccccccccaccaccacccccagcagccccaucaccaccacccccagcccccccaccaccaccaugaccacccccagccccaccaccacccccagcagccccaucaccaccaccaccacccccagcagcaccaccacccccagccccccccccaccaccaugaccacccccagccccaccaccacccccagcccccccaccaccaccaugaccacccugccccccaccaccaccagcagcccccugaccaccaccccccugccccccagcaucaccccccccaccuucagccccuucagcaccaccacccccaccacccccugcgugccccugugcaacuggaccggcuggcuggacagcggcaagcccaacuuccacaagcccggcggcgacaccgagcugaucggcgacgugugcggccccggcugggccgccaacaucagcugcagagccaccauguaccccgacgugcccaucggccagcugggccagaccguggugugcgacgugagcgugggccugaucugcaagaacgaggaccagaagcccggcggcgugauccccauggccuucugccugaacuacgagaucaacgugcagugcugcgagugcgugacccagcccaccaccaugaccaccaccaccaccgagaaccccaccccccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagacccccaccaccacccccaucaccaccaccaccaccgugacccccacccccacccccaccggcacccagaccggcccccccacccacaccagcaccgcccccaucgccgagcugaccaccagcaaccccccccccgagagcagcaccccccagaccagcagaagcaccagcagcccccugaccgagagcaccacccugcugagcacccugccccccgccaucgagaugaccagcaccgccccccccagcacccccaccgcccccaccaccaccagcggcggccacacccugagccccccccccagcaccaccaccagcccccccggcacccccaccagaggcaccaccaccggcagcagcagcgcccccacccccagcaccgugcagaccaccaccaccagcgccuggacccccacccccaccccccugagcacccccagcaucaucagaaccaccggccugagacccuaccccagcagcgugcugaucugcugcgugcugaacgacaccuacuacgcccccggcgaggagguguacaacggcaccuacggcgacaccugcuacuucgugaacugcagccugagcugcacccuggaguucuacaacuggagcugccccagcacccccagccccacccccacccccagcaagagcacccccacccccagcaagcccagcagcacccccagcaagcccacccccggcaccaagccccccgagugccccgacuucgacccccccagacaggagaacgagaccugguggcugugcgacugcuucauggccaccugcaaguacaacaacaccguggagaucgugaagguggagugcgagcccccccccaugcccaccugcagcaacggccugcagcccgugagaguggaggaccccgacggcugcugcuggcacugggagugcgacugcuacugcaccggcuggggcgacccccacuacgugaccuucgacggccuguacuacagcuaccagggcaacugcaccuacgugcugguggaggagaucagccccagcguggacaacuucggcguguacaucgacaacuaccacugcgaccccaacgacaaggugagcugccccagaacccugaucgugagacacgagacccaggaggugcugaucaagaccgugcacaugaugcccaugcaggugcaggugcaggugaacagacaggccguggcccugcccuacaagaaguacggccuggagguguaccagagcggcaucaacuacgugguggacauccccgagcugggcgugcuggugagcuacaacggccugagcuucagcgugagacugcccuaccacagauucggcaacaacaccaagggccagugcggcaccugcaccaacaccaccagcgacgacugcauccugcccagcggcgagaucgugagcaacugcgaggccgccgccgaccaguggcuggugaacgaccccagcaagccccacugcccccacagcagcagcaccaccaagagacccgccgugaccgugcccggcggcggcaagaccaccccccacaaggacugcacccccagcccccugugccagcugaucaaggacagccuguucgcccagugccacgcccuggugcccccccagcacuacuacgacgccugcguguucgacagcugcuucaugcccggcagcagccuggagugcgccagccugcaggccuacgccgcccugugcgcccagcagaacaucugccuggacuggagaaaccacacccacggcgccugccugguggagugccccagccacagagaguaccaggccugcggccccgccgaggagcccaccugcaagagcagcagcagccagcagaacaacaccgugcugguggagggcugcuucugccccgagggcaccaugaacuacgcccccggcuucgacgugugcgugaagaccugcggcugcgugggccccgacaacgugcccagagaguucggcgagcacuucgaguucgacugcaagaacugcgugugccuggagggcggcagcggcaucaucugccagcccaagagaugcagccagaagcccgugacccacugcguggaggacggcaccuaccuggccaccgaggugaaccccgccgacaccugcugcaacaucaccgugugcaagugcaacaccagccugugcaaggagaagcccagcgugugcccccugggcuucgaggugaagagcaagauggugcccggcagaugcugccccuucuacuggugcgagagcaagggcgugugcgugcacggcaacgccgaguaccagcccggcagccccguguacagcagcaagugccaggacugcgugugcaccgacaagguggacaacaacacccugcugaacgugaucgccugcacccacgugcccugcaacaccagcugcagccccggcuucgagcugauggaggcccccggcgagugcugcaagaagugcgagcagacccacugcaucaucaagagacccgacaaccagcacgugauccugaagcccggcgacuucaagagcgaccccaagaacaacugcaccuucuucagcugcgugaagauccacaaccagcugaucagcagcgugagcaacaucaccugccccaacuucgacgccagcaucugcauccccggcagcaucaccuucaugcccaacggcugcugcaagaccugcacccccagaaacgagaccagagugcccugcagcaccgugcccgugaccaccgaggugagcuacgccggcugcaccaagaccgugcugaugaaccacugcagcggcagcugcggcaccuucgugauguacagcgccaaggcccaggcccuggaccacagcugcagcugcugcaaggaggagaagaccagccagagagagguggugcugagcugccccaacggcggcagccugacccacaccuacacccacaucgagagcugccagugccaggacaccgugugcggccugcccaccggcaccagcagaagagccagaagaagccccagacaccugggcagcggcuaa

SEQ ID NO: 20165 - RNA, 9972 nt, Artificial Sequence
  MUC3A__Homo_sapiens__NP_005951
augcagcugcugggccugcugggccugcuguggaugcugaaggccagccccugggccaccggcacccugagcaccgccaccagcaucagccaggugcccuuccccagagccgaggccgccagcgccgugcugagcaacagcccccacagcagagaccuggccggcuggccccugggcgugccccagcuggccagccccgcccccggccacagagagaacgcccccaugacccugaccaccagcccccacgacacccugaucagcgagacccugcugaacagccccgugagcagcaacaccagcaccacccccaccagcaaguucgccuucaagguggagaccaccccccccaccgugcugguguacagcgccaccaccgagugcguguaccccaccagcuucaucaucaccaucagccaccccaccagcaucugcgugaccaccacccagguggccuucaccagcagcuacaccagcacccccgugacccagaagcccgugaccaccgugaccagcaccuacagcaugaccaccaccgagaagggcaccagcgccaugaccagcagccccagcaccaccaccgccagagagacccccaucgugaccgugacccccagcagcgugagcgccaccgacaccaccuuccacaccaccaucagcagcaccaccagaaccaccgagagaaccccccugcccaccggcagcauccacaccaccaccagccccacccccguguucaccacccugaagaccgccgugaccagcaccagccccaucaccagcagcaucaccagcaccaacaccgugaccagcaugaccaccaccgccagccagcccaccgccaccaacacccugagcagccccaccagaaccauccugagcagcacccccgugcugagcaccgagaccaucaccagcggcaucaccaacaccaccccccugagcacccuggugaccacccugcccaccaccaucagcagaagcacccccaccagcgagaccaccuacaccaccagccccaccagcaccgugaccgacagcaccaccaagaucgccuacagcaccagcaugaccggcacccugagcaccgagaccagccugccccccaccagcagcagccugcccaccaccgagaccgccaccacccccaugaccaaccuggugaccaccaccaccgagaucagcagccacagcacccccagcuucagcagcagcaccaucuacagcaccgugagcaccagcaccaccgccaucagcagccugccccccaccagcggcaccauggugaccagcaccaccaugacccccagcagccugagcaccgacauccccuucaccacccccaccaccaucacccaccacagcgugggcagcaccggcuuccugaccaccgccaccgaccugaccagcaccuucaccgugagcagcagcagcgccaugagcaccagcgugauccccagcagccccagcauccagaacaccgagaccagcagccuggugagcaugaccagcgccaccacccccaacgugagacccaccuucgugagcacccugagcacccccaccagcagccugcugaccaccuuccccgccaccuacagcuucagcagcagcaugagcgccagcagcgccggcaccacccacaccgagagcaucagcagcccccccgccagcaccagcacccugcacaccaccgccgagagcacccuggcccccaccaccaccaccagcuucaccaccagcaccaccauggagccccccagcaccaccgccgccaccaccggcaccggccagaccaccuucaccagcagcaccgccaccuuccccgagaccaccacccccacccccaccaccgacaugagcaccgagagccugaccaccgccaugaccagcccccccaucaccagcagcgugaccagcaccaacaccgugaccagcaugaccaccaccaccagcccccccaccaccaccaacagcuucaccagccugaccagcaugccccugagcagcacccccgugcccagcaccgagguggugaccagcggcaccaucaacaccaucccccccagcauccuggugaccacccugcccacccccaacgccagcagcaugaccaccagcgagaccaccuaccccaacagccccaccggccccggcaccaacagcaccaccgagaucaccuaccccaccaccaugaccgagaccagcagcaccgccaccagccugccccccaccagcccccuggugagcaccgccaagaccgccaagacccccaccaccaaccuggugaccaccaccaccaagaccaccagccacagcaccaccagcuucaccagcagcaccguguacagcaccgccagcaccuacaccaccgccaucaccagcgugcccaccacccugggcaccauggugaccagcaccagcaugaucagcagcaccgugagcaccggcauccccaccagccagcccaccaccaucacccccagcagcgugggcaucagcggcagccugcccaugaugaccgaccugaccagcguguacaccgugagcaacaugagcgccagacccaccaccgugauccccagcagccccaccgugcagaacaccgagaucagcaucagcgugagcaugaccagcgccaccacccccagcggcggccccaccuucaccagcaccgagaacacccccaccagaagccugcugaccagcuuccccaugacccacagcuucagcagcagcaugagcgagagcagcgccggcaccacccacaccgagagcaucagcagccccagaggcaccaccagcacccugcacaccaccguggagagcacccccagccccaccaccaccaccagcuucaccaccagcaccaugauggagccccccagcagcaccgugagcaccaccggcagaggccagaccaccuuccccagcagcaccgccaccuuccccgagaccaccacccugacccccaccaccgacaucagcaccgugagccugaccaccgccaugaccagccccccccccgugagcagcagcaucacccccaccaacaccaugaccagcaugagaaccaccaccuacuggcccaccgccaccaacacccugagcccccugaccagcagcauccugagcagcacccccgugcccagcaccgagaugaucaccagccacaccaccaacaccaccccccugagcacccuggugaccacccugcugaccaccaucaccagaagcacccccaccagcgagaccaccuaccccaccagccccaccagcaucgugagcgacagcaccaccgagaucaccuacagcaccagcaucaccggcacccugagcaccgccaccacccugccccccaccagcagcagccugcccaccaccgagaccgccaccaugacccccaccaccacccugaucaccaccacccccaacaccaccagccugagcacccccagcuucaccagcagcaccaucuacagcaccgugagcaccagcaccaccgccaucagcagcgccagccccaccagcggcaccauggugaccagcaccaccaugacccccagcagccugagcaccgacacccccagcaccacccccaccaccaucaccuaccccagcgugggcagcaccggcuuccugaccaccgccaccgaccugaccagcaccuucaccgugagcagcagcagcgccaugagcaccagcgugauccccagcagccccagcauccagaacaccgagaccagcagccuggugagcaugaccagcgccaccacccccagccugagacccaccaucaccagcaccgacagcacccugaccagcagccugcugaccaccuuccccagcaccuacagcuucagcagcagcaugagcgccagcagcgccggcaccacccacaccgagaccaucagcagccugcccgccagcaccaacaccauccacaccaccgccgagagcgcccuggcccccaccaccaccaccagcuucaccaccagccccaccauggagccccccagcaccaccguggccaccaccggcaccggccagaccaccuuccccagcagcaccgccaccuuccuggagaccaccacccugacccccaccaccgacuucagcaccgagagccugaccaccgccaugaccagcaccccccccaucaccagcagcaucacccccaccgacaccaugaccagcaugagaaccaccaccagcuggcccaccgccaccaacacccugagcccccugaccagcagcauccugagcagcacccccgugcccagcaccgaggugaccaccagccacaccaccaacaccaaccccgugagcacccuggugaccacccugcccaucaccaucaccagaagcacccugaccagcgagaccgccuaccccagcagccccaccagcaccgugaccgagagcaccaccgagaucaccuaccccaccaccaugaccgagaccagcagcaccgccaccagccugccccccaccagcagccuggugagcaccgccgagaccgccaagacccccaccaccaaccuggugaccaccaccaccaagaccaccagccacagcaccaccagcuucaccagcagcaccaucuacagcaccgccagcacccccaccaccgccaucaccagcgugcccaccacccugggcaccauggugaccagcaccagcaugauccccagcaccgugagcaccggcauccccaccagccagcccaccaccaucacccccagcagcgugggcaucagcggcagccugcccaugaugaccgaccugaccagcguguacaccgugagcagcaugagcgccagacccaccagcgugauccccagcagccccaccgugcagaacaccgagaccagcaucuucgugagcaugaugagcgccaccacccccagcggcggccccaccuucaccagcaccgagaacacccccaccagaagccugcugaccagcuuccccgugacccacagcuucagcagcagcaugagcgccagcagcgugggcaccacccacacccagagcaucagcagcccccccgccaucaccagcacccugcacaccaccgccgagagcacccccagccccaccaccaccaugagcuucaccaccuucaccaagauggagacccccagcagcaccguggccaccaccggcaccggccagaccaccuucaccagcagcaccgccaccagccccaagaccaccacccugacccccaccagcgacaucagcaccggcagcuucaagaccgccgugagcagcaccccccccaucaccagcagcaucaccagcaccuacaccgugaccagcaugaccaccaccaccccccugggccccaccgccaccaacacccugcccagcuucaccagcagcgugagcagcagcacccccgugcccagcaccgaggccaucaccagcggcaccaccaacaccaccccccugagcacccuggugaccaccuucagcaacagcgacaccagcagcacccccaccagcgagaccaccuaccccaccagccugaccagcgcccugaccgacagcaccaccagaaccaccuacagcaccaacaugaccggcacccugagcaccgugaccagccugagacccaccagcagcagccugcugaccaccgugaccgccaccgugcccaccaccaaccuggugaccaccaccaccaagaucaccagccacagcacccccagcuucaccagcagcaucgccaccaccgagacccccagccacagcacccccagauucaccagcagcaucaccaccaccgagacccccagccacagcacccccagauucaccagcagcaucaccaacaccaagaccaccagccacagcagccccagcuucaccagcagcaucaccaccaccgagaccaccagccacaacacccccagccugaccagcagcaucaccaccaccaagaccaccagccacagcacccccagcuacaccagccugaucaccaccaccaccaccaccagccacagcacccccagcuucaccagcagcaucaccaccaccgagaccaccagccacaacacccccagccugaccagcagcaucaccaccaccgagaccaccagccacagcacccccagcuucaccagcagcaucaccaccgagaccaccagccacagcacccccagcuucaccagccugaucaccaucaccgagaucaccagccacagcacccugagcuacaccaccagcaucaccaccaccgagacccccagccacagcacccugagcuucaccagcagcaucaccaccaccgagaccaccagccacagcacccccagcuucaccagcagcaucaccaccagcgagaugcccagccacagcacccccagcuucaccagcagcaucaccaccaccgagaacgccacccacagcacccccaacuucaccagcagcaucaccaccaccgagaccaccagccacagcacccccagcuucaccagccugaucaccaccaccgagaccaccagccacagauggggcaccaccgagaccaccagcuacagcacccccagcuucaccagcagcaacaccaucaccgagaccaccagccacagcacccccagcuacaucaccagcaucaccaccaccgagacccccagcagcagcacccccagcuucagcagcagcaucaccaccaccgagaccaccagccacagcacccccggcuucaccagcagcaucaccaccaccgagaccaccagccacagcacccccagcuucaccagcagcaucaccaccaccgagaccaccagccacgacacccccagcuucaccagcagcaucaccaccagcgagacccccagccacagcacccccagcagcaccagccugaucaccaccaccaagaccaccagccacagcacccccagcuucaccagcagcaucaccaccaccgagaccaccagccacagcgcccacagcuucaccagcagcaucaccaccaccgagaccaccagccacaacaccagaagcuucaccagcagcaucaccaccaccgagaccaacagccacagcaccaccagcuucaccagcagcaucaccaccaccgagaccaccagccacagcacccccagcuucagcagcagcaucaccaccaccgagaccccccugcacagcacccccggccugaccagcugggugaccaccaccaagaccaccagccacaucacccccggccugaccagcagcaucaccaccaccgagaccaccagccacagcacccccggcuucaccagcagcaucaccaccaccgagaccaccagcgagagcacccccagccugagcagcagcaccaucuacagcaccgugagcaccagcaccaccgccaucaccagccacuucaccaccagcgagaccgccgugacccccacccccgugacccccagcagccugagcaccgacauccccaccaccagccugagaacccugacccccagcagcgugggcaccagcaccagccugaccaccaccaccgacuuccccagcauccccaccgacaucagcacccugcccaccagaacccacaucaucagcagcagccccagcauccagagcaccgagaccagcagccuggugggcaccaccagccccaccaugagcaccgugagaaugacccugagaaucaccgagaacacccccaucagcagcuucagcaccagcaucguggugauccccgagacccccacccagaccccccccgugcugaccagcgccaccggcacccagaccagccccgcccccaccaccgugaccuucggcagcaccgacagcagcaccagcacccugcacacccugacccccagcaccgcccugagcaccaucgugagcaccagccaggugcccauccccagcacccacagcagcacccugcagaccacccccagcacccccagccugcagaccagccugaccagcaccagcgaguucaccaccgagagcuucaccagaggcagcaccagcaccaacgccauccugaccagcuucagcaccaucaucuggagcagcacccccaccaucaucaugagcagcagccccagcagcgccagcaucacccccguguucagcaccaccauccacagcgugcccagcagccccuacaucuucagcaccgagaacgugggcagcgccagcaucaccggcuuccccagccugagcagcagcgccaccaccagcaccagcagcaccagcagcagccugaccaccgcccugaccgagaucacccccuucagcuacaucagccugcccagcaccacccccugccccggcaccaucaccaucaccaucgugcccgccagccccaccgaccccugcguggagauggaccccagcaccgaggccaccagcccccccaccaccccccugaccguguuccccuucaccaccgagauggugaccugccccaccagcaucagcauccagaccacccugaccaccuacauggacaccagcagcaugaugcccgagagcgagagcagcaucagccccaacgccagcagcagcaccggcaccggcaccgugcccaccaacaccguguucaccagcaccagacugcccaccagcgagaccuggcugagcaacagcagcgugaucccccugccccugcccggcgugagcaccaucccccugaccaugaagcccagcagcagccugcccaccauccugagaaccagcagcaagagcacccaccccagcccccccaccaccagaaccagcgagacccccguggccaccacccagacccccaccacccugaccagcagaagaaccaccagaaucaccagccagaugaccacccagagcacccugaccaccaccgccggcaccugcgacaacggcggcaccugggagcagggccagugcgccugccugcccggcuucagcggcgacagaugccagcugcagaccagaugccagaacggcggccagugggacggccugaagugccagugccccagcaccuucuacggcagcagcugcgaguucgccguggagcagguggaccuggacgugguggagaccgaggugggcauggaggugagcguggaccagcaguucagccccgaccugaacgacaacaccagccaggccuacagagacuucaacaagaccuucuggaaccagaugcagaagaucuucgccgacaugcagggcuucaccuucaagggcguggagauccugagccugagaaacggcagcaucgugguggacuaccuggugcugcuggagaugcccuucagcccccagcuggagagcgaguacgagcaggugaagaccacccugaaggagggccugcagaacgccagccaggacgugaacagcugccaggacagccagacccugugcuucaagcccgacagcaucaaggugaacaacaacagcaagaccgagcugacccccgccgccaucugcagaagagccgcccccaccggcuacgaggaguucuacuucccccugguggaggccaccagacugagaugcgugaccaagugcaccagcggcguggacaacgccaucgacugccaccagggccagugcgugcuggagaccagcggccccaccugcagaugcuacagcaccgacacccacugguucagcggccccagaugcgagguggccgugcacuggagagcccuggugggcggccugaccgccggcgccgcccugcuggugcugcugcugcuggcccugggcgugagagccgugagaagcggcugguggggcggccagagaagaggcagaagcugggaccaggacagaaagugguucgagaccugggacgaggagguggugggcaccuucagcaacuggggcuucgaggacgacggcaccgacaaggacaccaacuucuacguggcccuggagaacguggacaccaccaugaaggugcacaucaagagacccgagaugaccagcagcagcguguaa

SEQ ID NO: 20166 - RNA, 3531 nt, Artificial Sequence
  MUC4__Homo_sapiens__NP_004523
augaagggcgccagauggagaagagugcccugggugagccugagcugccugugccugugccugcugccccacguggugcccggcaugaccacccccagccugaagaccgacggcggcagaagaaccgccaccagccccccccccaccaccagccagaccaucaucagcaccauccccagcaccgccaugcacaccagaagcaccgccgcccccauccccauccugcccgagagaggcgugagccuguuccccuacggcgccggcgccggcgaccuggaguucgugagaagaaccguggacuucaccagcccccuguucaagcccgccaccggcuucccccugggcagcagccugagagacagccuguacuucaccgacaacggccagaucaucuuccccgagagcgacuaccagaucuucagcuaccccaacccccugcccaccggcuucaccggcagagaccccguggcccugguggcccccuucugggacgacgccgacuucagcaccggcagaggcaccaccuucuaccaggaguacgagaccuucuacggcgagcacagccugcuggugcagcaggccgagagcuggaucagaaagaugaccaacaacggcggcuacaaggccagaugggcccugaaggugaccugggugaacgcccacgccuaccccgcccaguggacccugggcagcaacaccuaccaggccauccugagcaccgacggcagcagaagcuacgcccuguuccuguaccagagcggcggcaugcagugggacguggcccagagaagcggcaaccccgugcugaugggcuucagcagcggcgacggcuacuucgagaacagcccccugaugagccagcccgugugggagagauacagacccgacagauuccugaacagcaacagcggccugcagggccugcaguucuacagacugcacagagaggagagacccaacuacagacuggagugccugcaguggcugaagagccagcccagauggcccagcuggggcuggaaccaggugagcugccccugcagcuggcagcagggcagaagagaccugagauuccagcccgugagcaucggcagauggggccugggcagcagacagcugugcagcuucaccagcuggagaggcggcgugugcugcagcuacggccccuggggcgaguucagagagggcuggcacgugcagagacccuggcagcuggcccaggagcuggagccccagagcuggugcugcagauggaacgacaagcccuaccugugcgcccuguaccagcagagaagaccccacgugggcugcgccaccuacagacccccccagcccgccuggauguucggcgacccccacaucaccacccuggacggcgugagcuacaccuucaacggccugggcgacuuccugcuggugggcgcccaggacggcaacagcagcuuccugcugcagggcagaaccgcccagaccggcagcgcccaggccaccaacuucaucgccuucgccgcccaguacagaagcagcagccugggccccgugaccgugcaguggcugcuggagccccacgacgccaucagagugcugcuggacaaccagaccgugaccuuccagcccgaccacgaggacggcggcggccaggagaccuucaacgccaccggcgugcugcugagcagaaacggcagcgaggugagcgccagcuucgacggcugggccaccgugagcgugaucgcccugagcaacauccugcacgccagcgccagccugccccccgaguaccagaacagaaccgagggccugcugggcguguggaacaacaaccccgaggacgacuucagaaugcccaacggcagcaccaucccccccggcagccccgaggagaugcuguuccacuucggcaugaccuggcagaucaacggcaccggccugcugggcaagagaaacgaccagcugcccagcaacuucacccccguguucuacagccagcugcagaagaacagcagcugggccgagcaccugaucagcaacugcgacggcgacagcagcugcaucuacgacacccuggcccugagaaacgccagcaucggccugcacaccagagaggugagcaagaacuacgagcaggccaacgccacccugaaccaguacccccccagcaucaacggcggcagagugaucgaggccuacaagggccagaccacccugauccaguacaccagcaacgccgaggacgccaacuucacccugagagacagcugcaccgaccuggagcuguucgagaacggcacccugcuguggacccccaagagccuggagcccuucacccuggagauccuggccagaagcgccaagaucggccuggccagcgcccugcagcccagaaccguggugugccacugcaacgccgagagccagugccuguacaaccagaccagcagagugggcaacagcagccuggagguggccggcugcaagugcgacggcggcaccuucggcagauacugcgagggcagcgaggacgccugcgaggagcccugcuuccccagcgugcacugcgugcccggcaagggcugcgaggccugcccccccaaccugaccggcgacggcagacacugcgccgcccugggcagcagcuuccugugccagaaccagagcugccccgugaacuacugcuacaaccagggccacugcuacaucagccagacccugggcugccagcccaugugcaccugcccccccgccuucaccgacagcagaugcuuccuggccggcaacaacuucagccccaccgugaaccuggagcugccccugagagugauccagcugcugcugagcgaggaggagaacgccagcauggccgaggugaacgccagcguggccuacagacugggcacccuggacaugagagccuuccugagaaacagccagguggagagaaucgacagcgccgcccccgccagcggcagccccauccagcacuggauggugaucagcgaguuccaguacagacccagaggccccgugaucgacuuccugaacaaccagcugcuggccgccgugguggaggccuuccuguaccacgugcccagaagaagcgaggagcccagaaacgacgugguguuccagcccaucagcggcgaggacgugagagacgugaccgcccugaacgugagcacccugaaggccuacuucagaugcgacggcuacaagggcuacgaccugguguacagcccccagagcggcuucaccugcgugagccccugcagcagaggcuacugcgaccacggcggccagugccagcaccugcccagcggccccagaugcagcugcgugagcuucagcaucuacaccgccuggggcgagcacugcgagcaccugagcaugaagcuggacgccuucuucggcaucuucuucggcgcccugggcggccugcugcugcugggcgugggcaccuucguggugcugagauucuggggcugcagcggcgccagauucagcuacuuccugaacagcgccgaggcccugcccuaa

SEQ ID NO: 20167 - RNA, 16965 nt, Artificial Sequence
  MUC5AC__Homo_sapiens__NP_001291288
augagcgugggcagaagaaagcuggcccugcugugggcccuggcccuggcccuggccugcaccagacacaccggccacgcccaggacggcagcagcgagagcagcuacaagcaccaccccgcccugagccccaucgccagaggccccagcggcgugccccugagaggcgccaccguguuccccagccugagaaccauccccguggugagagccagcaaccccgcccacaacggcagagugugcagcaccuggggcagcuuccacuacaagaccuucgacggcgacguguucagauuccccggccugugcaacuacguguucagcgagcacugcggcgccgccuacgaggacuucaacauccagcugagaagaagccaggagagcgccgcccccacccugagcagagugcugaugaagguggacggcguggugauccagcugaccaagggcagcgugcuggugaacggccaccccgugcugcugcccuucagccagagcggcgugcugauccagcagagcagcagcuacaccaagguggaggccagacugggccuggugcugauguggaaccacgacgacagccugcugcuggagcuggacaccaaguacgccaacaagaccugcggccugugcggcgacuucaacggcaugcccguggugagcgagcugcugagccacaacaccaagcugacccccauggaguucggcaaccugcagaagauggacgaccccaccgaccagugccaggaccccgugcccgagccccccagaaacugcagcaccggcuucggcaucugcgaggagcugcugcacggccagcuguucagcggcugcguggcccugguggacgugggcagcuaccuggaggccugcagacaggaccugugcuucugcgaggacaccgaccugcugagcugcgugugccacacccuggccgaguacagcagacagugcacccacgccggcggccugccccaggacuggagaggccccgacuucugcccccagaagugccccaacaacaugcaguaccacgagugcagaagccccugcgccgacaccugcagcaaccaggagcacagcagagccugcgaggaccacugcguggccggcugcuucugccccgagggcaccgugcuggacgacaucggccagaccggcugcgugcccgugagcaagugcgccugcguguacaacggcgccgccuacgcccccggcgccaccuacagcaccgacugcaccaacugcaccugcagcggcggcagauggagcugccaggaggugcccugccccggcaccugcagcgugcugggcggcgcccacuucagcaccuucgacggcaagcaguacaccgugcacggcgacugcagcuacgugcugaccaagcccugcgacagcagcgccuucaccgugcuggccgagcugagaagaugcggccugaccgacagcgagaccugccugaagagcgugacccugagccuggacggcgcccagaccgugguggugaucaaggccagcggcgagguguuccugaaccagaucuacacccagcugcccaucagcgccgccaacgugaccaucuucagacccagcaccuucuucaucaucgcccagaccagccugggccugcagcugaaccugcagcuggugcccaccaugcagcuguucaugcagcuggcccccaagcugagaggccagaccugcggccugugcggcaacuucaacagcauccaggccgacgacuucagaacccugagcggcgugguggaggccaccgccgccgccuucuucaacaccuucaagacccaggccgccugccccaacaucagaaacagcuucgaggaccccugcagccugagcguggagaacgagaaguacgcccagcacuggugcagccagcugaccgacgccgacggccccuucggcagaugccacgccgccgugaagcccggcaccuacuacagcaacugcauguucgacaccugcaacugcgagagaagcgaggacugccugugcgccgcccugagcagcuacgugcacgccugcgccgccaagggcgugcagcugggcggcuggagagacggcgugugcaccaagcccaugaccaccugccccaagagcaugaccuaccacuaccacgugagcaccugccagcccaccugcagaagccugagcgagggcgacaucaccugcagcgugggcuucauccccguggacggcugcaucugccccaagggcaccuuccuggacgacaccggcaagugcgugcaggccagcaacugccccugcuaccacagaggcagcaugauccccaacggcgagagcgugcacgacagcggcgccaucugcaccugcacccacggcaagcugagcugcaucggcggccaggcccccgcccccgugugcgccgcccccaugguguucuucgacugcagaaacgccacccccggcgacaccggcgccggcugccagaagagcugccacacccuggacaugaccugcuacagcccccagugcgugcccggcugcgugugccccgacggccugguggccgacggcgagggcggcugcaucaccgccgaggacugccccugcgugcacaacgaggccagcuacagagccggccagaccaucagagugggcugcaacaccugcaccugcgacagcagaauguggagaugcaccgacgaccccugccuggccaccugcgccguguacggcgacggccacuaccugaccuucgacggccagagcuacagcuucaacggcgacugcgaguacacccuggugcagaaccacugcggcggcaaggacagcacccaggacagcuucagaguggugaccgagaacgugcccugcggcaccaccggcaccaccugcagcaaggccaucaagaucuuccugggcggcuucgagcugaagcugagccacggcaagguggaggugaucggcaccgacgagagccaggaggugcccuacaccaucagacagaugggcaucuaccuggugguggacaccgacaucggccuggugcugcugugggacaagaagaccagcaucuucaucaaccugagccccgaguucaagggcagagugugcggccugugcggcaacuucgacgacaucgccgugaacgacuucgccaccagaagcagaagcguggugggcgacgugcuggaguucggcaacagcuggaagcugagccccagcugccccgacgcccuggcccccaaggaccccugcaccgccaaccccuucagaaagagcugggcccagaagcagugcagcauccugcacggccccaccuucgccgccugccacgcccacguggagcccgccagauacuacgaggccugcgugaacgacgccugcgccugcgacagcggcggcgacugcgagugcuucugcaccgccguggccgccuacgcccaggccugccacgaggugggccugugcgugagcuggagaacccccagcaucugcccccuguucugcgacuacuacaaccccgagggccagugcgaguggcacuaccagcccugcggcgugcccugccugagaaccugcagaaaccccagaggcgacugccugagagacgugagaggccuggagggcugcuaccccaagugcccccccgaggcccccaucuucgacgaggacaagaugcagugcguggccaccugccccacccccccccugccccccagaugccacgugcacggcaagagcuacagacccggcgccguggugcccagcgacaagaacugccagagcugccugugcaccgagagaggcguggagugcaccuacaaggccgaggccugcgugugcaccuacaacggccagagauuccaccccggcgacgugaucuaccacaccaccgacggcaccggcggcugcaucagcgccagaugcggcgccaacggcaccaucgagagaagaguguaccccugcagccccaccacccccgugccccccaccaccuucagcuucagcacccccccccugguggugagcagcacccacacccccagcaacggccccagcagcgcccacaccggcccccccagcagcgccuggcccaccaccgccggcaccagccccagaaccagacugcccaccgccagcgccagccugccccccgugugcggcgagaagugccuguggagccccuggauggacgugagcagacccggcagaggcaccgacagcggcgacuucgacacccuggagaaccugagagcccacggcuacagagugugcgagagccccagaagcguggagugcagagccgaggacgcccccggcgugccccugagagcccugggccagagagugcagugcagccccgacgugggccugaccugcagaaacagagagcaggccagcggccugugcuacaacuaccagaucagagugcagugcugcaccccccugcccugcagcaccagcagcagccccgcccagaccaccccccccaccaccagcaagaccaccgagaccagagccagcggcagcagcgcccccagcagcacccccggcaccgugagccugagcaccgccagaaccacccccgcccccggcaccgccaccagcgugaagaagaccuucagcacccccagccccccccccgugcccgccaccagcaccagcagcaugagcaccaccgcccccggcaccagcguggugagcagcaagcccacccccaccgagcccagcaccagcagcugccugcaggagcugugcaccuggaccgaguggaucgacggcagcuaccccgcccccggcaucaacggcggcgacuucgacaccuuccagaaccugagagacgagggcuacaccuucugcgagagccccagaagcgugcagugcagagccgagagcuuccccaacaccccccuggccgaccugggccaggacgugaucugcagccacaccgagggccugaucugccugaacaagaaccagcugccccccaucugcuacaacuacgagaucagaauccagugcugcgagaccgugaacgugugcagagacaucaccagacugcccaagaccguggccaccaccagacccaccccccaccccaccggcgcccagacccagaccaccuucaccacccacaugcccagcgccagcaccgagcagcccaccgccaccagcagaggcggccccaccgccaccagcgugacccagggcacccacaccacccuggugaccagaaacugccaccccagaugcaccuggaccaagugguucgacguggacuuccccagccccggcccccacggcggcgacaaggagaccuacaacaacaucaucagaagcggcgagaagaucugcagaagacccgaggagaucaccagacugcagugcagagccaagagccaccccgaggugagcaucgagcaccugggccagguggugcagugcagcagagaggagggccuggugugcagaaaccaggaccagcagggccccuucaagaugugccugaacuacgaggugagagugcugugcugcgagacccccagaggcugccacaugaccagcacccccggcagcaccagcagcagccccgcccagaccacccccagcaccaccagcaagaccaccgagacccaggccagcggcagcagcgcccccagcagcacccccggcaccgugagccugagcaccgccagaaccacccccgcccccggcaccgccaccagcgugaagaagaccuucagcacccccagccccccccccgugcccgccaccagcaccagcagcaugagcaccaccgcccccggcaccagcguggugagcagcaagcccacccccaccgagcccagcaccagcagcugccugcaggagcugugcaccuggaccgaguggaucgacggcagcuaccccgcccccggcaucaacggcggcgacuucgacaccuuccagaaccugagagacgagggcuacaccuucugcgagagccccagaagcgugcagugcagagccgagagcuuccccaacaccccccuggccgaccugggccaggacgugaucugcagccacaccgagggccugaucugccugaacaagaaccagcugccccccaucugcuacaacuacgagaucagaauccagugcugcgagaccgugaacgugugcagagacaucaccagaccccccaagaccguggccaccaccagacccaccccccaccccaccggcgcccagacccagaccaccuucaccacccacaugcccagcgccagcaccgagcagcccaccgccaccagcagaggcggccccaccgccaccagcgugacccagggcacccacaccacccccgugaccagaaacugccaccccagaugcaccuggaccaccugguucgacguggacuuccccagccccggcccccacggcggcgacaaggagaccuacaacaacaucaucagaagcggcgagaagaucugcagaagacccgaggagaucaccagacugcagugcagagccaagagccaccccgaggugagcaucgagcaccugggccagguggugcagugcagcagagaggagggccuggugugcagaaaccaggaccagcagggccccuucaagaugugccugaacuacgaggugagagugcugugcugcgagacccccaagggcugccccgugaccagcacccccgugaccgcccccagcacccccagcggcagagccaccagccccacccagagcaccagcagcuggcagaagagcagaaccaccacccuggugaccaccagcaccaccagcaccccccagaccagcaccaccuacgcccacaccaccagcaccaccagcgcccccaccgccagaaccaccagcgcccccaccaccagaaccaccagcgccagccccgccagcaccaccagcggccccggcaacacccccagccccgugcccaccaccagcaccaucagcgcccccaccaccagcaucaccagcgcccccaccaccagcaccaccagcgcccccaccagcagcaccaccagcggccccggcaccacccccagccccgugcccaccaccagcaucaccagcgcccccaccaccagcaccaccagcgcccccaccaccagcaccaccagcgccagaaccagcagcaccaccagcgccaccaccaccagcagaaucagcggccccgagaccacccccagccccgugcccaccaccagcaccaccagcgccaccaccaccagcaccaccagcgcccccaccaccagcaccaccagcgcccccaccagcagcaccaccagcagcccccagaccagcaccaccagcgcccccaccaccagcaccaccagcggccccggcaccacccccagccccgugcccaccaccagcaccaccagcgcccccaccaccagaaccaccagcgcccccaagagcagcaccaccagcgccgccaccaccagcaccaccagcggccccgagaccacccccagacccgugcccaccaccagcaccaccagcagccccaccaccagcaccaccagcgcccccaccaccagcaccaccagcgccagcaccaccagcaccaccagcggcgccggcaccacccccagccccgugcccaccaccagcaccaccagcgcccccaccaccagcaccaccagcgcccccaucagcagcaccaccagcgccaccaccaccagcaccaccagcggccccggcaccacccccagccccgugcccaccaccagcaccaccagcgcccccaccaccagcaccaccagcggccccggcaccacccccagcgccgugcccaccaccagcaucaccagcgcccccaccaccagcaccaacagcgcccccaucagcagcaccaccagcgccaccaccaccagcagaaucagcggccccgagaccacccccagccccgugcccaccgccagcaccaccagcgccagcaccaccagcaccaccagcggccccggcaccacccccagccccgugcccaccaccagcaccaucagcgugcccaccaccagcaccaccagcgccagcaccaccagcaccaccagcgccagcaccaccagcaccaccagcggccccggcaccacccccagccccgugcccaccaccagcaccaccagcgcccccaccaccagcaccaccagcgcccccaccaccagcaccaucagcgcccccaccaccagcaccaccagcgccaccaccaccagcaccaccagcgcccccacccccagaagaaccagcgcccccaccaccagcaccaucagcgccagcaccaccagcaccaccagcgccaccaccaccagcaccaccagcgccaccaccaccagcaccaucagcgcccccaccaccagcaccacccugagccccaccaccagcaccaccagcaccaccaucaccagcaccaccagcgcccccaucagcagcaccaccagcaccccccagaccagcaccaccagcgcccccaccaccagcaccaccagcggccccggcaccaccagcagccccgugcccaccaccagcaccaccagcgcccccaccaccagcaccaccagcgcccccaccaccagaaccaccagcgugcccaccagcagcaccaccagcaccgccaccaccagcaccaccagcggccccggcaccacccccagccccgugcccaccaccagcaccaccagcgcccccaccaccagaaccaccagcgcccccaccaccagcaccaccagcgcccccaccaccagcaccaccagcgcccccaccagcagcaccaccagcgccaccaccaccagcaccaucagcgugcccaccaccagcaccaccagcgugcccggcaccacccccagccccgugcccaccaccagcaccaucagcgugcccaccaccagcaccaccagcgccagcaccaccagcaccaccagcggccccggcaccacccccagccccgugcccaccaccagcaccaccagcgcccccaccaccagcaccaccagcgcccccaccaccagcaccaucagcgcccccaccaccagcacccccagcgcccccaccaccagcaccacccuggcccccaccaccagcaccaccagcgcccccaccaccagcaccaccagcacccccaccagcagcaccaccagcagcccccagaccagcaccaccagcgccagcaccaccagcaucaccagcggccccggcaccacccccagccccgugcccaccaccagcaccaccagcgcccccaccaccagcaccaccagcgccgccaccaccagcaccaucagcgcccccaccaccagcaccaccagcgcccccaccaccagcaccaccagcgccagcaccgccagcaagaccagcggccugggcaccacccccagccccauccccaccaccagcaccaccagcccccccaccaccagcaccaccagcgccagcaccgccagcaagaccagcggccccggcaccacccccagccccgugcccaccaccagcaccaucuucgcccccagaaccagcaccaccagcgccagcaccaccagcaccacccccggccccggcaccacccccagccccgugcccaccaccagcaccgccagcgugagcaagaccagcaccagccacgugagcaucagcaagaccacccacagccagcccgugaccagagacugccaccugagaugcaccuggaccaagugguucgacaucgacuuccccagccccggcccccacggcggcgacaaggagaccuacaacaacaucaucagaagcggcgagaagaucugcagaagacccgaggagaucaccagacugcagugcagagccgagagccaccccgaggugagcaucgagcaccugggccagguggugcagugcagcagagaggagggccuggugugcagaaaccaggaccagcagggccccuucaagaugugccugaacuacgaggugagagugcugugcugcgagacccccaagggcugccccgugaccagcacccccgugaccgcccccagcacccccagcggcagagccaccagccccacccagagcaccagcagcuggcagaagagcagaaccaccacccuggugaccaccagcaccaccagcaccccccagaccagcaccaccagcgcccccaccaccagcaccaccagcgcccccaccaccagcaccaccagcgcccccaccaccagcaccaccagcaccccccagaccagcaucagcagcgcccccaccagcagcaccaccagcgcccccaccagcagcaccaucagcgccagaaccaccagcaucaucagcgcccccaccaccagcaccaccagcagccccaccaccagcaccaccagcgccaccaccaccagcaccaccagcgcccccaccagcagcaccaccagcaccccccagaccagcaagaccagcgccgccaccagcagcaccaccagcggcagcggcaccacccccagccccgugaccaccaccagcaccgccagcgugagcaagaccagcaccagccacgugagcgugagcaagaccacccacagccagcccgugaccagagacugccaccccagaugcaccuggaccaagugguucgacguggacuuccccagccccggcccccacggcggcgacaaggagaccuacaacaacaucaucagaagcggcgagaagaucugcagaagacccgaggagaucaccagacugcagugcagagccaagagccaccccgaggugagcaucgagcaccugggccagguggugcagugcagcagagaggagggccuggugugcagaaaccaggaccagcagggccccuucaagaugugccugaacuacgaggugagagugcugugcugcgagacccccaagggcugccccgugaccagcaccagcgugaccgcccccagcacccccagcggcagagccaccagccccacccagagcaccagcagcuggcagaagagcagaaccaccacccuggugaccagcagcaucaccagcaccacccagaccagcaccaccagcgcccccaccaccagcaccacccccgccagcauccccagcaccaccagcgcccccaccaccagcaccaccagcgcccccaccaccagcaccaccagcgcccccaccaccagcaccaccagcaccccccagaccaccaccagcagcgcccccaccagcagcaccaccagcgcccccaccaccagcaccaucagcgcccccaccaccagcaccaucagcgcccccaccaccagcaccaccagcgcccccaccgccagcaccaccagcgcccccaccagcaccagcagcgcccccaccaccaacaccaccagcgcccccaccaccagcaccaccagcgcccccaucaccagcaccaucagcgcccccaccaccagcaccaccagcaccccccagaccagcaccaucagcagccccaccaccagcaccaccagcaccccccagaccagcaccaccagcagccccaccaccagcaccaccagcgcccccaccaccagcaccaccagcgcccccaccaccagcaccaccagcaccccccagaccagcaucagcagcgcccccaccagcagcaccaccagcgcccccaccgccagcaccaucagcgcccccaccaccagcaccaccagcuuccacaccaccagcaccaccagcccccccaccagcagcaccagcagcaccccccagaccagcaagaccagcgccgccaccagcagcaccaccagcggcagcggcaccacccccagccccgugcccaccaccagcaccgccagcgugagcaagaccagcaccagccacgugagcgugagcaagaccacccacagccagcccgugaccagagacugccaccccagaugcaccuggaccaagugguucgacguggacuuccccagccccggcccccacggcggcgacaaggagaccuacaacaacaucaucagaagcggcgagaagaucugcagaagacccgaggagaucaccagacugcagugcagagccgagagccaccccgaggugagcaucgagcaccugggccagguggugcagugcagcagagaggagggccuggugugcagaaaccaggaccagcagggccccuucaagaugugccugaacuacgaggugagagugcugugcugcgagacccccaagggcugccccgugaccagcacccccgugaccgcccccagcacccccagcggcagagccaccagccccacccagagcaccagcagcuggcagaagagcagaaccaccacccuggugaccaccagcaccaccagcaccccccagaccagcaccaccagcgcccccaccaccagcaccauccccgccagcacccccagcaccaccagcgcccccaccaccagcaccaccagcgcccccaccaccagcaccaccagcgcccccacccacagaaccaccagcggccccaccaccagcaccacccuggcccccaccaccagcaccaccagcgcccccaccaccagcaccaacagcgcccccaccaccagcaccaucagcgccagcaccaccagcaccaucagcgcccccaccaccagcaccaucagcagccccaccagcagcaccaccagcaccccccagaccagcaagaccagcgccgccaccagcagcaccaccagcggcagcggcaccacccccagccccgugcccaccaccagcaccaccagcgccagcaccaccagcaccaccagcgcccccaccaccagcaccaccagcggccccggcaccacccccagccccgugcccagcaccagcaccaccagcgccgccaccaccagcaccaccagcgcccccaccaccagaaccaccagcgcccccaccagcagcaugaccagcggccccggcaccacccccagccccgugcccaccaccagcaccaccagcgcccccaccaccagcaccaccagcggccccggcaccacccccagccccgugcccaccaccagcaccaccagcgcccccaucaccagcaccaccagcggccccggcagcacccccagccccgugcccaccaccagcaccaccagcgcccccaccaccagcaccaccagcgccagcaccgccagcaccaccagcggccccggcaccacccccagccccgugcccaccaccagcaccaccagcgcccccaccaccagaaccaccagcgccagcaccgccagcaccaccagcggccccggcagcacccccagccccgugcccaccaccagcaccaccagcgcccccaccaccagaaccacccccgccagcaccgccagcaccaccagcggccccggcaccacccccagccccgugcccaccaccagcaccaccagcgccagcaccaccagcaccaucagccugcccaccaccagcaccaccagcgcccccaucaccagcaugaccagcggccccggcaccacccccagccccgugcccaccaccagcaccaccagcgcccccaccaccagcaccaccagcgccagcaccgccagcaccaccagcggccccggcaccacccccagccccgugcccaccaccagcaccaccagcgcccccaccaccagcaccaccagcgccagcaccgccagcaccaccagcggccccggcaccagccugagccccgugcccaccaccagcaccaccagcgcccccaccaccagcaccaccagcggccccggcaccacccccagccccgugcccaccaccagcaccaccagcgcccccaccaccagcaccaccagcggccccggcaccacccccagccccgugcccaccaccagcaccacccccgugagcaagaccagcaccagccaccugagcgugagcaagaccacccacagccagcccgugaccagcgacugccacccccugugcgccuggaccaagugguucgacguggacuuccccagccccggcccccacggcggcgacaaggagaccuacaacaacaucaucagaagcggcgagaagaucugcagaagacccgaggagaucaccagacugcagugcagagccgagagccaccccgaggugaacaucgagcaccugggccagguggugcagugcagcagagaggagggccuggugugcagaaaccaggaccagcagggccccuucaagaugugccugaacuacgaggugagagugcugugcugcgagacccccagaggcugccccgugaccagcgugacccccuacggcaccagccccaccaacgcccuguaccccagccugagcaccagcauggugagcgccagcguggccagcaccagcguggccagcagcagcguggccagcagcagcguggccuacagcacccagaccugcuucugcaacguggccgacagacuguaccccgccggcagcaccaucuacagacacagagaccuggccggccacugcuacuacgcccugugcagccaggacugccagguggugagaggcguggacagcgacugccccagcaccacccugccccccgcccccgccaccagccccagcaucagcaccagcgagcccgugaccgagcugggcugccccaacgccgugccccccagaaagaagggcgagaccugggccacccccaacugcagcgaggccaccugcgagggcaacaacgugaucagccugagacccagaaccugccccagaguggagaagcccaccugcgccaacggcuaccccgccgugaagguggccgaccaggacggcugcugccaccacuaccagugccagugcgugugcagcggcuggggcgacccccacuacaucaccuucgacggcaccuacuacaccuuccuggacaacugcaccuacgugcuggugcagcagaucgugcccguguacggccacuucagagugcugguggacaacuacuucugcggcgccgaggacggccugagcugccccagaagcaucauccuggaguaccaccaggacagaguggugcugaccagaaagcccgugcacggcgugaugaccaacgagaucaucuucaacaacaagguggugagccccggcuucagaaagaacggcaucguggugagcagaaucggcgugaagauguacgccaccauccccgagcugggcgugcaggugauguucagcggccugaucuucagcguggaggugcccuucagcaaguucgccaacaacaccgagggccagugcggcaccugcaccaacgacagaaaggacgagugcagaacccccagaggcaccgugguggccagcugcagcgagaugagcggccuguggaacgugagcauccccgaccagcccgccugccacagaccccaccccacccccaccaccgugggccccaccaccgugggcagcaccaccgugggccccaccaccgugggcagcaccaccgugggccccaccaccccccccgcccccugccugcccagccccaucugccagcugauccugagcaagguguucgagcccugccacaccgugauccccccccugcuguucuacgagggcugcguguucgacagaugccacaugaccgaccuggacguggugugcagcagccuggagcuguacgccgcccugugcgccagccacgacaucugcaucgacuggagaggcagaaccggccacaugugccccuucaccugccccgccgacaagguguaccagcccugcggccccagcaaccccagcuacugcuacggcaacgacagcgccagccugggcgcccugcccgaggccggccccaucaccgagggcugcuucugccccgagggcaugacccuguucagcaccagcgcccaggugugcgugcccaccggcugccccagaugccugggcccccacggcgagcccgugaaggugggccacaccgugggcauggacugccaggagugcaccugcgaggccgccaccuggacccugaccugcagacccaagcugugcccccugccccccgccugcccccugcccggcuucgugcccgugcccgccgccccccaggccggccagugcugcccccaguacagcugcgccugcaacaccagcagaugccccgcccccgugggcugccccgagggcgccagagccauccccaccuaccaggagggcgccugcugccccgugcagaacugcagcuggaccgugugcagcaucaacggcacccuguaccagcccggcgccguggugagcagcagccugugcgagaccugcagaugcgagcugcccggcggcccccccagcgacgccuucguggugagcugcgagacccagaucugcaacacccacugccccgugggcuucgaguaccaggagcagagcggccagugcugcggcaccugcgugcagguggccugcgugaccaacaccagcaagagccccgcccaccuguucuaccccggcgagaccuggagcgacgccggcaaccacugcgugacccaccagugcgagaagcaccaggacggccuggugguggugaccaccaagaaggccugccccccccugagcugcagccuggacgaggccagaaugagcaaggacggcugcugcagauucugcccccccccccccccccccuaccagaaccagagcaccugcgccguguaccacagaagccugaucauccagcagcagggcugcagcagcagcgagcccgugagacuggccuacugcagaggcaacugcggcgacagcagcagcauguacagccuggagggcaacaccguggagcacagaugccagugcugccaggagcugagaaccagccugagaaacgugacccugcacugcaccgacggcagcagcagagccuucagcuacaccgagguggaggagugcggcugcaugggcagaagaugccccgcccccggcgacacccagcacagcgaggaggccgagcccgagcccagccaggaggccgagagcggcagcugggagagaggcgugcccgugagccccaugcacuaa

SEQ ID NO: 20168 - RNA, 17289 nt, Artificial Sequence
  MUC5B__Homo_sapiens__NP_002449
augggcgcccccagcgccugcagaacccuggugcuggcccuggccgccaugcugguggugccccaggccgagacccagggccccguggagcccagcugggagaacgccggccacaccauggacggcggcgcccccaccagcagccccaccagaagagugagcuucgugccccccgugaccguguuccccagccugagcccccugaaccccgcccacaacggcagagugugcagcaccuggggcgacuuccacuacaagaccuucgacggcgacguguucagauuccccggccugugcaacuacguguucagcgagcacugcagagccgccuacgaggacuucaacgugcagcugagaagaggccuggugggcagcagacccguggugaccagaguggugaucaaggcccagggccuggugcuggaggccagcaacggcagcgugcugaucaacggccagagagaggagcugcccuacagcagaaccggccugcugguggagcagagcggcgacuacaucaaggugagcaucagacuggugcugaccuuccuguggaacggcgaggacagcgcccugcuggagcuggaccccaaguacgccaaccagaccugcggccugugcggcgacuucaacggccugcccgccuucaacgaguucuacgcccacaacgccagacugaccccccugcaguucggcaaccugcagaagcuggacggccccaccgagcagugccccgacccccugccccugcccgccggcaacugcaccgacgaggagggcaucugccacagaacccugcugggccccgccuucgccgagugccacgcccugguggacagcaccgccuaccuggccgccugcgcccaggaccugugcagaugccccaccugccccugcgccaccuucguggaguacagcagacagugcgcccacgccggcggccagcccagaaacuggagaugccccgagcugugccccagaaccugcccccugaacaugcagcaccaggagugcggcagccccugcaccgacaccugcagcaacccccagagagcccagcugugcgaggaccacugcguggacggcugcuucugcccccccggcaccgugcuggacgacaucacccacagcggcugccugccccugggccagugccccugcacccacggcggcagaaccuacagccccggcaccagcuucaacaccaccugcagcagcugcaccugcagcggcggccuguggcagugccaggaccugcccugccccggcaccugcagcgugcagggcggcgcccacaucagcaccuacgacgagaagcuguacgaccugcacggcgacugcagcuacgugcugagcaagaagugcgccgacagcagcuucaccgugcuggccgagcugagaaagugcggccugaccgacaacgagaacugccugaaggccgugacccugagccuggacggcggcgacaccgccaucagagugcaggccgacggcggcguguuccugaacagcaucuacacccagcugccccugagcgccgccaacaucacccuguucacccccagcagcuucuucaucguggugcagaccggccugggccugcagcugcuggugcagcuggugccccugaugcagguguucgugagacuggaccccgcccaccagggccagaugugcggccugugcggcaacuucaaccagaaccaggccgacgacuucaccgcccugagcggcgugguggaggccaccggcgccgccuucgccaacaccuggaaggcccaggccgccugcgccaacgccagaaacagcuucgaggaccccugcagccugagcguggagaacgagaacuacgccagacacuggugcagcagacugaccgaccccaacagcgccuucagcagaugccacagcaucaucaaccccaagcccuuccacagcaacugcauguucgacaccugcaacugcgagagaagcgaggacugccugugcgccgcccugagcagcuacgugcacgccugcgccgccaagggcgugcagcugagcgacuggagagacggcgugugcaccaaguacaugcagaacugccccaagagccagagauacgccuacgugguggacgccugccagcccaccugcagaggccugagcgaggccgacgugaccugcagcgugagcuucgugcccguggacggcugcaccugccccgccggcaccuuccugaacgacgccggcgccugcgugcccgcccaggagugccccugcuacgcccacggcaccgugcuggcccccggcgagguggugcacgacgagggcgccgugugcagcugcaccggcggcaagcugagcugccugggcgccagccugcagaagagcaccggcugcgccgcccccaugguguaccuggacugcagcaacagcagcgccggcacccccggcgccgagugccugagaagcugccacacccuggacgugggcugcuucagcacccacugcgugagcggcugcgugugcccccccggccuggugagcgacggcagcggcggcugcaucgccgaggaggacugccccugcgugcacaacgaggccaccuacaagcccggcgagaccaucagaguggacugcaacaccugcaccugcagaaacagaagaugggagugcagccacagacugugccugggcaccugcguggccuacggcgacggccacuucaucaccuucgacggcgacagauacagcuucgagggcagcugcgaguacauccuggcccaggacuacugcggcgacaacaccacccacggcaccuucagaaucgugaccgagaacauccccugcggcaccaccggcaccaccugcagcaaggccaucaagcuguucguggagagcuacgagcugauccugcaggagggcaccuucaaggccguggccagaggccccggcggcgacccccccuacaagaucagauacaugggcaucuuccuggugaucgagacccacggcauggccgugagcugggacagaaagaccagcguguucaucagacugcaccaggacuacaagggcagagugugcggccugugcggcaacuucgacgacaacgccaucaacgacuucgccaccagaagcagaagcguggugggcgacgcccuggaguucggcaacagcuggaagcugagccccagcugccccgacgcccuggcccccaaggaccccugcaccgccaaccccuucagaaagagcugggcccagaagcagugcagcauccugcacggccccaccuucgccgccugcagaagccagguggacagcaccaaguacuacgaggccugcgugaacgacgccugcgccugcgacagcggcggcgacugcgagugcuucugcaccgccguggccgccuacgcccaggccugccacgacgccggccugugcgugagcuggagaacccccgacaccugcccccuguucugcgacuucuacaacccccacggcggcugcgaguggcacuaccagcccugcggcgcccccugccugaagaccugcagaaaccccagcggccacugccugguggaccugcccggccuggagggcugcuaccccaagugcccccccagccagcccuucuucaacgaggaccagaugaagugcguggcccagugcggcugcuacgacaaggacggcaacuacuacgacgugggcgccagagugcccaccgccgagaacugccagagcugcaacugcacccccagcggcauccagugcgcccacagccuggaggccugcaccugcaccuacgaggacagaaccuacagcuaccaggacgugaucuacaacaccaccgacggccugggcgccugccugaucgccaucugcggcagcaacggcaccaucaucagaaaggccguggccugccccggcacccccgccaccacccccuucaccuucaccaccgccugggugccccacagcaccaccagccccgcccugcccgugagcaccgugugcgugagagaggugugcagauggagcagcugguacaacggccacagacccgagcccggccugggcggcggcgacuucgagaccuucgagaaccugagacagagaggcuaccaggugugccccgugcuggccgacaucgagugcagagccgcccagcugcccgacaugccccuggaggagcugggccagcagguggacugcgacagaaugagaggccugaugugcgccaacagccagcagagccccccccugugccacgacuacgagcugagagugcugugcugcgaguacgugcccugcggccccagccccgcccccggcaccagcccccagcccagccugagcgccagcaccgagcccgccgugcccacccccacccagaccaccgccaccgagaagaccacccugugggugacccccagcaucagaagcaccgccgcccugaccagccagaccggcagcagcagcggccccgugaccgugacccccagcgcccccggcaccaccaccugccagcccagaugccaguggaccgagugguucgacgaggacuaccccaagagcgagcagcugggcggcgacguggagagcuacgacaagaucagagccgccggcggccaccugugccagcagcccaaggacaucgagugccaggccgagagcuuccccaacuggacccuggcccaggugggccagaaggugcacugcgacgugcacuucggccuggugugcagaaacugggagcaggagggcguguucaagaugugcuacaacuacagaaucagagugcugugcugcagcgacgaccacugcagaggcagagccaccacccccccccccaccaccgagcuggagaccgccaccaccaccaccacccaggcccuguucagcaccccccagcccaccagcagccccggccugaccagagccccccccgccagcaccaccgccgugcccacccugagcgagggccugaccagccccagauacaccagcacccugggcaccgccaccaccggcggccccaccacccccgccggcagcaccgagcccaccgugcccggcguggccaccagcacccugcccaccagaagcgcccugcccggcaccaccggcagccugggcaccuggagacccagccagccccccacccuggcccccaccaccauggccaccagcagagccagacccaccggcaccgccagcaccgccagcaaggagccccugaccaccagccuggcccccacccugaccagcgagcugagcaccagccaggccgagaccagcacccccagaaccgagaccaccaugagcccccugaccaacaccaccaccagccagggcaccaccagaugccagcccaagugcgaguggaccgagugguucgacguggacuuccccaccagcggcguggccggcggcgacauggagaccuucgagaacaucagagccgccggcggcaagaugugcugggcccccaagagcaucgagugcagagccgagaacuaccccgaggugagcaucgaccaggugggccaggugcugaccugcagccuggagaccggccugaccugcaagaacgaggaccagaccggcagauucaacaugugcuucaacuacaacgugagagugcugugcugcgacgacuacagccacugccccagcacccccgccaccagcagcaccgccacccccagcagcacccccggcaccaccuggauccugaccaagcccaccaccaccgccaccaccaccgccagcaccggcagcaccgccacccccaccagcacccugagaaccgcccccccccccaaggugcugaccaccaccgccaccacccccaccgugaccagcagcaaggccacccccagcagcagccccggcaccgccaccgcccugcccgcccugagaagcaccgccaccacccccaccgccaccagcgugacccccauccccagcagcagccugggcaccaccuggaccagacugagccagaccaccacccccaccgccaccaugagcaccgccacccccagcagcacccccgagaccgcccacaccagcaccgugcugaccgccaccgccaccaccaccggcgccaccggcagcguggccacccccagcagcacccccggcaccgcccacaccaccaaggugcccaccaccaccaccaccggcuucaccgccacccccagcagcagccccggcaccgcccugaccccccccguguggaucagcaccaccaccacccccaccaccagaggcagcaccgugacccccagcagcauccccggcaccacccacaccgccaccgugcugaccaccaccaccaccaccguggccaccggcagcauggccacccccagcagcagcacccagaccagcggcaccccccccagccugaccaccaccgccaccaccaucaccgccaccggcagcaccaccaaccccagcagcacccccggcaccacccccaucccccccgugcugaccaccaccgccaccacccccgccgccaccagcaacaccgugacccccagcagcgcccugggcaccacccacaccccccccgugcccaacaccauggccaccacccacggcagaagccugccccccagcagcccccacaccgugagaaccgccuggaccagcgccaccagcggcauccugggcaccacccacaucaccgagcccagcaccgugaccagccacacccuggccgccaccaccggcaccacccagcacagcacccccgcccugagcagcccccaccccagcagcagaaccaccgagagcccccccagccccggcaccaccacccccggccacaccaccgccaccagcagaaccaccgccaccgccacccccagcaagaccagaaccagcacccugcugcccagcagccccaccagcgcccccaucaccaccguggugaccaugggcugcgagccccagugcgccuggagcgaguggcuggacuacagcuaccccaugcccggccccagcggcggcgacuucgacaccuacagcaacaucagagccgccggcggcgccgugugcgagcagccccugggccuggagugcagagcccaggcccagcccggcgugccccugagagagcugggccaggugguggagugcagccuggacuucggccuggugugcagaaacagagagcaggugggcaaguucaagaugugcuucaacuacgagaucagaguguucugcugcaacuacggccacugccccagcacccccgccaccagcagcaccgccaugcccagcagcacccccggcaccaccuggauccugaccgagcugaccaccaccgccaccaccaccgagagcaccggcagcaccgccacccccagcagcacccccggcaccaccuggauccugaccgagcccagcaccaccgccaccgugaccgugcccaccggcagcaccgccaccgccagcagcacccaggccaccgccggcaccccccacgugagcaccaccgccaccacccccaccgugaccagcagcaaggccacccccuucagcagccccggcaccgccaccgcccugcccgcccugagaagcaccgccaccacccccaccgccaccagcuucaccgccauccccagcagcagccugggcaccaccuggaccagacugagccagaccaccacccccaccgccaccaugagcaccgccacccccagcagcacccccgagaccgugcacaccagcaccgugcugaccaccaccgccaccaccaccggcgccaccggcagcguggccacccccagcagcacccccggcaccgcccacaccaccaaggugcugaccaccaccaccaccggcuucaccgccacccccagcagcagccccggcaccgccagaacccugcccguguggaucagcaccaccaccacccccaccaccagaggcagcaccgugacccccagcagcauccccggcaccacccacacccccaccgugcugaccaccaccaccaccaccguggccaccggcagcauggccacccccagcagcagcacccagaccagcggcaccccccccagccugaccaccaccgccaccaccaucaccgccaccggcagcaccaccaaccccagcagcacccccggcaccacccccaucccccccgugcugaccaccaccgccaccacccccgccgccaccagcagcaccgugacccccagcagcgcccugggcaccacccacaccccccccgugcccaacaccaccgccaccacccacggcagaagccugagccccagcagcccccacaccgugagaaccgccuggaccagcgccaccagcggcacccugggcaccacccacaucaccgagcccagcaccggcaccagccacacccccgccgccaccaccggcaccacccagcacagcacccccgcccugagcagcccccaccccagcagcagaaccaccgagagcccccccagccccggcaccaccacccccggccacaccagagccaccagcagaaccaccgccaccgccacccccagcaagaccagaaccagcacccugcugcccagcagccccaccagcgcccccaucaccaccguggugaccaugggcugcgagccccagugcgccuggagcgaguggcuggacuacagcuaccccaugcccggccccagcggcggcgacuucgacaccuacagcaacaucagagccgccggcggcgccgugugcgagcagccccugggccuggagugcagagcccaggcccagcccggcgugccccugagagagcugggccaggugguggagugcagccuggacuucggccuggugugcagaaacagagagcaggugggcaaguucaagaugugcuucaacuacgagaucagaguguucugcugcaacuacggccacugccccagcacccccgccaccagcagcaccgccacccccagcagcacccccggcaccaccuggauccugaccgagcagaccaccgccgccaccaccaccgccaccaccggcagcaccgccauccccagcagcacccccggcaccgcccccccccccaaggugcugaccagcaccgccaccacccccaccgccaccagcagcaaggccaccagcagcagcagccccagaaccgccaccacccugcccgugcugaccagcaccgccaccaagagcaccgccaccagcuucacccccauccccagcuucacccugggcaccaccggcacccugcccgagcagaccaccacccccauggccaccaugagcaccauccaccccagcagcacccccgagaccacccacaccagcaccgugcugaccaccaaggccaccaccaccagagccaccagcagcaugagcacccccagcagcacccccggcaccaccuggauccugaccgagcugaccaccgccgccaccaccaccgccgccaccggccccaccgccacccccagcagcacccccggcaccaccuggauccugaccgagcccagcaccaccgccaccgugaccgugcccaccggcagcaccgccaccgccagcagcaccagagccaccgccggcacccugaaggugcugaccagcaccgccaccacccccaccgugaucagcagcagagccacccccagcagcagccccggcaccgccaccgcccugcccgcccugagaagcaccgccaccacccccaccgccaccagcgugaccgccauccccagcagcagccugggcaccgccuggaccagacugagccagaccaccacccccaccgccaccaugagcaccgccacccccagcagcacccccgagaccgugcacaccagcaccgugcugaccaccaccaccaccaccaccagagccaccggcagcguggccacccccagcagcacccccggcaccgcccacaccaccaaggugcccaccaccaccaccaccggcuucaccgccacccccagcagcagccccggcaccgcccugaccccccccguguggaucagcaccaccaccacccccaccaccagaggcagcaccgugacccccagcagcauccccggcaccacccacaccgccaccgugcugaccaccaccaccaccaccguggccaccggcagcauggccacccccagcagcagcacccagaccagcggcaccccccccagccugaccaccaccgccaccaccaucaccgccaccggcagcaccaccaaccccagcagcacccccggcaccacccccaucccccccgugcugaccaccaccgccaccacccccgccgccaccagcagcaccgugacccccagcagcgcccugggcaccacccacaccccccccgugcccaacaccaccgccaccacccacggcagaagccugccccccagcagcccccacaccgugagaaccgccuggaccagcgccaccagcggcauccugggcaccacccacaucaccgagcccagcaccgugaccagccacacccccgccgccaccaccagcaccacccagcacagcacccccgcccugagcagcccccaccccagcagcagaaccaccgagagcccccccagccccggcaccaccacccccggccacaccagaggcaccagcagaaccaccgccaccgccacccccagcaagaccagaaccagcacccugcugcccagcagccccaccagcgcccccaucaccaccguggugaccaccggcugcgagccccagugcgccuggagcgaguggcuggacuacagcuaccccaugcccggccccagcggcggcgacuucgacaccuacagcaacaucagagccgccggcggcgccgugugcgagcagccccugggccuggagugcagagcccaggcccagcccggcgugccccugagagagcugggccaggugguggagugcagccuggacuucggccuggugugcagaaacagagagcaggugggcaaguucaagaugugcuucaacuacgagaucagaguguucugcugcaacuacggccacugccccagcacccccgccaccagcagcaccgccacccccagcagcacccccggcaccaccuggauccugaccaagcugaccaccaccgccaccaccaccgagagcaccggcagcaccgccacccccagcagcacccccggcaccaccuggauccugaccgagcccagcaccaccgccaccgugaccgugcccaccggcagcaccgccaccgccagcagcacccaggccaccgccggcaccccccacgugagcaccaccgccaccacccccaccgugaccagcagcaaggccacccccuucagcagccccggcaccgccaccgcccugcccgcccugagaagcaccgccaccacccccaccgccaccagcuucaccgccauccccagcagcagccugggcaccaccuggaccagacugagccagaccaccacccccaccgccaccaugagcaccgccacccccagcagcacccccgagaccgcccacaccagcaccgugcugaccaccaccgccaccaccaccagagccaccggcagcguggccacccccagcagcacccccggcaccgcccacaccaccaaggugcccaccaccaccaccaccggcuucaccgugacccccagcagcagccccggcaccgccagaaccccccccguguggaucagcaccaccaccacccccaccaccagcggcagcaccgugacccccagcagcgugcccggcaccacccacacccccaccgugcugaccaccaccaccaccaccguggccaccggcagcauggccacccccagcagcagcacccagaccagcggcaccccccccagccugaucaccaccgccaccaccaucaccgccaccggcagcaccaccaaccccagcagcacccccggcaccacccccaucccccccgugcugaccaccaccgccaccacccccgccgccaccagcagcaccgugacccccagcagcgcccugggcaccacccacaccccccccgugcccaacaccaccgccaccacccacggcagaagccugagccccagcagcccccacaccgugagaaccgccuggaccagcgccaccagcggcacccugggcaccacccacaucaccgagcccagcaccggcaccagccacacccccgccgccaccaccggcaccacccagcacagcacccccgcccugagcagcccccaccccagcagcagaaccaccgagagcccccccagccccggcaccaccacccccggccacaccaccgccaccagcagaaccaccgccaccgccacccccagcaagaccagaaccagcacccugcugcccagcagccccaccagcgcccccaucaccaccguggugaccaccggcugcgagccccagugcgccuggagcgaguggcuggacuacagcuaccccaugcccggccccagcggcggcgacuucgacaccuacagcaacaucagagccgccggcggcgccgugugcgagcagccccugggccuggagugcagagcccaggcccagcccggcgugccccugggcgagcugggccaggugguggagugcagccuggacuucggccuggugugcagaaacagagagcaggugggcaaguucaagaugugcuucaacuacgagaucagaguguucugcugcaacuacggccacugccccagcacccccgccaccagcagcaccgccaugcccagcagcacccccggcaccaccuggauccugaccgagcugaccaccaccgccaccaccaccgccagcaccggcagcaccgccacccccagcagcacccccggcaccgcccccccccccaaggugcugaccagccccgccaccacccccaccgccaccagcagcaaggccaccagcagcagcagccccagaaccgccaccacccugcccgugcugaccagcaccgccaccaagagcaccgccaccagcgugacccccauccccagcagcacccugggcaccaccggcacccugcccgagcagaccaccacccccguggccaccaugagcaccauccaccccagcagcacccccgagaccacccacaccagcaccgugcugaccaccaaggccaccaccaccagagccaccagcagcaccagcacccccagcagcacccccggcaccaccuggauccugaccgagcugaccaccgccgccaccaccaccgccgccaccggccccaccgccacccccagcagcacccccggcaccaccuggauccugaccgagcugaccaccaccgccaccaccaccgccagcaccggcagcaccgccacccccagcagcacccccggcaccaccuggauccugaccgagcccagcaccaccgccaccgugaccgugcccaccggcagcaccgccaccgccagcagcacccaggccaccgccggcaccccccacgugagcaccaccgccaccacccccaccgugaccagcagcaaggccacccccagcagcagccccggcaccgccaccgcccugcccgcccugagaagcaccgccaccacccccaccgccaccagcuucaccgccauccccagcagcagccugggcaccaccuggaccagacugagccagaccaccacccccaccgccaccaugagcaccgccacccccagcagcacccccgagaccgugcacaccagcaccgugcugaccgccaccgccaccaccaccggcgccaccggcagcguggccacccccagcagcacccccggcaccgcccacaccaccaaggugcccaccaccaccaccaccggcuucaccgccacccccagcagcagccccggcaccgcccugaccccccccguguggaucagcaccaccaccacccccaccaccaccacccccaccaccagcggcagcaccgugacccccagcagcauccccggcaccacccacaccgccagagugcugaccaccaccaccaccaccguggccaccggcagcauggccacccccagcagcagcacccagaccagcggcaccccccccagccugaccaccaccgccaccaccaucaccgccaccggcagcaccaccaaccccagcagcacccccggcaccacccccaucacccccgugcugaccagcaccgccaccacccccgccgccaccagcagcaaggccaccagcagcagcagccccagaaccgccaccacccugcccgugcugaccagcaccgccaccaagagcaccgccaccagcuucacccccauccccagcagcacccuguggaccaccuggaccgugcccgcccagaccaccacccccaugagcaccaugagcaccauccacaccagcagcacccccgagaccacccacaccagcaccgugcugaccaccaccgccaccaugaccagagccaccaacagcaccgccacccccagcagcacccugggcaccaccagaauccugaccgagcugaccaccaccgccaccaccaccgccgccaccggcagcaccgccacccugagcagcacccccggcaccaccuggauccugaccgagcccagcaccaucgccaccgugauggugcccaccggcagcaccgccaccgccagcagcacccugggcaccgcccacacccccaagguggugaccaccauggccaccaugcccaccgccaccgccagcaccgugcccagcagcagcaccgugggcaccaccagaacccccgccgugcugcccagcagccugcccaccuucagcgugagcaccgugagcagcagcgugcugaccacccugagacccaccggcuuccccagcagccacuucagcacccccugcuucugcagagccuucggccaguucuucagccccggcgaggugaucuacaacaagaccgacagagccggcugccacuucuacgccgugugcaaccagcacugcgacaucgacagauuccagggcgccugccccaccagccccccccccgugagcagcgccccccugagcagccccagccccgcccccggcugcgacaacgccaucccccugagacaggugaacgagaccuggacccuggagaacugcaccguggccagaugcgugggcgacaacagaguggugcugcuggaccccaagcccguggccaacgugaccugcgugaacaagcaccugcccaucaaggugagcgaccccagccagcccugcgacuuccacuacgagugcgagugcaucugcagcauguggggcggcagccacuacagcaccuucgacggcaccagcuacaccuucagaggcaacugcaccuacgugcugaugagagagauccacgccagauucggcaaccugagccuguaccuggacaaccacuacugcaccgccagcgccaccgccgccgccgccagaugccccagagcccugagcauccacuacaagagcauggacaucgugcugaccgugaccauggugcacggcaaggaggagggccugauccuguucgaccagauccccgugagcagcggcuucagcaagaacggcgugcuggugagcgugcugggcaccaccaccaugagaguggacauccccgcccugggcgugagcgugaccuucaacggccagguguuccaggccagacugcccuacagccuguuccacaacaacaccgagggccagugcggcaccugcaccaacaaccagagagacgacugccugcagagagacggcaccaccgccgccagcugcaaggacauggccaagaccuggcuggugcccgacagcagaaaggacggcugcugggcccccaccggcaccccccccaccgccagccccgccgcccccgugagcagcacccccacccccacccccugccccccccagccccugugcgaccugaugcugagccagguguucgccgagugccacaaccuggugccccccggccccuucuucaacgccugcaucagcgaccacugcagaggcagacuggaggugcccugccagagccuggaggccuacgccgagcugugcagagccagaggcgugugcagcgacuggagaggcgccaccggcggccugugcgaccugaccugcccccccaccaagguguacaagcccugcggccccauccagcccgccaccugcaacagcagaaaccagagcccccagcuggagggcauggccgagggcugcuucugccccgaggaccagauccuguucaacgcccacaugggcaucugcgugcaggccugccccugcgugggccccgacggcuuccccaaguuccccggcgagagaugggugagcaacugccagagcugcgugugcgacgagggcagcgugagcgugcagugcaagccccugcccugcgacgcccagggccagcccccccccugcaacagacccggcuucgugaccgugaccagacccagagccgagaaccccugcugccccgagaccgugugcgugugcaacaccaccaccugcccccagagccugcccgugugcccccccggccaggagagcaucugcacccaggaggagggcgacugcugccccaccuucagaugcagaccccagcugugcagcuacaacggcaccuucuacggcgugggcgccaccuuccccggcgcccugcccugccacaugugcaccugccugagcggcgacacccaggaccccaccgugcagugccaggaggacgccugcaacaacaccaccugcccccagggcuucgaguacaagagaguggccggccagugcugcggcgagugcgugcagaccgccugccugacccccgacggccagcccgugcagcugaacgagaccugggugaacagccacguggacaacugcaccguguaccugugcgaggccgagggcggcgugcaccugcugaccccccagcccgccagcugccccgacgugagcagcugcagaggcagccugagaaagaccggcugcugcuacagcugcgaggaggacagcugccaggugagaaucaacaccaccauccuguggcaccagggcugcgagaccgaggugaacaucaccuucugcgagggcagcugccccggcgccagcaaguacagcgccgaggcccaggccaugcagcaccagugcaccugcugccaggagagaagagugcacgaggagaccgugccccugcacugccccaacggcagcgccauccugcacaccuacacccacguggacgagugcggcugcacccccuucugcgugcccgcccccauggcccccccccacaccagaggcuuccccgcccaggaggccaccgccguguaa

SEQ ID NO: 20169 - RNA, 7320 nt, Artificial Sequence
  MUC6__Homo_sapiens__NP_005952
auggugcagagauggcugcugcugagcugcugcggcgcccugcugagcgccggccuggccaacaccagcuacaccagccccggccugcagagacugaaggacagcccccagaccgcccccgacaagggccagugcagcaccuggggcgccggccacuucagcaccuucgaccaccacguguacgacuucagcggcaccugcaacuacaucuucgccgccaccugcaaggacgccuuccccaccuucagcgugcagcugagaagaggccccgacggcagcaucagcagaaucaucguggagcugggcgccagcguggugaccgugagcgaggccaucaucagcgugaaggacaucggcgugaucagccugcccuacaccagcaacggccugcagaucacccccuucggccagagcgugagacugguggccaagcagcuggagcuggagcuggaggugguguggggccccgacagccaccugauggugcugguggagagaaaguacaugggccagaugugcggccugugcggcaacuucgacggcaaggugaccaacgaguucgugagcgaggagggcaaguuccuggagccccacaaguucgccgcccugcagaagcuggacgaccccggcgagaucugcaccuuccaggacauccccagcacccacgugagacaggcccagcacgccagaaucugcacccagcugcugacccugguggcccccgagugcagcgugagcaaggagcccuucgugcugagcugccaggccgacguggccgccgccccccagcccggcccccagaacagcagcugcgccacccugagcgaguacagcagacagugcagcauggugggccagcccgugagaagauggagaagccccggccugugcagcgugggccagugccccgccaaccagguguaccaggagugcggcagcgccugcgugaagaccugcagcaacccccagcacagcugcagcagcagcugcaccuucggcugcuucugccccgagggcaccgugcugaacgaccugagcaacaaccacaccugcgugcccgugacccagugccccugcgugcugcacggcgccauguacgcccccggcgaggugaccaucgccgccugccagaccugcagaugcacccugggcagaugggugugcaccgagagacccugccccggccacugcagccuggagggcggcagcuucgugaccaccuucgacgccagacccuacagauuccacggcaccugcaccuacauccugcugcagagcccccagcugcccgaggacggcgcccugauggccguguacgacaagagcggcgugagccacagcgagaccagccugguggccgugguguaccugagcagacaggacaagaucgugaucagccaggacgagguggugaccaacaacggcgaggccaaguggcugcccuacaagaccagaaacaucaccguguucagacagaccagcacccaccugcagauggccaccagcuucggccuggagcugguggugcagcugagacccaucuuccaggccuacgugaccgugggcccccaguucagaggccagaccagaggccugugcggcaacuucaacggcgacaccaccgacgacuucaccaccagcaugggcaucgccgagggcaccgccagccuguucguggacagcuggagagccggcaacugccccgccgcccuggagagagagaccgaccccugcagcaugagccagcugaacaaggugugcgccgagacccacugcagcaugcugcugagaaccggcaccguguucgagagaugccacgccaccgugaaccccgcccccuucuacaagagaugcguguaccaggccugcaacuacgaggagaccuucccccacaucugcgccgcccugggcgacuacgugcacgccugcagccugagaggcgugcugcuguggggcuggagaagcagcguggacaacugcaccauccccugcaccggcaacaccaccuucagcuacaacagccaggccugcgagagaaccugccugagccugagcgacagagccaccgagugccaccacagcgccgugcccguggacggcugcaacugccccgacggcaccuaccugaaccagaagggcgagugcgugagaaaggcccagugccccugcauccuggagggcuacaaguucauccuggccgagcagagcaccgugaucaacggcaucaccugccacugcaucaacggcagacugagcugcccccagagaccccagauguuccuggccagcugccaggcccccaagaccuucaagagcugcagccagagcagcgagaacaaguucggcgccgccugcgcccccaccugccagaugcuggccaccggcguggccugcgugcccaccaagugcgagcccggcugcgugugcgccgagggccuguacgagaacgccgacggccagugcgugccccccgaggagugccccugcgaguucagcggcgugagcuaccccggcggcgccgagcugcacaccgacugcagaaccugcagcugcagcagaggcagaugggccugccagcagggcacccacugccccagcaccugcacccuguacggcgagggccacgugaucaccuucgacggccagagauucguguucgacggcaacugcgaguacauccuggccaccgacgugugcggcgugaacgacagccagcccaccuucaagauccugaccgagaacgugaucugcggcaacagcggcgugaccugcagcagagccaucaagaucuuccugggcggccugagcguggugcuggccgacagaaacuacaccgugaccggcgaggagccccacgugcagcugggcgugacccccggcgcccugagccuggugguggacaucagcauccccggcagauacaaccugacccugaucuggaacagacacaugaccauccugaucagaaucgccagagccagccaggacccccugugcggccugugcggcaacuucaacggcaacaugaaggacgacuucgagaccagaagcagauacguggccagcagcgagcuggagcuggugaacagcuggaaggagagcccccugugcggcgacgugagcuucgugaccgaccccugcagccugaacgccuucagaagaagcugggccgagagaaagugcagcgugaucaacagccagaccuucgccaccugccacagcaagguguaccaccugcccuacuacgaggccugcgugagagacgccugcggcugcgacagcggcggcgacugcgagugccugugcgacgccguggccgccuacgcccaggccugccuggacaagggcgugugcguggacuggagaacccccgccuucugccccaucuacugcggcuucuacaacacccacacccaggacggccacggcgaguaccaguacacccaggaggccaacugcaccuggcacuaccagcccugccugugccccagccagccccagagcgugcccggcagcaacaucgagggcugcuacaacugcagccaggacgaguacuucgaccacgaggagggcgugugcgugcccugcaugccccccaccaccccccagccccccaccaccccccagcugcccaccaccggcagcagacccacccagguguggcccaugaccggcaccagcaccaccaucggccugcugagcagcaccggccccagccccagcagcaaccacacccccgccagccccacccagaccccccugcugcccgccacccugaccagcagcaagcccaccgccagcagcggcgagccccccagacccaccaccgccgugaccccccaggccaccagcggccugccccccaccgccacccugagaagcaccgccaccaagcccaccgugacccaggccaccaccagagccaccgccagcaccgccagccccgccaccaccagcaccgcccagagcaccaccagaaccaccaugacccugcccacccccgccaccagcggcaccagccccacccugcccaagagcaccaaccaggagcugcccggcaccaccgccacccagaccaccggccccagacccacccccgccagcaccaccggccccaccaccccccagcccggccagcccaccagacccaccgccaccgagaccacccagaccagaaccaccaccgaguacaccaccccccagaccccccacaccacccacagcccccccaccgccggcagccccgugcccagcaccggccccgugaccgccaccagcuuccacgccaccaccaccuaccccacccccagccaccccgagaccacccugcccacccacgugccccccuucagcaccagccuggugacccccagcacccacaccgugaucacccccacccacgcccagauggccaccagcgccagcaaccacagcgcccccaccggcaccauccccccccccaccacccugaaggccaccggcagcacccacaccgccccccccaucacccccaccaccagcggcaccagccaggcccacagcagcuucagcaccaacaagacccccaccagccugcacagccacaccagcagcacccaccaccccgaggugacccccaccagcaccaccaccaucacccccaaccccaccagcaccagaaccagaacccccguggcccacaccaacagcgccaccagcagcagaccccccccccccuucaccacccacagcccccccaccggcagcagccccuucagcagcaccggccccaugaccgccaccagcuucaagaccaccaccaccuaccccacccccagccacccccagaccacccugcccacccacgugccccccuucagcaccagccuggugacccccagcacccacaccgugaucacccccacccacgcccagauggccaccagcgccagcauccacagcaugcccaccggcaccauccccccccccaccacccugaaggccaccggcagcacccacaccgcccccaccaugacccugaccaccagcggcaccagccaggcccugagcagccugaacaccgccaagaccagcaccagccugcacagccacaccagcagcacccaccacgccgaggccaccagcaccagcaccaccaacaucacccccaaccccaccagcaccggcaccccccccaugaccgugaccaccagcggcaccagccagagcagaagcagcuucagcaccgccaagaccagcaccagccugcacagccacaccagcagcacccaccaccccgaggugaccagcaccagcaccaccagcaucacccccaaccacaccagcaccggcaccagaacccccguggcccacaccaccagcgccaccagcagcagacugcccacccccuucaccacccacagcccccccaccggcaccacccccaucagcagcaccggccccgugaccgccaccagcuuccagaccaccaccaccuaccccacccccagccacccccacaccacccugcccacccacgugcccagcuucagcaccagccuggugacccccagcacccacaccgugaucauccccacccacacccagauggccaccagcgccagcauccacagcaugcccaccggcaccauccccccccccaccaccaucaaggccaccggcagcacccacaccgccccccccaugacccccaccaccagcggcaccagccagagccccagcagcuucagcaccgccaagaccagcaccagccugcccuaccacaccagcagcacccaccaccccgaggugacccccaccagcaccaccaacaucacccccaagcacaccagcaccggcaccagaacccccguggcccacaccaccagcgccagcagcagcagacugcccacccccuucaccacccacagcccccccaccggcagcagccccuucagcagcaccggccccaugaccgccaccagcuuccagaccaccaccaccuaccccacccccagccacccccagaccacccugcccacccacgugccccccuucagcaccagccuggugacccccagcacccacaccgugaucaucaccacccacacccagauggccaccagcgccagcauccacagcacccccaccggcaccgugcccccccccaccacccugaaggccaccggcagcacccacaccgccccccccaugaccgugaccaccagcggcaccagccagacccacagcagcuucagcaccgccaccgccagcagcagcuucaucagcagcagcagcuggcugccccagaacagcagcagcagaccccccagcagccccaucaccacccagcugccccaccugagcagcgccaccacccccgugagcaccaccaaccagcugagcagcagcuucagccccagccccagcgcccccagcaccgugagcagcuacgugcccagcagccacagcagcccccagaccagcagccccagcgugggcaccagcagcagcuucgugagcgcccccgugcacagcaccacccugagcagcggcagccacagcagccugagcacccaccccaccaccgccagcgugagcgccagcccccuguuccccagcagccccgccgccagcaccaccaucagagccacccugccccacaccaucagcagccccuucacccugagcgcccugcugcccaucagcaccgugaccgugagccccacccccagcagccaccuggccagcagcaccaucgccuuccccagcacccccagaaccaccgccagcacccacaccgcccccgccuucagcagccagagcaccaccagcagaagcaccagccugaccaccagagugcccaccagcggcuucgugagccugaccagcggcgugaccggcauccccaccagccccgugaccaaccugaccaccagacaccccggccccacccugagccccaccaccagauuccugaccagcagccugaccgcccacggcagcacccccgccagcgcccccgugagcagccugggcacccccacccccaccagccccggcgugugcagcgugagagagcagcaggaggagaucaccuucaagggcugcauggccaacgugaccgugaccagaugcgagggcgccugcaucagcgccgccagcuucaacaucaucacccagcagguggacgccagaugcagcugcugcagaccccugcacagcuacgagcagcagcuggagcugcccugccccgaccccagcacccccggcagaagacuggugcugacccugcagguguucagccacugcgugugcagcagcguggccugcggcgacuaa

SEQ ID NO: 20170 - RNA, 1134 nt, Artificial Sequence
  MUC7__Homo_sapiens__NP_001138479
augaagacccugccccuguucgugugcaucugcgcccugagcgccugcuucagcuucagcgagggcagagagagagaccacgagcugagacacagaagacaccaccaccagagccccaagagccacuucgagcugccccacuaccccggccugcuggcccaccagaagcccuucaucagaaagagcuacaagugccugcacaagagaugcagacccaagcugccccccagccccaacaacccccccaaguuccccaacccccaccagccccccaagcaccccgacaagaacagcagcguggugaaccccacccugguggccaccacccagauccccagcgugaccuuccccagcgccagcaccaagaucaccacccugcccaacgugaccuuccugccccagaacgccaccaccaucagcagcagagagaacgugaacaccagcagcagcguggccacccuggcccccgugaacagccccgccccccaggacaccaccgccgccccccccacccccagcgccaccacccccgccccccccagcagcagcgccccccccgagaccaccgccgccccccccacccccagcgccaccacccaggccccccccagcagcagcgccccccccgagaccaccgccgccccccccaccccccccgccaccacccccgccccccccagcagcagcgccccccccgagaccaccgccgccccccccacccccagcgccaccacccccgccccccugagcagcagcgccccccccgagaccaccgccgugccccccacccccagcgccaccacccuggaccccagcagcgccagcgccccccccgagaccaccgccgccccccccacccccagcgccaccacccccgccccccccagcagccccgccccccaggagaccaccgccgcccccaucaccacccccaacagcagccccaccacccuggcccccgacaccagcgagaccagcgccgcccccacccaccagaccaccaccagcgugaccacccagaccaccaccaccaagcagcccaccagcgcccccggccagaacaagaucagcagauuccugcuguacaugaagaaccugcugaacagaaucaucgacgacaugguggagcaguaa

SEQ ID NO: 20171 - RNA, 273 nt, Artificial Sequence
  MUCL1__Homo_sapiens__XP_011536170
augaaguuccuggccgugcuggugcugcugggcgugagcaucuuccuggugagcgcccagaaccccaccaccgccgcccccgccgacaccuaccccgccaccggccccgccgacgacgaggcccccgacgccgagaccaccgccgccgccaccaccgccaccaccgccgcccccaccaccgccaccaccgccgccagcaccaccgccagaaaggacauccccgugcugcccaagugggugggcgaccugcccaacggcagagugugccccuaa

SEQ ID NO: 20172 - RNA, 2136 nt, Artificial Sequence
  MUM1__Homo_sapiens__NP_116242
augauggccgacgccaaguacgugcugugcagaugggagaagagacuguggcccgccaaggugcuggccagaaccgccaccagcaccaagaacaagagaagaaaggaguacuuccuggccgugcagauccugagccuggaggagaagaucaaggugaagagcaccgagguggagauccuggagaagagccagaucgaggccaucgccagcagccuggccagccagaacgaggugcccgccgccccccuggaggagcuggccuacagaagaagccugagaguggcccuggacgugcugagcgagggcagcaucuggagccaggagagcagcgccggcaccggcagagccgacagaagccugagaggcaagcccauggagcacgugagcagccccugcgacagcaacagcagcagccugcccagaggcgacgugcugggcagcagcagaccccacagaagaagacccugcgugcagcagagccugagcagcagcuucaccugcgagaaggaccccgagugcaagguggaccacaagaagggccugagaaagagcgagaaccccagaggcccccuggugcugcccgccggcggcggcgcccaggacgagagcggcagcagaauccaccacaagaacuggacccuggccagcaagagaggcggcaacagcgcccagaaggccagccugugccugaacggcagcagccugagcgaggacgacaccgagagagacaugggcagcaagggcggcagcugggccgcccccagccugcccagcggcgugagagaggacgaccccugcgccaacgccgagggccacgaccccggccugccccugggcagccugaccgccccccccgcccccgagcccagcgccugcagcgagcccggcgagugccccgccaagaagagacccagacuggacggcagccagagaccccccgccgugcagcuggagcccauggccgccggcgccgcccccagccccggccccggccccggccccagagagagcgugacccccagaagcaccgccagacugggccccccccccagccacgccagcgccgacgccaccagaugccugcccugccccgacagccagaagcuggagaaggagugccagagcagcgaggagagcaugggcagcaacagcaugagaagcauccuggaggaggacgaggaggacgaggagccccccagagugcugcuguaccacgagcccagaagcuucgaggugggcaugcugguguggcacaagcacaagaaguaccccuucuggcccgccguggugaagagcgugagacagagagacaagaaggccagcgugcuguacaucgagggccacaugaaccccaagaugaagggcuucaccgugagccugaagagccugaagcacuucgacugcaaggagaagcagacccugcugaaccaggccagagaggacuucaaccaggacaucggcuggugcgugagccugaucaccgacuacagagugagacugggcugcggcagcuucgccggcagcuuccuggaguacuacgccgccgacaucagcuaccccgugagaaagagcauccagcaggacgugcugggcaccaagcugccccagcugagcaagggcagccccgaggagcccguggugggcugcccccugggccagagacagcccugcagaaagaugcugcccgacagaagcagagccgccagagacagagccaaccagaagcugguggaguacaucgugaaggccaagggcgccgagagccaccugagagccauccugaagagcagaaagcccagcagauggcugcagaccuuccugagcagcagccaguacgugaccugcguggagaccuaccuggaggacgagggccagcuggaccugguggugaaguaccugcagggcguguaccaggaggugggcgccaaggugcugcagagaaccaacggcgacagaaucagauucauccuggacgugcugcugcccgaggccaucaucugcgccaucagcgccguggacgagguggacuacaagaccgccgaggagaaguacaucaagggccccagccugagcuacagagagaaggagaucuucgacaaccagcugcuggaggagagaaacagaagaagaagauaa

SEQ ID NO: 20173 - RNA, 1095 nt, Artificial Sequence
  MURC__Homo_sapiens__NP_001018126
auggagcacaacggcagcgccagcaacgccgacaagauccaccagaacagacugagcagcgugaccgaggacgaggaccaggacgccgcccugaccaucgugaccgugcuggacaagguggccagcaucguggacagcgugcaggccagccagaagagaaucgaggagagacacagagagauggagaacgccaucaagagcgugcagaucgaccugcugaagcugagccagagccacagcaacaccggccacaucaucaacaagcuguucgagaagaccagaaaggugagcgcccacaucaaggacgugaaggccagaguggagaagcagcagauccacgugaagaagguggaggugaagcaggaggagaucaugaagaagaacaaguucagaguggugaucuuccaggagaaguucagaugccccaccagccugagcguggugaaggacagaaaccugaccgagaaccaggaggaggacgacgacgacaucuucgacccccccguggaccugagcagcgacgaggaguacuacguggaggagagcagaagcgccagacugagaaagagcggcaaggagcacaucgacaacaucaagaaggccuucagcaaggagaacaugcagaagaccagacagaaccuggacaagaaggugaacagaaucagaaccagaaucgugacccccgagagaagagagagacugagacagagcggcgagagacugagacagagcggcgagagacugagacagagcggcgagagauucaagaagagcaucagcaacgccgcccccagcaaggaggccuucaagaugagaagccugagaaagggcaaggacagaaccguggccgagggcgaggagugcgccagagagaugggcguggacaucaucgccagaagcgagagccugggccccaucagcgagcuguacagcgacgagcugagcgagcccgagcacgaggccgccagacccguguaccccccccacgagggcagagagauccccacccccgagccccugaaggugaccuucaagagccaggugaagguggaggacgacgagagccugcugcuggaccugaagcacagcagcuaa

SEQ ID NO: 20174 - RNA, 1656 nt, Artificial Sequence
  MUS81__Homo_sapiens__XP_011543572
auggccgcccccgugagacugggcagaaagagaccccugcccgccugccccaacccccuguucgugagauggcugaccgaguggagagacgaggccaccagaagcagaagaagaaccagauucguguuccagaaggcccugagaagccugagaagauacccccugccccugagaagcggcaaggaggccaagauccugcagcacuucggcgacggccugugcagaaugcuggacgagagacugcagagacacagaaccagcggcggcgaccacgcccccgacagccccagcggcgagaacagccccgccccccagggcagacuggccgaggugcaggacagcagcaugcccgugcccgcccagcccaaggccggcggcagcggcagcuacuggcccgccagacacagcggcgccagagugauccugcuggugcuguacagagagcaccugaaccccaacggccaccacuuccugaccaaggaggagcugcugcagagaugcgcccagaagagccccagaguggcccccggcagcgccagacccuggcccgcccugagaagccugcugcacagaaaccuggugcugagaacccaccagcccgccagauacagccugacccccgagggccuggagcuggcccagaagcuggccgagagcgagggccugagccugcugaacgugggcaucggccccaaggagccccccggcgaggagaccgccgugcccggcgccgccagcgccgagcuggccagcgaggccggcgugcagcagcagccccuggagcugagacccggcgaguacagagugcugcugugcguggacaucggcgagaccagaggcggcggccacagacccgagcugcugagagagcugcagagacugcacgugacccacaccgugagaaagcugcacgugggcgacuucguguggguggcccaggagaccaaccccagagaccccgccaaccccggcgagcuggugcuggaccacaucguggagagaaagagacuggacgaccugugcagcagcaucaucgacggcagauucagagagcagaaguucagacugaagagaugcggccuggagagaagaguguaccugguggaggagcacggcagcgugcacaaccugagccugcccgagagcacccugcugcaggccgugaccaacacccaggugaucgacggcuucuucgugaagagaaccgccgacaucaaggagagcgccgccuaccuggcccugcugaccagaggccugcagagacuguaccagggccacacccugagaagcagacccuggggcacccccggcaaccccgagagcggcgccaugaccagccccaacccccugugcagccugcugaccuucagcgacuucaacgccggcgccaucaagaacaaggcccagagcgugagagagguguucgccagacagcugaugcaggugagaggcgugagcggcgagaaggccgccgcccugguggacagauacagcacccccgccagccugcuggccgccuacgacgccugcgccacccccaaggagcaggagacccugcugagcaccaucaagugcggcagacugcagagaaaccugggccccgcccugagcagaacccugagccagcuguacugcagcuacggcccccugaccuaa

SEQ ID NO: 20175 - RNA, 2352 nt, Artificial Sequence
  MUSK__Homo_sapiens__NP_001159752
augagagagcuggugaacaucccccuggugcacauccugacccugguggccuucagcggcaccgagaagcugcccaaggcccccgugaucaccaccccccuggagaccguggacgcccugguggaggagguggccaccuucaugugcgccguggagagcuacccccagcccgagaucagcuggaccagaaacaagauccugaucaagcuguucgacaccagauacagcaucagagagaacggccagcugcugaccauccugagcguggaggacagcgacgacggcaucuacugcugcaccgccaacaacggcgugggcggcgccguggagagcugcggcgcccugcaggugaagaugaagcccaagaucaccagaccccccaucaacgugaagaucaucgagggccugaaggccgugcugcccugcaccaccaugggcaaccccaagcccagcgugagcuggaucaagggcgacagcccccugagagagaacagcagaaucgccgugcuggagagcggcagccugagaauccacaacgugcagaaggaggacgccggccaguacagaugcguggccaagaacagccugggcaccgccuacagcaagguggugaagcuggagguggaggaggagagcgagcccgagcaggacaccaagguguucgccagaauccugagagcccccgagagccacaacgugaccuucggcagcuucgugacccugcacugcaccgccaccggcauccccgugcccaccaucaccuggaucgagaacggcaacgccgugagcagcggcagcauccaggagagcgugaaggacagagugaucgacagcagacugcagcuguucaucaccaagcccggccuguacaccugcaucgccaccaacaagcacggcgagaaguucagcaccgccaaggccgccgccaccaucagcaucgccgaguggagagaguacugccuggccgugaaggagcuguucugcgccaaggaguggcuggugauggaggagaagacccacagaggccuguacagaagcgagaugcaccugcugagcgugcccgagugcagcaagcugcccagcaugcacugggaccccaccgccugcgccagacugccccaccuggccuucccccccaugaccagcagcaagcccagcguggacauccccaaccugcccagcagcagcagcagcagcuucagcgugagccccaccuacagcaugaccgugaucaucagcaucaugagcagcuucgccaucuucgugcugcugaccaucaccacccuguacugcugcagaagaagaaagcaguggaagaacaagaagagagagagcgccgccgugacccugaccacccugcccagcgagcugcugcuggacagacugcaccccaaccccauguaccagagaaugccccugcugcugaaccccaagcugcugagccuggaguaccccagaaacaacaucgaguacgugagagacaucggcgagggcgccuucggcagaguguuccaggccagagcccccggccugcugcccuacgagcccuucaccaugguggccgugaagaugcugaaggaggaggccagcgccgacaugcaggccgacuuccagagagaggccgcccugauggccgaguucgacaaccccaacaucgugaagcugcugggcgugugcgccgugggcaagcccaugugccugcuguucgaguacauggccuacggcgaccugaacgaguuccugagaagcaugagcccccacaccgugugcagccugagccacagcgaccugagcaugagagcccaggugagcagccccggcccccccccccugagcugcgccgagcagcugugcaucgccagacagguggccgccggcauggccuaccugagcgagagaaaguucgugcacagagaccuggccaccagaaacugccuggugggcgagaacaugguggugaagaucgccgacuucggccugagcagaaacaucuacagcgccgacuacuacaaggccaacgagaacgacgccauccccaucagauggaugccccccgagagcaucuucuacaacagauacaccaccgagagcgacgugugggccuacggcguggugcugugggagaucuucagcuacggccugcagcccuacuacggcauggcccacgaggaggugaucuacuacgugagagacggcaacauccugagcugccccgagaacugccccguggagcuguacaaccugaugagacugugcuggagcaagcugcccgccgacagacccagcuucaccagcauccacagaauccuggagagaaugugcgagagagccgagggcaccgugagcguguaa

SEQ ID NO: 20176 - RNA, 2253 nt, Artificial Sequence
  MUT__Homo_sapiens__NP_000246
augcugagagccaagaaccagcuguuccugcugagcccccacuaccugagacaggugaaggagagcagcggcagcagacugauccagcagagacugcugcaccagcagcagccccugcaccccgagugggccgcccuggccaagaagcagcugaagggcaagaaccccgaggaccugaucuggcacacccccgagggcaucagcaucaagccccuguacagcaagagagacaccauggaccugcccgaggagcugcccggcgugaagcccuucaccagaggccccuaccccaccauguacaccuucagacccuggaccaucagacaguacgccggcuucagcaccguggaggagagcaacaaguucuacaaggacaacaucaaggccggccagcagggccugagcguggccuucgaccuggccacccacagaggcuacgacagcgacaaccccagagugagaggcgacgugggcauggccggcguggccaucgacaccguggaggacaccaagauccuguucgacggcaucccccuggagaagaugagcgugagcaugaccaugaacggcgccgugauccccgugcuggccaacuucaucgugaccggcgaggagcagggcgugcccaaggagaagcugaccggcaccauccagaacgacauccugaaggaguucauggugagaaacaccuacaucuucccccccgagcccagcaugaagaucaucgccgacaucuucgaguacaccgccaagcacaugcccaaguucaacagcaucagcaucagcggcuaccacaugcaggaggccggcgccgacgccauccuggagcuggccuacacccuggccgacggccuggaguacagcagaaccggccugcaggccggccugaccaucgacgaguucgcccccagacugagcuucuucuggggcaucggcaugaacuucuacauggagaucgccaagaugagagccggcagaagacugugggcccaccugaucgagaagauguuccagcccaagaacagcaagagccugcugcugagagcccacugccagaccagcggcuggagccugaccgagcaggaccccuacaacaacaucgugagaaccgccaucgaggccauggccgccguguucggcggcacccagagccugcacaccaacagcuucgacgaggcccugggccugcccaccgugaagagcgccagaaucgccagaaacacccagaucaucauccaggaggagagcggcauccccaagguggccgaccccuggggcggcagcuacaugauggagugccugaccaacgacguguacgacgccgcccugaagcugaucaacgagaucgaggagaugggcggcauggccaaggccguggccgagggcauccccaagcugagaaucgaggagugcgccgccagaagacaggccagaaucgacagcggcagcgaggugaucgugggcgugaacaaguaccagcuggagaaggaggacgccguggaggugcuggccaucgacaacaccagcgugagaaacagacagaucgagaagcugaagaagaucaagagcagcagagaccaggcccuggccgagagaugccuggccgcccugaccgagugcgccgccagcggcgacggcaacauccuggcccuggccguggacgccagcagagccagaugcaccgugggcgagaucaccgacgcccugaagaagguguucggcgagcacaaggccaacgacagaauggugagcggcgccuacagacaggaguucggcgagagcaaggagaucaccagcgccaucaagagagugcacaaguucauggagagagagggcagaagacccagacugcugguggccaagaugggccaggacggccacgacagaggcgccaaggugaucgccaccggcuucgccgaccugggcuucgacguggacaucggcccccuguuccagacccccagagagguggcccagcaggccguggacgccgacgugcacgccgugggcaucagcacccuggccgccggccacaagacccuggugcccgagcugaucaaggagcugaacagccugggcagacccgacauccuggugaugugcggcggcgugauccccccccaggacuacgaguuccuguucgaggugggcgugagcaacguguucggccccggcaccagaauccccaaggccgccgugcaggugcuggacgacaucgagaagugccuggagaagaagcagcagagcguguaa

SEQ ID NO: 20177 - RNA, 1611 nt, Artificial Sequence
  MUTYH__Homo_sapiens__NP_001280119
augaccccccuggugagcagacugagcagacugugggccaucaugagaaagcccagagccgccgugggcagcggccacagaaagcaggccgccagccaggagggcagacagaagcacgccaagaacaacagccaggccaagcccagcgccugcgacgccggccuggccagacagcccgaggagguggugcugcaggccagcgugagcagcuaccaccuguucagagacguggccgaggugaccgccuucagaggcagccugcugagcugguacgaccaggagaagagagaccugcccuggagaagaagagccgaggacgagauggaccuggacagaagagccuacgccgugugggugagcgaggugaugcugcagcagacccagguggccaccgugaucaacuacuacaccggcuggaugcagaaguggcccacccugcaggaccuggccagcgccagccuggaggaggugaaccagcugugggccggccugggcuacuacagcagaggcagaagacugcaggagggcgccagaaaggugguggaggagcugggcggccacaugcccagaaccgccgagacccugcagcagcugcugcccggcgugggcagauacaccgccggcgccaucgccagcaucgccuucggccaggccaccggcgugguggacggcaacguggccagagugcugugcagagugagagccaucggcgccgaccccagcagcacccuggugagccagcagcuguggggccuggcccagcagcugguggaccccgccagacccggcgacuucaaccaggccgccauggagcugggcgccaccgugugcaccccccagagaccccugugcagccagugccccguggagagccugugcagagccagacagagaguggagcaggagcagcugcuggccagcggcagccugagcggcagccccgacguggaggagugcgcccccaacaccggccagugccaccugugccugccccccagcgagcccugggaccagacccugggcguggugaacuuccccagaaaggccagcagaaagccccccagagaggagagcagcgccaccugcgugcuggagcagcccggcgcccugggcgcccagauccugcuggugcagagacccaacagcggccugcuggccggccugugggaguuccccagcgugaccugggagcccagcgagcagcugcagagaaaggcccugcugcaggagcugcagagaugggccggcccccugcccgccacccaccugagacaccugggcgagguggugcacaccuucagccacaucaagcugaccuaccagguguacggccuggcccuggagggccagacccccgugaccaccgugccccccggcgccagauggcugacccaggaggaguuccacaccgccgccgugagcaccgccaugaagaagguguucagaguguaccagggccagcagcccggcaccugcaugggcagcaagagaagccaggugagcagccccugcagcagaaagaagcccagaaugggccagcaggugcuggacaacuucuucagaagccacaucagcaccgacgcccacagccugaacagcgccgcccaguaa

SEQ ID NO: 20178 - RNA, 666 nt, Artificial Sequence
  MVB12B__Homo_sapiens__NP_001011703
augagaagcugcuucugcgugagaagaagcagagaccccccccccccccagcccccccccccccccccccagagaggcaccgaccagagcaccaugcccgaggugaaggaccugagcgaggcccugcccgagaccagcauggaccccaucaccggcgugggcgugguggccagcagaaacagagcccccaccggcuacgacgugguggcccagaccgccgacggcguggacgccgaccuguggaaggacggccuguucaagagcaaggugaccagauaccugugcuucaccagaagcuucagcaaggagaacagccaccugggcaacgugcugguggacaugaagcugaucgacaucaaggacacccugcccgugggcuucauccccauccaggagaccguggacacccaggagguggccuucagaaagaagagacugugcaucaaguucauccccagagacagcaccgaggccgccaucugcgacaucagaaucaugggcagaaccaagcaggcccccccccaguacaccuucaucggcgagcugaacagcaugggcaucugguacagaaugggcagagugcccagaaaccacgacagcagccagcccaccacccccagccagagcagcgccgccagcacccccgcccccaaccugcccagauaa

SEQ ID NO: 20179 - RNA, 1203 nt, Artificial Sequence
  MVD__Homo_sapiens__NP_002452
auggccagcgagaagccccuggccgccgugaccugcaccgcccccgugaacaucgccgugaucaaguacuggggcaagagagacgaggagcuggugcugcccaucaacagcagccugagcgugacccugcaccaggaccagcugaagaccaccaccaccgccgugaucagcaaggacuucaccgaggacagaaucuggcugaacggcagagaggaggacgugggccagcccagacugcaggccugccugagagagaucagaugccuggccagaaagagaagaaacagcagagacggcgacccccugcccagcagccugagcugcaaggugcacguggccagcgugaacaacuuccccaccgccgccggccuggccagcagcgccgccggcuacgccugccuggccuacacccuggccagaguguacggcguggagagcgaccugagcgagguggccagaagaggcagcggcagcgccugcagaagccuguacggcggcuucguggaguggcagaugggcgagcaggccgacggcaaggacagcaucgccagacagguggcccccgagagccacuggcccgagcugagagugcugauccugguggugagcgccgagaagaagcugaccggcagcaccgugggcaugagagccagcguggagaccagcccccugcugagauucagagccgagagcguggugcccgccagaauggccgagauggccagaugcaucagagagagagacuuccccagcuucgcccagcugaccaugaaggacagcaaccaguuccacgccaccugccuggacaccuucccccccaucagcuaccugaacgccaucagcuggagaaucauccaccuggugcacagauucaacgcccaccacggcgacaccaagguggccuacaccuucgacgccggccccaacgccgugaucuucacccuggacgacaccguggccgaguucguggccgccguguggcacggcuucccccccggcagcaacggcgacaccuuccugaagggccugcaggugagacccgccccccugagcgccgagcugcaggccgcccuggccauggagcccacccccggcggcgugaaguacaucaucgugacccaggugggccccggcccccagauccuggacgaccccugcgcccaccugcugggccccgacggccugcccaagcccgccgccuaa

SEQ ID NO: 20180 - RNA, 1035 nt, Artificial Sequence
  MVK__Homo_sapiens__NP_001288111
augcugagcgaggugcugcuggugagcgcccccggcaaggugauccugcacggcgagcacgccguggugcacggcaagguggcccuggccgugagccugaaccugagaaccuuccugagacugcagccccacagcaacggcaagguggaccugagccugcccaacaucggcaucaagagagccugggacguggccagacugcagagccuggacaccagcuuccuggagcagggcgacgugaccacccccaccagcgagcagguggagaagcugaaggagguggccggccugcccgacgacugcgccgugaccgagagacuggccgugcuggccuuccuguaccuguaccugagcaucugcagaaagcagagauggaccaaggaggaccuggagcugaucaacaagugggccuuccagggcgagagaaugauccacggcaaccccagcggcguggacaacgccgugagcaccuggggcggcgcccugagauaccaccagggcaagaucagcagccugaagagaagccccgcccugcagauccugcugaccaacaccaaggugcccagaaacaccagagcccugguggccggcgugagaaacagacugcugaaguuccccgagaucguggccccccugcugaccagcaucgacgccaucagccuggagugcgagagagugcugggcgagaugggcgaggcccccgcccccgagcaguaccuggugcuggaggagcugaucgacaugaaccagcaccaccugaacgcccugggcgugggccacgccagccuggaccagcugugccaggugaccagagccagaggccugcacagcaagcugaccggcgccggcggcggcggcugcggcaucacccugcugaagcccggccuggagcagcccgagguggaggccaccaagcaggcccugaccagcugcggcuucgacugccuggagaccagcaucggcgcccccggcgugagcauccacagcgccaccagccuggacagcagagugcagcaggcccuggacggccuguaa

SEQ ID NO: 20181 - RNA, 2502 nt, Artificial Sequence
  MVP__Homo_sapiens__NP_001280133
auggccaccgaggaguucaucaucagaaucccccccuaccacuacauccacgugcuggaccagaacagcaacgugagcagaguggaggugggccccaagaccuacaucagacaggacaacgagagagugcuguucgcccccaugagaauggugaccgugccccccagacacuacugcaccguggccaaccccgugagcagagacgcccagggccuggugcuguucgacgugaccggccaggugagacugagacacgccgaccuggagaucagacuggcccaggaccccuucccccuguaccccggcgaggugcuggagaaggacaucaccccccugcagguggugcugcccaacaccgcccugcaccugaaggcccugcuggacuucgaggacaaggacggcgacaaggugguggccggcgacgaguggcuguucgagggccccggcaccuacauccccagaaaggagguggaggugguggagaucauccaggccaccaucaucagacagaaccaggcccugagacugagagccagaaaggagugcugggacagagacggcaaggagagagugaccggcgaggaguggcuggugaccaccgugggcgccuaccugcccgccguguucgaggaggugcuggaccugguggacgccgugauccugaccgagaagaccgcccugcaccugagagccagaagaaacuucagagacuucagaggcgugagcagaagaaccggcgaggaguggcuggugaccgugcaggacaccgaggcccacgugcccgacgugcacgaggaggugcugggcguggugcccaucaccacccugggcccccacaacuacugcgugauccuggaccccgugggccccgacggcaagaaccagcugggccagaagagaguggugaagggcgagaagagcuucuuccugcagcccggcgagcagcuggagcagggcauccaggacguguacgugcugagcgagcagcagggccugcugcugagagcccugcagccccuggaggagggcgaggacgaggagaaggugagccaccaggccggcgaccacuggcugaucagaggcccccuggaguacgugcccagcgccaagguggaggugguggaggagagacaggccaucccccuggacgagaacgagggcaucuacgugcaggacgugaagaccggcaaggugagagccgugaucggcagcaccuacaugcugacccaggacgaggugcugugggagaaggagcugccccccggcguggaggagcugcugaacaagggccaggacccccuggccgacagaggcgagaaggacaccgccaagagccugcagccccuggcccccagaaacaagaccagaguggugagcuacagagugccccacaacgccgccgugcagguguacgacuacagagagaagagagccagagugguguucggccccgagcuggugagccugggccccgaggagcaguucaccgugcugagccugagcgccggcagacccaagagaccccacgccagaagagcccugugccugcugcugggccccgacuucuucaccgacgugaucaccaucgagaccgccgaccacgccagacugcagcugcagcuggccuacaacuggcacuucgaggugaacgacagaaaggacccccaggagaccgccaagcuguucagcgugcccgacuucgugggcgacgccugcaaggccaucgccagcagagugagaggcgccguggccagcgugaccuucgacgacuuccacaagaacagcgccagaaucaucagaaccgccguguucggcuucgagaccagcgaggccaagggccccgacggcauggcccugcccagacccagagaccaggccguguucccccagaacggccugguggugagcagcguggacgugcagagcguggagcccguggaccagagaaccagagacgcccugcagagaagcgugcagcuggccaucgagaucaccaccaacagccaggaggccgccgccaagcacgaggcccagagacuggagcaggaggccagaggcagacuggagagacagaagauccuggaccagagcgaggccgagaaggccagaaaggagcugcuggagcuggaggcccugagcauggccguggagagcaccggcaccgccaaggccgaggccgagagcagagccgaggccgccagaaucgagggcgagggcagcgugcugcaggccaacaccaucagagaccuggccguggccggccccgagaugcaggugaagcugcugcagagccugggccugaagagcacccugaucaccgacggcagcacccccaucaaccuguucaacaccgccuucggccugcugggcaugggccccgagggccagccccugggcagaagaguggccagcggccccagccccggcgagggcaucagcccccagagcgcccaggccccccaggcccccggcgacaaccacguggugcccgugcugagauaa

SEQ ID NO: 20182 - RNA, 1989 nt, Artificial Sequence
  MX1__Homo_sapiens__XP_005261039
augguggugagcgagguggacaucgccaaggccgaccccgccgccgccagccacccccugcugcugaacggcgacgccaccguggcccagaagaaccccggcagcguggccgagaacaaccugugcagccaguacgaggagaaggugagacccugcaucgaccugaucgacagccugagagcccugggcguggagcaggaccuggcccugcccgccaucgccgugaucggcgaccagagcagcggcaagagcagcgugcuggaggcccugagcggcguggcccugcccagaggcagcggcaucgugaccagaugcccccuggugcugaagcugaagaagcuggugaacgaggacaaguggagaggcaaggugagcuaccaggacuacgagaucgagaucagcgacgccagcgagguggagaaggagaucaacaaggcccagaacgccaucgccggcgagggcaugggcaucagccacgagcugaucacccuggagaucagcagcagagacgugcccgaccugacccugaucgaccugcccggcaucaccagaguggccgugggcaaccagcccgccgacaucggcuacaagaucaagacccugaucaagaaguacauccagagacaggagaccaucagccuggugguggugcccagcaacguggacaucgccaccaccgaggcccugagcauggcccaggagguggaccccgagggcgacagaaccaucggcauccugaccaagcccgaccugguggacaagggcaccgaggacaaggugguggacguggugagaaaccugguguuccaccugaagaagggcuacaugaucgugaagugcagaggccagcaggagauccaggaccagcugagccugagcgaggcccugcagagagagaagaucuucuucgagaaccaccccuacuucagagaccugcuggaggagggcaaggccaccgugcccugccuggccgagaagcugaccagcgagcugaucacccacaucugcaagagccugccccugcuggagaaccagaucaaggagacccaccagagaaucaccgaggagcugcagaaguacggcguggacauccccgaggacgagaacgagaagauguucuuccugaucgacaaggugaacgccuucaaccaggacaucaccgcccugaugcagggcgaggagaccgugggcgaggaggacaucagacuguucaccagacugagacacgaguuccacaaguggagcaccaucaucgagaacaacuuccaggagggccacaagauccugagcagaaagauccagaaguucgagaaccaguacagaggcagagagcugcccggcuucgugaacuacagaaccuucgagaccaucgugaagcagcagaucaaggcccuggaggagcccgccguggacaugcugcacaccgugaccgacauggugagacuggccuucaccgacgugagcaucaagaacuucgaggaguucuucaaccugcacagaaccgccaagagcaagaucgaggacaucagagccgagcaggagagagagggcgagaagcugaucagacugcacuuccagauggagcagaucguguacugccaggaccagguguacagaggcgcccugcagaaggugagagagaaggagcuggaggaggagaagaagaagaagagcugggacuucggcgccuuccagagcagcagcgccaccgacagcagcauggaggagaucuuccagcaccugauggccuaccaccaggaggccagcaagagaaucagcagccacaucccccugaucauccaguucuucaugcugcagaccuacggccagcagcugcagaaggccaugcugcagcugcugcaggacaaggacaccuacagcuggcugcugaaggagagaagcgacaccagcgacaagagaaaguuccugaaggagagacuggccagacugacccaggccagaagaagacuggcccaguuccccggcuaa

SEQ ID NO: 20183 - RNA, 2148 nt, Artificial Sequence
  MX2__Homo_sapiens__XP_011527874
augagcaaggcccacaagcccuggcccuacagaagaagaagccaguucagcagcagaaaguaccugaagaaggagaugaacagcuuccagcagcagcccccccccuucggcaccgugcccccccagaugauguucccccccaacuggcagggcgccgagaaggacgccgccuuccuggccaaggacuucaacuuccugacccugaacaaccagcccccccccggcaacagaagccagcccagagccaugggccccgagaacaaccuguacagccaguacgagcagaaggugagacccugcaucgaccugaucgacagccugagagcccugggcguggagcaggaccuggcccugcccgccaucgccgugaucggcgaccagagcagcggcaagagcagcgugcuggaggcccugagcggcguggcccugcccagaggcagcggcaucgugaccagaugcccccuggugcugaagcugaagaagcagcccugcgaggccugggccggcagaaucagcuacagaaacaccgagcuggagcugcaggaccccggccagguggagaaggagauccacaaggcccagaacgugauggccggcaacggcagaggcaucagccacgagcugaucagccuggagaucaccagccccgaggugcccgaccugaccaucaucgaccugcccggcaucaccagaguggccguggacaaccagcccagagacaucggccugcagaucaaggcccugaucaagaaguacauccagagacagcagaccaucaaccuggugguggugcccugcaacguggacaucgccaccaccgaggcccugagcauggcccacgagguggaccccgagggcgacagaaccaucggcauccugaccaagcccgaccugauggacagaggcaccgagaagagcgugaugaacguggugagaaaccugaccuacccccugaagaagggcuacaugaucgugaagugcagaggccagcaggagaucaccaacagacugagccuggccgaggccaccaagaaggagaucaccuucuuccagacccaccccuacuucagagugcugcuggaggagggcagcgccaccgugcccagacuggccgagagacugaccaccgagcugaucaugcacauccagaagagccugccccugcuggagggccagaucagagagagccaccagaaggccaccgaggagcugagaagaugcggcgccgacauccccagccaggaggccgacaagauguucuuccugaucgagaagaucaagauguucaaccaggacaucgagaagcugguggagggcgaggagguggugagagagaacgagaccagacuguacaacaagaucagagaggacuucaagaacugggugggcauccuggccaccaacacccagaaggugaagaacaucauccacgaggagguggagaaguacgagaagcaguacagaggcaaggagcugcugggcuucgugaacuacaagaccuucgagaucaucgugcaccaguacauccagcagcugguggagcccgcccugagcaugcugcagaaggccauggagaucauccagcaggccuucaucaacguggccaagaagcacuucggcgaguucuucaaccugaaccagaccgugcagagcaccaucgaggacaucaaggugaagcacaccgccaaggccgagaacaugauccagcugcaguucagaauggagcagaugguguucugccaggaccagaucuacagcguggugcugaagaaggugagagaggagaucuucaacccccugggcacccccagccagaacaugaagcugaacagccacuuccccagcaacgagagcagcgugagcagcuucaccgagaucggcauccaccugaacgccuacuuccuggagaccagcaagagacuggccaaccagauccccuucaucauccaguacuucaugcugagagagaacggcgacagccugcagaaggccaugaugcagauccugcaggagaagaacagauacagcuggcugcugcaggagcagagcgagaccgccaccaagagaagaauccugaaggagagaaucuacagacugacccaggccagacacgcccugugccaguucagcagcaaggagauccacuaa

SEQ ID NO: 20184 - RNA, 636 nt, Artificial Sequence
  MXD1__Homo_sapiens__NP_001189443
auggccgccgccgugagaaugaacauccagaugcugcuggaggccgccgacuaccuggagagaagagagagagaggccgagcacggcuacgccagcaugcugcccuacaacaacaaggacagagacgcccugaagagaagaaacaagagcaagaagaacaacagcagcagcagaagagcccaccugagacugugccuggagaagcugaagggccuggugccccugggccccgagagcagcagacacaccacccugagccugcugaccaaggccaagcugcacaucaagaagcuggaggacugcgacagaaaggccgugcaccagaucgaccagcugcagagagagcagagacaccugaagagacagcuggagaagcugggcaucgagagaaucagaauggacagcaucggcagcaccgugagcagcgagagaagcgacagcgacagagaggagaucgacguggacguggagagcaccgacuaccugaccggcgaccuggacuggagcagcagcagcgugagcgacagcgacgagagaggcagcaugcagagccugggcagcgacgagggcuacagcagcaccagcaucaagagaaucaagcugcaggacagccacaaggccugccugggccuguaa

SEQ ID NO: 20185 - RNA, 582 nt, Artificial Sequence
  MXD3__Homo_sapiens__NP_001136407
auggagccccuggccagcaacauccaggugcugcugcaggccgccgaguuccuggagagaagagagagagaggccgagcacggcuacgccagccugugcccccacagaagccccggccccauccacagaagaaagaagagacccccccaggcccccggcgcccaggacagcggcagaagcgugcacaacgagcuggagaagagaagaagagcccagcugaagagaugccuggagagacugaagcagcagaugccccugggcgccgacugcgccagauacaccacccugagccugcugagaagagccagaaugcacauccagaagcuggaggaccaggagcagagagccagacagcugaaggagagacugagaagcaagcagcagagccugcagagacagcuggagcagcugagaggccuggccggcgccgccgagagagagagacugagagccgacagccuggacagcagcggccugagcagcgagagaagcgacagcgaccaggugcugcccaacgagaacggcggcacccccaaccacagacccaccggcagaggcaacaacaucagcagccaccacuaa

SEQ ID NO: 20186 - RNA, 630 nt, Artificial Sequence
  MXD4__Homo_sapiens__NP_006445
auggagcugaacagccugcugauccugcuggaggccgccgaguaccuggagagaagagacagagaggccgagcacggcuacgccagcgugcugcccuucgacggcgacuucgccagagagaagaccaaggccgccggccuggugagaaaggcccccaacaacagaagcagccacaacgagcuggagaagcacagaagagccaagcugagacuguaccuggagcagcugaagcagcuggugccccugggccccgacagcaccagacacaccacccugagccugcugaagagagccaaggugcacaucaagaagcuggaggagcaggacagaagagcccugagcaucaaggagcagcugcagcaggagcacagauuccugaagagaagacuggagcagcugagcgugcagagcguggagagagugagaaccgacagcaccggcagcgccgugagcaccgacgacagcgagcaggagguggacaucgagggcauggaguucggccccggcgagcuggacagcgugggcagcagcagcgacgccgacgaccacuacagccugcagagcggcaccggcggcgacagcggcuucggcccccacugcagaagacugggcagacccgcccugagcuaa

SEQ ID NO: 20187 - RNA, 549 nt, Artificial Sequence
  MXI1__Homo_sapiens__NP_001008541
augcccagccccagacugcagcacagcaagccccccagaagacugagcagagcccagaagcacagcagcggcagcagcaacaccagcaccgccaacagaagagcccaccugagacugugccuggagagacugaaggugcugaucccccugggccccgacugcaccagacacaccacccugggccugcugaacaaggccaaggcccacaucaagaagcuggaggaggccgagagaaagagccagcaccagcuggagaaccuggagagagagcagagauuccugaaguggagacuggagcagcugcagggcccccaggagauggagagaaucagaauggacagcaucggcagcaccaucagcagcgacagaagcgacagcgagagagaggagaucgagguggacguggagagcaccgaguucagccacggcgagguggacaacaucagcaccaccagcaucagcgacaucgacgaccacagcagccugcccagcaucggcagcgacgagggcuacagcagcgccagcgugaagcugagcuucaccagcuaa

SEQ ID NO: 20188 - RNA, 8487 nt, Artificial Sequence
  MXRA5__Homo_sapiens__NP_056234
augcccaagagagcccacuggggcgcccugagcguggugcugauccugcuguggggccaccccagaguggcccuggccugcccccaccccugcgccugcuacgugcccagcgaggugcacugcaccuucagaagccuggccagcgugcccgccggcaucgccaagcacguggagagaaucaaccugggcuucaacagcauccaggcccugagcgagaccagcuucgccggccugaccaagcuggagcugcugaugauccacggcaacgagauccccagcauccccgacggcgcccugagagaccugagcagccugcagguguucaaguucagcuacaacaagcugagagugaucaccggccagacccugcagggccugagcaaccugaugagacugcacaucgaccacaacaagaucgaguucauccacccccaggccuucaacggccugaccagccugagacugcugcaccuggagggcaaccugcugcaccagcugcaccccagcaccuucagcaccuucaccuuccuggacuacuucagacugagcaccaucagacaccuguaccuggccgagaacauggugagaacccugcccgccagcaugcugagaaacaugccccugcuggagaaccuguaccugcagggcaaccccuggaccugcgacugcgagaugagaugguuccuggagugggacgccaagagcagaggcauccugaagugcaagaaggacaaggccuacgagggcggccagcugugcgccaugugcuucagccccaagaagcuguacaagcacgagauccacaagcugaaggacaugaccugccugaagcccagcaucgagagcccccugagacagaacagaagcagaagcaucgaggaggagcaggagcaggaggaggacggcggcagccagcugauccuggagaaguuccagcugccccaguggagcaucagccugaacaugaccgacgagcacggcaacauggugaaccuggugugcgacaucaagaagcccauggacguguacaagauccaccugaaccagaccgacccccccgacaucgacaucaacgccaccguggcccuggacuucgagugccccaugaccagagagaacuacgagaagcuguggaagcugaucgccuacuacagcgaggugcccgugaagcugcacagagagcugaugcugagcaaggaccccagagugagcuaccaguacagacaggacgccgacgaggaggcccuguacuacaccggcgugagagcccagauccuggccgagcccgagugggugaugcagcccagcaucgacauccagcugaacagaagacagagcaccgccaagaaggugcugcugagcuacuacacccaguacagccagaccaucagcaccaaggacaccagacaggccagaggcagaagcugggugaugaucgagcccagcggcgccgugcagagagaccagaccgugcuggagggcggccccugccagcugagcugcaacgugaaggccagcgagagccccagcaucuucugggugcugcccgacggcagcauccugaaggcccccauggacgaccccgacagcaaguucagcauccugagcagcggcuggcugagaaucaagagcauggagcccagcgacagcggccuguaccagugcaucgcccaggugagagacgagauggacagaaugguguacagagugcuggugcagagccccagcacccagcccgccgagaaggacaccgugaccaucggcaagaaccccggcgagagcgugacccugcccugcaacgcccuggccauccccgaggcccaccugagcuggauccugcccaacagaagaaucaucaacgaccuggccaacaccagccacguguacaugcugcccaacggcacccugagcauccccaaggugcaggugagcgacagcggcuacuacagaugcguggccgugaaccagcagggcgccgaccacuucaccgugggcaucaccgugaccaagaagggcagcggccugcccagcaagagaggcagaagacccggcgccaaggcccugagcagagugagagaggacaucguggaggacgagggcggcagcggcaugggcgacgaggagaacaccagcagaagacugcugcaccccaaggaccaggagguguuccugaagaccaaggacgacgccaucaacggcgacaagaaggccaagaagggcagaagaaagcugaagcuguggaagcacagcgagaaggagcccgagaccaacguggccgagggcagaagaguguucgagagcagaagaagaaucaacauggccaacaagcagaucaaccccgagagaugggccgacauccuggccaaggugagaggcaagaaccugcccaagggcaccgaggugcccccccugaucaagaccaccagcccccccagccugagccuggaggugaccccccccuuccccgccaucagcccccccagcgccagccccgugcagaccgugaccagcgccgaggagagcagcgccgacgugccccugcugggcgaggaggagcacgugcugggcaccaucagcagcgccagcaugggccuggagcacaaccacaacggcgugauccugguggagcccgaggugaccagcaccccccuggaggaggugguggacgaccugagcgagaagaccgaggagaucaccagcaccgagggcgaccugaagggcaccgccgcccccacccugaucagcgagcccuacgagcccagccccacccugcacacccuggacaccguguacgagaagcccacccacgaggagaccgccaccgagggcuggagcgccgccgacgugggcagcagccccgagcccaccagcagcgaguacgagcccccccuggacgccgugagccuggccgagagcgagcccaugcaguacuucgaccccgaccuggagaccaagagccagcccgacgaggacaagaugaaggaggacaccuucgcccaccugacccccacccccaccaucugggugaacgacagcagcaccagccagcuguucgaggacagcaccaucggcgagcccggcgugcccggccagagccaccugcagggccugaccgacaacauccaccuggugaagagcagccugagcacccaggacacccugcugaucaagaagggcaugaaggagaugagccagacccugcagggcggcaacaugcuggagggcgaccccacccacagcagaagcagcgagagcgagggccaggagagcaagagcaucacccugcccgacagcacccugggcaucaugagcagcaugagccccgugaagaagcccgccgagaccaccgugggcacccugcuggacaaggacaccaccaccgccaccaccacccccagacagaagguggcccccagcagcaccaugagcacccaccccagcagaagaagacccaacggcagaagaagacugagacccaacaaguucagacacagacacaagcagaccccccccaccaccuucgcccccagcgagaccuucagcacccagcccacccaggcccccgacaucaagaucagcagccagguggagagcagccuggugcccaccgccuggguggacaacaccgugaacacccccaagcagcuggagauggagaagaacgccgagcccaccagcaagggcacccccagaagaaagcacggcaagagacccaacaagcacagauacacccccagcaccgugagcagcagagccagcggcagcaagcccagccccagccccgagaacaagcacagaaacaucgugacccccagcagcgagaccauccugcugcccagaaccgugagccugaagaccgagggccccuacgacagccuggacuacaugaccaccaccagaaagaucuacagcagcuaccccaaggugcaggagacccugcccgugaccuacaagcccaccagcgacggcaaggagaucaaggacgacguggccaccaacguggacaagcacaagagcgacauccuggugaccggcgagagcaucaccaacgccauccccaccagcagaagccuggugagcaccaugggcgaguucaaggaggagagcagccccgugggcuuccccggcacccccaccuggaaccccagcagaaccgcccagcccggcagacugcagaccggcauccccgugaccaccagcggcgagaaccugaccgaccccccccugcugaaggagcuggaggacguggacuucaccagcgaguuccugagcagccugaccgugagcacccccuuccaccaggaggaggccggcagcagcaccacccugagcagcaucaagguggagguggccagcagccaggccgagaccaccacccuggaccaggaccaccuggagaccaccguggccauccugcugagcgagaccagaccccagaaccacacccccaccgccgccagaaugaaggagcccgccagcagcagccccagcaccauccugaugagccugggccagaccaccaccaccaagcccgcccugcccagccccagaaucagccaggccagcagagacagcaaggagaacguguuccugaacuacgugggcaaccccgagaccgaggccacccccgugaacaacgagggcacccagcacaugagcggccccaacgagcugagcacccccagcagcgaccaggacgccuucaaccugagcaccaagcuggagcuggagaagcagguguucggcagcagaagccugcccagaggccccgacagccagagacaggacggcagagugcacgccagccaccagcugaccagagugcccgccaagcccauccugcccaccgccaccgugagacugcccgagaugagcacccagagcgccagcagauacuucgugaccagccagagccccagacacuggaccaacaagcccgagaucaccaccuaccccagcggcgcccugcccgagaacaagcaguucaccacccccagacugagcagcaccaccaucccccugccccugcacaugagcaagcccagcauccccagcaaguucaccgacagaagaaccgaccaguucaacggcuacagcaagguguucggcaacaacaacauccccgaggccagaaaccccgugggcaagccccccagccccagaaucccccacuacagcaacggcagacugcccuucuucaccaacaagacccugagcuucccccagcugggcgugaccagaagaccccagauccccaccagccccgcccccgugaugagagagagaaaggugauccccggcagcuacaacagaauccacagccacagcaccuuccaccuggacuucggcccccccgcccccccccugcugcacaccccccagaccaccggcagccccagcaccaaccugcagaacauccccauggugagcagcacccagagcagcaucagcuucaucaccagcagcgugcagagcagcggcagcuuccaccagagcagcagcaaguucuucgccggcggcccccccgccagcaaguucuggagccugggcgagaagccccagauccugaccaagagcccccagaccgugagcgugaccgccgagaccgacaccguguuccccugcgaggccaccggcaagcccaagcccuucgugaccuggaccaaggugagcaccggcgcccugaugacccccaacaccagaauccagagauucgaggugcugaagaacggcacccuggugaucagaaaggugcaggugcaggacagaggccaguacaugugcaccgccagcaaccugcacggccuggacagaaugguggugcugcugagcgugaccgugcagcagccccagauccuggccagccacuaccaggacgugaccguguaccugggcgacaccaucgccauggagugccuggccaagggcacccccgccccccagaucagcuggaucuuccccgacagaagaguguggcagaccgugagccccguggagggcagaaucacccugcacgagaacagaacccugagcaucaaggaggccagcuucagcgacagaggcguguacaagugcguggccagcaacgccgccggcgccgacagccuggccaucagacugcacguggccgcccugccccccgugauccaccaggagaagcuggagaacaucagccugccccccggccugagcauccacauccacugcaccgccaaggccgccccccugcccagcgugagaugggugcugggcgacggcacccagaucagacccagccaguuccugcacggcaaccuguucguguuccccaacggcacccuguacaucagaaaccuggcccccaaggacagcggcagauacgagugcguggccgccaaccuggugggcagcgccagaagaaccgugcagcugaacgugcagagagccgccgccaacgccagaaucaccggcaccagccccagaagaaccgacgugagauacggcggcacccugaagcuggacugcagcgccagcggcgaccccuggcccagaauccuguggagacugcccagcaagagaaugaucgacgcccuguucagcuucgacagcagaaucaagguguucgccaacggcacccugguggugaagagcgugaccgacaaggacgccggcgacuaccugugcguggccagaaacaaggugggcgacgacuacguggugcugaagguggacguggugaugaagcccgccaagaucgagcacaaggaggagaacgaccacaagguguucuacggcggcgaccugaagguggacugcguggccaccggccugcccaaccccgagaucagcuggagccugcccgacggcagccuggugaacagcuucaugcagagcgacgacagcggcggcagaaccaagagauacgugguguucaacaacggcacccuguacuucaacgaggugggcaugagagaggagggcgacuacaccugcuucgccgagaaccaggugggcaaggacgagaugagagugagagugaagguggugaccgcccccgccaccaucagaaacaagaccuaccuggccgugcaggugcccuacggcgacguggugaccguggccugcgaggccaagggcgagcccaugcccaaggugaccuggcugagccccaccaacaaggugauccccaccagcagcgagaaguaccagaucuaccaggacggcacccugcugauccagaaggcccagagaagcgacagcggcaacuacaccugccuggugagaaacagcgccggcgaggacagaaagaccguguggauccacgugaacgugcagccccccaagaucaacggcaaccccaaccccaucaccaccgugagagagaucgccgccggcggcagcagaaagcugaucgacugcaaggccgagggcauccccacccccagagugcugugggccuuccccgagggcguggugcugcccgcccccuacuacggcaacagaaucaccgugcacggcaacggcagccuggacaucagaagccugagaaagagcgacagcgugcagcuggugugcauggccagaaacgagggcggcgaggccagacugauccugcagcugaccgugcuggagcccauggagaagcccaucuuccacgaccccaucagcgagaagaucaccgccauggccggccacaccaucagccugaacugcagcgccgccggcacccccacccccagccuggugugggugcugcccaacggcaccgaccugcagagcggccagcagcugcagagauucuaccacaaggccgacggcaugcugcacaucagcggccugagcagcguggacgccggcgccuacagaugcguggccagaaacgccgccggccacaccgagagacuggugagccugaaggugggccugaagcccgaggccaacaagcaguaccacaaccuggugagcaucaucaacggcgagacccugaagcugcccugcaccccccccggcgccggccagggcagauucagcuggacccugcccaacggcaugcaccuggagggcccccagacccugggcagagugagccugcuggacaacggcacccugaccgugagagaggccagcguguucgacagaggcaccuacgugugcagaauggagaccgaguacggccccagcgugaccagcauccccgugaucgugaucgccuacccccccagaaucaccagcgagcccacccccgugaucuacaccagacccggcaacaccgugaagcugaacugcauggccaugggcauccccaaggccgacaucaccugggagcugcccgacaagagccaccugaaggccggcgugcaggccagacuguacggcaacagauuccugcacccccagggcagccugaccauccagcacgccacccagagagacgccggcuucuacaagugcauggccaagaacauccugggcagcgacagcaagaccaccuacauccacguguucuaa

SEQ ID NO: 20189 - RNA, 969 nt, Artificial Sequence
  MYADM__Homo_sapiens__NP_001277119
augcccgugaccgugaccagaaccaccaucaccaccaccaccaccagcagcagcggccugggcagccccaugaucgugggcagccccagagcccugacccagccccugggccugcugagacugcugcagcuggugagcaccugcguggccuucagccugguggccagcgugggcgccuggaccggcagcaugggcaacuggagcauguucaccuggugcuucugcuucagcgugacccugaucauccugaucguggagcugugcggccugcaggccagauucccccugagcuggagaaacuuccccaucaccuucgccugcuacgccgcccuguucugccugagcgccagcaucaucuaccccaccaccuacgugcaguuccugagccacggcagaagcagagaccacgccaucgccgccaccuucuucagcugcaucgccugcguggccuacgccaccgagguggccuggaccagagccagacccggcgagaucaccggcuacauggccaccgugcccggccugcugaaggugcuggagaccuucguggccugcaucaucuucgccuucaucagcgaccccaaccuguaccagcaccagcccgcccuggaguggugcguggccguguacgccaucugcuucauccuggccgccaucgccauccugcugaaccugggcgagugcaccaacgugcugcccauccccuuccccagcuuccugagcggccuggcccugcugagcgugcugcuguacgccaccgcccuggugcuguggccccuguaccaguucgacgagaaguacggcggccagcccagaagaagcagagacgugagcugcagcagaagccacgccuacuacgugugcgccugggacagaagacuggccguggccauccugaccgccaucaaccugcuggccuacguggccgaccuggugcacagcgcccaccugguguucgugaagguguaa

SEQ ID NO: 20190 - RNA, 3999 nt, Artificial Sequence
  MYBBP1A__Homo_sapiens__NP_001099008
auggagagcagagaccccgcccagcccaugagccccggcgaggccacccagagcggcgccagacccgccgacagauacggccugcugaagcacagcagagaguuccuggacuucuucugggacaucgccaagcccgagcaggagaccagacuggccgccaccgagaagcugcuggaguaccugagaggcagacccaagggcagcgagaugaaguacgcccugaagagacugaucaccggccugggcgugggcagagagaccgccagacccugcuacagccuggcccuggcccagcugcugcagagcuucgaggaccugccccugugcagcauccugcagcagauccaggagaaguacgaccugcaccaggugaagaaggccaugcugagacccgcccuguucgccaaccuguucggcgugcuggcccuguuccagagcggcagacuggugaaggaccaggaggcccugaugaagagcgugaagcugcugcaggcccuggcccaguaccagaaccaccugcaggagcagcccagaaaggcccugguggacauccugagcgaggugagcaaggccacccugcaggagauccugcccgaggugcugaaggccgaccugaacaucauccugagcagccccgagcagcuggagcuguuccugcuggcccagcagaaggugcccagcaagcugaagaagcuggugggcagcgugaaccuguucagcgacgagaacgugcccagacuggugaacgugcugaagauggccgccagcagcgugaagaaggacagaaagcugcccgccaucgcccuggaccugcugagacuggcccugaaggaggacaaguuccccagauucuggaaggaggugguggagcagggccugcugaagaugcaguucuggcccgccagcuaccugugcuucagacugcugggcgccgcccugccccugcugaccaaggagcagcugcaccuggugaugcagggcgacgugaucagacacuacggcgagcacgugugcaccgccaagcugcccaagcaguucaaguucgcccccgagauggacgacuacgugggcaccuuccuggagggcugccaggacgaccccgagagacagcuggccgugcugguggccuucagcagcgugaccaaccagggccugcccgugacccccaccuucuggagaguggugagauuccugagcccccccgcccugcagggcuacguggccuggcugagagccauguuccugcagcccgaccuggacagccugguggacuucagcaccaacaaccagaagaaggcccaggacagcagccugcacaugcccgagagagccguguucagacugagaaaguggaucaucuucagacuggugagcaucguggacagccugcaccuggagauggaggaggcccugaccgagcagguggccagauucugccuguuccacagcuucuucgugaccaagaagcccaccagccagauccccgagaccaagcaccccuucagcuucccccuggagaaccaggccagagaggccgugagcagcgccuucuucagccugcugcagacccugagcacccaguucaagcaggcccccggccagacccagggcggccagcccuggaccuaccaccuggugcaguucgccgaccugcugcugaaccacagccacaacgugaccaccgugacccccuucaccgcccagcagagacaggccugggacagaaugcugcagacccugaaggagcuggaggcccacagcgccgaggccagagccgccgccuuccagcaccugcugcugcuggugggcauccaccugcugaagagccccgccgagagcugcgaccugcugggcgacauccagaccugcaucagaaagagccugggcgagaagcccagaagaagcagaaccaagaccaucgacccccaggagccccccuggguggaggugcugguggagauccugcuggcccugcuggcccagcccagccaccugaugagacagguggccagaagcguguucggccacaucugcagccaccugacccccagagcccugcagcugauccuggacgugcugaaccccgagaccagcgaggacgagaacgacagagugguggugaccgacgacagcgacgagagaagacugaagggcgccgaggacaagagcgaggagggcgaggacaacagaagcagcgagagcgaggaggagagcgagggcgaggagagcgaggaggaggagagagacggcgacguggaccagggcuucagagagcagcugaugaccgugcugcaggccggcaaggcccugggcggcgaggacagcgagaacgaggaggagcugggcgacgaggccaugauggcccuggaccagagccuggccagccuguucgccgagcagaagcugagaauccaggccagaagagacgagaagaacaagcugcagaaggagaaggcccugagaagagacuuccagaucagagugcuggaccugguggaggugcuggugaccaagcagcccgagaacgcccuggugcuggagcugcuggagccccugcugagcaucaucagaagaagccugagaagcagcagcagcaagcaggagcaggaccugcugcacaagaccgccagaaucuucacccaccaccugugcagagccagaagauacugccacgaccugggcgagagagccggcgcccugcacgcccagguggagagacuggugcagcaggccggcagacagcccgacagccccaccgcccuguaccacuucaacgccagccuguaccugcugagagugcugaagggcaacaccgccgagggcugcgugcacgagacccaggagaagcagaaggccggcaccgaccccagccacaugcccaccggcccccaggccgccagcugccuggaccugaaccuggugaccagaguguacagcaccgcccugagcagcuuccugaccaagagaaacagcccccugaccgugcccauguuccugagccuguucagcagacaccccgugcugugccagagccugcugcccauccuggugcagcacaucaccggccccgugagacccagacaccaggccugccugcugcugcagaagacccugagcaugagagaggugagaagcugcuucgaggaccccgaguggaagcagcugaugggccaggugcuggccaaggugaccgagaaccugagagugcugggcgaggcccagaccaaggcccagcaccagcaggcccugagcagccuggagcugcugaacgugcuguucagaaccugcaagcacgagaagcugacccuggaccugaccgugcugcugggcgugcugcagggccagcagcagagccugcagcagggcgcccacagcaccggcagcagcagacugcacgaccuguacuggcaggccaugaagacccugggcgugcagagacccaagcuggagaagaaggacgccaaggagauccccagcgccacccagagccccaucagcaagaagagaaagaagaagggcuuccugcccgagaccaagaagagaaagaagagaaagagcgaggacggcacccccgccgaggacggcacccccgccgccaccggcggcagccagccccccagcaugggcagaaagaagagaaacagaaccaaggccaaggugcccgcccaggccaacggcacccccaccaccaagagccccgcccccggcgcccccaccagaagccccagcacccccgccaagagccccaagcugcagaagaagaaccagaagcccagccaggugaacggcgcccccggcagccccaccgagcccgccggccagaagcagcaccagaaggcccugcccaagaagggcgugcugggcaagagcccccugagcgcccuggccagaaagaaggccagacugagccuggugaucagaagccccagccugcugcagagcggcgccaagaagaaggcccagacccugagauucaccaucagcagcagcaagaaguaa

SEQ ID NO: 20191 - RNA, 1914 nt, Artificial Sequence
  MYB__Homo_sapiens__NP_001123644
auggccagaagacccagacacagcaucuacagcagcgacgaggacgacgaggacuucgagaugugcgaccacgacuacgacggccugcugcccaagagcggcaagagacaccugggcaagaccagauggaccagagaggaggacgagaagcugaagaagcugguggagcagaacggcaccgacgacuggaaggugaucgccaacuaccugcccaacagaaccgacgugcagugccagcacagauggcagaaggugcugaaccccgagcugaucaagggccccuggaccaaggaggaggaccagagagugaucgagcuggugcagaaguacggccccaagagauggagcgugaucgccaagcaccugaagggcagaaucggcaagcagugcagagagagauggcacaaccaccugaaccccgaggugaagaagaccagcuggaccgaggaggaggacagaaucaucuaccaggcccacaagagacugggcaacagaugggccgagaucgccaagcugcugcccggcagaaccgacaacgccaucaagaaccacuggaacagcaccaugagaagaaagguggagcaggagggcuaccugcaggagagcagcaaggccagccagcccgccguggccaccagcuuccagaagaacagccaccugaugggcuucgcccaggccccccccaccgcccagcugcccgccaccggccagcccaccgugaacaacgacuacagcuacuaccacaucagcgaggcccagaacgugagcagccacgugcccuaccccguggcccugcacgugaacaucgugaacgugccccagcccgccgccgccgccauccagagacacuacaacgacgaggaccccgagaaggagaagagaaucaaggagcuggagcugcugcugaugagcaccgagaacgagcugaagggccagcagacccagaaccacaccugcagcuaccccggcuggcacagcaccaccaucgccgaccacaccagaccccacggcgacagcgcccccgugagcugccugggcgagcaccacagcacccccagccugcccgccgaccccggcagccugcccgaggagagcgccagccccgccagaugcaugaucgugcaccagggcaccauccuggacaacgugaagaaccugcuggaguucgccgagacccugcaguucaucgacagcuuccugaacaccagcagcaaccacgagaacagcgaccuggagaugcccagccugaccagcaccccccugaucggccacaagcugaccgugaccacccccuuccacagagaccagaccgugaagacccagaaggagaacaccguguucagaacccccgccaucaagagaagcauccuggagagcagccccagaacccccacccccuucaagcacgcccuggccgcccaggagaucaaguacggcccccugaagaugcugccccagacccccagccaccugguggaggaccugcaggacgugaucaagcaggagagcgacgagagcggcaucguggccgaguuccaggagaacggccccccccugcugaagaagaucaagcaggagguggagagccccaccgacaagagcggcaacuucuucugcagccaccacugggagggcgacagccugaacacccagcuguucacccagaccagccccguggccgacgcccccaacauccugaccagcagcgugcugauggcccccgccagcgaggacgaggacaacgugcugaaggccuucaccgugcccaagaacagaagccuggccagcccccugcagcccugcagcagcaccugggagcccgccagcugcggcaagauggaggagcagaugaccagcagcagccaggccagaaaguacgugaacgccuucagcgccagaacccuggugauguaa

SEQ ID NO: 20192 - RNA, 2259 nt, Artificial Sequence
  MYBL1__Homo_sapiens__NP_001073885
auggccaagagaagcagaagcgaggacgaggacgacgaccugcaguacgccgaccacgacuacgaggugccccagcagaagggccugaagaagcuguggaacagagugaaguggaccagagacgaggacgacaagcugaagaagcugguggagcagcacggcaccgacgacuggacccugaucgccagccaccugcagaacagaagcgacuuccagugccagcacagauggcagaaggugcugaaccccgagcugaucaagggccccuggaccaaggaggaggaccagagagugaucgagcuggugcagaaguacggccccaagagauggagccugaucgccaagcaccugaagggcagaaucggcaagcagugcagagagagauggcacaaccaccugaaccccgaggugaagaagagcagcuggaccgaggaggaggacagaaucaucuacgaggcccacaagagacugggcaacagaugggccgagaucgccaagcugcugcccggcagaaccgacaacagcaucaagaaccacuggaacagcaccaugagaagaaagguggagcaggagggcuaccugcaggacggcaucaagagcgagagaagcagcagcaagcugcagcacaagcccugcgccgccauggaccacaugcagacccagaaccaguucuacauccccgugcagauccccggcuaccaguacgugagccccgagggcaacugcaucgagcacgugcagcccaccagcgccuucauccagcagcccuucaucgacgaggaccccgacaaggagaagaagaucaaggagcuggagaugcugcugaugagcgccgagaacgaggugagaagaaagagaauccccagccagcccggcagcuucagcagcuggagcggcagcuuccugauggacgacaacaugagcaacacccugaacagccuggacgagcacaccagcgaguucuacagcauggacgagaaccagcccgugagcgcccagcagaacagccccaccaaguuccuggccguggaggccaacgccgugcugagcagccugcagaccauccccgaguucgccgagacccuggagcugaucgagagcgaccccguggccuggagcgacgugaccagcuucgacaucagcgacgccgccgccagccccaucaagagcacccccgugaagcugaugagaauccagcacaacgagggcgccauggagugccaguucaacgugagccuggugcuggagggcaagaagaacaccugcaacggcggcaacagcgaggccgugccccugaccagccccaacaucgccaaguucagcaccccccccgccauccugagaaagaagagaaagaugagagugggccacagccccggcagcgagcugagagacggcagccugaacgacggcggcaacauggcccugaagcacaccccccugaagacccugcccuucagccccagccaguucuucaacaccugccccggcaacgagcagcugaacaucgagaaccccagcuucaccagcacccccaucugcggccagaaggcccugaucaccaccccccugcacaaggagaccacccccaaggaccagaaggagaacgugggcuucagaacccccaccaucagaagaagcauccugggcaccacccccagaacccccacccccuucaagaacgcccuggccgcccaggagaagaaguacggcccccugaagaucgugagccagccccuggccuuccuggaggaggacaucagagaggugcugaaggaggagaccggcaccgaccuguuccugaaggaggaggacgagcccgccuacaagagcugcaagcaggagaacaccgccagcggcaagaaggugagaaagagccuggugcuggacaacugggagaaggaggagagcggcacccagcugcugaccgaggacaucagcgacaugcagagcgagaacagauucaccaccagccugcugaugaucccccugcuggagauccacgacaacagaugcaaccugauccccgagaagcaggacaucaacagcaccaacaagaccuacacccugaccaagaagaagcccaaccccaacaccagcaagguggugaagcuggagaagaaccugcagagcaacugcgagugggagaccgugguguacggcaagaccgaggaccagcugaucaugaccgagcaggccagaagauaccugagcaccuacaccgccaccagcagcaccagcagagcccugauccuguaa

SEQ ID NO: 20193 - RNA, 2031 nt, Artificial Sequence
  MYBL2__Homo_sapiens__NP_001265539
augagcagaagaaccagaugcgaggaccuggacgagcugcacuaccaggacaccgacagcgacgugcccgagcagagagacagcaagugcaaggugaaguggacccacgaggagaacagaaccgaccagcagugccaguacagauggcugagagugcugaaccccgaccuggugaagggccccuggaccaaggaggaggaccagaaggugaucgagcuggugaagaaguacggcaccaagcaguggacccugaucgccaagcaccugaagggcagacugggcaagcagugcagagagagauggcacaaccaccugaaccccgaggugaagaagagcugcuggaccgaggaggaggacagaaucaucugcgaggcccacaaggugcugggcaacagaugggccgagaucgccaagaugcugcccggcagaaccgacaacgccgugaagaaccacuggaacagcaccaucaagagaaagguggacaccggcggcuuccugagcgagagcaaggacugcaagccccccguguaccugcugcuggagcuggaggacaaggacggccugcagagcgcccagcccaccgagggccagggcagccugcugaccaacuggcccagcgugccccccaccaucaaggaggaggagaacagcgaggaggagcuggccgccgccaccaccagcaaggagcaggagcccaucggcaccgaccuggacgccgugagaacccccgagccccuggaggaguuccccaagagagaggaccaggagggcagcccccccgagaccagccugcccuacaagugggugguggaggccgccaaccugcugauccccgccgugggcagcagccugagcgaggcccuggaccugaucgagagcgaccccgacgccuggugcgaccugagcaaguucgaccugcccgaggagcccagcgccgaggacagcaucaacaacagccuggugcagcugcaggccagccaccagcagcaggugcugccccccagacagcccagcgcccuggugcccagcgugaccgaguacagacuggacggccacaccaucagcgaccugagcagaagcagcagaggcgagcugauccccaucagccccagcaccgaggugggcggcagcggcaucggcaccccccccagcgugcugaagagacagagaaagagaagaguggcccugagccccgugaccgagaacagcaccagccugagcuuccuggacagcugcaacagccugacccccaagagcacccccgugaagacccugcccuucagccccagccaguuccugaacuucuggaacaagcaggacacccuggagcuggagagccccagccugaccagcacccccgugugcagccagaaggugguggugaccaccccccugcacagagacaagaccccccugcaccagaagcacgccgccuucgugacccccgaccagaaguacagcauggacaacaccccccacacccccacccccuucaagaacgcccuggagaaguacggcccccugaagccccugccccagaccccccaccuggaggaggaccugaaggaggugcugagaagcgaggccggcaucgagcugaucaucgaggacgacaucagacccgagaagcagaagagaaagcccggccugagaagaagccccaucaagaaggugagaaagagccuggcccuggacaucguggacgaggacgugaagcugaugaugagcacccugcccaagagccugagccugcccaccaccgcccccagcaacagcagcagccugacccugagcggcaucaaggaggacaacagccugcugaaccagggcuuccugcaggccaagcccgagaaggccgccguggcccagaagcccagaagccacuucaccacccccgcccccaugagcagcgccuggaagaccguggccugcggcggcaccagagaccagcuguucaugcaggagaaggccagacagcugcugggcagacugaagcccagccacaccagcagaacccugauccugagcuaa

SEQ ID NO: 20194 - RNA, 3522 nt, Artificial Sequence
  MYBPC1__Homo_sapiens__NP_001241647
augcccgagcccaccaagaaggaggagaacgaggugcccgcccccgcccccccccccgaggagcccagcaaggagaaggaggccggcaccacccccgccaaggacuggacccugguggagaccccccccggcgaggagcaggccaagcagaacgccaacagccagcugagcauccuguucaucgagaagccccagggcggcaccgugaaggugggcgaggacaucaccuucaucgccaaggugaaggccgaggaccugcugagaaagcccaccaucaagugguucaagggcaaguggauggaccuggccagcaaggccggcaagcaccugcagcugaaggagaccuucgagagacacagcagaguguacaccuucgagaugcagaucaucaaggccaaggacaacuucgccggcaacuacagaugcgaggugaccuacaaggacaaguucgacagcugcagcuucgaccuggaggugcacgagagcaccggcaccacccccaacaucgacaucagaagcgccuucaagagaagcggcgagggccaggaggacgccggcgagcuggacuucagcggccugcugaagagaagagaggugaagcagcaggaggaggagccccagguggacgugugggagcugcugaagaacgccaagcccagcgaguacgagaagaucgccuuccaguacggcaucaccgaccugagaggcaugcugaagagacugaagagaaugagaagagaggagaagaagagcgccgccuucgccaagauccuggaccccgccuaccagguggacaagggcggcagagugagauucgugguggagcuggccgaccccaagcuggaggugaagugguacaagaacggccaggagaucagacccagcaccaaguacaucuucgagcacaagggcugccagagaauccuguucaucaacaacugccagaugaccgacgacagcgaguacuacgugaccgccggcgacgagaagugcagcaccgagcuguucgugagagagccccccaucauggugaccaagcagcuggaggacaccaccgccuacugcggcgagagaguggagcuggagugcgaggugagcgaggacgacgccaacgugaagugguucaagaacggcgaggagaucauccccggccccaagagcagauacagaaucagaguggagggcaagaagcacauccugaucaucgagggcgccaccaaggccgacgccgccgaguacagcgugaugaccaccggcggccagagcagcgccaagcugagcguggaccugaagccccugaagauccugaccccccugaccgaccagaccgugaaccugggcaaggagaucugccugaagugcgagaucagcgagaacauccccggcaaguggaccaagaacggccugcccgugcaggagagcgacagacugaagguggugcacaagggcagaauccacaagcuggugaucgccaacgcccugaccgaggacgagggcgacuacguguucgcccccgacgccuacaacgugacccugcccgccaaggugcacgugaucgacccccccaagaucauccuggacggccuggacgccgacaacaccgugaccgugaucgccggcaacaagcugagacuggagauccccaucagcggcgagcccccccccaaggccauguggagcagaggcgacaaggccaucauggagggcagcggcagaaucagaaccgagagcuaccccgacagcagcacccuggugaucgacaucgccgagagagacgacagcggcguguaccacaucaaccugaagaacgaggccggcgaggcccacgccagcaucaaggugaaggugguggacuuccccgacccccccguggcccccaccgugaccgaggugggcgacgacuggugcaucaugaacugggagccccccgccuacgacggcggcagccccauccugggcuacuucaucgagagaaagaagaagcagagcagcagauggaugagacugaacuucgaccugugcaaggagaccaccuucgagcccaagaagaugaucgagggcguggccuacgaggugagaaucuucgccgugaacgccaucggcaucagcaagcccagcaugcccagcagacccuucgugccccuggccgugaccagcccccccacccugcugaccguggacagcgugaccgacaccaccgugaccaugagauggagaccccccgaccacaucggcgccgccggccuggacggcuacgugcuggaguacugcuucgagggcagcaccagcgccaagcagagcgacgagaacggcgaggccgccuacgaccugcccgccgaggacuggaucguggccaacaaggaccugaucgacaagaccaaguucaccaucaccggccugcccaccgacgccaagaucuucgugagagugaaggccgugaacgccgccggcgccagcgagcccaaguacuacagccagcccauccuggugaaggagaucaucgagccccccaagaucagaauccccagacaccugaagcagaccuacaucagaagagugggcgaggccgugaaccuggugauccccuuccagggcaagcccagacccgagcugaccuggaagaaggacggcgccgagaucgacaagaaccagaucaacaucagaaacagcgagaccgacaccaucaucuucaucagaaaggccgagagaagccacagcggcaaguacgaccugcaggugaagguggacaaguucguggagaccgccagcaucgacauccagaucaucgacagacccggccccccccagaucgugaagaucgaggacguguggggcgagaacguggcccugaccuggaccccccccaaggacgacggcaacgccgccaucaccggcuacaccauccagaaggccgacaagaagagcauggagugguucaccgugaucgagcacuaccacagaaccagcgccaccaucaccgagcuggugaucggcaacgaguacuacuucagaguguucagcgagaacaugugcggccugagcgaggacgccaccaugaccaaggagagcgccgugaucgccagagacggcaagaucuacaagaaccccguguacgaggacuucgacuucagcgaggcccccauguucacccagccccuggugaacaccuacgccaucgccggcuacaacgccacccugaacugcagcgugagaggcaaccccaagcccaagaucaccuggaugaagaacaagguggccaucguggacgaccccagauacagaauguucagcaaccagggcgugugcacccuggagaucagaaagcccagccccuacgacggcggcaccuacugcugcaaggccgugaacgaccugggcaccguggagaucgagugcaagcuggaggugaaggugaucuaccagggcgugaacacccccggccagcccguguuccuggagggccagcagcaggugggcagccccagcgccgacagcagcugcaaggccuaccugcagaccuaa

SEQ ID NO: 20195 - RNA, 3426 nt, Artificial Sequence
  MYBPC2__Homo_sapiens__NP_004524
augcccgaggccaagcccgccgccaagaaggcccccaagggcaaggacgcccccaagggcgcccccaaggaggccccccccaaggaggcccccgccgaggcccccaaggaggccccccccgaggaccagagccccaccgccgaggagcccaccggcguguuccugaagaagcccgacagcgugagcguggagaccggcaaggacgccguggugguggccaaggugaacggcaaggagcugcccgacaagcccaccaucaagugguucaagggcaaguggcuggagcugggcagcaagagcggcgccagauucagcuucaaggagagccacaacagcgccagcaacguguacaccguggagcugcacaucggcaagguggugcugggcgacagaggcuacuacagacuggaggugaaggccaaggacaccugcgacagcugcggcuucaacaucgacguggaggcccccagacaggacgccagcggccagagccuggagagcuucaagagaaccagcgagaagaagagcgacaccgccggcgagcuggacuucagcggccugcugaagaagagagaggugguggaggaggagaagaagaagaagaagaaggacgacgacgaccugggcaucccccccgagaucugggagcugcugaagggcgccaagaagagcgaguacgagaagaucgccuuccaguacggcaucaccgaccugagaggcaugcugaagagacugaagaaggccaagguggaggugaagaagagcgccgccuucaccaagaagcuggaccccgccuaccagguggacagaggcaacaagaucaagcugaugguggagaucagcgaccccgaccugacccugaagugguucaagaacggccaggagaucaagcccagcagcaaguacguguucgagaacgugggcaagaagagaauccugaccaucaacaagugcacccuggccgacgacgccgccuacgagguggccgugaaggacgagaagugcuucaccgagcuguucgugaaggagccccccgugcugaucgugaccccccuggaggaccagcagguguucgugggcgacagaguggagauggccguggaggugagcgaggagggcgcccaggugauguggaugaaggacggcguggagcugaccagagaggacagcuucaaggccagauacagauucaagaaggacggcaagagacacauccugaucuucagcgacguggugcaggaggacagaggcagauaccaggugaucaccaacggcggccagugcgaggccgagcugaucguggaggagaagcagcuggaggugcugcaggacaucgccgaccugaccgugaaggccagcgagcaggccguguucaagugcgaggugagcgacgagaaggugaccggcaagugguacaagaacggcguggaggugagacccagcaagagaaucaccaucagccacgugggcagauuccacaagcuggugaucgacgacgugagacccgaggacgagggcgacuacaccuucgugcccgacggcuacgcccugagccugagcgccaagcugaacuuccuggagaucaagguggaguacgugcccaagcaggagccccccaagauccaccuggacugcagcggcaagaccagcgagaacgccaucguggugguggccggcaacaagcugagacuggacgugagcaucaccggcgagcccccccccguggccaccuggcugaagggcgacgagguguucaccaccaccgagggcagaaccagaaucgagaagagaguggacugcagcagcuucgugaucgagagcgcccagagagaggacgagggcagauacaccaucaaggugaccaaccccgugggcgaggacguggccagcaucuuccugcaggugguggacgugcccgacccccccgaggccgugagaaucaccagcgugggcgaggacugggccauccuggugugggagccccccauguacgacggcggcaagcccgugaccggcuaccugguggagagaaagaagaagggcagccagagauggaugaagcugaacuucgagguguucaccgagaccaccuacgagagcaccaagaugaucgagggcauccuguacgagaugagaguguucgccgugaacgccaucggcgugagccagcccagcaugaacaccaagcccuucaugcccaucgcccccaccagcgagccccugcaccugaucguggaggacgugaccgacaccaccaccacccugaaguggagaccccccaacagaaucggcgccggcggcaucgacggcuaccugguggaguacugccuggagggcagcgaggagugggugcccgccaacaccgagcccguggagagaugcggcuucaccgugaagaaccugcccaccggcgccagaauccuguucagaguggugggcgugaacaucgccggcagaagcgagcccgccacccuggcccagcccgugaccaucagagagaucgccgagccccccaagaucagacugcccagacaccugagacagaccuacaucagaaaggugggcgagcagcugaaccugguggugcccuuccagggcaagcccagaccccaggugguguggaccaagggcggcgccccccuggacaccagcagagugcacgugagaaccagcgacuucgacaccguguucuucgugagacaggccgccagaagcgacagcggcgaguacgagcugagcgugcagaucgagaacaugaaggacaccgccaccaucagaaucagagugguggagaaggccggcccccccaucaacgugauggugaaggagguguggggcaccaacgcccugguggaguggcaggcccccaaggacgacggcaacagcgagaucaugggcuacuucgugcagaaggccgacaagaagaccauggagugguucaacguguacgagagaaacagacacaccagcugcaccgugagcgaccugaucgugggcaacgaguacuacuucagaguguacaccgagaacaucugcggccugagcgacagccccggcgugagcaagaacaccgccagaauccugaagaccggcaucaccuucaagcccuucgaguacaaggagcacgacuucagaauggcccccaaguuccugaccccccugaucgacagaguggugguggccggcuacagcgccgcccugaacugcgccgugagaggccaccccaagcccaaggugguguggaugaagaacaagauggagaucagagaggaccccaaguuccugaucaccaacuaccagggcgugcugacccugaacaucagaagacccagccccuucgacgccggcaccuacaccugcagagccgugaacgagcugggcgaggcccuggccgagugcaagcuggaggugagagugccccaguaa

SEQ ID NO: 20196 - RNA, 3825 nt, Artificial Sequence
  MYBPC3__Homo_sapiens__NP_000247
augcccgagcccggcaagaagcccgugagcgccuucagcaagaagcccagaagcguggagguggccgccggcagccccgccguguucgaggccgagaccgagagagccggcgugaaggugagauggcagagaggcggcagcgacaucagcgccagcaacaaguacggccuggccaccgagggcaccagacacacccugaccgugagagaggugggccccgccgaccagggcagcuacgccgugaucgccggcagcagcaaggugaaguucgaccugaaggugaucgaggccgagaaggccgagcccaugcuggcccccgcccccgcccccgccgaggccaccggcgcccccggcgaggcccccgcccccgccgccgagcugggcgagagcgcccccagccccaagggcagcagcagcgccgcccugaacggccccacccccggcgcccccgacgaccccaucggccuguucgugaugagaccccaggacggcgaggugaccgugggcggcagcaucaccuucagcgccagaguggccggcgccagccugcugaagccccccguggugaagugguucaagggcaaguggguggaccugagcagcaaggugggccagcaccugcagcugcacgacagcuacgacagagccagcaagguguaccuguucgagcugcacaucaccgacgcccagcccgccuucaccggcagcuacagaugcgaggugagcaccaaggacaaguucgacugcagcaacuucaaccugaccgugcacgaggccaugggcaccggcgaccuggaccugcugagcgccuucagaagaaccagccuggccggcggcggcagaagaaucagcgacagccacgaggacaccggcauccuggacuucagcagccugcugaagaagagagacagcuucagaacccccagagacagcaagcuggaggcccccgccgaggaggacgugugggagauccugagacaggccccccccagcgaguacgagagaaucgccuuccaguacggcgugaccgaccugagaggcaugcugaagagacugaagggcaugagaagagacgagaagaagagcaccgccuuccagaagaagcuggagcccgccuaccaggugagcaagggccacaagaucagacugaccguggagcuggccgaccacgacgccgaggugaaguggcugaagaacggccaggagauccagaugagcggcagcaaguacaucuucgagagcaucggcgccaagagaacccugaccaucagccagugcagccuggccgacgacgccgccuaccagugcguggugggcggcgagaagugcagcaccgagcuguucgugaaggagccccccgugcugaucaccagaccccuggaggaccagcuggugauggugggccagagaguggaguucgagugcgaggugagcgaggagggcgcccaggugaaguggcugaaggacggcguggagcugaccagagaggagaccuucaaguacagauucaagaaggacggccagagacaccaccugaucaucaacgaggccaugcuggaggacgccggccacuacgcccugugcaccagcggcggccaggcccuggccgagcugaucgugcaggagaagaagcuggagguguaccagagcaucgccgaccugauggugggcgccaaggaccaggccguguucaagugcgaggugagcgacgagaacgugagaggcguguggcugaagaacggcaaggagcuggugcccgacagcagaaucaaggugagccacaucggcagagugcacaagcugaccaucgacgacgugacccccgccgacgaggccgacuacagcuucgugcccgagggcuucgccugcaaccugagcgccaagcugcacuucauggaggugaagaucgacuucgugcccagacaggagccccccaagauccaccuggacugccccggcagaauccccgacaccaucguggugguggccggcaacaagcugagacuggacgugcccaucagcggcgaccccgcccccaccgugaucuggcagaaggccaucacccagggcaacaaggcccccgccagacccgcccccgacgcccccgaggacaccggcgacagcgacgaguggguguucgacaagaagcugcugugcgagaccgagggcagagugagaguggagaccaccaaggacagaagcaucuucaccguggagggcgccgagaaggaggacgagggcguguacaccgugaccgugaagaaccccgugggcgaggaccaggugaaccugaccgugaaggugaucgacgugcccgacgcccccgccgcccccaagaucagcaacgugggcgaggacagcugcaccgugcagugggagccccccgccuacgacggcggccagcccauccugggcuacauccuggagagaaagaagaagaagagcuacagauggaugagacugaacuucgaccugauccaggagcugagccacgaggccagaagaaugaucgagggcgugguguacgagaugagaguguacgccgugaacgccaucggcaugagcagacccagccccgccagccagcccuucaugcccaucggcccccccagcgagcccacccaccuggccguggaggacgugagcgacaccaccgugagccugaaguggagaccccccgagagagugggcgccggcggccuggacggcuacagcguggaguacugccccgagggcugcagcgaguggguggccgcccugcagggccugaccgagcacaccagcauccuggugaaggaccugcccaccggcgccagacugcuguucagagugagagcccacaacauggccggccccggcgcccccgugaccaccaccgagcccgugaccgugcaggagauccugcagagacccagacugcagcugcccagacaccugagacagaccauccagaagaaggugggcgagcccgugaaccugcugauccccuuccagggcaagcccagaccccaggugaccuggaccaaggagggccagccccuggccggcgaggaggugagcaucagaaacagccccaccgacaccauccuguucaucagagccgccagaagagugcacagcggcaccuaccaggugaccgugagaaucgagaacauggaggacaaggccacccuggugcugcaggugguggacaagcccagccccccccaggaccugagagugaccgacgccuggggccugaacguggcccuggaguggaagcccccccaggacgugggcaacaccgagcuguggggcuacaccgugcagaaggccgacaagaagaccauggagugguucaccgugcuggagcacuacagaagaacccacugcguggugcccgagcugaucaucggcaacggcuacuacuucagaguguucagccagaacauggugggcuucagcgacagagccgccaccaccaaggagcccguguucauccccagacccggcaucaccuacgagccccccaacuacaaggcccuggacuucagcgaggcccccagcuucacccagccccuggugaacagaagcgugaucgccggcuacaccgccaugcugugcugcgccgugagaggcagccccaagcccaagaucagcugguucaagaacggccuggaccugggcgaggacgccagauucagaauguucagcaagcagggcgugcugacccuggagaucagaaagcccugccccuucgacggcggcaucuacgugugcagagccaccaaccugcagggcgaggccagaugcgagugcagacuggaggugagagugccccaguaa

SEQ ID NO: 20197 - RNA, 1434 nt, Artificial Sequence
  MYBPH__Homo_sapiens__NP_004988
augauggagaagaacaccagcgagggccccgccugcagccccgaggagaccgccagcgagagcgccaaggugcccaccgccgagccccccggcgagguggccgugagcgagagcaccagagaggagcaggugcccaagccccaggcccccgccccccaggcccccaccgccagcaccgccaccaagcccgccccccccagcgaggacgugcccagcgccccccugcugcugacccuggacgacgugagcagcagcagcgugaccgugagcugggagccccccgagagacugggcagacugggccugcagggcuacgugcuggagcugugcagagagggcgccagcgagugggugcccgugagcgccagacccaugauggugacccagcagaccgugagaaaccuggcccugggcgacaaguuccugcugagagugagcgccgugagcagcgccggcgccggcccccccgccaugcuggaccagcccauccacaucagagagaacaucgaggcccccaagaucagagugcccagacaccugagacagaccuacaucagacaggugggcgagaccgugaaccugcagauccccuuccagggcaagcccaagccccaggccaccuggacccacaacggccacgcccuggacagccagagagugagcaugagaaccggcgaccaggacagcauccuguucaucagaagcgcccagagaagcgacagcggcagauacgagcugaccgugagaguggaggaccuggaggccaaggccgugaucgacauccuggugaucgagaagcccggcccccccagcagcaucagacugcuggacguguggggcugcaacgccgcccugcaguggacccccccccaggacaccggcaacaccgagcugcugggcuacauggugcagaaggccgacaagaagaccggccagugguucaccgugcuggagagauaccaccccaccaccugcaccaucagcgaccugaucaucggcaacagcuacagcuucagaguguucagcgagaaccugugcggccugagcaccagcgccaccgugaccaaggagcuggcccacauccagaaggccgacaucgccgccaagcccaagggcuucaucgagagagacuucagcgaggcccccagcuucacccagccccuggccgaccacaccagcacccccggcuacagcacccagcuguucugcagcgugagagccagccccaagcccaagaucaucuggaugaagaacaagauggagauccagggcaaccccaaguacagagcccugagcgagcagggcgugugcacccuggagaucagaaagcccagccccuucgacagcggcguguacaccugcaaggccaucaacgugcugggcgaggccagcguggacugcagacuggaggugaaggccagcgccgcccacuaa

SEQ ID NO: 20198 - RNA, 14037 nt, Artificial Sequence
  MYCBP2__Homo_sapiens__NP_055872
augaugaugugcgccgccaccgccagccccgccgccgccagcagcggccugggcggcgacggcuucuaccccgccgccaccuucagcagcagccccgcccccggcgcccuguucaugcccgugcccgacggcagcguggccgccgccggccugggccugggccugcccgccgccgacagcagaggccacuaccagcugcugcugagcggcagagcccuggccgacagauacagaagaaucuacaccgccgcccugaacgacagagaccagggcggcggcagcgccggccaccccgccagcagaaacaagaagauccugaacaagaagaagcugaagagaaagcagaagagcaagagcaaggugaagaccagaagcaagagcgagaaccuggagaacaccgugaucauccccgacaucaagcugcacagcaaccccagcgccuucaacaucuacugcaacgugagacacugcgugcuggaguggcagaagaaggagaucagccuggccgccgccagcaagaacagcgugcagagcggcgagagcgacagcgacgaggaggaggagagcaaggagccccccaucaagcugcccaagaucaucgaggugggccugugcgagguguucgagcugaucaaggagaccagauucagccaccccagccugugccugagaagccugcaggcccugcugaacgugcugcagggccagcagcccgagggccugcagagcgagccccccgaggugcuggagagccuguuccagcugcugcuggagaucaccgugagaagcaccggcaugaacgacagcaccggccagagccugaccgcccugagcugcgccugccuguucagccugguggccagcuggggcgagaccggcagaacccugcaggccaucagcgccauccugaccaacaacggcagccacgccugccagaccauccaggugcccaccauccugaacagccugcagagaagcgugcaggccgugcuggugggcaagauccagauccaggacugguucagcaacggcaucaagaaggccgcccugaugcacaaguggccccugaaggagaucagcguggacgaggacgaccagugccugcugcagaacgacggcuucuuccuguaccugcugugcaaggacggccuguacaagaucggcagcggcuacagcggcaccgugagaggccacaucuacaacagcaccagcagaaucagaaacagaaaggagaagaagagcuggcugggcuacgcccagggcuaccugcuguacagagacgugaacaaccacagcaugaccgccaucagaaucagccccgagacccuggagcaggacggcaccgugaugcugcccgacugccacaccgagggccagaacauccuguucaccgacggcgaguacaucaaccagaucgccgccagcagagacgacggcuucguggugagaaucuucgccaccagcaccgagcccgugcugcagcaggagcugcagcugaagcuggccagaaagugccugcacgccugcggcaucagccuguucgaccuggagaaggaccugcacaucaucagcaccggcuucgacgaggagagcgccauccugggcgccggcagagaguucgcccugaugaagaccgccaacggcaagaucuacuacaccggcaaguaccagagccugggcaucaagcagggcggccccagcgccggcaaguggguggagcugcccaucaccaagagccccaagaucgugcacuucagcgugggccacgacggcagccacgcccugcugguggccgaggacggcagcaucuucuucaccggcagcgccagcaagggcgaggacggcgagagcaccaagagcagaagacagagcaagcccuacaagcccaagaagaucaucaagauggagggcaagaucgugguguacaccgccugcaacaacggcagcagcagcgugaucagcaaggacggcgagcuguacauguucggcaaggacgccaucuacagcgacagcagcagccuggugaccgaccugaagggccacuucgugacccagguggccaugggcaaggcccacaccugcgugcugaugaagaacggcgagguguggaccuucggcgugaacaacaagggccagugcggcagagacaccggcgccaugaaccagggcggcaagggcuucggcguggagaacauggccaccgccauggacgaggaccuggaggaggagcuggacgagaaggacgagaagagcaugaugugcccccccggcaugcacaaguggaagcuggagcagugcauggugugcaccgugugcggcgacugcaccggcuacggcgccagcugcgugagcagcggcagacccgacagagugcccggcggcaucugcggcugcggcagcggcgagagcggcugcgccgugugcggcugcugcaaggccugcgccagagagcuggacggccaggaggccagacagagaggcauccuggacgccgugaaggagaugaucccccuggaccugcugcuggccgugcccgugcccggcgugaacaucgaggagcaccugcagcugagacaggaggagaagagacagagagugaucagaagacacagacuggaggagggcagaggcccccugguguucgccggccccaucuucaugaaccacagagagcaggcccuggccagacugagaagccaccccgcccagcugaagcacaagagagacaagcacaaggacggcagcggcgagagaggcgagaaggacgccagcaagaucaccaccuacccccccggcagcgugagauucgacugcgagcugagagccgugcaggugagcugcggcuuccaccacagcguggugcugauggagaacggcgacguguacaccuucggcuacggccagcacggccagcugggccacggcgacgugaacagcagaggcugccccacccuggugcaggcccugcccggccccagcacccaggugaccgccggcagcaaccacaccgccgugcugcugauggacggccagguguucaccuucggcagcuucagcaagggccagcugggcagacccauccuggacgugcccuacuggaacgccaagcccgcccccaugcccaacaucggcagcaaguacggcagaaaggccaccuggaucggcgccagcggcgaccagaccuuccugagaaucgacgaggcccugaucaacagccacgugcuggccaccagcgagaucuucgccagcaagcacaucaucggccuggugcccgccagcaucagcgagcccccccccuucaagugccugcugaucaacaagguggacggcagcugcaagaccuucaacgacagcgagcaggaggaccugcagggcuucggcgugugccuggaccccguguacgacgugaucuggagauucagacccaacaccagagagcuguggugcuacaacgccgugguggccgacgccagacugcccagcgccgccgacaugcagagcagaugcagcauccugagccccgagcuggcccugcccaccggcagcagagcccugaccaccagaagccacgccgcccugcacauccugggcugccuggacacccuggccgccaugcaggaccugaagaugggcguggccagcaccgaggaggagacccaggccgugaugaagguguacagcaaggaggacuacagcguggugaacagauucgagagccacggcggcggcuggggcuacagcgcccacagcguggaggccaucagauucagcgccgacaccgacauccugcugggcggccugggccuguucggcggcagaggcgaguacaccgccaagaucaagcuguucgagcugggccccgacggcggcgaccacgagaccgacggcgaccugcuggccgagaccgacgugcuggccuacgacugcgccgccagagagaaguacgccaugauguucgacgagcccgugcugcugcaggccggcuggugguacguggccugggccagagugagcggccccagcagcgacugcggcagccacggccaggccagcaucaccaccgacgacggcgugguguuccaguucaagagcagcaagaagagcaacaacggcaccgacgugaacgccggccagaucccccagcugcuguacagacugcccaccagcgacggcagcgccagcaagggcaagcagcagaccagcgagcccgugcacauccugaagagaagcuucgccagaaccgugagcguggagugcuucgagagccugcugagcauccugcacuggagcuggaccacccuggugcugggcguggaggagcugagaggccugaagggcuuccaguucaccgccacccugcuggaccuggagagacugagauucgugggcaccugcugccugagacugcugagaguguacaccugcgagaucuaccccgugagcgccaccggcaaggccgugguggaggagaccagcaagcuggccgagugcaucggcaagaccagaacccugcugagaaagauccugagcgagggcguggaccacugcauggugaagcuggacaacgacccccagggcuaccugagccagccccugagccugcuggaggccgugcugcaggagugccacaacaccuucaccgccugcuuccacagcuucuaccccacccccgcccugcagugggccugccugugcgaccugcugaacugccuggaccaggacauccaggaggccaacuucaagaccagcagcagcagacugcuggccgccgugaugagcgcccugugccacaccagcgugaagcugaccagcaucuuccccaucgccuacgacggcgaggugcugcugagaagcaucgugaagcaggugagcaccgagaacgacagcacccuggugcacagauucccccugcugguggcccacauggagaagcugagccagagcgaggagaacaucagcggcaugaccagcuucagagaggugcuggagaagaugcuggugaucguggugcugcccgugagaaacagccugagaagagagaacgagcuguucagcagccaccuggugagcaacaccugcggccugcuggccagcaucgugagcgagcugaccgccagcgcccugggcagcgagguggacggccugaacagccugcacagcgugaaggccagcgccaacagauucaccaagaccagccagggcagaagcuggaacaccggcaacggcagccccgacgccaucugcuucagcguggacaagcccggcaucgugguggugggcuucagcguguacggcggcggcggcauccacgaguacgagcuggaggugcugguggacgacagcgagcacgccggcgacagcacccacagccacagauggaccagccuggagcuggugaagggcaccuacaccaccgacgacagccccagcgacaucgccgagaucagacuggacaagguggugccccugaaggagaacgugaaguacgccgugagacugagaaacuacggcagcagaaccgccaacggcgacggcggcaugaccaccgugcagugccccgacggcgugaccuucaccuucagcaccugcagccugagcagcaacggcaccaaccagaccagaggccagaucccccagauccuguacuacagaagcgaguucgacggcgaccugcagagccagcugcugagcaaggccaacgaggaggacaagaacugcagcagagcccugagcguggugagcaccguggugagagccagcaaggaccugcugcacagagcccuggccguggacgccgacgacauccccgagcugcugagcagcagcagccuguucagcaugcugcugccccugaucaucgccuacaucggccccguggccgccgccauccccaagguggccguggagguguucggccuggugcagcagcugcugcccagcguggccauccugaaccagaaguacgccccccccgccuucaaccccaaccagagcaccgacagcaccaccggcaaccagcccgagcagggccugagcgccugcaccaccagcagccacuacgccgugaucgagagcgagcaccccuacaagcccgccugcgugaugcacuacaaggugaccuuccccgagugcgugagauggaugaccaucgaguucgacccccagugcggcaccgcccagagcgaggacgugcugagacugcugauccccgugagaaccgugcagaacagcggcuacggccccaagcugaccagcgugcacgagaaccugaacagcuggaucgagcugaagaaguucagcggcagcagcggcuggcccaccauggugcuggugcugcccggcaacgaggcccuguucagccuggagaccgccagcgacuacgugaaggacgacaaggccagcuucuacggcuucaagugcuucgccaucggcuacgaguucagccccggccccgacgagggcgugauccagcuggagaaggagcuggccaaccugggcggcgugugcgccgccgcccugaugaagaaggaccuggcccugcccaucggcaacgagcuggaggaggaccuggagauccuggaggaggccgcccugcaggugugcaagacccacagcggcauccugggcaagggccuggcccugagccacagccccaccauccuggaggcccuggagggcaaccugccccugcagauccagagcaacgagcagagcuuccuggacgacuucaucgccugcgugcccggcagcagcggcggcagacuggccagauggcugcagcccgacagcuacgccgacccccagaagaccagccugauccugaacaaggacgacaucagaugcggcuggcccaccaccaucaccgugcagaccaaggaccaguacggcgacguggugcacgugcccaacaugaagguggaggugaaggccgugcccgugagccagaagaagaugagccugcagcaggaccaggccaagaagccccagagaauccccggcagccccgccgugaccgccgccagcagcaacaccgacaugaccuacggcggccuggccagccccaagcuggacgugagcuacgagcccaugaucgugaaggaggccagauacaucgccaucaccaugaugaagguguacgagaacuacagcuucgaggagcugagauucgccagccccacccccaagagacccagcgagaacaugcugaucagagugaacaacgacggcaccuacugcgccaacuggacccccggcgccaucggccuguacacccugcacgugaccaucgacggcaucgagaucgacgccggccuggaggugaaggugaaggacccccccaagggcaugaucccccccggcacccagcuggugaagcccaagagcgagccccagcccaacaaggugagaaaguucguggccaaggacagcgccggccugagaaucagaagccaccccagccugcagagcgagcagaucggcaucgugaaggugaacggcaccaucaccuucaucgacgagauccacaacgacgacggcguguggcugagacugaacgacgagaccaucaagaaguacgugcccaacaugaacggcuacaccgaggccuggugccugagcuucaaccagcaccugggcaagagccugcuggugcccguggacgagagcaagaccaacaccgacgacuucuucaaggacaucaacagcugcugcccccaggaggccaccaugcaggagcaggacaugcccuuccugagaggcggccccggcauguacaagguggugaagaccggccccagcggccacaacaucagaagcugccccaaccugagaggcauccccaucggcaugcuggugcugggcaacaaggugaaggccgugggcgaggugaccaacagcgagggcaccugggugcagcuggaccagaacagcaugguggaguucugcgagagcgacgagggcgaggccuggagccuggccagagacagaggcggcaaccaguaccugagacacgaggacgagcaggcccugcuggaccagaacagccagacccccccccccagccccuucagcgugcaggccuucaacaagggcgccagcugcagcgcccagggcuucgacuacggccugggcaacagcaagggcgacagaggcaacaucagcaccagcagcaagcccgccagcaccagcggcaagagcgagcugagcagcaagcacagcagaagccugaagcccgacggcagaaugagcagaaccaccgccgaccagaagaagcccagaggcaccgagagccugagcgccagcgagagccugauccugaagagcgacgccgccaagcugagaagcgacagccacagcagaagccugagccccaaccacaacacccugcagacccugaagagcgacggcagaaugcccagcagcagcagagccgagagccccggccccggcagcagacugagcagccccaagcccaagacccugcccgccaacagaagcagccccagcggcgccagcagccccagaagcagcagcccccacgacaagaaccugccccagaagagcaccgcccccgugaagaccaagcuggacccccccagagagagaagcaagagcgacagcuacacccuggaccccgacacccugagaaagaagaagaugccccugaccgagccccugagaggcagaagcaccagccccaagcccaagagcgugcccaaggacagcaccgacagccccggcagcgagaacagagcccccagcccccacguggugcaggagaaccugcacagcgaggugguggaggugugcaccagcagcacccugaagaccaacagccugaccgacagcaccugcgacgacagcagcgaguucaagagcguggacgagggcagcaacaaggugcacuucagcaucggcaaggccccccugaaggacgagcaggagaugagagccagccccaagaucagcagaaagugcgccaacagacacaccagacccaagaaggagaagagcagcuuccuguucaagggcgacggcagcaagccccuggagcccgccaagcaggccaugagccccagcguggccgagugcgccagagccguguucgccagcuuccuguggcacgagggcaucgugcacgacgccauggccugcagcagcuuccugaaguuccaccccgagcugagcaaggagcacgcccccaucagaagcagccugaacagccagcagcccaccgaggagaaggagaccaagcugaagaacagacacagccuggagaucagcagcgcccugaacauguucaacaucgccccccacggccccgacaucagcaagaugggcagcaucaacaagaacaaggugcugagcaugcugaaggagcccccccugcacgagaagugcgaggacggcaagaccgagaccaccuucgagaugagcaugcacaacaccaugaagagcaagagcccccugccccugacccugcagcaccugguggccuucugggaggacaucagccuggccaccaucaaggccgccagccagaacaugaucuuccccagccccggcagcugcgccgugcugaagaagaaggagugcgagaaggagaacaagaagagcaagaaggagaagaagaagaaggagaaggccgaggugagacccagaggcaaccuguucggcgagauggcccagcuggccgugggcggccccgagaaggacaccaucugcgagcugugcggcgagagccaccccuaccccgugaccuaccacaugagacaggcccaccccggcugcggcagauacgccggcggccagggcuacaacagcaucggccacuucugcggcggcugggccggcaacugcggcgacggcggcaucggcggcagcaccugguaccuggugugcgacagaugcagagagaaguaccugagagagaagcaggccgccgccagagagaaggugaagcagagcagaagaaagcccaugcaggugaagacccccagagcccugcccaccauggaggcccaccaggugaucaaggccaacgcccuguuccugcugagccugagcagcgccgccgagcccagcauccugugcuaccaccccgccaagcccuuccagagccagcugcccagcgugaaggagggcaucagcgaggaccugcccgugaagaugcccugccuguaccugcagacccuggccagacaccaccacgagaacuucgugggcuaccaggacgacaaccuguuccaggacgagaugagauaccugagaagcaccagcgugcccgcccccuacaucagcgugacccccgacgccagccccaacguguucgaggagcccgagagcaacaugaagagcaugccccccagccuggagaccagccccaucaccgacaccgaccuggccaagagaaccguguuccagagaagcuacagcgugguggccagcgaguacgacaagcagcacagcauccugcccgccagagugaaggccauccccagaagaagagugaacagcggcgacaccgaggugggcagcagccugcugagacaccccagccccgagcugagcagacugaucagcgcccacagcagccugagcaagggcgagagaaacuuccaguggcccgugcuggccuucgugauccagcaccacgaccuggagggccuggagaucgccaugaagcaggcccugagaaagagcgccugcagaguguucgccauggaggccuucaacuggcugcugugcaacgugauccagaccaccagccugcacgacauccuguggcacuucguggccagccugacccccgcccccguggagcccgaggaggaggaggacgaggagaacaagaccagcaaggagaacagcgagcaggagaaggacaccagagugugcgagcacccccugagcgacaucgugaucgccggcgaggccgcccacccccugccccacaccuuccacagacugcugcagaccaucagcgaccugaugaugagccugcccagcggcagcagccugcagcagauggcccugagaugcuggagccugaaguucaagcagagcgaccaccaguuccugcaccagagcaacguguuccaccacaucaacaacauccugagcaagagcgacgacggcgacagcgaggagagcuucagcaucagcauccagagcggcuucgaggccaugagccaggagcugugcaucgugaugugccugaaggaccugaccagcaucguggacaucaagaccagcagcagacccgccaugaucggcagccugaccgacggcagcaccgagaccuucugggagagcggcgacgaggacaagaacaagaccaagaacaucaccaucaacugcgugaagggcaucaacgccagauacgugagcgugcacguggacaacagcagagaccugggcaacaaggugaccagcaugaccuuccugaccggcaaggccguggaggaccugugcagaaucaagcagguggaccuggacagcagacacaucggcugggugaccagcgagcugcccggcggcgacaaccacaucaucaagaucgagcugaagggccccgagaacacccugagagugagacaggugaaggugcugggcuggaaggacggcgagagcaccaagaucgccggccagaucagcgccagcguggcccagcagagaaacugcgaggccgagacccugagaguguucagacugaucaccagccagguguucggcaagcugaucagcggcgacgccgagcccacccccgagcaggaggagaaggcccugcugagcagccccgagggcgaggagaagguguacaacgccaccagcgacgccgaccugaaggagcacauggugggcaucaucuucagcagaagcaagcugaccaaccugcagaagcaggugugcgcccacaucgugcaggccaucagaauggaggccaccagagugagagaggagugggagcacgccaucagcagcaaggagaacgccaacagccagcccaacgacgaggacgccagcagcgacgccuacugcuucgagcugcugagcauggugcuggcccugagcggcagcaacgugggcagacaguaccuggcccagcagcugacccugcugcaggaccuguucagccugcugcacaccgccagccccagagugcagagacaggugaccagccugcugagaagagugcugcccgaggugacccccagcagacuggccagcaucaucggcgugaagagccugccccccgccgacaucagcgacaucauccacagcaccgagaagggcgacuggaacaagcugggcauccuggacauguuccugggcugcaucgccaaggcccugaccgugcagcugaaggccaagggcaccaccaucaccggcaccgccggcaccaccgugggcaagggcgugaccaccgugacccugcccaugaucuucaacagcagcuaccugagaagaggcgagagccacugguggaugaagggcagcacccccacccagaucagcgagaucaucaucaagcugaucaaggacauggccgccggccaccugagcgaggccuggagcagagugaccaagaacgccaucgccgagaccaucaucgcccugaccaagauggaggaggaguucagaagccccgugagaugcaucgccaccaccagacuguggcuggcccuggccagccugugcgugcuggaccaggaccacguggacagacugagcagcggcagauggaugggcaaggacggccagcagaagcagaugcccaugugcgacaaccacgacgacggcgagaccgccgccaucauccugugcaacgugugcggcaaccugugcaccgacugcgacagauuccugcaccugcacagaagaaccaagacccaccagagacagguguucaaggaggaggaggaggccaucaagguggaccugcacgagggcugcggcagaaccaagcuguucuggcugauggcccuggccgacagcaagaccaugaaggccaugguggaguucagagagcacaccggcaagcccaccaccagcagcagcgaggccugcagauucugcggcagcagaagcggcaccgagcugagcgccgugggcagcgugugcagcgacgccgacugccaggaguacgccaagaucgccugcagcaagacccaccccugcggccaccccugcggcggcgugaagaacgaggagcacugccugcccugccugcacggcugcgacaagagcgccaccagccugaagcaggacgccgacgacaugugcaugaucugcuucaccgaggcccugagcgccgcccccgccauccagcuggacugcagccacaucuuccaccugcagugcugcagaagagugcuggagaacagauggcugggccccagaaucaccuucggcuucaucagcugccccaucugcaagaacaagaucaaccacaucgugcugaaggaccugcuggaccccaucaaggagcuguacgaggacgugagaagaaaggcccugaugagacuggaguacgagggccugcacaagagcgaggccaucaccacccccggcgugagauucuacaacgaccccgccggcuacgccaugaacagauacgccuacuacgugugcuacaagugcagaaaggccuacuucggcggcgaggccagaugcgacgccgaggccggcagaggcgacgacuacgaccccagagagcugaucugcggcgccugcagcgacgugagcagagcccagaugugccccaagcacggcaccgacuuccuggaguacaagugcagauacugcugcagcguggccguguucuucugcuucggcaccacccacuucugcaacgccugccacgacgacuuccagagaaugaccagcauccccaaggaggagcugccccacugccccgccggccccaagggcaagcagcuggagggcaccgagugcccccugcacguggugcacccccccaccggcgaggaguucgcccugggcugcggcgugugcagaaacgcccacaccuucuaa

SEQ ID NO: 20199 - RNA, 2955 nt, Artificial Sequence
  MYCBPAP__Homo_sapiens__NP_115509
augagagcccccgccagaggcaccggcugcugcggcagaagcggcggcagauggcuggccggcgccgcccagcccagaugccugugggccggcggcgccggccagagauucauggugcccggcggcaccaugaagagccugaagaaggacagcagacugagaaucacccccaccagacugcuggaggccagcgagaacgugaaggagaagaagagagccaagggccccgagcagcccacccccaccauccaggaggagcccgagcccgugagcaacgugcugcagggcgacgacauccuggcccuggccaucaagaaggaggaccugaaggagcagcacauccccagacugaccgagaaggaggacaagagagugaucacccagaaguucaucaucagaaagcugaagcccauggaccccagaagaaaggugugccaccugguggccagacccgccaaccccgacgaggccaccaagccccuggacuacagcggccccggcgacagcuucgacggcagcgaccagauccugccccaccacauccugggcagccugcaggacuucaagagaaucgcccuggccagaggcaacacccagcuggccgagagaauccccaccagccccugccugaugacccugaucagcgccgagggcgagagcaagcagaaggcccccaaggaggagaagagaccccccugggccccccccccccagcacaacuuccugaagaacuggcagagaaacaccgcccugagaaagaagcagcaggaggcccugagcgagcaccugaagaagcccgugagcgagcugcugaugcacaccggcgagaccuacagaagaauccaggaggagagagagcugaucgacugcacccugcccaccagaagagacagaaagagcugggagaacagcggcuucuggagcagacuggaguaccugggcgacgagaugaccggccuggugaugaccaagaccaagacccagagaggccugauggagcccaucacccacaucagaaagccccacagcaucagaguggagaccggccugcccgcccagagagacgccagcuacagauacaccugggacagaagccuguuccugaucuacagaagaaaggagcugcagagaaucauggaggagcuggacuucagccagcaggacaucgacggccuggagguggugggcaagggcuggcccuucagcgccgugaccguggaggacuacaccguguucgagagaagccagggcagcagcagcgaggacaccgccuaccugggcacccuggccagcagcagcgacgugagcaugcccauccugggccccagccugcuguucugcggcaagcccgccugcuggaucagaggcagcaacccccaggacaagagacaggugggcaucgccgcccaccugaccuucgagacccuggagggcgagaagaccagcagcgagcugaccguggugaacaacggcaccguggccaucugguacgacuggagaagacagcaccagcccgacaccuuccaggaccugaagaagaacagaaugcagagauucuacuucgacaacagagagggcgugauccugcccggcgagaucaagaccuucaccuucuucuucaagagccugaccgccggcguguucagagaguucugggaguucagaacccaccccacccugcugggcggcgccauccugcaggugaaccugcacgccgugagccugacccaggacguguucgaggacgagagaaaggugcuggagagcaagcugaccgcccacgaggccgugaccguggugagagaggugcugcaggagcugcugaugggcgugcugacccccgagagaacccccagccccguggacgccuaccugaccgaggaggaccuguucagacacagaaaccccccccugcacuacgagcaccagguggugcagagccugcaccagcuguggagacaguacaugacccugcccgccaaggccgaggaggccagacccggcgacaaggagcacgugagccccaucgccaccgagaaggccagcgugaacgccgagcugcugcccagauucagaagccccaucagcgagacccaggugcccagacccgagaacgaggcccugagagagagcggcagccagaaggccagagugggcaccaagagcccccagagaaagagcaucauggaggagauccugguggaggagagccccgacguggacagcaccaagagccccugggagcccgacggccugccccugcuggaguggaaccugugccuggaggacuucagaaaggccgugauggugcugcccgacgagaaccacagagaggacgcccugaugagacugaacaaggccgcccuggagcugugccagaagcccagaccccugcagagcaaccugcugcaccagaugugccugcagcuguggagagacgugaucgacagccuggugggccacagcauguggcugagaagcgugcugggccugcccgagaaggagaccaucuaccugaacgugcccgaggagcaggaccagaagagcccccccaucauggaggugaaggugcccgugggcaaggccggcaaggaggagagaaagggcgccgcccaggagaagaagcagcugggcaucaaggacaaggaggacaagaagggcgccaagcugcugggcaaggaggacagacccaacagcaagaagcacaaggccaaggacgacaagaaggugaucaagagcgccagccaggacagauucagccuggaggaccccacccccgacaucauccugagcagccaggagcccaucgacccccuggugaugggcaaguacacccagagccugcacagcgaggugagaggccugcuggacacccuggugaccgaccugauggugcuggccgacgagcugagccccaucaagaacguggaggaggcccugagacugugcagauaa

SEQ ID NO: 20200 - RNA, 1365 nt, Artificial Sequence
  MYC__Homo_sapiens__NP_002458
auggacuucuucagagugguggagaaccagcagccccccgccaccaugccccugaacgugagcuucaccaacagaaacuacgaccuggacuacgacagcgugcagcccuacuucuacugcgacgaggaggagaacuucuaccagcagcagcagcagagcgagcugcagccccccgcccccagcgaggacaucuggaagaaguucgagcugcugcccacccccccccugagccccagcagaagaagcggccugugcagccccagcuacguggccgugacccccuucagccugagaggcgacaacgacggcggcggcggcagcuucagcaccgccgaccagcuggagauggugaccgagcugcugggcggcgacauggugaaccagagcuucaucugcgaccccgacgacgagaccuucaucaagaacaucaucauccaggacugcauguggagcggcuucagcgccgccgccaagcuggugagcgagaagcuggccagcuaccaggccgccagaaaggacagcggcagccccaaccccgccagaggccacagcgugugcagcaccagcagccuguaccugcaggaccugagcgccgccgccagcgagugcaucgaccccagcgugguguuccccuacccccugaacgacagcagcagccccaagagcugcgccagccaggacagcagcgccuucagccccagcagcgacagccugcugagcagcaccgagagcagcccccagggcagccccgagccccuggugcugcacgaggagaccccccccaccaccagcagcgacagcgaggaggagcaggaggacgaggaggagaucgacguggugagcguggagaagagacaggcccccggcaagagaagcgagagcggcagccccagcgccggcggccacagcaagcccccccacagcccccuggugcugaagagaugccacgugagcacccaccagcacaacuacgccgccccccccagcaccagaaaggacuaccccgccgccaagagagugaagcuggacagcgugagagugcugagacagaucagcaacaacagaaagugcaccagccccagaagcagcgacaccgaggagaacgugaagagaagaacccacaacgugcuggagagacagagaagaaacgagcugaagagaagcuucuucgcccugagagaccagauccccgagcuggagaacaacgagaaggcccccaagguggugauccugaagaaggccaccgccuacauccugagcgugcaggccgaggagcagaagcugaucagcgaggaggaccugcugagaaagagaagagagcagcugaagcacaagcuggagcagcugagaaacagcugcgccuaa

SEQ ID NO: 20201 - RNA, 1395 nt, Artificial Sequence
  MYCN__Homo_sapiens__NP_005369
augcccagcugcagcaccagcaccaugcccggcaugaucugcaagaaccccgaccuggaguucgacagccugcagcccugcuucuaccccgacgaggacgacuucuacuucggcggccccgacagcaccccccccggcgaggacaucuggaagaaguucgagcugcugcccacccccccccugagccccagcagaggcuucgccgagcacagcagcgagccccccagcugggugaccgagaugcugcuggagaacgagcuguggggcagccccgccgaggaggacgccuucggccugggcggccugggcggccugacccccaaccccgugauccugcaggacugcauguggagcggcuucagcgccagagagaagcuggagagagccgugagcgagaagcugcagcacggcagaggcccccccaccgccggcagcaccgcccagagccccggcgccggcgccgccagccccgccggcagaggccacggcggcgccgccggcgccggcagagccggcgccgcccugcccgccgagcuggcccaccccgccgccgagugcguggaccccgccgugguguuccccuuccccgugaacaagagagagcccgcccccgugcccgccgcccccgccagcgcccccgccgccggccccgccguggccagcggcgccggcaucgccgcccccgccggcgcccccggcguggccccccccagacccggcggcagacagaccagcggcggcgaccacaaggcccugagcaccagcggcgaggacacccugagcgacagcgacgacgaggacgacgaggaggaggacgaggaggaggagaucgacguggugaccguggagaagagaagaagcagcagcaacaccaaggccgugaccaccuucaccaucaccgugagacccaagaacgccgcccugggccccggcagagcccagagcagcgagcugauccugaagagaugccugcccauccaccagcagcacaacuacgccgcccccagccccuacguggagagcgaggacgcccccccccagaagaagaucaagagcgaggccagccccagaccccugaagagcgugaucccccccaaggccaagagccugagccccagaaacagcgacagcgaggacagcgagagaagaagaaaccacaacauccuggagagacagagaagaaacgaccugagaagcagcuuccugacccugagagaccacgugcccgagcuggugaagaacgagaaggccgccaagguggugauccugaagaaggccaccgaguacgugcacagccugcaggccgaggagcaccagcugcugcuggagaaggagaagcugcaggccagacagcagcagcugcugaagaagaucgagcacgccagaaccugcuaa

SEQ ID NO: 20202 - RNA, 708 nt, Artificial Sequence
  MYCT1__Homo_sapiens__NP_079383
augagaacccagguguacgagggccugugcaagaacuacuucagccuggccgugcugcagagagacagaaucaagcugcuguucuucgacauccugguguuccugagcguguuccugcuguuccugcuguuccugguggacaucauggccaacaacaccaccagccugggcagccccuggcccgagaacuucugggaggaccugaucaugagcuucaccgugagcauggccaucggccuggugcugggcggcuucaucugggccguguucaucugccugagcagaagaagaagagccagcgcccccaucagccaguggagcagcagcagaagaagcagaagcagcuacacccacggccugaacagaaccggcuucuacagacacagcggcugcgagagaagaagcaaccugagccuggccagccugaccuuccagagacaggccagccuggagcaggccaacagcuuccccagaaagagcagcuucagagccagcaccuuccaccccuuccugcagugccccccccugcccguggagaccgagagccagcuggugacccugcccagcagcaacaucagccccaccaucagcaccagccacagccugagcagacccgacuacuggagcagcaacagccugagagugggccugagcaccccccccccccccgccuacgagagcaucaucaaggccuuccccgacagcuaa

SEQ ID NO: 20203 - RNA, 480 nt, Artificial Sequence
  MYD88__Homo_sapiens__NP_001166037
augagacccgacagagccgaggcccccggcccccccgccauggccgccggcggccccggcgccggcagcgccgcccccgugagcagcaccagcagccugccccuggccgcccugaacaugagagugagaagaagacugagccuguuccugaacgugagaacccagguggccgccgacuggaccgcccuggccgaggagauggacuucgaguaccuggagaucagacagcuggagacccaggccgaccccaccggcagacugcuggacgccuggcagggcagacccggcgccagcgugggcagacugcuggagcugcugaccaagcugggcagagacgacgugcugcuggagcugggccccagcaucggcgccgccggcuggugguggcugagccugaugaucaccugcagagccagaaacgugaccagcagacccaaccugcacagcgccagccugcaggugcccaucagaagcgacuaa

SEQ ID NO: 20204 - RNA, 522 nt, Artificial Sequence
  MYDGF__Homo_sapiens__NP_061980
auggccgcccccagcggcggcuggaacggcgugggcgccagccugugggccgcccugcugcugggcgccguggcccugagacccgccgaggccgugagcgagcccaccaccguggccuucgacgugagacccggcggcguggugcacagcuucagccacaacgugggccccggcgacaaguacaccugcauguucaccuacgccagccagggcggcaccaacgagcaguggcagaugagccugggcaccagcgaggaccaccagcacuucaccugcaccaucuggagaccccagggcaagagcuaccuguacuucacccaguucaaggccgaggugagaggcgccgagaucgaguacgccauggccuacagcaaggccgccuucgagagagagagcgacgugccccugaagaccgaggaguucgaggugaccaagaccgccguggcccacagacccggcgccuucaaggccgagcugagcaagcuggugaucguggccaaggccagcagaaccgagcuguaa

SEQ ID NO: 20205 - RNA, 1731 nt, Artificial Sequence
  MYEF2__Homo_sapiens__NP_001288139
auggccgacgccaacaaggccgaggugcccggcgccaccggcggcgacagcccccaccugcagcccgccgagccccccggcgagcccagaagagagccccaccccgccgaggccgagaagcagcagccccagcacagcagcagcagcaacggcgugaagauggagaacgacgagagcgccaaggaggagaagagcgaccugaaggagaagagcaccggcagcaagaaggccaacagauuccaccccuacagcaaggacaagaacagcggcaccggcgagaagaagggccccaacagaaacagaguguucaucagcaacauccccuacgacaugaaguggcaggccaucaaggaccugaugagagagaaggugggcgaggugaccuacguggagcuguucaaggacgccgagggcaagagcagaggcugcggcgugguggaguucaaggacgaggaguucgugaagaaggcccuggagaccaugaacaaguacgaccugagcggcagaccccugaacaucaaggaggaccccgacggcgagaacgccagaagagcccugcagagaaccggcggcagcuuccccggcggccacgugcccgacaugggcagcggccugaugaaccugccccccagcauccugaacaaccccaacaucccccccgaggugaucagcaaccugcaggccggcagacugggcagcaccaucuucguggccaaccuggacuucaaggugggcuggaagaagcugaaggagguguucagcaucgccggcaccgugaagagagccgacaucaaggaggacaaggacggcaagagcagaggcaugggcaccgugaccuucgagcaggccaucgaggccgugcaggccaucagcauguucaacggccaguuccuguucgacagacccaugcacgugaagauggacgacaagagcgugccccacgaggaguacagaagccacgacggcaagaccccccagcugcccagaggccugggcggcaucggcaugggccugggccccggcggccagcccaucagcgccagccagcugaacaucggcggcgugaugggcaaccugggccccggcggcaugggcauggacggccccggcuucggcggcaugaacagaaucggcggcggcaucggcuucggcggccuggaggccaugaacagcaugggcggcuucggcggcgugggcagaaugggcgagcuguacagaggcgccaugaccagcagcauggagagagacuucggcagaggcgacaucggcaucaacagaggcuucggcgacagcuucggcagacugggcggcggcaugggcagcaugaacagcgugaccggcggcaugggcaugggccuggacagaaugagcagcagcuucgacagaaugggccccggcaucggcgccauccuggagagaagcaucgacauggacagaggcuuccugagcggccccaugggcagcggcaugagagagagaaucggcagcaagggcaaccagaucuucgugagaaaccugcccuucgaccugaccuggcagaagcugaaggagaaguucagccagugcggccacgugauguucgccgagaucaagauggagaacggcaagagcaagggcugcggcaccgugagauucgacagccccgagagcgccgagaaggccugcagaaucaugaacggcaucaagaucagcggcagagagaucgacgugagacuggacagaaacgccuaa

SEQ ID NO: 20206 - RNA, 942 nt, Artificial Sequence
  MYEOV__Homo_sapiens__NP_001280220
auggcccugagaaucugcgugaccuacacccccgcccugcccaucggccugugcaccagaugcugccugugccuggagcagagccccagcuggugccacugccugagaggcgugagcuuccugaccuuccaccugcaccagagcgugccccugggcgacagagacagccugcugauguucaccagacaggccggccacuucguggagggcagcaaggccggcagaagcagaggcagacugugccugagccaggcccugagaguggccgugagaggcgccuucgugagccugugguucgccgccggcgccggcgacagagagagaaacaagggcgacaagggcgcccagaccggcgccggccugagccaggaggccgaggacguggacgugagcagagccagaagagugaccgacgccccccagggcacccugugcggcaccggcaacagaaacagcggcagccagagcgccagaguggugggcguggcccaccugggcgaggccuucagagugggcguggagcaggccaucagcagcugccccgaggaggugcacggcagacacggccugagcauggagaucaugugggccagaauggacguggcccugagaagccccggcagaggccugcuggccggcgccggcgcccugugcaugacccuggccgagagcagcugccccgacuacgagagaggcagaagagccugccugacccugcacagacaccccaccccccacugcagcaccuggggccugccccugagaguggccggcagcuggcugaccguggugaccguggaggcccugggcggcuggagaaugggcgugagaagaaccggccaggugggccccaccaugcaccccccccccgugagcggcgccagcccccugcugcugcaccaccugcugcugcugcugcugaucaucauccugaccugcuaa

SEQ ID NO: 20207 - RNA, 768 nt, Artificial Sequence
  MYF5__Homo_sapiens__NP_005584
auggacgugauggacggcugccaguucagccccagcgaguacuucuacgacggcagcugcauccccagccccgagggcgaguucggcgacgaguucgugcccagaguggccgccuucggcgcccacaaggccgagcugcagggcagcgacgaggacgagcacgugagagcccccaccggccaccaccaggccggccacugccugaugugggccugcaaggccugcaagagaaagagcaccaccauggacagaagaaaggccgccaccaugagagagagaagaagacugaagaaggugaaccaggccuucgagacccugaagagaugcaccaccaccaaccccaaccagagacugcccaagguggagauccugagaaacgccaucagauacaucgagagccugcaggagcugcugagagagcagguggagaacuacuacagccugcccggccagagcugcagcgagcccaccagccccaccagcaacugcagcgacggcaugcccgagugcaacagccccguguggagcagaaagagcagcaccuucgacagcaucuacugccccgacgugagcaacguguacgccaccgacaagaacagccugagcagccuggacugccugagcaacaucguggacagaaucaccagcagcgagcagcccggccugccccugcaggaccuggccagccugagccccguggccagcaccgacagccagcccgccacccccggcgccagcagcagcagacugaucuaccacgugcuguaa

SEQ ID NO: 20208 - RNA, 729 nt, Artificial Sequence
  MYF6__Homo_sapiens__NP_002460
augaugauggaccuguucgagaccggcagcuacuucuucuaccuggacggcgagaacgugacccugcagccccuggagguggccgagggcagcccccuguaccccggcagcgacggcacccugagccccugccaggaccagaugccccccgaggccggcagcgacagcagcggcgaggagcacgugcuggccccccccggccugcagcccccccacugccccggccagugccugaucugggccugcaagaccugcaagagaaagagcgcccccaccgacagaagaaaggccgccacccugagagagagaagaagacugaagaagaucaacgaggccuucgaggcccugaagagaagaaccguggccaaccccaaccagagacugcccaagguggagauccugagaagcgccaucagcuacaucgagagacugcaggaccugcugcacagacuggaccagcaggagaagaugcaggagcugggcguggaccccuucagcuacagacccaagcaggagaaccuggagggcgccgacuuccugagaaccugcagcagccaguggcccagcgugagcgaccacagcagaggccuggugaucaccgccaaggagggcggcgccagcaucgacagcagcgccagcagcagccugagaugccugagcagcaucguggacagcaucagcagcgaggagagaaagcugcccugcguggaggaggugguggagaaguaa

SEQ ID NO: 20209 - RNA, 6024 nt, Artificial Sequence
  MYH10__Homo_sapiens__NP_001242941
auggcccagagaaccggccuggaggaccccgagagauaccuguucguggacagagccgugaucuacaaccccgccacccaggccgacuggaccgccaagaagcugguguggauccccagcgagagacacggcuucgaggccgccagcaucaaggaggagagaggcgacgaggugaugguggagcuggccgagaacggcaagaaggccauggugaacaaggacgacauccagaagaugaacccccccaaguucagcaagguggaggacauggccgagcugaccugccugaacgaggccagcgugcugcacaaccugaaggacagauacuacagcggccugaucuacaccuacagcggccuguucugcguggugaucaaccccuacaagaaccugcccaucuacagcgagaacaucaucgagauguacagaggcaagaagagacacgagaugcccccccacaucuacgccaucagcgagagcgccuacagaugcaugcugcaggacagagaggaccagagcauccugugcaccggcgagagcggcgccggcaagaccgagaacaccaagaaggugauccaguaccuggcccacguggccagcagccacaagggcagaaaggaccacaacaucccccaggagagccccaagcccgugaagcaccagggcgagcuggagagacagcugcugcaggccaaccccauccuggagagcuucggcaacgccaagaccgugaagaacgacaacagcagcagauucggcaaguucaucagaaucaacuucgacgugaccggcuacaucgugggcgccaacaucgagaccuaccugcuggagaagagcagagccgugagacaggccaaggacgagagaaccuuccacaucuucuaccagcugcugagcggcgccggcgagcaccugaagagcgaccugcugcuggagggcuucaacaacuacagauuccugagcaacggcuacauccccauccccggccagcaggacaaggacaacuuccaggagaccauggaggccaugcacaucaugggcuucagccacgaggagauccugagcaugcugaagguggugagcagcgugcugcaguucggcaacaucagcuucaagaaggagagaaacaccgaccaggccagcaugcccgagaacaccguggcccagaagcugugccaccugcugggcaugaacgugauggaguucaccagagccauccugacccccagaaucaaggugggcagagacuacgugcagaaggcccagaccaaggagcaggccgacuucgccguggaggcccuggccaaggccaccuacgagagacuguucagauggcuggugcacagaaucaacaaggcccuggacagaaccaagagacagggcgccagcuucaucggcauccuggacaucgccggcuucgagaucuucgagcugaacagcuucgagcagcugugcaucaacuacaccaacgagaagcugcagcagcuguucaaccacaccauguucauccuggagcaggaggaguaccagagagagggcaucgaguggaacuucaucgacuucggccuggaccugcagcccugcaucgaccugaucgagagacccgccaacccccccggcgugcuggcccugcuggacgaggagugcugguuccccaaggccaccgacaagaccuucguggagaagcuggugcaggagcagggcagccacagcaaguuccagaagcccagacagcugaaggacaaggccgacuucugcaucauccacuacgccggcaagguggacuacaaggccgacgaguggcugaugaagaacauggacccccugaacgacaacguggccacccugcugcaccagagcagcgacagauucguggccgagcuguggaaggacgagauccagaacauccagagagccagcuucuacgacagcgugagcggccugcacgagccccccguggacagaaucgugggccuggaccaggugaccggcaugaccgagaccgccuucggcagcgccuacaagaccaagaagggcauguucagaaccgugggccagcuguacaaggagagccugaccaagcugauggccacccugagaaacaccaaccccaacuucgugagaugcaucauccccaaccacgagaagagagccggcaagcuggacccccaccuggugcuggaccagcugagaugcaacggcgugcuggagggcaucagaaucugcagacagggcuuccccaacagaaucguguuccaggaguucagacagagauacgagauccugacccccaacgccauccccaagggcuucauggacggcaagcaggccugcgagagaaugaucagagcccuggagcuggaccccaaccuguacagaaucggccagagcaagaucuucuucagagccggcgugcuggcccaccuggaggaggagagagaccugaagaucaccgacaucaucaucuucuuccaggccgugugcagaggcuaccuggccagaaaggccuucgccaagaagcagcagcagcugagcgcccugaaggugcugcagagaaacugcgccgccuaccugaagcugagacacuggcagugguggagaguguucaccaaggugaagccccugcugcaggugaccagacaggaggaggagcugcaggccaaggacgaggagcugcugaaggugaaggagaagcagaccaagguggagggcgagcuggaggagauggagagaaagcaccagcagcugcuggaggagaagaacauccuggccgagcagcugcaggccgagaccgagcuguucgccgaggccgaggagaugagagccagacuggccgccaagaagcaggagcuggaggagauccugcacgaccuggagagcagaguggaggaggaggaggagagaaaccagauccugcagaacgagaagaagaagaugcaggcccacauccaggaccuggaggagcagcuggacgaggaggagggcgccagacagaagcugcagcuggagaaggugaccgccgaggccaagaucaagaagauggaggaggagauccugcugcuggaggaccagaacagcaaguucaucaaggagaagaagcugauggaggacagaaucgccgagugcagcagccagcuggccgaggaggaggagaaggccaagaaccuggccaagaucagaaacaagcaggaggugaugaucagcgaccuggaggagagacugaagaaggaggagaagaccagacaggagcuggagaaggccaagagaaagcuggacggcgagaccaccgaccugcaggaccagaucgccgagcugcaggcccagaucgacgagcugaagcugcagcuggccaagaaggaggaggagcugcagggcgcccuggccagaggcgacgacgagacccugcacaagaacaacgcccugaagguggugagagagcugcaggcccagaucgccgagcugcaggaggacuucgagagcgagaaggccagcagaaacaaggccgagaagcagaagagagaccugagcgaggagcuggaggcccugaagaccgagcuggaggacacccuggacaccaccgccgcccagcaggagcugagaaccaagagagagcaggagguggccgagcugaagaaggcccuggaggaggagaccaagaaccacgaggcccagauccaggacaugagacagagacacgccaccgcccuggaggagcugagcgagcagcuggagcaggccaagagauucaaggccaaccuggagaagaacaagcagggccuggagaccgacaacaaggagcuggccugcgaggugaaggugcugcagcaggugaaggccgagagcgagcacaagagaaagaagcuggacgcccaggugcaggagcugcacgccaaggugagcgagggcgacagacugagaguggagcuggccgagaaggccagcaagcugcagaacgagcuggacaacgugagcacccugcuggaggaggccgagaagaagggcaucaaguucgccaaggacgccgccagccuggagagccagcugcaggacacccaggagcugcugcaggaggagaccagacagaagcugaaccugagcagcagaaucagacagcuggaggaggagaagaacagccugcaggagcagcaggaggaggaggaggaggccagaaagaaccuggagaagcaggugcuggcccugcagagccagcuggccgacaccaagaagaagguggacgacgaccugggcaccaucgagagccuggaggaggccaagaagaagcugcugaaggacgccgaggcccugagccagagacuggaggagaaggcccuggccuacgacaagcuggagaagaccaagaacagacugcagcaggagcuggacgaccugaccguggaccuggaccaccagagacagguggccagcaaccuggagaagaagcagaagaaguucgaccagcugcuggccgaggagaagagcaucagcgccagauacgccgaggagagagacagagccgaggccgaggccagagagaaggagaccaaggcccugagccuggccagagcccuggaggaggcccuggaggccaaggaggaguucgagagacagaacaagcagcugagagccgacauggaggaccugaugagcagcaaggacgacgugggcaagaacgugcacgagcuggagaagagcaagagagcccuggagcagcagguggaggagaugagaacccagcuggaggagcuggaggacgagcugcaggccaccgaggacgccaagcugagacuggaggugaacaugcaggccaugaaggcccaguucgagagagaccugcagaccagagacgagcagaacgaggagaagaagagacugcugaucaagcaggugagagagcuggaggccgagcuggaggacgagagaaagcagagagcccuggccguggccagcaagaagaagauggagaucgaccugaaggaccuggaggcccagaucgaggccgccaacaaggccagagacgaggugaucaagcagcugagaaagcugcaggcccagaugaaggacuaccagagagagcuggaggaggccagagccagcagagacgagaucuucgcccagagcaaggagagcgagaagaagcugaagagccuggaggccgagauccugcagcugcaggaggagcuggccagcagcgagagagccagaagacacgccgagcaggagagagacgagcuggccgacgagaucaccaacagcgccagcggcaagagcgcccugcuggacgagaagagaagacuggaggccagaaucgcccagcuggaggaggagcuggaggaggagcagagcaacauggagcugcugaacgacagauucagaaagaccacccugcagguggacacccugaacgccgagcuggccgccgagagaagcgccgcccagaagagcgacaacgccagacagcagcuggagagacagaacaaggagcugaaggccaagcugcaggagcuggagggcgccgugaagagcaaguucaaggccaccaucagcgcccuggaggccaagaucggccagcuggaggagcagcuggagcaggaggccaaggagagagccgccgccaacaagcuggugagaagaaccgagaagaagcugaaggagaucuucaugcagguggaggacgagagaagacacgccgaccaguacaaggagcagauggagaaggccaacgccagaaugaagcagcugaagagacagcuggaggaggccgaggaggaggccaccagagccaacgccagcagaagaaagcugcagagagagcuggacgacgccaccgaggccaacgagggccugagcagagaggugagcacccugaagaacagacugagaagaggcggccccaucagcuucagcagcagcagaagcggcagaagacagcugcaccuggagggcgccagccuggagcugagcgacgacgacaccgagagcaagaccagcgacgugaacgagacccagcccccccagagcgaguaa

SEQ ID NO: 20210 - RNA, 5838 nt, Artificial Sequence
  MYH11__Homo_sapiens__NP_001035202
auggcccagaagggccagcugagcgacgacgagaaguuccuguucguggacaagaacuucaucaacagccccguggcccaggccgacugggccgccaagagacuggugugggugcccagcgagaagcagggcuucgaggccgccagcaucaaggaggagaagggcgacgagguggugguggagcugguggagaacggcaagaaggugaccgugggcaaggacgacauccagaagaugaacccccccaaguucagcaagguggaggacauggccgagcugaccugccugaacgaggccagcgugcugcacaaccugagagagagauacuucagcggccugaucuacaccuacagcggccuguucugcgugguggugaaccccuacaagcaccugcccaucuacagcgagaagaucguggacauguacaagggcaagaagagacacgagaugcccccccacaucuacgccaucgccgacaccgccuacagaagcaugcugcaggacagagaggaccagagcauccugugcaccggcgagagcggcgccggcaagaccgagaacaccaagaaggugauccaguaccuggccgugguggccagcagccacaagggcaagaaggacaccagcaucacccagggccccagcuucgccuacggcgagcuggagaagcagcugcugcaggccaaccccauccuggaggccuucggcaacgccaagaccgugaagaacgacaacagcagcagauucggcaaguucaucagaaucaacuucgacgugaccggcuacaucgugggcgccaacaucgagaccuaccugcuggagaagagcagagccaucagacaggccagagacgagagaaccuuccacaucuucuacuacaugaucgccggcgccaaggagaagaugagaagcgaccugcugcuggagggcuucaacaacuacaccuuccugagcaacggcuucgugcccauccccgccgcccaggacgacgagauguuccaggagaccguggaggccauggccaucaugggcuucagcgaggaggagcagcugagcauccugaagguggugagcagcgugcugcagcugggcaacaucguguucaagaaggagagaaacaccgaccaggccagcaugcccgacaacaccgccgcccagaaggugugccaccugaugggcaucaacgugaccgacuucaccagaagcauccugacccccagaaucaaggugggcagagacguggugcagaaggcccagaccaaggagcaggccgacuucgccguggaggcccuggccaaggccaccuacgagagacuguucagauggauccugaccagagugaacaaggcccuggacaagacccacagacagggcgccagcuuccugggcauccuggacaucgccggcuucgagaucuucgaggugaacagcuucgagcagcugugcaucaacuacaccaacgagaagcugcagcagcuguucaaccacaccauguucauccuggagcaggaggaguaccagagagagggcaucgaguggaacuucaucgacuucggccuggaccugcagcccugcaucgagcugaucgagagacccaacaacccccccggcgugcuggcccugcuggacgaggagugcugguuccccaaggccaccgacaagagcuucguggagaagcugugcaccgagcagggcagccaccccaaguuccagaagcccaagcagcugaaggacaagaccgaguucagcaucauccacuacgccggcaagguggacuacaacgccagcgccuggcugaccaagaacauggacccccugaacgacaacgugaccagccugcugaacgccagcagcgacaaguucguggccgaccuguggaaggacguggacagaaucgugggccuggaccagauggccaagaugaccgagagcagccugcccagcgccagcaagaccaagaagggcauguucagaaccgugggccagcuguacaaggagcagcugggcaagcugaugaccacccugagaaacaccacccccaacuucgugagaugcaucauccccaaccacgagaagagaagcggcaagcuggacgccuuccuggugcuggagcagcugagaugcaacggcgugcuggagggcaucagaaucugcagacagggcuuccccaacagaaucguguuccaggaguucagacagagauacgagauccuggccgccaacgccauccccaagggcuucauggacggcaagcaggccugcauccugaugaucaaggcccuggagcuggaccccaaccuguacagaaucggccagagcaagaucuucuucagaaccggcgugcuggcccaccuggaggaggagagagaccugaagaucaccgacgugaucauggccuuccaggccaugugcagaggcuaccuggccagaaaggccuucgccaagagacagcagcagcugaccgccaugaaggugauccagagaaacugcgccgccuaccugaagcugagaaacuggcagugguggagacuguucaccaaggugaagccccugcugcaggugaccagacaggaggaggagaugcaggccaaggaggacgagcugcagaagaccaaggagagacagcagaaggccgagaacgagcugaaggagcuggagcagaagcacagccagcugaccgaggagaagaaccugcugcaggagcagcugcaggccgagaccgagcuguacgccgaggccgaggagaugagagugagacuggccgccaagaagcaggagcuggaggagauccugcacgagauggaggccagacuggaggaggaggaggacagaggccagcagcugcaggccgagagaaagaagauggcccagcagaugcuggaccuggaggagcagcuggaggaggaggaggccgccagacagaagcugcagcuggagaaggugaccgccgaggccaagaucaagaagcuggaggacgagauccuggugauggacgaccagaacaacaagcugagcaaggagagaaagcugcuggaggagagaaucagcgaccugaccaccaaccuggccgaggaggaggagaaggccaagaaccugaccaagcugaagaacaagcacgagagcaugaucagcgagcuggaggugagacugaagaaggaggagaagagcagacaggagcuggagaagcugaagagaaagcuggagggcgacgccagcgacuuccacgagcagaucgccgaccugcaggcccagaucgccgagcugaagaugcagcuggccaagaaggaggaggagcugcaggccgcccuggccagacuggacgacgagaucgcccagaagaacaacgcccugaagaagaucagagagcuggagggccacaucagcgaccugcaggaggaccuggacagcgagagagccgccagaaacaaggccgagaagcagaagagagaccugggcgaggagcuggaggcccugaagaccgagcuggaggacacccuggacagcaccgccacccagcaggagcugagagccaagagagagcaggaggugaccgugcugaagaaggcccuggacgaggagaccagaagccacgaggcccaggugcaggagaugagacagaagcacgcccaggccguggaggagcugaccgagcagcuggagcaguucaagagagccaaggccaaccuggacaagaacaagcagacccuggagaaggagaacgccgaccuggccggcgagcugagagugcugggccaggccaagcaggagguggagcacaagaagaagaagcuggaggcccaggugcaggagcugcagagcaagugcagcgacggcgagagagccagagccgagcugaacgacaaggugcacaagcugcagaacgagguggagagcgugaccggcaugcugaacgaggccgagggcaaggccaucaagcuggccaaggacguggccagccugagcagccagcugcaggacacccaggagcugcugcaggaggagaccagacagaagcugaacgugagcaccaagcugagacagcuggaggaggagagaaacagccugcaggaccagcuggacgaggagauggaggccaagcagaaccuggagagacacaucagcacccugaacauccagcugagcgacagcaagaagaagcugcaggacuucgccagcaccguggaggcccuggaggagggcaagaagagauuccagaaggagaucgagaaccugacccagcaguacgaggagaaggccgccgccuacgacaagcuggagaagaccaagaacagacugcagcaggagcuggacgaccuggugguggaccuggacaaccagagacagcuggugagcaaccuggagaagaagcagagaaaguucgaccagcugcuggccgaggagaagaacaucagcagcaaguacgccgacgagagagacagagccgaggccgaggccagagagaaggagaccaaggcccugagccuggccagagcccuggaggaggcccuggaggccaaggaggagcuggagagaaccaacaagaugcugaaggccgagauggaggaccuggugagcagcaaggacgacgugggcaagaacgugcacgagcuggagaagagcaagagagcccuggagacccagauggaggagaugaagacccagcuggaggagcuggaggacgagcugcaggccaccgaggacgccaagcugagacuggaggugaacaugcaggcccugaagggccaguucgagagagaccugcaggccagagacgagcagaacgaggagaagagaagacagcugcagagacagcugcacgaguacgagaccgagcuggaggacgagagaaagcagagagcccuggccgccgccgccaagaagaagcuggagggcgaccugaaggaccuggagcugcaggccgacagcgccaucaagggcagagaggaggccaucaagcagcugagaaagcugcaggcccagaugaaggacuuccagagagagcuggaggacgccagagccagcagagacgagaucuucgccaccgccaaggagaacgagaagaaggccaagagccuggaggccgaccugaugcagcugcaggaggaccuggccgccgccgagagagccagaaagcaggccgaccuggagaaggaggagcuggccgaggagcuggccagcagccugagcggcagaaacgcccugcaggacgagaagagaagacuggaggccagaaucgcccagcuggaggaggagcuggaggaggagcagggcaacauggaggccaugagcgacagagugagaaaggccacccagcaggccgagcagcugagcaacgagcuggccaccgagagaagcaccgcccagaagaacgagagcgccagacagcagcuggagagacagaacaaggagcugagaagcaagcugcacgagauggagggcgccgugaagagcaaguucaagagcaccaucgccgcccuggaggccaagaucgcccagcuggaggagcagguggagcaggaggccagagagaagcaggccgccaccaagagccugaagcagaaggacaagaagcugaaggagauccugcugcagguggaggacgagagaaagauggccgagcaguacaaggagcaggccgagaagggcaacgccagagugaagcagcugaagagacagcuggaggaggccgaggaggagagccagagaaucaacgccaacagaagaaagcugcagagagagcuggacgaggccaccgagagcaacgaggccaugggcagagaggugaacgcccugaagagcaagcugagaggcccccccccccaggagaccagccaguaa

SEQ ID NO: 20211 - RNA, 5817 nt, Artificial Sequence
  MYH13__Homo_sapiens__NP_003793
augagcagcgacgccgagauggccaucuucggcgaggccgcccccuaccugagaaagcccgagaaggagagaaucgaggcccagaacagacccuucgacagcaagaaggccugcuucguggccgacaacaaggagauguacgugaagggcaugauccagaccagagagaacgacaaggugaucgugaagacccuggacgacagaaugcugacccugaacaacgaccagguguuccccaugaacccccccaaguucgacaagaucgaggacauggccaugaugacccaccugcacgagcccgccgugcuguacaaccugaaggagagauacgccgccuggaugaucuacaccuacagcggccuguucugcgugaccgugaaccccuacaaguggcugcccguguacaagcccgaggugguggccgccuacagaggcaagaagagacaggaggcccccccccacaucuucagcaucagcgacaacgccuaccaguucaugcugaccgacagagacaaccagagcauccugaucaccggcgagagcggcgccggcaagaccgugaacaccaagagagugauccaguacuucgccaccaucgccgugaccggcgacaagaagaaggagacccagcccggcaagaugcagggcacccuggaggaccagaucauccaggccaacccccugcuggaggccuucggcaacgccaagaccgugagaaacgacaacagcagcagauucggcaaguucaucagaauccacuucggcgccaccggcaagcuggccagcgccgacaucgagaccuaccugcuggagaagagcagagugaccuuccagcugagcagcgagagaagcuaccacaucuucuaccagaucaugagcaacaagaagcccgagcugaucgaccugcugcugaucagcaccaaccccuucgacuuccccuucgugagccagggcgaggugaccguggccagcaucgacgacagcgaggagcugcuggccaccgacaacgccaucgacauccugggcuucagcagcgaggagaaggugggcaucuacaagcugaccggcgccgugaugcacuacggcaacaugaaguucaagcagaagcagagagaggagcaggccgagcccgacggcaccgagguggccgacaaggccggcuaccugaugggccugaacagcgccgagaugcugaagggccugugcugccccagagugaaggugggcaacgaguacgugaccaagggccagaacgugcagcaggugaccaacagcgugggcgcccuggccaaggccguguacgagaagauguuccuguggauggugaccagaaucaaccagcagcuggacaccaagcagcccagacaguacuucaucggcgugcuggacaucgccggcuucgagaucuucgacuucaacagccuggagcagcugugcaucaacuucaccaacgagaagcugcagcaguucuucaaccaccacauguucgugcuggagcaggaggaguacaagaaggagggcaucgagugggaguucaucgacuucggcauggaccuggccgccugcaucgagcugaucgagaagcccaugggcaucuucagcauccuggaggaggagugcauguuccccaaggccaccgacaccagcuucaagaacaagcuguacgaccagcaccugggcaagagcaacaacuuccagaagcccaagcccgccaagggcaaggccgaggcccacuucagccuggugcacuacgccggcaccguggacuacaacaucgccggcuggcuggacaagaacaaggacccccugaacgagaccguggugggccuguaccagaagagcagccugaagcugcugagcuuccuguucagcaacuacgccggcgccgagaccggcgacagcggcggcagcaagaagggcggcaagaagaagggcagcagcuuccagaccgugagcgccguguucagagagaaccugaacaagcugaugaccaaccugagaagcacccacccccacuucgugagaugccugauccccaacgagaccaagacccccggcgugauggaccacuaccuggugaugcaccagcugagaugcaacggcgugcuggagggcaucagaaucugcagaaagggcuuccccagcagaauccuguacgccgacuucaagcagagauacagaauccugaacgccagcgccauccccgagggccaguucaucgacagcaagaacgccagcgagaagcugcugaacagcaucgacguggacagagagcaguucagauucggcaacaccaagguguucuucaaggccggccugcugggccugcuggaggagaugagagacgagaagcuggugacccugaugaccagcacccaggccgugugcagaggcuaccugaugagaguggaguucaagaagaugauggagagaagagacagcaucuucugcauccaguacaacaucagaagcuucaugaacgugaagcacuggcccuggaugaaccuguucuucaagaucaagccccugcugaagagcgccgaggccgagaaggagauggccaccaugaaggaggacuucgagagaaccaaggaggagcuggccagaagcgaggccagaagaaaggagcuggaggagaagauggugagccugcugcaggagaagaacgaccugcagcugcaggugcagagcgagaccgagaaccugauggacgccgaggagagaugcgagggccugaucaagagcaagauccugcuggaggccaaggugaaggagcugaccgagagacuggaggaggaggaggagaugaacagcgagcugguggccaagaagagaaaccuggaggacaagugcagcagccugaagagagacaucgacgaccuggagcugacccugaccaagguggagaaggagaagcacgccaccgagaacaaggugaagaaccugagcgaggagaugaccgcccuggaggagaacaucagcaagcugaccaaggagaagaagagccugcaggaggcccaccagcagacccuggacgaccugcagguggaggaggacaaggugaacggccugaucaagaucaacgccaagcuggagcagcagaccgacgaccuggagggcagccuggagcaggagaagaagcugagagccgaccuggagagagccaagagaaagcuggagggcgaccugaagaugagccaggagagcaucauggaccuggagaacgacaagcagcagaucgaggagaagcugaagaagaaggaguucgagcugagccagcugcaggccaagaucgacgacgagcaggugcacagccugcaguuccagaagaagaucaaggagcugcaggccagaaucgaggagcuggaggaggagaucgaggccgagcacacccugagagccaagaucgagaagcagagaagcgaccuggccagagagcuggaggagaucagcgagagacuggaggaggccagcggcgccaccagcgcccagaucgagaugaacaagaagagagaggccgaguuccagaagaugagaagagaccuggaggaggccacccugcagcacgaggccaccgccgccacccugagaaagaagcaggccgacagcguggccgagcugggcgagcagaucgacaaccugcagagagugaagcagaagcuggagaaggagaagagcgagcugaagauggagaucgacgacauggccagcaacaucgaggcccugagcaagagcaagagcaacaucgagagaaccugcagaaccguggaggaccaguucagcgagaucaaggccaaggacgagcagcagacccagcugauccacgaccugaacaugcagaaggccagacugcagacccagaacggcgagcugagccacagaguggaggagaaggagagccugaucagccagcugaccaagagcaagcaggcccugacccagcagcuggaggagcugaagagacagauggaggaggagaccaaggccaagaacgccauggcccacgcccugcagagcagcagacacgacugcgaccugcugagagagcaguacgaggaggagcaggaggccaaggccgagcugcagagagcccugagcaaggccaacagcgagguggcccaguggagaaccaaguacgagaccgacgccauccagagaaccgaggagcuggaggaggccaagaagaagcuggcccagagacugcaggaggccgaggagaacaccgagaccgccaacagcaagugcgccagccuggagaagaccaagcagagacugcagggcgagguggaggaccugaugagagaccuggagagaagccacaccgccugcgccacccuggacaagaagcagagaaacuucgacaaggugcuggccgaguggaagcagaagcuggacgagagccaggccgagcuggaggccgcccagaaggagagcagaagccugagcaccgagcuguucaagaugagaaacgccuacgaggaggugguggaccagcuggagacccugagaagagagaacaagaaccugcaggaggagaucagcgaccugaccgagcagaucgccgagaccggcaagaaccugcaggaggccgagaagaccaagaagcugguggagcaggagaagagcgaccugcagguggcccuggaggagguggagggcagccuggagcacgaggagagcaagauccugagagugcagcuggagcugagccaggugaagagcgagcuggacagaaaggugaucgagaaggacgaggagaucgagcagcugaagagaaacagccagagagccgccgaggcccugcagagcgugcuggacgccgagaucagaagcagaaacgacgcccugagacugaagaagaagauggagggcgaccugaacgagauggagauccagcugggccacagcaacagacagauggccgagacccagaagcaccugagaaccgugcagggccagcugaaggacagccagcugcaccuggacgacgcccugagaagcaacgaggaccugaaggagcagcuggccaucguggagagaagaaacggccugcugcuggaggagcuggaggagaugaagguggcccuggagcagaccgagagaaccagaagacugagcgagcaggagcugcuggacgccagcgacagagugcagcugcugcacagccagaacaccagccugaucaacaccaagaagaagcuggaggccgacaucgcccagugccaggccgagguggagaacagcauccaggagagcagaaacgccgaggagaaggccaagaaggccaucaccgacgccgccaugauggccgaggagcugaagaaggagcaggacaccagcgcccaccuggagagaaugaagaagaaccuggagcagaccgugaaggaccugcagcacagacuggacgaggccgagcagcuggcccugaagggcggcaagaagcagauccagaagcuggagaacagagugagagagcuggagaacgagcuggacguggagcagaagagaggcgccgaggcccugaagggcgcccacaaguacgagagaaaggugaaggagaugaccuaccaggccgaggaggaccacaagaacauccugagacugcaggaccugguggacaagcugcaggccaaggugaagagcuacaagagacaggccgaggaggccgaggagcaggccaacacccagcugagcagaugcagaagagugcagcacgagcuggaggaggccgccgagagagccgacaucgccgagagccaggugaacaagcugagagccaagagcagagacgugggcagccagaagauggaggaguaa

SEQ ID NO: 20212 - RNA, 6111 nt, Artificial Sequence
  MYH14__Homo_sapiens__NP_001139281
auggccgccgugaccaugagcgugcccggcagaaaggccccccccagacccggccccgugcccgaggccgcccagcccuuccuguucacccccagaggccccagcgccggcggcggccccggcagcggcaccagcccccagguggaguggaccgccagaagacuggugugggugcccagcgagcugcacggcuucgaggccgccgcccugagagacgagggcgaggaggaggccgagguggagcuggccgagagcggcagaagacugagacugcccagagaccagauccagagaaugaacccccccaaguucagcaaggccgaggacauggccgagcugaccugccugaacgaggccagcgugcugcacaaccugagagagagauacuacagcggccugaucuacaccuacagcggccuguucugcguggugaucaaccccuacaagcagcugcccaucuacaccgaggccaucguggagauguacagaggcaagaagagacacgaggugcccccccacguguacgccgugaccgagggcgccuacagaagcaugcugcaggacagagaggaccagagcauccugugcaccggcgagagcggcgccggcaagaccgagaacaccaagaaggugauccaguaccuggcccacguggccagcagccccaagggcagaaaggagcccggcgugcccgccagcgugagcaccgugagcuacggcgagcuggagagacagcugcugcaggccaaccccauccuggaggccuucggcaacgccaagaccgugaagaacgacaacagcagcagauucggcaaguucaucagaaucaacuucgacguggccggcuacaucgugggcgccaacaucgagaccuaccugcuggagaagagcagagccaucagacaggccaaggacgagugcagcuuccacaucuucuaccagcugcugggcggcgccggcgagcagcugaaggccgaccugcugcuggagcccugcagccacuacagauuccugaccaacggccccagcagcagccccggccaggagagagagcuguuccaggagacccuggagagccugagagugcugggcuucagccacgaggagaucaucagcaugcugagaauggugagcgccgugcugcaguucggcaacaucgcccugaagagagagagaaacaccgaccaggccaccaugcccgacaacaccgccgcccagaagcugugcagacugcugggccugggcgugaccgacuucagcagagcccugcugacccccagaaucaaggugggcagagacuacgugcagaaggcccagaccaaggagcaggccgacuucgcccuggaggcccuggccaaggccaccuacgagagacuguucagauggcuggugcugagacugaacagagcccuggacagaagccccagacagggcgccagcuuccugggcauccuggacaucgccggcuucgagaucuuccagcugaacagcuucgagcagcugugcaucaacuacaccaacgagaagcugcagcagcuguucaaccacaccauguucgugcuggagcaggaggaguaccagagagagggcauccccuggaccuuccuggacuucggccuggaccugcagcccugcaucgaccugaucgagagacccgccaacccccccggccugcuggcccugcuggacgaggagugcugguuccccaaggccaccgacaagagcuucguggagaagguggcccaggagcagggcggccaccccaaguuccagagacccagacaccugagagaccaggccgacuucagcgugcugcacuacgccggcaagguggacuacaaggccaacgaguggcugaugaagaacauggacccccugaacgacaacguggccgcccugcugcaccagagcaccgacagacugaccgccgagaucuggaaggacgagcacggcggcuuccagcaguucagcuuccugggcagcuucccccccagcccccccggcagcgccgagagaugcagcagcgccaucagcccccccggcguggagggcaucgugggccuggagcaggugagcagccugggcgacggcccccccggcggcagacccagaagaggcauguucagaaccgugggccagcuguacaaggagagccugagcagacugauggccacccugagcaacaccaaccccagcuucgugagaugcaucgugcccaaccacgagaagagagccggcaagcuggagcccagacuggugcuggaccagcugagaugcaacggcgugcuggagggcaucagaaucugcagacagggcuuccccaacagaauccuguuccaggaguucagacagagauacgagauccugacccccaacgccauccccaagggcuucauggacggcaagcaggccugcgagaagaugauccaggcccuggagcuggaccccaaccuguacagagugggccagagcaagaucuucuucagagccggcgugcuggcccagcuggaggaggagagagaccugaaggugaccgacaucaucgugagcuuccaggccgccgccagaggcuaccuggccagaagagccuuccagaagagacagcagcagcagagcgcccugagagugaugcagagaaacugcgccgccuaccugaagcugagacacuggcagugguggagacuguucaccaaggugaagccccugcugcaggugaccagacaggacgaggugcugcaggccagagcccaggagcugcagaaggugcaggagcugcagcagcagagcgccagagaggugggcgagcugcagggcagaguggcccagcuggaggaggagagagccagacuggccgagcagcugagagccgaggccgagcugugcgccgaggccgaggagaccagaggcagacuggccgccagaaagcaggagcuggagcugguggugagcgagcuggaggccagagugggcgaggaggaggagugcagcagacagaugcagaccgagaagaagagacugcagcagcacauccaggagcuggaggcccaccuggaggccgaggagggcgccagacagaagcugcagcuggagaaggugaccaccgaggccaagaugaagaaguucgaggaggaccugcugcugcuggaggaccagaacagcaagcugagcaaggagagaaagcugcuggaggacagacuggccgaguucagcagccaggccgccgaggaggaggagaaggugaagagccugaacaagcugagacugaaguacgaggccaccaucgccgacauggaggacagacugagaaaggaggagaagggcagacaggagcuggagaagcugaagagaagacuggacggcgagagcagcgagcugcaggagcagaugguggagcagcagcagagagccgaggagcugagagcccagcugggcagaaaggaggaggagcugcaggccgcccuggccagagccgaggacgagggcggcgccagagcccagcugcugaagagccugagagaggcccaggccgcccuggccgaggcccaggaggaccuggagagcgagagaguggccagaaccaaggccgagaagcagagaagagaccugggcgaggagcuggaggcccugagaggcgagcuggaggacacccuggacagcaccaacgcccagcaggagcugagaagcaagagagagcaggaggugaccgagcugaagaagacccuggaggaggagaccagaauccacgaggccgccgugcaggagcugagacagagacacggccaggcccugggcgagcuggccgagcagcuggagcaggccagaagaggcaagggcgccugggagaagaccagacuggcccuggaggccgaggugagcgagcugagagccgagcugagcagccugcagaccgccagacaggagggcgagcagagaagaagaagacuggagcugcagcugcaggaggugcagggcagagccggcgacggcgagagagccagagccgaggccgccgagaagcugcagagagcccaggccgagcuggagaacgugagcggcgcccugaacgaggccgagagcaagaccaucagacugagcaaggagcugagcagcaccgaggcccagcugcacgacgcccaggagcugcugcaggaggagaccagagccaagcuggcccugggcagcagagugagagccauggaggccgaggccgccggccugagagagcagcuggaggaggaggccgccgccagagagagagccggcagagagcugcagaccgcccaggcccagcugagcgaguggagaagaagacaggaggaggaggccggcgcccuggaggccggcgaggaggccagaagaagagccgccagagaggccgaggcccugacccagagacuggccgagaagaccgagaccguggacagacuggagagaggcagaagaagacugcagcaggagcuggacgacgccaccauggaccuggagcagcagagacagcuggugagcacccuggagaagaagcagagaaaguucgaccagcugcuggccgaggagaaggccgccgugcugagagccguggaggagagagagagagccgaggccgagggcagagagagagaggccagagcccugagccugaccagagcccuggaggaggagcaggaggccagagaggagcuggagagacagaacagagcccugagagccgagcuggaggcccugcugagcagcaaggacgacgugggcaagagcgugcacgagcuggagagagccugcagaguggccgagcaggccgccaacgaccugagagcccaggugaccgagcuggaggacgagcugaccgccgccgaggacgccaagcugagacuggaggugaccgugcaggcccugaagacccagcacgagagagaccugcagggcagagacgaggccggcgaggagagaagaagacagcuggccaagcagcugagagacgccgagguggagagagacgaggagagaaagcagagaacccuggccguggccgccagaaagaagcuggagggcgagcuggaggagcugaaggcccagauggccagcgccggccagggcaaggaggaggccgugaagcagcugagaaagaugcaggcccagaugaaggagcuguggagagagguggaggagaccagaaccagcagagaggagaucuucagccagaacagagagagcgagaagagacugaagggccuggaggccgaggugcugagacugcaggaggagcuggccgccagcgacagagccagaagacaggcccagcaggacagagacgagauggccgacgagguggccaacggcaaccugagcaaggccgccauccuggaggagaagagacagcuggagggcagacugggccagcuggaggaggagcuggaggaggagcagagcaacagcgagcugcugaacgacagauacagaaagcugcugcugcagguggagagccugaccaccgagcugagcgccgagagaagcuucagcgccaaggccgagagcggcagacagcagcuggagagacagauccaggagcugagaggcagacugggcgaggaggacgccggcgccagagccagacacaagaugaccaucgccgcccuggagagcaagcuggcccaggccgaggagcagcuggagcaggagaccagagagagaauccugagcggcaagcuggugagaagagccgagaagagacugaaggagguggugcugcagguggaggaggagagaagaguggccgaccagcugagagaccagcuggagaagggcaaccugagagugaagcagcugaagagacagcuggaggaggccgaggaggaggccagcagagcccaggccggcagaagaagacugcagagagagcuggaggacgugaccgagagcgccgagagcaugaacagagaggugaccacccugagaaacagacugagaagaggcccccugaccuucaccaccagaaccgugagacagguguucagacuggaggagggcguggccagcgacgaggaggccgaggaggcccagcccggcagcggccccagccccgagcccgagggcagcccccccgcccacccccaguaa

SEQ ID NO: 20213 - RNA, 5841 nt, Artificial Sequence
  MYH15__Homo_sapiens__NP_055796
augguggagagcugccugcugaccuucagagccuucuucugguggaucgcccugaucaagauggaccugagcgaccugggcgaggccgccgccuuccugagaagaagcgaggccgagcugcugcugcugcaggccaccgcccuggacggcaagaagaagugcuggauccccgacggcgagaacgccuacaucgaggccgaggugaagggcagcgaggacgacggcaccgugaucguggagaccgccgacggcgagagccugagcaucaaggaggacaagauccagcagaugaacccccccgaguucgagaugaucgaggacauggccaugcugacccaccugaacgaggccagcgugcugcacacccugaagagaagauacggccaguggaugaucuacaccuacagcggccuguucugcgugaccaucaaccccuacaaguggcugcccguguaccagaaggaggugauggccgccuacaagggcaagagaagaagcgaggcccccccccacaucuucgccguggccaacaacgccuuccaggacaugcugcacaacagagagaaccagagcauccuguucaccggcgagagcggcgccggcaagaccgugaacagcaagcacaucauccaguacuucgccaccaucgccgccaugaucgagagcagaaagaagcagggcgcccuggaggaccagaucaugcaggccaacaccauccuggaggccuucggcaacgccaagacccugagaaacgacaacagcagcagauucggcaaguucaucagaaugcacuucggcgccagaggcaugcugagcagcguggacaucgacaucuaccugcuggagaagagcagagugaucuuccagcaggccggcgagagaaacuaccacaucuucuaccagauccugagcggccagaaggagcugcacgaccugcugcuggugagcgccaaccccagcgacuuccacuucugcagcugcggcgccgugaccguggagagccuggacgacgccgaggagcugcuggccaccgagcaggccauggacauccugggcuuccugcccgacgagaaguacggcugcuacaagcugaccggcgccaucaugcacuucggcaacaugaaguucaagcagaagcccagagaggagcagcuggaggccgacggcaccgagaacgccgacaaggccgccuuccugaugggcaucaacagcagcgagcuggugaagugccugauccaccccagaaucaaggugggcaacgaguacgugaccagaggccagaccaucgagcaggugaccugcgccgugggcgcccugagcaagagcauguacgagagaauguucaaguggcugguggccagaaucaacagagcccuggacgccaagcugagcagacaguucuucaucggcauccuggacaucaccggcuucgagauccuggaguacaacagccuggagcagcugugcaucaacuucaccaacgagaagcugcagcaguucuucaacuggcacauguucgugcuggagcaggaggaguacaagaaggagagcaucgagugggugagcaucggcuucggccuggaccugcaggccugcaucgaccugaucgagaagcccaugggcauccugagcauccuggaggaggagugcauguuccccaaggccaccgaccugaccuucaagaccaagcuguucgacaaccacuucggcaagagcgugcaccugcagaagcccaagcccgacaagaagaaguucgaggcccacuucgagcuggugcacuacgccggcguggugcccuacaacaucagcggcuggcuggagaagaacaaggaccugcugaacgagaccgugguggccguguuccagaagagcagcaacagacugcuggccagccuguucgagaacuacaugagcaccgacagcgccauccccuucggcgagaagaagagaaagaagggcgccagcuuccagaccguggccagccugcacaaggagaaccugaacaagcugaugaccaaccugaagagcaccgccccccacuucgugagaugcaucaaccccaacgugaacaagauccccggcauccuggaccccuaccuggugcugcagcagcugagaugcaacggcgugcuggagggcaccagaaucugcagagagggcuuccccaacagacugcaguacgccgacuucaagcagagauacugcauccugaaccccagaaccuuccccaagagcaaguucgugagcagcagaaaggccgccgaggagcugcugggcagccuggagaucgaccacacccaguacagauucggcaucaccaagguguucuucaaggccggcuuccugggccagcuggaggccaucagagacgagagacugagcaagguguucacccuguuccaggccagagcccagggcaagcugaugagaaucaaguuccagaagauccuggaggagagagacgcccugauccugauccaguggaacaucagagccuucauggccgugaagaacuggcccuggaugagacuguucuucaagaucaagccccuggugaagagcagcgaggugggcgaggagguggccggccugaaggaggagugcgcccagcugcagaaggcccuggagaagagcgaguuccagagagaggagcugaaggccaagcaggugagccugacccaggagaagaacgaccugauccugcagcugcaggccgagcaggagacccuggccaacguggaggagcagugcgaguggcugaucaagagcaagauccagcuggaggccagagugaaggagcugagcgagagaguggaggaggaggaggagaucaacagcgagcugaccgccagaggcagaaagcuggaggacgagugcuucgagcugaagaaggagaucgacgaccuggagaccaugcuggugaagagcgagaaggagaagagaaccaccgagcacaaggugaagaaccugaccgaggagguggaguuccugaacgaggacaucagcaagcugaacagagccgccaagguggugcaggaggcccaccagcagacccuggacgaccugcacauggaggaggagaagcugagcagccugagcaaggccaaccugaagcuggagcagcagguggacgagcuggagggcgcccuggagcaggagagaaaggccagaaugaacugcgagagagagcugcacaagcuggagggcaaccugaagcugaacagagagagcauggagaaccuggagagcagccagagacaccuggccgaggagcugagaaagaaggagcuggagcugagccagaugaacagcaagguggagaacgagaagggccugguggcccagcugcagaagaccgugaaggagcugcagacccagaucaaggaccugaaggagaagcuggaggccgagagaaccaccagagccaagauggagagagagagagccgaccugacccaggaccuggccgaccugaacgagagacuggaggaggugggcggcagcagccuggcccagcuggagaucaccaagaagcaggagaccaaguuccagaagcugcacagagacauggaggaggccacccugcacuucgagaccaccagcgccagccugaagaagagacacgccgacagccuggccgagcuggagggccagguggagaaccugcagcaggugaagcagaagcuggagaaggacaagagcgaccugcagcuggagguggacgaccugcugaccagaguggagcagaugaccagagccaaggccaacgccgagaagcugugcacccuguacgaggagagacugcacgaggccaccgccaagcuggacaaggugacccagcuggccaacgaccuggccgcccagaagaccaagcuguggagcgagagcggcgaguuccugagaagacuggaggagaaggaggcccugaucaaccagcugagcagagagaagagcaacuucaccagacagaucgaggaccugagaggccagcuggagaaggagaccaagagccagagcgcccuggcccacgcccugcagaaggcccagagagacugcgaccugcugagagagcaguacgaggaggagcaggaggugaaggccgagcugcacagaacccugagcaaggugaacgccgagauggugcaguggagaaugaaguacgagaacaacgugauccagagaaccgaggaccuggaggacgccaagaaggagcuggccaucagacugcaggaggccgccgaggccaugggcguggccaacgccagaaacgccagccuggagagagccagacaccagcugcagcuggagcugggcgacgcccugagcgaccugggcaaggugagaagcgccgccgccagacuggaccagaagcagcugcagagcggcaaggcccuggccgacuggaagcagaagcacgaggagagccaggcccugcuggacgccagccagaaggaggugcaggcccugagcaccgagcugcugaagcugaagaacaccuacgaggagagcaucgugggccaggagacccugagaagagagaacaagaaccugcaggaggagaucagcaaccugaccaaccaggugagagagggcaccaagaaccugaccgagauggagaaggugaagaagcugaucgaggaggagaagaccgaggugcaggugacccuggaggagaccgagggcgcccuggagagaaacgagagcaagauccugcacuuccagcuggagcugcuggaggccaaggccgagcuggagagaaagcugagcgagaaggacgaggagaucgagaacuucagaagaaagcagcagugcaccaucgacagccugcagagcagccuggacagcgaggccaagagcagaaucgaggugaccagacugaagaagaagauggaggaggaccugaacgagauggagcugcagcugagcugcgccaacagacaggugagcgaggccaccaagagccugggccagcugcagauccagaucaaggaccugcagaugcagcuggacgacagcacccagcugaacagcgaccugaaggagcagguggccguggccgagagaagaaacagccugcugcagagcgagcuggaggaccugagaagccugcaggagcagaccgagagaggcagaagacugagcgaggaggagcugcuggaggccaccgagagaaucaaccuguucuacacccagaacaccagccugcugagccagaagaagaagcuggaggccgacguggccagaaugcagaaggaggccgaggagguggugcaggagugccagaacgccgaggagaaggccaagaaggccgccaucgaggccgccaaccugagcgaggagcugaagaagaagcaggacaccaucgcccaccuggagagaaccagagagaacauggagcagaccaucaccgaccugcagaagagacuggccgaggccgagcagauggcccugaugggcagcagaaagcagauccagaagcuggagagcagagugagagagcuggagggcgagcuggagggcgagaucagaagaagcgccgaggcccagagaggcgccagaagacuggagagaugcaucaaggagcugaccuaccaggccgaggaggacaagaagaaccugagcagaaugcagacccagauggacaagcugcagcugaaggugcagaacuacaagcagcagguggagguggccgagacccaggccaaccaguaccugagcaaguacaagaagcagcagcacgagcugaacgaggugaaggagagagccgagguggccgagagccaggugaacaagcugaagaucaaggccagagaguucggcaagaaggugcaggaggaguaa

SEQ ID NO: 20214 - RNA, 5820 nt, Artificial Sequence
  MYH1__Homo_sapiens__NP_005954
augagcagcgacagcgagauggccaucuucggcgaggccgcccccuuccugagaaagagcgagagagagagaaucgaggcccagaacaagcccuucgacgccaagaccagcguguucgugguggaccccaaggagagcuucgugaaggccaccgugcagagcagagagggcggcaaggugaccgccaagaccgaggccggcgccaccgugaccgugaaggacgaccagguguuccccaugaacccccccaaguacgacaagaucgaggacauggccaugaugacccaccugcacgagcccgccgugcuguacaaccugaaggagagauacgccgccuggaugaucuacaccuacagcggccuguucugcgugaccgugaaccccuacaaguggcugcccguguacaacgccgagguggugaccgccuacagaggcaagaagagacaggaggcccccccccacaucuucagcaucagcgacaacgccuaccaguucaugcugaccgacagagagaaccagagcauccugaucaccggcgagagcggcgccggcaagaccgugaacaccaagagagugauccaguacuucgccaccaucgccgugaccggcgagaagaagaaggaggaggugaccagcggcaagaugcagggcacccuggaggaccagaucaucagcgccaacccccugcuggaggccuucggcaacgccaagaccgugagaaacgacaacagcagcagauucggcaaguucaucagaauccacuucggcaccaccggcaagcuggccagcgccgacaucgagaccuaccugcuggagaagagcagagugaccuuccagcugaaggccgagagaagcuaccacaucuucuaccagaucaugagcaacaagaagcccgaccugaucgagaugcugcugaucaccaccaaccccuacgacuacgccuucgugagccagggcgagaucaccgugcccagcaucgacgaccaggaggagcugauggccaccgacagcgccaucgagauccugggcuucaccagcgacgagagagugagcaucuacaagcugaccggcgccgugaugcacuacggcaacaugaaguucaagcagaagcagagagaggagcaggccgagcccgacggcaccgagguggccgacaaggccgccuaccugcagaaccugaacagcgccgaccugcugaaggcccugugcuaccccagagugaaggugggcaacgaguacgugaccaagggccagaccgugcagcagguguacaacgccgugggcgcccuggccaaggccguguacgacaagauguuccuguggauggugaccagaaucaaccagcagcuggacaccaagcagcccagacaguacuucaucggcgugcuggacaucgccggcuucgagaucuucgacuucaacagccuggagcagcugugcaucaacuucaccaacgagaagcugcagcaguucuucaaccaccacauguucgugcuggagcaggaggaguacaagaaggagggcaucgaguggaccuucaucgacuucggcauggaccuggccgccugcaucgagcugaucgagaagcccaugggcaucuucagcauccuggaggaggagugcauguuccccaaggccaccgacaccagcuucaagaacaagcuguacgagcagcaccugggcaagagcaacaacuuccagaagcccaagcccgccaagggcaagcccgaggcccacuucagccugauccacuacgccggcaccguggacuacaacaucgccggcuggcuggacaagaacaaggacccccugaacgagaccguggugggccuguaccagaagagcgccaugaagacccuggcccugcuguucgugggcgccaccggcgccgaggccgaggccggcggcggcaagaagggcggcaagaagaagggcagcagcuuccagaccgugagcgcccuguucagagagaaccugaacaagcugaugaccaaccugagaagcacccacccccacuucgugagaugcaucauccccaacgagaccaagacccccggcgccauggagcacgagcuggugcugcaccagcugagaugcaacggcgugcuggagggcaucagaaucugcagaaagggcuuccccagcagaauccuguacgccgacuucaagcagagauacaaggugcugaacgccagcgccauccccgagggccaguucaucgacagcaagaaggccagcgagaagcugcugggcagcaucgacaucgaccacacccaguacaaguucggccacaccaagguguucuucaaggccggccugcugggccugcuggaggagaugagagacgagaagcuggcccagcugaucaccagaacccaggccaugugcagaggcuuccuggccagaguggaguaccagaagaugguggagagaagagagagcaucuucugcauccaguacaacgugagagccuucaugaacgugaagcacuggcccuggaugaagcuguacuucaagaucaagccccugcugaagagcgccgagaccgagaaggagauggccaacaugaaggaggaguucgagaagaccaaggaggagcuggccaagaccgaggccaagagaaaggagcuggaggagaagauggugacccugaugcaggagaagaacgaccugcagcugcaggugcaggccgaggccgacagccuggccgacgccgaggagagaugcgaccagcugaucaagaccaagauccagcuggaggccaagaucaaggaggugaccgagagagccgaggacgaggaggagaucaacgccgagcugaccgccaagaagagaaagcuggaggacgagugcagcgagcugaagaaggacaucgacgaccuggagcugacccuggccaagguggagaaggagaagcacgccaccgagaacaaggugaagaaccugaccgaggagauggccggccuggacgagaccaucgccaagcugaccaaggagaagaaggcccugcaggaggcccaccagcagacccuggacgaccugcaggccgaggaggacaaggugaacacccugaccaaggccaagaucaagcuggagcagcagguggacgaccuggagggcagccuggagcaggagaagaagaucagaauggaccuggagagagccaagagaaagcuggagggcgaccugaagcuggcccaggagagcaccauggacaucgagaacgacaagcagcagcuggacgagaagcugaagaagaaggaguucgagaugagcggccugcagagcaagaucgaggacgagcaggcccugggcaugcagcugcagaagaagaucaaggagcugcaggccagaaucgaggagcuggaggaggagaucgaggccgagagagccagcagagccaaggccgagaagcagagaagcgaccugagcagagagcuggaggagaucagcgagagacuggaggaggccggcggcgccaccagcgcccagaucgagaugaacaagaagagagaggccgaguuccagaagaugagaagagaccuggaggaggccacccugcagcacgaggccaccgccgccacccugagaaagaagcacgccgacagcguggccgagcugggcgagcagaucgacaaccugcagagagugaagcagaagcuggagaaggagaagagcgagaugaagauggagaucgacgaccuggccagcaacauggagaccgugagcaaggccaagggcaaccuggagaagaugugcagagcccuggaggaccagcugagcgagaucaagaccaaggaggaggagcagcagagacugaucaacgaccugaccgcccagagagccagacugcagaccgagagcggcgaguacagcagacagcuggacgagaaggacacccuggugagccagcugagcagaggcaagcaggccuucacccagcagaucgaggagcugaagagacagcuggaggaggagaucaaggccaagagcgcccuggcccacgcccugcagagcagcagacacgacugcgaccugcugagagagcaguacgaggaggagcaggaggccaaggccgagcugcagagagccaugagcaaggccaacagcgagguggcccaguggagaaccaaguacgagaccgacgccauccagagaaccgaggagcuggaggaggccaagaagaagcuggcccagagacugcaggacgccgaggagcacguggaggccgugaacgccaagugcgccagccuggagaagaccaagcagagacugcagaacgagguggaggaccugaugaucgacguggagagaaccaacgccgccugcgccgcccuggacaagaagcagagaaacuucgacaagauccuggccgaguggaagcagaagugcgaggagacccacgccgagcuggaggccagccagaaggagagcagaagccugagcaccgagcuguucaagaucaagaacgccuacgaggagagccuggaccagcuggagacccugaagagagagaacaagaaccugcagcaggagaucagcgaccugaccgagcagaucgccgagggcggcaagagaauccacgagcuggagaagaucaagaagcagguggagcaggagaagagcgagcugcaggccgcccuggaggaggccgaggccagccuggagcacgaggagggcaagauccugagaauccagcuggagcugaaccaggugaagagcgagguggacagaaagaucgccgagaaggacgaggagaucgaccagaugaagagaaaccacaucagaaucguggagagcaugcagagcacccuggacgccgagaucagaagcagaaacgacgccaucagacugaagaagaagauggagggcgaccugaacgagauggagauccagcugaaccacgccaacagaauggccgccgaggcccugagaaacuacagaaacacccaggccauccugaaggacacccagcugcaccuggacgacgcccugagaagccaggaggaccugaaggagcagcuggccaugguggagagaagagccaaccugcugcaggccgagaucgaggagcugagagccacccuggagcagaccgagagaagcagaaagaucgccgagcaggagcugcuggacgccagcgagagagugcagcugcugcacacccagaacaccagccugaucaacaccaagaagaagcuggagaccgacaucagccagauccagggcgagauggaggacaucauccaggaggccagaaacgccgaggagaaggccaagaaggccaucaccgacgccgccaugauggccgaggagcugaagaaggagcaggacaccagcgcccaccuggagagaaugaagaagaaccuggagcagaccgugaaggaccugcagcacagacuggacgaggccgagcagcuggcccugaagggcggcaagaagcagauccagaagcuggaggccagagugagagagcuggagggcgagguggagagcgagcagaagagaaacguggaggccgugaagggccugagaaagcacgagagaaaggugaaggagcugaccuaccagaccgaggaggacagaaagaacauccugagacugcaggaccugguggacaagcugcaggccaaggugaagagcuacaagagacaggccgaggaggccgaggagcagagcaacgugaaccugagcaaguucagaagaauccagcacgagcuggaggaggccgaggagagagccgacaucgccgagagccaggugaacaagcugagagugaagagcagagaggugcacaccaagaucaucagcgaggaguaa

SEQ ID NO: 20215 - RNA, 5826 nt, Artificial Sequence
  MYH2__Homo_sapiens__NP_001093582
augagcagcgacagcgagcuggccguguucggcgaggccgcccccuuccugagaaagagcgagagagagagaaucgaggcccagaacagacccuucgacgccaagaccagcguguucguggccgagcccaaggagagcuucgugaagggcaccauccagagcagagagggcggcaaggugaccgugaagaccgagggcggcgccacccugaccgugaaggacgaccagguguuccccaugaacccccccaaguacgacaagaucgaggacauggccaugaugacccaccugcacgagcccgccgugcuguacaaccugaaggagagauacgccgccuggaugaucuacaccuacagcggccuguucugcgugaccgugaaccccuacaaguggcugcccguguacaagcccgagguggugaccgccuacagaggcaagaagagacaggaggcccccccccacaucuucagcaucagcgacaacgccuaccaguucaugcugaccgacagagagaaccagagcauccugaucaccggcgagagcggcgccggcaagaccgugaacaccaagagagugauccaguacuucgccaccaucgccgugaccggcgagaagaagaaggaggagaucaccagcggcaagauccagggcacccuggaggaccagaucaucagcgccaacccccugcuggaggccuucggcaacgccaagaccgugagaaacgacaacagcagcagauucggcaaguucaucagaauccacuucggcaccaccggcaagcuggccagcgccgacaucgagaccuaccugcuggagaagagcagagugguguuccagcugaaggccgagagaagcuaccacaucuucuaccagaucaccagcaacaagaagcccgagcugaucgagaugcugcugaucaccaccaaccccuacgacuaccccuucgugagccagggcgagaucagcguggccagcaucgacgaccaggaggagcugauggccaccgacagcgccaucgacauccugggcuucaccaacgaggagaaggugagcaucuacaagcugaccggcgccgugaugcacuacggcaaccugaaguucaagcagaagcagagagaggagcaggccgagcccgacggcaccgagguggccgacaaggccgccuaccugcagagccugaacagcgccgaccugcugaaggcccugugcuaccccagagugaaggugggcaacgaguacgugaccaagggccagaccguggagcaggugagcaacgccgugggcgcccuggccaaggccguguacgagaagauguuccuguggaugguggccagaaucaaccagcagcuggacaccaagcagcccagacaguacuucaucggcgugcuggacaucgccggcuucgagaucuucgacuucaacagccuggagcagcugugcaucaacuucaccaacgagaagcugcagcaguucuucaaccaccacauguucgugcuggagcaggaggaguacaagaaggagggcaucgaguggaccuucaucgacuucggcauggaccuggccgccugcaucgagcugaucgagaagcccaugggcaucuucagcauccuggaggaggagugcauguuccccaaggccaccgacaccagcuucaagaacaagcuguacgaccagcaccugggcaagagcgccaacuuccagaagcccaagguggugaagggcaaggccgaggcccacuucgcccugauccacuacgccggcgugguggacuacaacaucaccggcuggcuggagaagaacaaggacccccugaacgagaccguggugggccuguaccagaagagcgccaugaagacccuggcccagcuguucagcggcgcccagaccgccgagggcgagggcgccggcggcggcgccaagaagggcggcaagaagaagggcagcagcuuccagaccgugagcgcccuguucagagagaaccugaacaagcugaugaccaaccugagaagcacccacccccacuucgugagaugcaucauccccaacgagaccaagacccccggcgccauggagcacgagcuggugcugcaccagcugagaugcaacggcgugcuggagggcaucagaaucugcagaaagggcuuccccagcagaauccuguacgccgacuucaagcagagauacaaggugcugaacgccagcgccauccccgagggccaguucaucgacagcaagaaggccagcgagaagcugcuggccagcaucgacaucgaccacacccaguacaaguucggccacaccaagguguucuucaaggccggccugcugggccugcuggaggagaugagagacgacaagcuggcccagcugaucaccagaacccaggccagaugcagaggcuuccuggccagaguggaguaccagagaaugguggagagaagagaggccaucuucugcauccaguacaacaucagaagcuucaugaacgugaagcacuggcccuggaugaagcuguucuucaagaucaagccccugcugaagagcgccgagaccgagaaggagauggccaccaugaaggaggaguuccagaagaucaaggacgagcuggccaagagcgaggccaagagaaaggagcuggaggagaagauggugacccugcugaaggagaagaacgaccugcagcugcaggugcaggccgaggccgagggccuggccgacgccgaggagagaugcgaccagcugaucaagaccaagauccagcuggaggccaagaucaaggaggugaccgagagagccgaggacgaggaggagaucaacgccgagcugaccgccaagaagagaaagcuggaggacgagugcagcgagcugaagaaggacaucgacgaccuggagcugacccuggccaagguggagaaggagaagcacgccaccgagaacaaggugaagaaccugaccgaggagauggccggccuggacgagaccaucgccaagcugaccaaggagaagaaggcccugcaggaggcccaccagcagacccuggacgaccugcaggccgaggaggacaaggugaacacccugaccaaggccaagaucaagcuggagcagcagguggacgaccuggagggcagccuggagcaggagaagaagcugagaauggaccuggagagagccaagagaaagcuggagggcgaccugaagcuggcccaggagagcaucauggacaucgagaacgagaagcagcagcuggacgagaagcugaagaagaaggaguucgagaucagcaaccugcagagcaagaucgaggacgagcaggcccugggcauccagcugcagaagaagaucaaggagcugcaggccagaaucgaggagcuggaggaggagaucgaggccgagagagccagcagagccaaggccgagaagcagagaagcgaccugagcagagagcuggaggagaucagcgagagacuggaggaggccggcggcgccaccagcgcccagaucgagaugaacaagaagagagaggccgaguuccagaagaugagaagagaccuggaggaggccacccugcagcacgaggccaccgccgccacccugagaaagaagcacgccgacagcguggccgagcugggcgagcagaucgacaaccugcagagagugaagcagaagcuggagaaggagaagagcgagaugaagauggagaucgacgaccuggccagcaacguggagaccgugagcaaggccaagggcaaccuggagaagaugugcagaacccuggaggaccagcugagcgagcugaagagcaaggaggaggagcagcagagacugaucaacgaccugaccgcccagagaggcagacugcagaccgagagcggcgaguucagcagacagcuggacgagaaggaggcccuggugagccagcugagcagaggcaagcaggccuucacccagcagaucgaggagcugaagagacagcuggaggaggagaucaaggccaagaacgcccuggcccacgcccugcagagcagcagacacgacugcgaccugcugagagagcaguacgaggaggagcaggagagcaaggccgagcugcagagagcccugagcaaggccaacaccgagguggcccaguggagaaccaaguacgagaccgacgccauccagagaaccgaggagcuggaggaggccaagaagaagcuggcccagagacugcaggccgccgaggagcacguggaggccgugaacgccaagugcgccagccuggagaagaccaagcagagacugcagaacgagguggaggaccugaugcuggacguggagagaaccaacgccgccugcgccgcccuggacaagaagcagagaaacuucgacaagauccuggccgaguggaagcagaagugcgaggagacccacgccgagcuggaggccagccagaaggaggccagaagccugggcaccgagcuguucaagaucaagaacgccuacgaggagagccuggaccagcuggagacccugaagagagagaacaagaaccugcagcaggagaucagcgaccugaccgagcagaucgccgagggcggcaagagaauccacgagcuggagaagaucaagaagcagguggagcaggagaagugcgagcugcaggccgcccuggaggaggccgaggccagccuggagcacgaggagggcaagauccugagaauccagcuggagcugaaccaggugaagagcgagguggacagaaagaucgccgagaaggacgaggagaucgaccagcugaagagaaaccacaucagaaucguggagagcaugcagagcacccuggacgccgagaucagaagcagaaacgacgccaucagacugaagaagaagauggagggcgaccugaacgagauggagauccagcugaaccacgccaacagaauggccgccgaggcccugagaaacuacagaaacacccagggcauccugaaggacacccagauccaccuggacgacgcccugagaagccaggaggaccugaaggagcagcuggccaugguggagagaagagccaaccugcugcaggccgagaucgaggagcugagagccacccuggagcagaccgagagaagcagaaagaucgccgagcaggagcugcuggacgccagcgagagagugcagcugcugcacacccagaacaccagccugaucaacaccaagaagaagcuggagaccgacaucagccagaugcagggcgagauggaggacauccugcaggaggccagaaacgccgaggagaaggccaagaaggccaucaccgacgccgccaugauggccgaggagcugaagaaggagcaggacaccagcgcccaccuggagagaaugaagaagaacauggagcagaccgugaaggaccugcagcugagacuggacgaggccgagcagcuggcccugaagggcggcaagaagcagauccagaagcuggaggccagagugagagagcuggagggcgagguggagagcgagcagaagagaaacgccgaggccgugaagggccugagaaagcacgagagaagagugaaggagcugaccuaccagaccgaggaggacagaaagaacauccugagacugcaggaccugguggacaagcugcaggccaaggugaagagcuacaagagacaggccgaggaggccgaggagcagagcaacaccaaccuggccaaguucagaaagcugcagcacgagcuggaggaggccgaggagagagccgacaucgccgagagccaggugaacaagcugagagugaagagcagagaggugcacaccaaggugaucagcgaggaguaa

SEQ ID NO: 20216 - RNA, 5823 nt, Artificial Sequence
  MYH3__Homo_sapiens__XP_011522173
augagcagcgacaccgagauggagguguucggcaucgccgcccccuuccugagaaagagcgagaaggagagaaucgaggcccagaaccagcccuucgacgccaagaccuacugcuucgugguggacagcaaggaggaguacgccaagggcaagaucaagagcagccaggacggcaaggugaccguggagaccgaggacaacagaacccugguggugaagcccgaggacguguacgccaugaacccccccaaguucgacagaaucgaggacauggccaugcugacccaccugaacgagcccgccgugcuguacaaccugaaggacagauacaccagcuggaugaucuacaccuacagcggccuguucugcgugaccgugaaccccuacaaguggcugcccguguacaaccccgaggugguggagggcuacagaggcaagaagagacaggaggcccccccccacaucuucagcaucagcgacaacgccuaccaguucaugcugaccgacagagagaaccagagcauccugaucaccggcgagagcggcgccggcaagaccgugaacaccaagagagugauccaguacuucgccaccaucgccgccaccggcgaccuggccaagaagaaggacagcaagaugaagggcacccuggaggaccagaucaucagcgccaacccccugcuggaggccuucggcaacgccaagaccgugagaaacgacaacagcagcagauucggcaaguucaucagaauccacuucggcaccaccggcaagcuggccagcgccgacaucgagaccuaccugcuggagaagagcagagugaccuuccagcugaaggccgagagaagcuaccacaucuucuaccagauccugagcaacaagaagcccgagcugaucgagcugcugcugaucaccaccaaccccuacgacuaccccuucaucagccagggcgagauccugguggccagcaucgacgacgccgaggagcugcuggccaccgacagcgccaucgacauccugggcuucacccccgaggagaagagcggccuguacaagcugaccggcgccgugaugcacuacggcaacaugaaguucaagcagaagcagagagaggagcaggccgagcccgacggcaccgagguggccgacaagaccgccuaccugaugggccugaacagcagcgaccugcugaaggcccugugcuuccccagagugaaggugggcaacgaguacgugaccaagggccagaccguggaccaggugcaccacgccgugaacgcccugagcaagagcguguacgagaagcuguuccuguggauggugaccagaaucaaccagcagcuggacaccaagcugcccagacagcacuucaucggcgugcuggacaucgccggcuucgagaucuucgaguacaacagccuggagcagcugugcaucaacuucaccaacgagaagcugcagcaguucuucaaccaccacauguucgugcuggagcaggaggaguacaagaaggagggcaucgaguggaccuucaucgacuucggcauggaccuggccgccugcaucgagcugaucgagaagcccaugggcaucuucagcauccuggaggaggagugcauguuccccaaggccaccgacaccagcuucaagaacaagcuguacgaccagcaccugggcaagagcaacaacuuccagaagcccaagguggugaagggcagagccgaggcccacuucagccugauccacuacgccggcaccguggacuacagcgugagcggcuggcuggagaagaacaaggacccccugaacgagaccguggugggccuguaccagaagagcagcaacagacugcuggcccaccuguacgccaccuucgccaccgccgacgccgacagcggcaagaagaagguggccaagaagaagggcagcagcuuccagaccgugagcgcccuguucagagagaaccugaacaagcugaugagcaaccugagaaccacccacccccacuucgugagaugcaucauccccaacgagaccaagacccccggcgccauggagcacagccuggugcugcaccagcugagaugcaacggcgugcuggagggcaucagaaucugcagaaagggcuuccccaacagaauccuguacggcgacuucaagcagagauacagagugcugaacgccagcgccauccccgagggccaguucaucgacagcaagaaggccugcgagaagcugcuggccagcaucgacaucgaccacacccaguacaaguucggccacaccaagguguucuucaaggccggccugcugggcacccuggaggagaugagagacgacagacuggccaagcugaucaccagaacccaggccgugugcagaggcuuccugaugagaguggaguuccagaagauggugcagagaagagagagcaucuucugcauccaguacaacaucagaagcuucaugaacgugaagcacuggcccuggaugaagcuguucuucaagaucaagccccugcugaagagcgccgagaccgagaaggagauggccaccaugaaggaggaguuccagaagaccaaggacgagcuggccaagagcgaggccaagagaaaggagcuggaggagaagcuggugacccuggugcaggagaagaacgaccugcagcugcaggugcaggccgagagcgagaaccugcuggacgccgaggagagaugcgaccagcugaucaaggccaaguuccagcuggaggccaagaucaaggaggugaccgagagagccgaggacgaggaggagaucaacgccgagcugaccgccaagaagagaaagcuggaggacgagugcagcgagcugaagaaggacaucgacgaccuggagcugacccuggccaagguggagaaggagaagcacgccaccgagaacaaggugaagaaccugaccgaggagcugagcggccuggacgagaccaucgccaagcugaccagagagaagaaggcccugcaggaggcccaccagcaggcccuggacgaccugcaggccgaggaggacaaggugaacagccugaacaagaccaagagcaagcuggagcagcagguggaggaccuggagagcagccuggagcaggagaagaagcugagaguggaccuggagagaaacaagagaaagcuggagggcgaccugaagcuggcccaggagagcauccuggaccuggagaacgacaagcagcagcuggacgagagacugaagaagaaggacuucgaguacugccagcugcagagcaagguggaggacgagcagacccugggccugcaguuccagaagaagaucaaggagcugcaggccagaaucgaggagcuggaggaggagaucgaggccgagagagccaccagagccaagaccgagaagcagagaagcgacuacgccagagagcuggaggagcugagcgagagacuggaggaggccggcggcgugaccagcacccagaucgagcugaacaagaagagagaggccgaguuccugaagcugagaagagaccuggaggaggccacccugcagcacgaggccaugguggccgcccugagaaagaagcacgccgacagcguggccgagcugggcgagcagaucgacaaccugcagagagugaagcagaagcuggagaaggagaagagcgaguucaagcuggagaucgacgaccugagcagcagcauggagagcgugagcaagagcaaggccaaccuggagaagaucugcagaacccuggaggaccagcugagcgaggccagaggcaagaacgaggagauccagagaagccugagcgagcugaccacccagaagagcagacugcagaccgaggccggcgagcugagcagacagcuggaggagaaggagagcaucgugagccagcugagcagaagcaagcaggccuucacccagcagaccgaggagcugaagagacagcuggaggaggagaacaaggccaagaacgcccuggcccacgcccugcagagcagcagacacgacugcgaccugcugagagagcaguacgaggaggagcaggagggcaaggccgagcugcagagagcccugagcaaggccaacagcgagguggcccaguggagaaccaaguacgagaccgacgccauccagagaaccgaggagcuggaggaggccaagaagaagcuggcccagagacugcaggacagcgaggagcagguggaggccgugaacgccaagugcgccagccuggagaagaccaagcagagacugcagggcgagguggaggaccugaugguggacguggagagagccaacagccuggccgccgcccuggacaagaagcagagaaacuucgacaaggugcuggccgaguggaagaccaagugcgaggagagccaggccgagcuggaggccagccugaaggagagcagaagccugagcaccgagcuguucaagcugaagaacgccuacgaggaggcccuggaccagcuggagaccgugaagagagagaacaagaaccuggagcaggagaucgccgaccugaccgagcagaucgccgagaacggcaagaccauccacgagcuggagaagagcagaaagcagaucgagcuggagaaggccgacauccagcuggcccuggaggaggccgaggccgcccuggagcacgaggaggccaagauccugagaauccagcuggagcugacccaggugaagagcgagaucgacagaaagaucgccgagaaggacgaggagaucgagcagcugaagagaaacuaccagagaaccguggagaccaugcagagcgcccuggacgccgaggugagaagcagaaacgaggccaucagacugaagaagaagauggagggcgaccugaacgagaucgagauccagcugagccacgccaacagacaggccgccgagacccugaagcaccugagaagcgugcagggccagcugaaggacacccagcugcaccuggacgacgcccugagaggccaggaggaccugaaggagcagcuggccaucguggagagaagagccaaccugcugcaggccgagguggaggagcugagagccacccuggagcagaccgagagagccagaaagcuggccgagcaggagcugcuggacagcaacgagagagugcagcugcugcacacccagaacaccagccugauccacaccaagaagaagcuggagaccgaccugaugcagcugcagagcgagguggaggacgccagcagagacgccagaaacgccgaggagaaggccaagaaggccaucaccgacgccgccaugauggccgaggagcugaagaaggagcaggacaccagcgcccaccuggagagaaugaagaagaaccuggagcagaccgugaaggaccugcagcacagacuggacgaggccgagcagcuggcccugaagggcggcaagaagcagauccagaagcuggagaccagaaucagagagcuggaguucgagcuggagggcgagcagaagaagaacaccgagagcgugaagggccugagaaaguacgagagaagagugaaggagcugaccuaccagagcgaggaggacagaaagaacgugcugagacugcaggaccugguggacaagcugcaggugaaggugaagagcuacaagagacaggccgaggaggccgacgagcaggccaacgcccaccugaccaaguucagaaaggcccagcacgagcuggaggaggccgaggagagagccgacaucgccgagagccaggugaacaagcugagagccaagaccagagacuucaccagcagcagaaugguggugcacgagagcgaggaguaa

SEQ ID NO: 20217 - RNA, 5820 nt, Artificial Sequence
  MYH4__Homo_sapiens__NP_060003
augagcagcgacagcgagauggccaucuucggcgaggccgcccccuuccugagaaagagcgagaaggagagaaucgaggcccagaacaagcccuucgacgccaagaccagcguguucgugguggaccccaaggagagcuacgugaaggccaucgugcagagcagagagggcggcaaggugaccgccaagaccgaggccggcgccaccgugaccgugaaggaggaccagguguucagcaugaacccccccaaguacgacaagaucgaggacauggccaugaugacccaccugcacgagcccgccgugcuguacaaccugaaggagagauacgccgccuggaugaucuacaccuacagcggccuguucugcgugaccgugaaccccuacaaguggcugcccguguacaaccccgagguggugaccgccuacagaggcaagaagagacaggaggcccccccccacaucuucagcaucagcgacaacgccuaccaguucaugcugaccgacagagagaaccagagcauccugaucaccggcgagagcggcgccggcaagaccgugaacaccaagagagugauccaguacuucgccaccaucgccgugaccggcgagaagaagaaggaggagcccgccagcggcaagaugcagggcacccuggaggaccagaucaucagcgccaacccccugcuggaggccuucggcaacgccaagaccgugagaaacgacaacagcagcagauucggcaaguucaucagaauccacuucggcgccaccggcaagcuggccagcgccgacaucgagaccuaccugcuggagaagagcagagugaccuuccagcugaaggccgagagaagcuaccacaucuucuaccagauccugagcaacaagaagcccgagcugaucgagaugcugcugaucaccaccaaccccuacgacuucgccuucgugagccagggcgagaucaccgugcccagcaucgacgaccaggaggagcugauggccaccgacagcgccguggacauccugggcuucaccgccgacgagaagguggccaucuacaagcugaccggcgccgugaugcacuacggcaacaugaaguucaagcagaagcagagagaggagcaggccgagcccgacggcaccgagguggccgacaaggccgccuaccugaccagccugaacagcgccgaccugcugaagagccugugcuaccccagagugaaggugggcaacgaguucgugaccaagggccagaccgugcagcagguguacaacgccgugggcgcccuggccaaggccaucuacgagaagauguuccuguggauggugaccagaaucaaccagcagcuggacaccaagcagcccagacaguacuucaucggcgugcuggacaucgccggcuucgagaucuucgacuucaacagccuggagcagcugugcaucaacuucaccaacgagaagcugcagcaguucuucaaccaccacauguucgugcuggagcaggaggaguacaagaaggagggcaucgagugggaguucaucgacuucggcauggaccuggccgccugcaucgagcugaucgagaagcccaugggcaucuucagcauccuggaggaggagugcauguuccccaaggccaccgacaccagcuucaagaacaagcuguacgagcagcaccugggcaagagcaacaacuuccagaagcccaagcccgccaagggcaagcccgaggcccacuucagccuggugcacuacgccggcaccguggacuacaacaucgccggcuggcuggacaagaacaaggacccccugaacgagaccguggugggccuguaccagaagagcgccaugaagacccuggccuuccuguucagcggcgcccagaccgccgaggccgagggcggcggcggcaagaagggcggcaagaagaagggcagcagcuuccagaccgugagcgcccuguucagagagaaccugaacaagcugaugaccaaccugagaagcacccacccccacuucgugagaugcaucauccccaacgagaccaagacccccggcgccauggagcacgagcuggugcugcaccagcugagaugcaacggcgugcuggagggcaucagaaucugcagaaagggcuuccccagcagaauccuguacgccgacuucaagcagagauacaaggugcugaacgccagcgccauccccgagggccaguucaucgacagcaagaaggccagcgagaagcugcugggcagcaucgagaucgaccacacccaguacaaguucggccacaccaagguguucuucaaggccggccugcugggcacccuggaggagaugagagacgagaagcuggcccagcugaucaccagaacccaggccaucugcagaggcuuccugaugagaguggaguucagaaagaugauggagagaagagagagcaucuucugcauccaguacaacaucagagccuucaugaacgugaagcacuggcccuggaugaagcuguacuucaagaucaagccccugcugaagagcgccgagaccgagaaggagauggccaacaugaaggaggaguucgagaagaccaaggaggagcuggccaagaccgaggccaagagaaaggagcuggaggagaagauggugacccugaugcaggagaagaacgaccugcagcugcaggugcaggccgaggccgacgcccuggccgacgccgaggagagaugcgaccagcugaucaagaccaagauccagcuggaggccaagaucaaggaggugaccgagagagccgaggacgaggaggagaucaacgccgagcugaccgccaagaagagaaagcuggaggacgagugcagcgagcugaagaaggacaucgacgaccuggagcugacccuggccaagguggagaaggagaagcacgccaccgagaacaaggugaagaaccugaccgaggagauggccggccuggacgagaccaucgccaagcugaccaaggagaagaaggcccugcaggaggcccaccagcagacccuggacgaccugcagauggaggaggacaaggugaacacccugaccaaggccaagaccaagcuggagcagcagguggacgaccuggagggcagccuggagcaggagaagaagcugugcauggaccuggagagagccaagagaaagcuggagggcgaccugaagcuggcccaggagagcaccauggacaccgagaacgacaagcagcagcugaacgagaagcugaagaagaaggaguucgagaugagcaaccugcagggcaagaucgaggacgagcaggcccuggccauccagcugcagaagaagaucaaggagcugcaggccagaaucgaggagcuggaggaggagaucgaggccgagagagccagcagagccaaggccgagaagcagagaagcgaccugagcagagagcuggaggagaucagcgagagacuggaggaggccggcggcgccaccagcgcccagaucgagaugaacaagaagagagaggccgaguuccagaagaugagaagagaccuggaggagagcacccugcagcacgaggccaccgccgccgcccugagaaagaagcacgccgacagcguggccgagcugggcgagcagaucgacagccugcagagagugaagcagaagcuggagaaggagaagagcgagcugaagauggagaucaacgaccuggccagcaacauggagaccgugagcaaggccaaggccaacuucgagaagaugugcagaacccuggaggaccagcugagcgagaucaagaccaaggaggaggagcagcagagacugaucaacgagcugagcgcccagaaggccagacugcacaccgagagcggcgaguucagcagacagcuggacgagaaggacgccauggugagccagcugagcagaggcaagcaggccuucacccagcagaucgaggagcugaagagacagcuggaggaggagaccaaggccaagagcacccuggcccacgcccugcagagcgccagacacgacugcgaccugcugagagagcaguacgaggaggagcaggaggccaaggccgagcugcagagaggcaugagcaaggccaacagcgagguggcccaguggagaaccaaguacgagaccgacgccauccagagaaccgaggagcuggaggaggccaagaagaagcuggcccagagacugcaggacgccgaggagcacguggaggccgugaacagcaagugcgccagccuggagaagaccaagcagagacugcagaacgagguggaggaccugaugaucgacguggagagaagcaacgccgccugcaucgcccuggacaagaagcagagaaacuucgacaaggugcuggccgaguggaagcagaaguacgaggagacccaggccgagcuggaggccagccagaaggagagcagaagccugagcaccgagcuguucaaggugaagaacgccuacgaggagagccuggaccaccuggagacccugaagagagagaacaagaaccugcagcaggagaucagcgaccugaccgagcagaucgccgagggcggcaagcacauccacgagcuggagaaggugaagaagcagcuggaccacgagaagagcgagcugcagaccagccuggaggaggccgaggccagccuggagcacgaggagggcaagauccugagaauccagcuggagcugaaccaggugaagagcgagaucgacagaaagaucgccgagaaggacgaggagcuggaccagcugaagagaaaccaccugagagugguggagagcaugcagagcacccuggacgccgagaucagaagcagaaacgacgcccugagaaucaagaagaagauggagggcgaccugaacgagauggagauccagcugaaccacgccaacagacaggccgccgaggcccugagaaaccugagaaacacccagggcauccugaaggacacccagcugcaccuggacgacgccaucagaggccaggacgaccugaaggagcagcuggccaugguggagagaagagccaaccugaugcaggccgagguggaggagcugagagccagccuggagagaaccgagagaggcagaaagauggccgagcaggagcugcuggacgccagcgagagagugcagcugcugcacacccagaacaccagccugaucaacaccaagaagaagcuggagaccgacaucagccagauccagggcgagauggaggacaucgugcaggaggccagaaacgccgaggagaaggccaagaaggccaucaccgacgccgccaugauggccgaggagcugaagaaggagcaggacaccagcgcccaccuggagagaaugaagaagaacauggagcagaccgugaaggaccugcagcugagacuggacgaggccgagcagcuggcccugaagggcggcaagaagcagauccagaagcuggaggccagagugagagagcuggagagcgagguggagagcgagcagaagcacaacguggaggccgugaagggccugagaaagcacgagagaagagugaaggagcugaccuaccagaccgaggaggacagaaagaacauccugagacugcaggaccugguggacaagcugcagaccaaggugaaggccuacaagagacaggccgaggaggccgaggagcagagcaacgugaaccuggccaaguucagaaagcugcagcacgagcuggaggaggccaaggagagagccgacaucgccgagagccaggugaacaagcugagagugaagagcagagaggugcacaccaaggugaucagcgaggaguaa

SEQ ID NO: 20218 - RNA, 5820 nt, Artificial Sequence
  MYH6__Homo_sapiens__NP_002462
augaccgacgcccagauggccgacuucggcgccgccgcccaguaccugagaaagagcgagaaggagagacuggaggcccagaccagacccuucgacaucagaaccgagugcuucgugcccgacgacaaggaggaguucgugaaggccaagauccugagcagagagggcggcaaggugaucgccgagaccgagaacggcaagaccgugaccgugaaggaggaccaggugcugcagcagaacccccccaaguucgacaagaucgaggacauggccaugcugaccuuccugcacgagcccgccgugcuguucaaccugaaggagagauacgccgccuggaugaucuacaccuacagcggccuguucugcgugaccgugaaccccuacaaguggcugcccguguacaacgccgaggugguggccgccuacagaggcaagaagagaagcgaggcccccccccacaucuucagcaucagcgacaacgccuaccaguacaugcugaccgacagagagaaccagagcauccugaucaccggcgagagcggcgccggcaagaccgugaacaccaagagagugauccaguacuucgccagcaucgccgccaucggcgacagaggcaagaaggacaacgccaacgccaacaagggcacccuggaggaccagaucauccaggccaaccccgcccuggaggccuucggcaacgccaagaccgugagaaacgacaacagcagcagauucggcaaguucaucagaauccacuucggcgccaccggcaagcuggccagcgccgacaucgagaccuaccugcuggagaagagcagagugaucuuccagcugaaggccgagagaaacuaccacaucuucuaccagauccugagcaacaagaagcccgagcugcuggacaugcugcuggugaccaacaaccccuacgacuacgccuucgugagccagggcgaggugagcguggccagcaucgacgacagcgaggagcugauggccaccgacagcgccuucgacgugcugggcuucaccagcgaggagaaggccggcguguacaagcugaccggcgccaucaugcacuacggcaacaugaaguucaagcagaagcagagagaggagcaggccgagcccgacggcaccgaggacgccgacaagagcgccuaccugaugggccugaacagcgccgaccugcugaagggccugugccaccccagagugaaggugggcaacgaguacgugaccaagggccagagcgugcagcagguguacuacagcaucggcgcccuggccaaggccguguacgagaagauguucaacuggauggugaccagaaucaacgccacccuggagaccaagcagcccagacaguacuucaucggcgugcuggacaucgccggcuucgagaucuucgacuucaacagcuucgagcagcugugcaucaacuucaccaacgagaagcugcagcaguucuucaaccaccacauguucgugcuggagcaggaggaguacaagaaggagggcaucgaguggaccuucaucgacuucggcauggaccugcaggccugcaucgaccugaucgagaagcccaugggcaucaugagcauccuggaggaggagugcauguuccccaaggccaccgacaugaccuucaaggccaagcuguacgacaaccaccugggcaagagcaacaacuuccagaagcccagaaacaucaagggcaagcaggaggcccacuucagccugauccacuacgccggcaccguggacuacaacauccugggcuggcuggagaagaacaaggacccccugaacgagaccgugguggcccuguaccagaagagcagccugaagcugauggccacccuguucagcagcuacgccaccgccgacaccggcgacagcggcaagagcaagggcggcaagaagaagggcagcagcuuccagaccgugagcgcccugcacagagagaaccugaacaagcugaugaccaaccugagaaccacccacccccacuucgugagaugcaucauccccaacgagagaaaggcccccggcgugauggacaacccccuggugaugcaccagcugagaugcaacggcgugcuggagggcaucagaaucugcagaaagggcuuccccaacagaauccuguacggcgacuucagacagagauacagaauccugaaccccguggccauccccgagggccaguucaucgacagcagaaagggcaccgagaagcugcugagcagccuggacaucgaccacaaccaguacaaguucggccacaccaagguguucuucaaggccggccugcugggccugcuggaggagaugagagacgagagacugagcagaaucaucaccagaaugcaggcccaggccagaggccagcugaugagaaucgaguucaagaagaucguggagagaagagacgcccugcuggugauccaguggaacaucagagccuucaugggcgugaagaacuggcccuggaugaagcuguacuucaagaucaagccccugcugaagagcgccgagaccgagaaggagauggccaccaugaaggaggaguucggcagaaucaaggagacccuggagaagagcgaggccagaagaaaggagcuggaggagaagauggugagccugcugcaggagaagaacgaccugcagcugcaggugcaggccgagcaggacaaccugaacgacgccgaggagagaugcgaccagcugaucaagaacaagauccagcuggaggccaaggugaaggagaugaacgagagacuggaggacgaggaggagaugaacgccgagcugaccgccaagaagagaaagcuggaggacgagugcagcgagcugaagaaggacaucgacgaccuggagcugacccuggccaagguggagaaggagaagcacgccaccgagaacaaggugaagaaccugaccgaggagauggccggccuggacgagaucaucgccaagcugaccaaggagaagaaggcccugcaggaggcccaccagcaggcccuggacgaccugcagguggaggaggacaaggugaacagccugagcaagagcaaggugaagcuggagcagcagguggacgaccuggagggcagccuggagcaggagaagaaggugagaauggaccuggagagagccaagagaaagcuggagggcgaccugaagcugacccaggagagcaucauggaccuggagaacgacaagcugcagcuggaggagaagcugaagaagaaggaguucgacaucaaccagcagaacagcaagaucgaggacgagcaggugcuggcccugcagcugcagaagaagcugaaggagaaccaggccagaaucgaggagcuggaggaggagcuggaggccgagagaaccgccagagccaagguggagaagcugagaagcgaccugagcagagagcuggaggagaucagcgagagacuggaggaggccggcggcgccaccagcgugcagaucgagaugaacaagaagagagaggccgaguuccagaagaugagaagagaccuggaggaggccacccugcagcacgaggccaccgccgccgcccugagaaagaagcacgccgacagcguggccgagcugggcgagcagaucgacaaccugcagagagugaagcagaagcuggagaaggagaagagcgaguucaagcuggagcuggacgacgugaccagcaacauggagcagaucaucaaggccaaggccaaccuggagaaggugagcagaacccuggaggaccaggccaacgaguacagagugaagcuggaggaggcccagagaagccugaacgacuucaccacccagagagccaagcugcagaccgagaacggcgagcuggccagacagcuggaggagaaggaggcccugaucagccagcugaccagaggcaagcugagcuacacccagcagauggaggaccugaagagacagcuggaggaggagggcaaggccaagaacgcccuggcccacgcccugcagagcgccagacacgacugcgaccugcugagagagcaguacgaggaggagaccgaggccaaggccgagcugcagagagugcugagcaaggccaacagcgagguggcccaguggagaaccaaguacgagaccgacgccauccagagaaccgaggagcuggaggaggccaagaagaagcuggcccagagacugcaggacgccgaggaggccguggaggccgugaacgccaagugcagcagccuggagaagaccaagcacagacugcagaacgagaucgaggaccugaugguggacguggagagaagcaacgccgccgccgccgcccuggacaagaagcagagaaacuucgacaagauccuggccgaguggaagcagaaguacgaggagagccagagcgagcuggagagcagccagaaggaggccagaagccugagcaccgagcuguucaagcugaagaacgccuacgaggagagccuggagcaccuggagaccuucaagagagagaacaagaaccugcaggaggagaucagcgaccugaccgagcagcugggcgagggcggcaagaacgugcacgagcuggagaaggugagaaagcagcuggagguggagaagcuggagcugcagagcgcccuggaggaggccgaggccagccuggagcacgaggagggcaagauccugagagcccagcuggaguucaaccagaucaaggccgagaucgagagaaagcuggccgagaaggacgaggagauggagcaggccaagagaaaccaccagagagugguggacagccugcagaccagccuggacgccgagaccagaagcagaaacgaggugcugagagugaagaagaagauggagggcgaccugaacgagauggagauccagcugagccacgccaacagaauggccgccgaggcccagaagcaggugaagagccugcagagccugcugaaggacacccagauccagcuggacgacgccgugagagccaacgacgaccugaaggagaacaucgccaucguggagagaagaaacaaccugcugcaggccgagcuggaggagcugagagccgugguggagcagaccgagagaagcagaaagcuggccgagcaggagcugaucgagaccagcgagagagugcagcugcugcacagccagaacaccagccugaucaaccagaagaagaagauggagagcgaccugacccagcugcagagcgagguggaggaggccgugcaggagugcagaaacgccgaggagaaggccaagaaggccaucaccgacgccgccaugauggccgaggagcugaagaaggagcaggacaccagcgcccaccuggagagaaugaagaagaacauggagcagaccaucaaggaccugcagcacagacuggacgaggccgagcagaucgcccugaagggcggcaagaagcagcugcagaagcuggaggccagagugagagagcuggagggcgagcuggaggccgagcagaagagaaacgccgagagcgugaagggcaugagaaagagcgagagaagaaucaaggagcugaccuaccagaccgaggaggacaagaagaaccugcugagacugcaggaccugguggacaagcugcagcugaaggugaaggccuacaagagacaggccgaggaggccgaggagcaggccaacaccaaccugagcaaguucagaaaggugcagcacgagcuggacgaggccgaggagagagccgacaucgccgagagccaggugaacaagcugagagccaagagcagagacaucggcgccaagcagaagaugcacgacgaggaguaa

SEQ ID NO: 20219 - RNA, 5952 nt, Artificial Sequence
  MYH7B__Homo_sapiens__NP_065935
augagcggcaacaagagaggcagcagagccagcugcccccacagaggcgccgagugccugcugcccugggccgcccugaaccugcagggcuuccagcugcugcugcugcaccccagcgccaccgccaugauggacgugagcgagcugggcgagagcgccagauaccugagacagggcuaccaggagaugaccaaggugcacaccauccccugggacggcaagaagagagugugggugcccgacgagcaggacgccuacguggaggccgaggugaagagcgaggccaccggcggcagagugaccguggagaccaaggaccagaaggugcugauggugagagaggccgagcugcagcccaugaacccccccagauucgaccugcuggaggacauggccaugaugacccaccugaacgaggccagcgugcugcacaaccugagacagagauacgccagauggaugaucuacaccuacagcggccuguucugcgugaccaucaaccccuacaaguggcugcccguguacaccgccagcgugguggccgccuacaagggcaagagaagaagcgacagccccccccacaucuacgccguggccgacaacgccuacaacgacaugcugagaaacagagacaaccagagcaugcugaucaccggcgagagcggcgccggcaagaccgugaacaccaagagagugauccaguacuucgccaucguggccgcccugggcgacggccccggcaagaaggcccaguuccuggccaccaagaccggcggcacccuggaggaccagaucaucgaggccaaccccgccauggaggccuucggcaacgccaagacccugagaaacgacaacagcagcagauucggcaaguucaucagaauccacuucggccccagcggcaagcuggccagcgccgacaucgacagcuaccugcuggagaagagcagagugaucuuccagcugcccggcgagagaagcuaccacguguacuaccagauccugagcggcagaaagcccgagcugcaggacaugcugcugcugagcaugaaccccuacgacuaccacuucugcagccagggcgugaucaccguggacaacaugaacgacggcgaggagcugaucgccaccgaccacgccauggacauccugggcuucagcguggacgagaagugcgccugcuacaagaucgugggcgcccugcugcacuucggcaacaugaaguucaagcagaagcagagagaggagcaggccgaggccgacggcaccgagagcgccgacaaggccgccuaccugaugggcgugagcagcggcgaccugcugaagggccugcugcaccccagagugagagugggcaacgaguacgugaccaagggccagagcguggagcaggugguguucgccgugggcgcccuggccaaggccaccuacgacagacuguucagauggcuggugagcagaaucaaccagacccuggacaccaagcugcccagacaguucuucaucggcgugcuggacaucgccggcuucgagaucuucgaguucaacagcuucgagcagcugugcaucaacuucaccaacgagaagcugcagcaguucuucaaccagcacauguucgugcuggagcaggaggaguacaagagagagggcaucgacuggguguucaucgacuucggccuggaccugcagcccugcaucgaccugaucgagaagccccugggcauccugagcauccuggaggaggagugcauguuccccaaggccagcgacgccagcuucagagccaagcuguacgacaaccacgccggcaagagccccaacuuccagcagcccagacccgacaagaagagaaaguaccaggcccacuucgagguggugcacuacgccggcguggugcccuacagcaucgugggcuggcuggagaagaacaaggacccccugaacgagaccguggugcccaucuuccagaagagccagaacagacugcuggccacccuguacgagaacuacgccggcagcugcagcaccgagccccccaagagcggcgugaaggagaagagaaagaaggccgccagcuuccagaccgugagccagcugcacaaggagaaccugaacaagcugaugaccaaccugagagccacccagccccacuucgugagaugcaucgugcccaacgagaacaagacccccggcgugauggacgccuuccuggugcugcaccagcugagaugcaacggcgugcuggagggcaucagaaucugcagacagggcuuccccaacagacugcuguacaccgacuucagacagagauacagaauccugaaccccagcgccauccccgacgacaccuucauggacagcagaaaggccaccgagaagcugcugggcagccuggaccuggaccacacccaguaccaguucggccacaccaagguguucuucaaggccggccugcugggcgugcuggaggagcugagagaccagagacuggccaaggugcugacccugcugcaggccagaagcagaggcagacugaugagacuggaguaccagagacugcugggcggcagagacgcccuguucaccauccaguggaacaucagagccuucaacgccgugaagaacuggagcuggaugaagcuguucuucaagaugaagccccugcugagaagcgcccaggccgaggaggagcuggccgcccugagagccgagcugagaggccugagaggcgcccuggccgccgccgaggccaagagacaggagcuggaggagacccacgugagcaucacccaggagaagaacgaccuggcccugcagcugcaggccgagcaggacaaccuggccgacgccgaggagagaugccaccugcugaucaagagcaaggugcagcuggagggcaaggugaaggagcugagcgagagacuggaggacgaggaggaggugaacgccgaccuggccgccagaagaagaaagcuggaggacgagugcaccgagcugaagaaggacaucgacgaccuggagcugacccuggccaaggccgagaaggagaagcaggccaccgagaacaaggugaagaaccugaccgaggagauggccgcccuggacgagagcguggccagacugaccaaggagaagaaggcccugcaggaggcccaccagcaggcccugggcgaccugcaggccgaggaggacagagugagcgcccugaccaaggccaagcugagacuggagcagcagguggaggaccuggagugcagccuggagcaggagaagaagcugagaauggacaccgagagagccaagagaaagcuggagggcgaccugaagcugacccaggagagcguggccgacgccgcccaggacaagcagcagcuggaggagaagcugaagaagaaggacagcgagcugagccagcugagccugagaguggaggacgagcagcugcugggcgcccagaugcagaagaagaucaaggagcugcaggccagagccgaggagcuggaggaggagcuggaggccgagagagccgccagagccagaguggagaagcagagagccgaggccgccagagagcuggaggagcugagcgagagacuggaggaggccggcggcgccagcgccggccagagagagggcugcagaaagagagaggccgagcugggcagacugagaagagagcuggaggaggccgcccugagacacgaggccaccguggccgcccugagaagaaagcaggccgagggcgccgccgagcugggcgagcagguggacagccugcagagagugagacagaagcuggagaaggagaagagcgagcugagaauggagguggacgaccuggccgccaacguggagacccugaccagagccaaggccagcgccgagaagcugugcagaaccuacgaggaccagcugagcgaggccaagaucaagguggaggagcugcagagacagcuggccgacgccagcacccagagaggcagacugcagaccgagagcggcgagcugagcagacugcuggaggagaaggagugccugaucagccagcugagcagaggcaaggcccuggccgcccagagccuggaggagcugagaagacagcuggaggaggagagcaaggccaagagcgcccuggcccacgccgugcaggcccugagacacgacugcgaccugcugagagagcagcacgaggaggaggccgaggcccaggccgagcugcagagacugcugagcaaggccaacgccgagguggcccaguggagaagcaaguacgaggccgacgccauccagagaaccgaggagcuggaggaggccaagaagaagcuggcccugagacugcaggaggccgaggagggcguggaggccgccaacgccaagugcagcagccuggagaaggccaagcugagacugcagaccgagagcgaggacgugacccuggagcuggagagagccaccagcgccgccgccgcccuggacaagaagcagagacaccuggagagagcccuggaggagagaagaagacaggaggaggagaugcagagagagcuggaggccgcccagagagagagcagaggccugggcaccgagcuguucagacugagacacggccacgaggaggcccuggaggcccuggagacccugaagagagagaacaagaaccugcaggaggagaucagcgaccugaccgaccaggugagccugagcggcaagagcauccaggagcuggagaagaccaagaaggcccuggagggcgagaagagcgagauccaggccgcccuggaggaggccgagggcgcccuggagcuggaggagaccaagacccugagaauccagcuggagcugagccaggugaaggccgagguggacagaaagcuggccgagaaggacgaggagugcgccaaccugagaagaaaccaccagagagccguggagagccugcaggccagccuggacgccgagaccagagccagaaacgaggcccugagacugaagaagaagauggagggcgaccugaacgaccuggagcugcagcugggccacgccaccagacaggccaccgaggcccaggccgccaccagacugaugcaggcccagcugaaggaggagcaggccggcagagacgaggagcagagacuggccgccgagcugcacgagcaggcccaggcccuggagagaagagccagccugcuggccgccgagcuggaggagcugagagccgcccuggagcagggcgagagaagcagaagacuggccgagcaggagcugcuggaggccaccgagagacugaaccugcugcacagccagaacaccggccugcugaaccagaagaagaagcuggaggccgaccuggcccagcugagcggcgagguggaggaggccgcccaggagagaagagaggccgaggagaaggccaagaaggccaucaccgacgccgccaugauggccgaggagcugaagaaggagcaggacaccagcgcccaccuggagagaaugaagaagacccuggagcagaccgugagagagcugcaggccagacuggaggaggccgagcaggccgcccugagaggcggcaagaagcaggugcagaagcuggaggccaaggugagagagcuggaggccgagcuggacgccgagcagaagaagcacgccgaggcccugaagggcgugagaaagcacgagagaagagugaaggagcuggccuaccaggccgaggaggacagaaagaaccuggccagaaugcaggaccugguggacaagcugcagagcaaggugaagagcuacaagagacaguucgaggaggccgagcagcaggccaacaccaaccuggccaaguacagaaaggcccagcacgagcuggacgacgccgaggagagagccgacauggccgagacccaggccaacaagcugagagccagaaccagagacgcccugggccccaagcacaaggaguaa

SEQ ID NO: 20220 - RNA, 5808 nt, Artificial Sequence
  MYH7__Homo_sapiens__NP_000248
augggcgacagcgagauggccguguucggcgccgccgcccccuaccugagaaagagcgagaaggagagacuggaggcccagaccagacccuucgaccugaagaaggacguguucgugcccgacgacaagcaggaguucgugaaggccaagaucgugagcagagagggcggcaaggugaccgccgagaccgaguacggcaagaccgugaccgugaaggaggaccaggugaugcagcagaacccccccaaguucgacaagaucgaggacauggccaugcugaccuuccugcacgagcccgccgugcuguacaaccugaaggacagauacggcagcuggaugaucuacaccuacagcggccuguucugcgugaccgugaaccccuacaaguggcugcccguguacacccccgaggugguggccgccuacagaggcaagaagagaagcgaggcccccccccacaucuucagcaucagcgacaacgccuaccaguacaugcugaccgacagagagaaccagagcauccugaucaccggcgagagcggcgccggcaagaccgugaacaccaagagagugauccaguacuucgccgugaucgccgccaucggcgacagaagcaagaaggaccagagccccggcaagggcacccuggaggaccagaucauccaggccaaccccgcccuggaggccuucggcaacgccaagaccgugagaaacgacaacagcagcagauucggcaaguucaucagaauccacuucggcgccaccggcaagcuggccagcgccgacaucgagaccuaccugcuggagaagagcagagugaucuuccagcugaaggccgagagagacuaccacaucuucuaccagauccugagcaacaagaagcccgagcugcuggacaugcugcugaucaccaacaaccccuacgacuacgccuucaucagccagggcgagaccaccguggccagcaucgacgacgccgaggagcugauggccaccgacaacgccuucgacgugcugggcuucaccagcgaggagaagaacagcauguacaagcugaccggcgccaucaugcacuucggcaacaugaaguucaagcugaagcagagagaggagcaggccgagcccgacggcaccgaggaggccgacaagagcgccuaccugaugggccugaacagcgccgaccugcugaagggccugugccaccccagagugaaggugggcaacgaguacgugaccaagggccagaacgugcagcaggugaucuacgccaccggcgcccuggccaaggccguguacgagagaauguucaacuggauggugaccagaaucaacgccacccuggagaccaagcagcccagacaguacuucaucggcgugcuggacaucgccggcuucgagaucuucgacuucaacagcuucgagcagcugugcaucaacuucaccaacgagaagcugcagcaguucuucaaccaccacauguucgugcuggagcaggaggaguacaagaaggagggcaucgaguggaccuucaucgacuucggcauggaccugcaggccugcaucgaccugaucgagaagcccaugggcaucaugagcauccuggaggaggagugcauguuccccaaggccaccgacaugaccuucaaggccaagcuguucgacaaccaccugggcaagagcgccaacuuccagaagcccagaaacaucaagggcaagcccgaggcccacuucagccugauccacuacgccggcaucguggacuacaacaucaucggcuggcugcagaagaacaaggacccccugaacgagaccguggugggccuguaccagaagagcagccugaagcugcugagcacccuguucgccaacuacgccggcgccgacgcccccaucgagaagggcaagggcaaggccaagaagggcagcagcuuccagaccgugagcgcccugcacagagagaaccugaacaagcugaugaccaaccugagaagcacccacccccacuucgugagaugcaucauccccaacgagaccaagagccccggcgugauggacaacccccuggugaugcaccagcugagaugcaacggcgugcuggagggcaucagaaucugcagaaagggcuuccccaacagaauccuguacggcgacuucagacagagauacagaauccugaaccccgccgccauccccgagggccaguucaucgacagcagaaagggcgccgagaagcugcugagcagccuggacaucgaccacaaccaguacaaguucggccacaccaagguguucuucaaggccggccugcugggccugcuggaggagaugagagacgagagacugagcagaaucaucaccagaauccaggcccagagcagaggcgugcuggccagaauggaguacaagaagcugcuggagagaagagacagccugcuggugauccaguggaacaucagagccuucaugggcgugaagaacuggcccuggaugaagcuguacuucaagaucaagccccugcugaagagcgccgagagagagaaggagauggccagcaugaaggaggaguucaccagacugaaggaggcccuggagaagagcgaggccagaagaaaggagcuggaggagaagauggugagccugcugcaggagaagaacgaccugcagcugcaggugcaggccgagcaggacaaccuggccgacgccgaggagagaugcgaccagcugaucaagaacaagauccagcuggaggccaaggugaaggagaugaacgagagacuggaggacgaggaggagaugaacgccgagcugaccgccaagaagagaaagcuggaggacgagugcagcgagcugaagagagacaucgacgaccuggagcugacccuggccaagguggagaaggagaagcacgccaccgagaacaaggugaagaaccugaccgaggagauggccggccuggacgagaucaucgccaagcugaccaaggagaagaaggcccugcaggaggcccaccagcaggcccuggacgaccugcaggccgaggaggacaaggugaacacccugaccaaggccaaggugaagcuggagcagcagguggacgaccuggagggcagccuggagcaggagaagaaggugagaauggaccuggagagagccaagagaaagcuggagggcgaccugaagcugacccaggagagcaucauggaccuggagaacgacaagcagcagcuggacgagagacugaagaagaaggacuucgagcugaacgcccugaacgccagaaucgaggacgagcaggcccugggcagccagcugcagaagaagcugaaggagcugcaggccagaaucgaggagcuggaggaggagcuggaggccgagagaaccgccagagccaagguggagaagcugagaagcgaccugagcagagagcuggaggagaucagcgagagacuggaggaggccggcggcgccaccagcgugcagaucgagaugaacaagaagagagaggccgaguuccagaagaugagaagagaccuggaggaggccacccugcagcacgaggccaccgccgccgcccugagaaagaagcacgccgacagcguggccgagcugggcgagcagaucgacaaccugcagagagugaagcagaagcuggagaaggagaagagcgaguucaagcuggagcuggacgacgugaccagcaacauggagcagaucaucaaggccaaggccaaccuggagaagaugugcagaacccuggaggaccagaugaacgagcacagaagcaaggccgaggagacccagagaagcgugaacgaccugaccagccagagagccaagcugcagaccgagaacggcgagcugagcagacagcuggacgagaaggaggcccugaucagccagcugaccagaggcaagcugaccuacacccagcagcuggaggaccugaagagacagcuggaggaggaggugaaggccaagaacgcccuggcccacgcccugcagagcgccagacacgacugcgaccugcugagagagcaguacgaggaggagaccgaggccaaggccgagcugcagagagugcugagcaaggccaacagcgagguggcccaguggagaaccaaguacgagaccgacgccauccagagaaccgaggagcuggaggaggccaagaagaagcuggcccagagacugcaggaggccgaggaggccguggaggccgugaacgccaagugcagcagccuggagaagaccaagcacagacugcagaacgagaucgaggaccugaugguggacguggagagaagcaacgccgccgccgccgcccuggacaagaagcagagaaacuucgacaagauccuggccgaguggaagcagaaguacgaggagagccagagcgagcuggagagcagccagaaggaggccagaagccugagcaccgagcuguucaagcugaagaacgccuacgaggagagccuggagcaccuggagaccuucaagagagagaacaagaaccugcaggaggagaucagcgaccugaccgagcagcugggcagcagcggcaagaccauccacgagcuggagaaggugagaaagcagcuggaggccgagaagauggagcugcagagcgcccuggaggaggccgaggccagccuggagcacgaggagggcaagauccugagagcccagcuggaguucaaccagaucaaggccgagaucgagagaaagcuggccgagaaggacgaggagauggagcaggccaagagaaaccaccugagagugguggacagccugcagaccagccuggacgccgagaccagaagcagaaacgaggcccugagagugaagaagaagauggagggcgaccugaacgagauggagauccagcugagccacgccaacagaauggccgccgaggcccagaagcaggugaagagccugcagagccugcugaaggacacccagauccagcuggacgacgccgugagagccaacgacgaccugaaggagaacaucgccaucguggagagaagaaacaaccugcugcaggccgagcuggaggagcugagagccgugguggagcagaccgagagaagcagaaagcuggccgagcaggagcugaucgagaccagcgagagagugcagcugcugcacagccagaacaccagccugaucaaccagaagaagaagauggacgccgaccugagccagcugcagaccgagguggaggaggccgugcaggagugcagaaacgccgaggagaaggccaagaaggccaucaccgacgccgccaugauggccgaggagcugaagaaggagcaggacaccagcgcccaccuggagagaaugaagaagaacauggagcagaccaucaaggaccugcagcacagacuggacgaggccgagcagaucgcccugaagggcggcaagaagcagcugcagaagcuggaggccagagugagagagcuggagaacgagcuggaggccgagcagaagagaaacgccgagagcgugaagggcaugagaaagagcgagagaagaaucaaggagcugaccuaccagaccgaggaggacagaaagaaccugcugagacugcaggaccugguggacaagcugcagcugaaggugaaggccuacaagagacaggccgaggaggccgaggagcaggccaacaccaaccugagcaaguucagaaaggugcagcacgagcuggacgaggccgaggagagagccgacaucgccgagagccaggugaacaagcugagagccaagagcagagacaucggcaccaagggccugaacgaggaguaa

SEQ ID NO: 20221 - RNA, 5814 nt, Artificial Sequence
  MYH8__Homo_sapiens__NP_002463
augagcgccagcagcgacgccgagauggccguguucggcgaggccgcccccuaccugagaaagagcgagaaggagagaaucgaggcccagaacaagcccuucgacgccaagaccagcguguucguggccgagcccaaggagagcuacgugaagagcaccauccagagcaaggagggcggcaaggugaccgugaagaccgagggcggcgccacccugaccgugagagaggaccagguguuccccaugaacccccccaaguacgacaagaucgaggacauggccaugaugacccaccugcacgagcccggcgugcuguacaaccugaaggagagauacgccgccuggaugaucuacaccuacagcggccuguucugcgugaccgugaaccccuacaaguggcugcccguguacaagcccgaggugguggccgccuacagaggcaagaagagacaggaggcccccccccacaucuucagcaucagcgacaacgccuaccaguucaugcugaccgacagagagaaccagagcauccugaucaccggcgagagcggcgccggcaagaccgugaacaccaagagagugauccaguacuucgccaccaucgccgugaccggcgagaagaagaaggacgagagcggcaagaugcagggcacccuggaggaccagaucaucagcgccaacccccugcuggaggccuucggcaacgccaagaccgugagaaacgacaacagcagcagauucggcaaguucaucagaauccacuucggcaccaccggcaagcuggccagcgccgacaucgagaccuaccugcuggagaagagcagagugaccuuccagcugaaggccgagagaagcuaccacaucuucuaccagaucaccagcaacaagaagcccgaccugaucgagaugcugcugaucaccaccaaccccuacgacuacgccuucgugagccagggcgagaucaccgugcccagcaucgacgaccaggaggagcugauggccaccgacagcgccaucgacauccugggcuucacccccgaggagaaggugagcaucuacaagcugaccggcgccgugaugcacuacggcaacaugaaguucaagcagaagcagagagaggagcaggccgagcccgacggcaccgagguggccgacaaggccgccuaccugcagagccugaacagcgccgaccugcugaaggcccugugcuaccccagagugaaggugggcaacgaguacgugaccaagggccagaccgugcagcagguguacaacgccgugggcgcccuggccaaggccguguacgagaagauguuccuguggauggugaccagaaucaaccagcagcuggacaccaagcagcccagacaguacuucaucggcgugcuggacaucgccggcuucgagaucuucgacuucaacagccuggagcagcugugcaucaacuucaccaacgagaagcugcagcaguucuucaaccaccacauguucgugcuggagcaggaggaguacaagaaggagggcaucgaguggaccuucaucgacuucggcauggaccuggccgccugcaucgagcugaucgagaagccccugggcaucuucagcauccuggaggaggagugcauguuccccaaggccaccgacaccagcuucaagaacaagcuguacgaccagcaccugggcaagagcgccaacuuccagaagcccaagguggugaagggcaaggccgaggcccacuucagccugauccacuacgccggcaccguggacuacaacaucaccggcuggcuggacaagaacaaggacccccugaacgacaccguggugggccuguaccagaagagcgccaugaagacccuggccagccuguucagcaccuacgccagcgccgaggccgacagcagcgccaagaagggcgccaagaagaagggcagcagcuuccagaccgugagcgcccuguucagagagaaccugaacaagcugaugaccaaccugagaagcacccacccccacuucgugagaugcaucauccccaacgagaccaagacccccggcgccauggagcacgagcuggugcugcaccagcugagaugcaacggcgugcuggagggcaucagaaucugcagaaagggcuuccccagcagaauccuguacggcgacuucaagcagagauacaaggugcugaacgccagcgccauccccgagggccaguucaucgacagcaagaaggccagcgagaagcugcuggccagcaucgacaucgaccacacccaguacaaguucggccacaccaagguguucuucaaggccggccugcugggccugcuggaggagaugagagacgagaagcuggcccagaucaucaccagaacccaggccgugugcagaggcuuccugaugagaguggaguaccagaagaugcugcagagaagagaggcccuguucugcauccaguacaacgugagagccuucaugaacgugaagcacuggcccuggaugaagcuguucuucaagaucaagccccugcugaagagcgccgagaccgagaaggagauggccaccaugaaggaggaguuccagaagaccaaggacgagcuggccaagagcgaggccaagagaaaggagcuggaggagaagauggugacccugcugaaggagaagaacgaccugcagcugcaggugcagagcgaggccgacagccuggccgacgccgaggagagaugcgagcagcugaucaagaacaagauccagcuggaggccaagaucaaggaggugaccgagagagccgaggaggaggaggagaucaacgccgagcugaccgccaagaagagaaagcuggaggacgagugcagcgagcugaagaaggacaucgacgaccuggagcugacccuggccaagguggagaaggagaagcacgccaccgagaacaaggugaagaaccugaccgaggagauggccggccuggacgagaccaucgccaagcugagcaaggagaagaaggcccugcaggagacccaccagcagacccuggacgaccugcaggccgaggaggacaaggugaacauccugaccaaggccaagaccaagcuggagcagcagguggacgaccuggagggcagccuggagcaggagaagaagcugagaauggaccuggagagagccaagagaaagcuggagggcgaccugaagcuggcccaggagagcaccauggacauggagaacgacaagcagcagcuggacgagaagcuggagaagaaggaguucgagaucagcaaccugaucagcaagaucgaggacgagcaggccguggagauccagcugcagaagaagaucaaggagcugcaggccagaaucgaggagcugggcgaggagaucgaggccgagagagccagcagagccaaggccgagaagcagagaagcgaccugagcagagagcuggaggagaucagcgagagacuggaggaggccggcggcgccaccagcgcccagguggagcugaacaagaagagagaggccgaguuccagaagcugagaagagaccuggaggaggccacccugcagcacgaggccaugguggccgcccugagaaagaagcacgccgacagcauggccgagcugggcgagcagaucgacaaccugcagagagugaagcagaagcuggagaaggagaagagcgagcugaagauggagaccgacgaccugagcagcaacgccgaggccaucagcaaggccaagggcaaccuggagaagaugugcagaagccuggaggaccaggugagcgagcugaagaccaaggaggaggagcagcagagacugaucaacgaccugaccgcccagagagccagacugcagaccgaggccggcgaguacagcagacagcuggacgagaaggacgcccuggugagccagcugagcagaagcaagcaggccagcacccagcagaucgaggagcugaagcaccagcuggaggaggagaccaaggccaagaacgcccuggcccacgcccugcagagcagcagacacgacugcgaccugcugagagagcaguacgaggaggagcaggagggcaaggccgagcugcagagagcccugagcaaggccaacagcgagguggcccaguggagaaccaaguacgagaccgacgccauccagagaaccgaggagcuggaggaggccaagaagaagcuggcccagagacugcaggaggccgaggagcacguggaggccgugaacgccaagugcgccagccuggagaagaccaagcagagacugcagaacgagguggaggaccugaugcuggacguggagagaagcaacgccgccugcgccgcccuggacaagaagcagagaaacuucgacaaggugcugagcgaguggaagcagaaguacgaggagacccaggccgagcuggaggccagccagaaggagagcagaagccugagcaccgagcuguucaaggugaagaacguguacgaggagagccuggaccagcuggagacccugagaagagagaacaagaaccugcagcaggagaucagcgaccugaccgagcagaucgccgagggcggcaagcagauccacgagcuggagaagaucaagaagcagguggagcaggagaagugcgagauccaggccgcccuggaggaggccgaggccagccuggagcacgaggagggcaagauccugagaauccagcuggagcugaaccaggugaagagcgagguggacagaaagaucgccgagaaggacgaggagaucgaccagcugaagagaaaccacaccagagugguggagaccaugcagagcacccuggacgccgagaucagaagcagaaacgacgcccugagagugaagaagaagauggagggcgaccugaacgagauggagauccagcugaaccacgccaacagacuggccgccgagagccugagaaacuacagaaacacccagggcauccugaaggagacccagcugcaccuggacgacgcccugagaggccaggaggaccugaaggagcagcuggccaucguggagagaagagccaaccugcugcaggccgagaucgaggagcugugggccacccuggagcagaccgagagaagcagaaagaucgccgagcaggagcugcuggacgccagcgagagagugcagcugcugcacacccagaacaccagccugaucaacaccaagaagaagcuggagaacgacgugagccagcugcagagcgagguggaggaggugauccaggagagcagaaacgccgaggagaaggccaagaaggccaucaccgacgccgccaugauggccgaggagcugaagaaggagcaggacaccagcgcccaccuggagagaaugaagaagaaccuggagcagaccgugaaggaccugcagcacagacuggacgaggccgagcagcuggcccugaagggcggcaagaagcagauccagaagcuggaggccagagugagagagcuggagggcgagguggagaacgagcagaagagaaacgccgaggccgugaagggccugagaaagcacgagagaagagugaaggagcugaccuaccagaccgaggaggacagaaagaacgugcugagacugcaggaccugguggacaagcugcaggccaaggugaagagcuacaagagacaggccgaggaggccgaggagcagagcaacgccaaccugagcaaguucagaaagcugcagcacgagcuggaggaggccgaggagagagccgacaucgccgagagccaggugaacaagcugagagugaagagcagagaggugcacaccaagaucagcgccgaguaa

SEQ ID NO: 20222 - RNA, 5883 nt, Artificial Sequence
  MYH9__Homo_sapiens__NP_002464
auggcccagcaggccgccgacaaguaccuguacguggacaagaacuucaucaacaacccccuggcccaggccgacugggccgccaagaagcuggugugggugcccagcgacaagagcggcuucgagcccgccagccugaaggaggaggugggcgaggaggccaucguggagcugguggagaacggcaagaaggugaaggugaacaaggacgacauccagaagaugaacccccccaaguucagcaagguggaggacauggccgagcugaccugccugaacgaggccagcgugcugcacaaccugaaggagagauacuacagcggccugaucuacaccuacagcggccuguucugcguggugaucaaccccuacaagaaccugcccaucuacagcgaggagaucguggagauguacaagggcaagaagagacacgagaugcccccccacaucuacgccaucaccgacaccgccuacagaagcaugaugcaggacagagaggaccagagcauccugugcaccggcgagagcggcgccggcaagaccgagaacaccaagaaggugauccaguaccuggccuacguggccagcagccacaagagcaagaaggaccagggcgagcuggagagacagcugcugcaggccaaccccauccuggaggccuucggcaacgccaagaccgugaagaacgacaacagcagcagauucggcaaguucaucagaaucaacuucgacgugaacggcuacaucgugggcgccaacaucgagaccuaccugcuggagaagagcagagccaucagacaggccaaggaggagagaaccuuccacaucuucuacuaccugcugagcggcgccggcgagcaccugaagaccgaccugcugcuggagcccuacaacaaguacagauuccugagcaacggccacgugaccauccccggccagcaggacaaggacauguuccaggagaccauggaggccaugagaaucaugggcauccccgaggaggagcagaugggccugcugagagugaucagcggcgugcugcagcugggcaacaucguguucaagaaggagagaaacaccgaccaggccagcaugcccgacaacaccgccgcccagaaggugagccaccugcugggcaucaacgugaccgacuucaccagaggcauccugacccccagaaucaaggugggcagagacuacgugcagaaggcccagaccaaggagcaggccgacuucgccaucgaggcccuggccaaggccaccuacgagagaauguucagauggcuggugcugagaaucaacaaggcccuggacaagaccaagagacagggcgccagcuucaucggcauccuggacaucgccggcuucgagaucuucgaccugaacagcuucgagcagcugugcaucaacuacaccaacgagaagcugcagcagcuguucaaccacaccauguucauccuggagcaggaggaguaccagagagagggcaucgaguggaacuucaucgacuucggccuggaccugcagcccugcaucgaccugaucgagaagcccgccggcccccccggcauccuggcccugcuggacgaggagugcugguuccccaaggccaccgacaagagcuucguggagaaggugaugcaggagcagggcacccaccccaaguuccagaagcccaagcagcugaaggacaaggccgacuucugcaucauccacuacgccggcaagguggacuacaaggccgacgaguggcugaugaagaacauggacccccugaacgacaacaucgccacccugcugcaccagagcagcgacaaguucgugagcgagcuguggaaggacguggacagaaucaucggccuggaccagguggccggcaugagcgagaccgcccugcccggcgccuucaagaccagaaagggcauguucagaaccgugggccagcuguacaaggagcagcuggccaagcugauggccacccugagaaacaccaaccccaacuucgugagaugcaucauccccaaccacgagaagaaggccggcaagcuggacccccaccuggugcuggaccagcugagaugcaacggcgugcuggagggcaucagaaucugcagacagggcuuccccaacagagugguguuccaggaguucagacagagauacgagauccugacccccaacagcauccccaagggcuucauggacggcaagcaggccugcgugcugaugaucaaggcccuggagcuggacagcaaccuguacagaaucggccagagcaagguguucuucagagccggcgugcuggcccaccuggaggaggagagagaccugaagaucaccgacgugaucaucggcuuccaggccugcugcagaggcuaccuggccagaaaggccuucgccaagagacagcagcagcugaccgccaugaaggugcugcagagaaacugcgccgccuaccugaagcugagaaacuggcagugguggagacuguucaccaaggugaagccccugcugcaggugagcagacaggaggaggagaugauggccaaggaggaggagcuggugaaggugagagagaagcagcuggccgccgagaacagacugaccgagauggagacccugcagagccagcugauggccgagaagcugcagcugcaggagcagcugcaggccgagaccgagcugugcgccgaggccgaggagcugagagccagacugaccgccaagaagcaggagcuggaggagaucugccacgaccuggaggccagaguggaggaggaggaggagagaugccagcaccugcaggccgagaagaagaagaugcagcagaacauccaggagcuggaggagcagcuggaggaggaggagagcgccagacagaagcugcagcuggagaaggugaccaccgaggccaagcugaagaagcuggaggaggagcagaucauccuggaggaccagaacugcaagcuggccaaggagaagaagcugcuggaggacagaaucgccgaguucaccaccaaccugaccgaggaggaggagaagagcaagagccuggccaagcugaagaacaagcacgaggccaugaucaccgaccuggaggagagacugagaagagaggagaagcagagacaggagcuggagaagaccagaagaaagcuggagggcgacagcaccgaccugagcgaccagaucgccgagcugcaggcccagaucgccgagcugaagaugcagcuggccaagaaggaggaggagcugcaggccgcccuggccagaguggaggaggaggccgcccagaagaacauggcccugaagaagaucagagagcuggagagccagaucagcgagcugcaggaggaccuggagagcgagagagccagcagaaacaaggccgagaagcagaagagagaccugggcgaggagcuggaggcccugaagaccgagcuggaggacacccuggacagcaccgccgcccagcaggagcugagaagcaagagagagcaggaggugaacauccugaagaagacccuggaggaggaggccaagacccacgaggcccagauccaggagaugagacagaagcacagccaggccguggaggagcuggccgagcagcuggagcagaccaagagagugaaggccaaccuggagaaggccaagcagacccuggagaacgagagaggcgagcuggccaacgaggugaaggugcugcugcagggcaagggcgacagcgagcacaagagaaagaagguggaggcccagcugcaggagcugcaggugaaguucaacgagggcgagagagugagaaccgagcuggccgacaaggugaccaagcugcagguggagcuggacaacgugaccggccugcugagccagagcgacagcaagagcagcaagcugaccaaggacuucagcgcccuggagagccagcugcaggacacccaggagcugcugcaggaggagaacagacagaagcugagccugagcaccaagcugaagcagguggaggacgagaagaacagcuucagagagcagcuggaggaggaggaggaggccaagcacaaccuggagaagcagaucgccacccugcacgcccagguggccgacaugaagaagaagauggaggacagcgugggcugccuggagaccgccgaggaggugaagagaaagcugcagaaggaccuggagggccugagccagagacacgaggagaagguggccgccuacgacaagcuggagaagaccaagaccagacugcagcaggagcuggacgaccugcugguggaccuggaccaccagagacagagcgccugcaaccuggagaagaagcagaagaaguucgaccagcugcuggccgaggagaagaccaucagcgccaaguacgccgaggagagagacagagccgaggccgaggccagagagaaggagaccaaggcccugagccuggccagagcccuggaggaggccauggagcagaaggccgagcuggagagacugaacaagcaguucagaaccgagauggaggaccugaugagcagcaaggacgacgugggcaagagcgugcacgagcuggagaagagcaagagagcccuggagcagcagguggaggagaugaagacccagcuggaggagcuggaggacgagcugcaggccaccgaggacgccaagcugagacuggaggugaaccugcaggccaugaaggcccaguucgagagagaccugcagggcagagacgagcagagcgaggagaagaagaagcagcuggugagacaggugagagagauggaggccgagcuggaggacgagagaaagcagagaagcauggccguggccgccagaaagaagcuggagauggaccugaaggaccuggaggcccacaucgacagcgccaacaagaacagagacgaggccaucaagcagcugagaaagcugcaggcccagaugaaggacugcaugagagagcuggacgacaccagagccagcagagaggagauccuggcccaggccaaggagaacgagaagaagcugaagagcauggaggccgagaugauccagcugcaggaggagcuggccgccgccgagagagccaagagacaggcccagcaggagagagacgagcuggccgacgagaucgccaacagcagcggcaagggcgcccuggcccuggaggagaagagaagacuggaggccagaaucgcccagcuggaggaggagcuggaggaggagcagggcaacaccgagcugaucaacgacagacugaagaaggccaaccugcagaucgaccagaucaacaccgaccugaaccuggagagaagccacgcccagaagaacgagaacgccagacagcagcuggagagacagaacaaggagcugaaggugaagcugcaggagauggagggcaccgugaagagcaaguacaaggccagcaucaccgcccuggaggccaagaucgcccagcuggaggagcagcuggacaacgagaccaaggagagacaggccgccugcaagcaggugagaagaaccgagaagaagcugaaggacgugcugcugcagguggacgacgagagaagaaacgccgagcaguacaaggaccaggccgacaaggccagcaccagacugaagcagcugaagagacagcuggaggaggccgaggaggaggcccagagagccaacgccagcagaagaaagcugcagagagagcuggaggacgccaccgagaccgccgacgccaugaacagagaggugagcagccugaagaacaagcugagaagaggcgaccugcccuucguggugcccagaagaauggccagaaagggcgccggcgacggcagcgacgaggagguggacggcaaggccgacggcgccgaggccaagcccgccgaguaa

SEQ ID NO: 20223 - RNA, 516 nt, Artificial Sequence
  MYL12A__Homo_sapiens__NP_001289977
augagcagcaagagaaccaagaccaagaccaagaagagaccccagagagccaccagcaacguguucgccauguucgaccagagccagauccaggaguucaaggaggccuucaacaugaucgaccagaacagagacggcuucaucgacaaggaggaccugcacgacaugcuggccagccugggcaagaaccccaccgacgaguaccuggacgccaugaugaacgaggcccccggccccaucaacuucaccauguuccugaccauguucggcgagaagcugaacggcaccgaccccgaggacgugaucagaaacgccuucgccugcuucgacgaggaggccaccggcaccauccaggaggacuaccugagagagcugcugaccaccaugggcgacagauucaccgacgaggagguggacgagcuguacagagaggcccccaucgacaagaagggcaacuucaacuacaucgaguucaccagaauccugaagcacggcgccaaggacaaggacgacuaa

SEQ ID NO: 20224 - RNA, 519 nt, Artificial Sequence
  MYL12B__Homo_sapiens__NP_001138416
augagcagcaagaaggccaagaccaagaccaccaagaagagaccccagagagccaccagcaacguguucgccauguucgaccagagccagauccaggaguucaaggaggccuucaacaugaucgaccagaacagagacggcuucaucgacaaggaggaccugcacgacaugcuggccagccugggcaagaaccccaccgacgccuaccuggacgccaugaugaacgaggcccccggccccaucaacuucaccauguuccugaccauguucggcgagaagcugaacggcaccgaccccgaggacgugaucagaaacgccuucgccugcuucgacgaggaggccaccggcaccauccaggaggacuaccugagagagcugcugaccaccaugggcgacagauucaccgacgaggagguggacgagcuguacagagaggcccccaucgacaagaagggcaacuucaacuacaucgaguucaccagaauccugaagcacggcgccaaggacaaggacgacuaa

SEQ ID NO: 20225 - RNA, 585 nt, Artificial Sequence
  MYL1__Homo_sapiens__NP_524144
auggcccccaagaaggacgugaagaagcccguggccgccgccgccgccgcccccgcccccgcccccgcccccgcccccgcccccgcccccgccaagcccaaggaggagaagaucgaccugagcgccaucaagaucgaguucagcaaggagcagcaggacgaguucaaggaggccuuccugcuguucgacagaaccggcgacagcaagaucacccugagccaggugggcgacgugcugagagcccugggcaccaaccccaccaacgccgaggugagaaaggugcugggcaaccccagcaacgaggagcugaacgccaagaagaucgaguucgagcaguuccugcccaugaugcaggccaucagcaacaacaaggaccaggccaccuacgaggacuucguggagggccugagaguguucgacaaggagggcaacggcaccgugaugggcgccgagcugagacacgugcuggccacccugggcgagaagaugaaggaggaggagguggaggcccugauggccggccaggaggacagcaacggcugcaucaacuacgaggccuucgugaagcacaucaugagcaucuaa

SEQ ID NO: 20226 - RNA, 501 nt, Artificial Sequence
  MYL2__Homo_sapiens__NP_000423
auggcccccaagaaggccaagaagagagccggcggcgccaacagcaacguguucagcauguucgagcagacccagauccaggaguucaaggaggccuucaccaucauggaccagaacagagacggcuucaucgacaagaacgaccugagagacaccuucgccgcccugggcagagugaacgugaagaacgaggagaucgacgagaugaucaaggaggcccccggccccaucaacuucaccguguuccugaccauguucggcgagaagcugaagggcgccgaccccgaggagaccauccugaacgccuucaagguguucgaccccgagggcaagggcgugcugaaggccgacuacgugagagagaugcugaccacccaggccgagagauucagcaaggaggagguggaccagauguucgccgccuucccccccgacgugaccggcaaccuggacuacaagaaccuggugcacaucaucacccacggcgaggagaaggacuaa

SEQ ID NO: 20227 - RNA, 588 nt, Artificial Sequence
  MYL3__Homo_sapiens__NP_000249
auggcccccaagaagcccgagcccaagaaggacgacgccaaggccgcccccaaggccgcccccgcccccgcccccccccccgagcccgagagacccaaggagguggaguucgacgccagcaagaucaagaucgaguucacccccgagcagaucgaggaguucaaggaggccuucaugcuguucgacagaacccccaagugcgagaugaagaucaccuacggccagugcggcgacgugcugagagcccugggccagaaccccacccaggccgaggugcugagagugcugggcaagcccagacaggaggagcugaacaccaagaugauggacuucgagaccuuccugcccaugcugcagcacaucagcaagaacaaggacaccggcaccuacgaggacuucguggagggccugagaguguucgacaaggagggcaacggcaccgugaugggcgccgagcugagacacgugcuggccacccugggcgagagacugaccgaggacgagguggagaagcugauggccggccaggaggacagcaacggcugcaucaacuacgaggccuucgugaagcacaucaugagcagcuaa

SEQ ID NO: 20228 - RNA, 594 nt, Artificial Sequence
  MYL4__Homo_sapiens__NP_001002841
auggcccccaagaagcccgagcccaagaaggaggccgccaagcccgcccccgcccccgcccccgcccccgcccccgcccccgcccccgcccccgaggcccccaaggagcccgccuucgaccccaagagcgugaagaucgacuucaccgccgaccagaucgaggaguucaaggaggccuucagccuguucgacagaacccccaccggcgagaugaagaucaccuacggccagugcggcgacgugcugagagcccugggccagaaccccaccaacgccgaggugcugagagugcugggcaagcccaagcccgaggagaugaacgugaagaugcuggacuucgagaccuuccugcccauccugcagcacaucagcagaaacaaggagcagggcaccuacgaggacuucguggagggccugagaguguucgacaaggagagcaacggcaccgugaugggcgccgagcugagacacgugcuggccacccugggcgagaagaugaccgaggccgagguggagcagcugcuggccggccaggaggacgccaacggcugcaucaacuacgaggccuucgugaagcacaucaugagcggcuaa

SEQ ID NO: 20229 - RNA, 456 nt, Artificial Sequence
  MYL6__Homo_sapiens__NP_066299
augugcgacuucaccgaggaccagaccgccgaguucaaggaggccuuccagcuguucgacagaaccggcgacggcaagauccuguacagccagugcggcgacgugaugagagcccugggccagaaccccaccaacgccgaggugcugaaggugcugggcaaccccaagagcgacgagaugaacgugaaggugcuggacuucgagcacuuccugcccaugcugcagaccguggccaagaacaaggaccagggcaccuacgaggacuacguggagggccugagaguguucgacaaggagggcaacggcaccgugaugggcgccgagaucagacacgugcuggugacccugggcgagaagaugaccgaggaggagguggagaugcugguggccggccacgaggacagcaacggcugcaucaacuacgaggccuucgugagacacauccugagcggcuaa

SEQ ID NO: 20230 - RNA, 528 nt, Artificial Sequence
  MYL7__Homo_sapiens__NP_067046
auggccagcagaaaggccggcaccagaggcaagguggccgccaccaagcaggcccagagaggcagcagcaacguguucagcauguucgagcaggcccagauccaggaguucaaggaggccuucagcugcaucgaccagaacagagacggcaucaucugcaaggccgaccugagagagaccuacagccagcugggcaaggugagcgugcccgaggaggagcuggacgccaugcugcaggagggcaagggccccaucaacuucaccguguuccugacccuguucggcgagaagcugaacggcaccgaccccgaggaggccauccugagcgccuucagaauguucgaccccagcggcaagggcguggugaacaaggacgaguucaagcagcugcugcugacccaggccgacaaguucagccccgccgagguggagcagauguucgcccugacccccauggaccuggccggcaacaucgacuacaagagccugugcuacaucaucacccacggcgacgagaaggaggaguaa

SEQ ID NO: 20231 - RNA, 519 nt, Artificial Sequence
  MYL9__Homo_sapiens__NP_006088
augagcagcaagagagccaaggccaagaccaccaagaagagaccccagagagccaccagcaacguguucgccauguucgaccagagccagauccaggaguucaaggaggccuucaacaugaucgaccagaacagagacggcuucaucgacaaggaggaccugcacgacaugcuggccagccugggcaagaaccccaccgacgaguaccuggagggcaugaugagcgaggcccccggccccaucaacuucaccauguuccugaccauguucggcgagaagcugaacggcaccgaccccgaggacgugaucagaaacgccuucgccugcuucgacgaggaggccagcggcuucauccacgaggaccaccugagagagcugcugaccaccaugggcgacagauucaccgacgaggagguggacgagauguacagagaggcccccaucgacaagaagggcaacuucaacuacguggaguucaccagaauccugaagcacggcgccaaggacaaggacgacuaa

SEQ ID NO: 20232 - RNA, 1338 nt, Artificial Sequence
  MYLIP__Homo_sapiens__NP_037394
augcugugcuacgugaccagacccgacgccgugcugauggagguggagguggaggccaaggccaacggcgaggacugccugaaccaggugugcagaagacugggcaucaucgagguggacuacuucggccugcaguucaccggcagcaagggcgagagccuguggcugaaccugagaaacagaaucagccagcagauggacggccuggcccccuacagacugaagcugagagugaaguucuucguggagccccaccugauccugcaggagcagaccagacacaucuucuuccugcacaucaaggaggcccugcuggccggccaccugcugugcagccccgagcaggccguggagcugagcgcccugcuggcccagaccaaguucggcgacuacaaccagaacaccgccaaguacaacuacgaggagcugugcgccaaggagcugagcagcgccacccugaacagcaucguggccaagcacaaggagcuggagggcaccagccaggccagcgccgaguaccaggugcugcagaucgugagcgccauggagaacuacggcaucgaguggcacagcgugagagacagcgagggccagaagcugcugaucggcgugggccccgagggcaucagcaucugcaaggacgacuucagccccaucaacagaaucgccuaccccguggugcagauggccacccagagcggcaagaacguguaccugaccgugaccaaggagagcggcaacagcaucgugcugcuguucaagaugaucagcaccagagccgccagcggccuguacagagccaucaccgagacccacgccuucuacagaugcgacaccgugaccagcgccgugaugaugcaguacagcagagaccugaagggccaccuggccagccuguuccugaacgagaacaucaaccugggcaagaaguacguguucgacaucaagagaaccagcaaggagguguacgaccacgccagaagagcccuguacaacgccggcgugguggaccuggugagcagaaacaaccagagccccagccacagcccccugaagagcagcgagagcagcaugaacugcagcagcugcgagggccugagcugccagcagaccagagugcugcaggagaagcugagaaagcugaaggaggccaugcugugcauggugugcugcgaggaggagaucaacagcaccuucugccccugcggccacaccgugugcugcgagagcugcgccgcccagcugcagagcugccccgugugcagaagcagaguggagcacgugcagcacguguaccugcccacccacaccagccugcugaaccugaccgugaucuaa

SEQ ID NO: 20233 - RNA, 1791 nt, Artificial Sequence
  MYLK2__Homo_sapiens__NP_149109
auggccaccgagaacggcgccguggagcugggcauccagaaccccagcaccgacaaggcccccaagggccccaccggcgagagaccccuggccgccggcaaggaccccggcccccccgaccccaagaaggcccccgacccccccacccugaagaaggacgccaaggcccccgccagcgagaagggcgacggcacccuggcccagcccagcaccagcagccagggccccaagggcgagggcgacagaggcggcggccccgccgagggcagcgccggcccccccgccgcccugccccagcagaccgccacccccgagaccagcgugaagaagcccaaggccgagcagggcgccagcggcagccaggaccccggcaagcccagagugggcaagaaggccgccgagggccaggccgccgccagaagaggcagccccgccuuccugcacagccccagcugccccgccaucaucagcagcagcgagaagcugcuggccaagaagccccccagcgaggccagcgagcugaccuucgagggcgugcccaugacccacagccccaccgaccccagacccgccaaggccgaggagggcaagaacauccuggccgagagccagaaggaggugggcgagaagacccccggccaggccggccaggccaagaugcagggcgacaccagcagaggcaucgaguuccaggccgugcccagcgagaagagcgaggugggccaggcccugugccugaccgccagagaggaggacugcuuccagauccuggacgacugcccccccccccccgcccccuucccccacagaaugguggagcugagaaccggcaacgugagcagcgaguucagcaugaacagcaaggaggcccugggcggcggcaaguucggcgccgugugcaccugcauggagaaggccaccggccugaagcuggccgccaaggugaucaagaagcagacccccaaggacaaggagauggugcugcuggagaucgaggugaugaaccagcugaaccacagaaaccugauccagcuguacgccgccaucgagaccccccacgagaucgugcuguucauggaguacaucgagggcggcgagcuguucgagagaaucguggacgaggacuaccaccugaccgagguggacaccaugguguucgugagacagaucugcgacggcauccuguucaugcacaagaugagagugcugcaccuggaccugaagcccgagaacauccugugcgugaacaccaccggccaccuggugaagaucaucgacuucggccuggccagaagauacaaccccaacgagaagcugaaggugaacuucggcacccccgaguuccugagccccgagguggugaacuacgaccagaucagcgacaagaccgacauguggagcaugggcgugaucaccuacaugcugcugagcggccugagccccuuccugggcgacgacgacaccgagacccugaacaacgugcugagcggcaacugguacuucgacgaggagaccuucgaggccgugagcgacgaggccaaggacuucgugagcaaccugaucgugaaggaccagagagccagaaugaacgccgcccagugccuggcccaccccuggcugaacaaccuggccgagaaggccaagagaugcaacagaagacugaagagccagauccugcugaagaaguaccugaugaagagaagauggaagaagaacuucaucgccgugagcgccgccaacagauucaagaagaucagcagcagcggcgcccugauggcccugggcguguaa

SEQ ID NO: 20234 - RNA, 2460 nt, Artificial Sequence
  MYLK3__Homo_sapiens__NP_872299
augagcggcaccagcaaggagagccugggccacggcggccugcccggccugggcaagaccugccugaccaccauggacaccaagcugaacaugcugaacgagaagguggaccagcugcugcacuuccaggaggacgugaccgagaagcugcagagcaugugcagagacaugggccaccuggagagaggccugcacagacuggaggccagcagagcccccggccccggcggcgccgacggcgugccccacaucgacacccaggccggcuggcccgaggugcuggagcuggugagagccaugcagcaggacgccgcccagcacggcgccagacuggaggcccuguucagaaugguggccgccguggacagagccaucgcccuggugggcgccaccuuccagaagagcaagguggccgacuuccugaugcagggcagagugcccuggagaagaggcagccccggcgacagccccgaggagaacaaggagagaguggaggaggagggcggcaagcccaagcacgugcugagcaccagcggcgugcagagcgacgccagagagcccggcgaggagagccagaaggccgacgugcuggagggcaccgccgagagacugccccccaucagagccagcggccugggcgccgaccccgcccaggccguggugagccccggccagggcgacggcgugcccggccccgcccaggccuuccccggccaccugccccugcccaccaagguggaggccaaggcccccgagacccccagcgagaaccugagaaccggccuggagcuggcccccgcccccggcagagugaacguggugagccccagccuggagguggcccccggcgccggccagggcgccagcagcagcagacccgaccccgagccccuggaggagggcaccagacugacccccggccccggcccccagugccccggcccccccggccugcccgcccaggccagagccacccacagcggcggcgagaccccccccagaaucagcauccacauccaggagauggacacccccggcgagaugcugaugaccggcagaggcagccugggccccacccugaccaccgaggcccccgccgccgcccagcccggcaagcagggcccccccggcaccggcagaugccugcaggcccccggcaccgagcccggcgagcagacccccgagggcgccagagagcugagcccccugcaggagagcagcagccccggcggcgugaaggccgaggaggagcagagagccggcgccgagcccggcaccagacccagccuggccagaagcgacgacaacgaccacgaggugggcgcccugggccugcagcagggcaagagccccggcgccggcaaccccgagcccgagcaggacugcgccgccagagcccccgugagagccgaggccgugagaagaaugccccccggcgccgaggccggcagcguggugcuggacgacagccccgccccccccgcccccuucgagcacagaguggugagcgugaaggagaccagcaucagcgccggcuacgaggugugccagcacgaggugcugggcggcggcagauucggccaggugcacagaugcaccgagaagagcaccggccugccccuggccgccaagaucaucaaggugaagagcgccaaggacagagaggacgugaagaacgagaucaacaucaugaaccagcugagccacgugaaccugauccagcuguacgacgccuucgagagcaagcacagcugcacccuggugauggaguacguggacggcggcgagcuguucgacagaaucaccgacgagaaguaccaccugaccgagcuggacguggugcuguucaccagacagaucugcgagggcgugcacuaccugcaccagcacuacauccugcaccuggaccugaagcccgagaacauccugugcgugaaccagaccggccaccagaucaagaucaucgacuucggccuggccagaagauacaagcccagagagaagcugaaggugaacuucggcacccccgaguuccuggcccccgagguggugaacuacgaguucgugagcuuccccaccgacauguggagcgugggcgugaucaccuacaugcugcugagcggccugagccccuuccugggcgagaccgacgccgagaccaugaacuucaucgugaacugcagcugggacuucgacgccgacaccuucgagggccugagcgaggaggccaaggacuucgugagcagacugcuggugaaggagaagagcugcagaaugagcgccacccagugccugaagcacgaguggcugaacaaccugcccgccaaggccagcagaagcaagaccagacugaagagccagcugcugcugcagaaguacaucgcccagagaaaguggaagaagcacuucuacguggugaccgccgccaacagacugagaaaguuccccaccagccccuaa

SEQ ID NO: 20235 - RNA, 5745 nt, Artificial Sequence
  MYLK__Homo_sapiens__NP_444253
augggcgacgugaagcugguggccagcagccacaucagcaagaccagccugagcguggaccccagcagaguggacagcaugccccugaccgaggcccccgccuucauccugccccccagaaaccugugcaucaaggagggcgccaccgccaaguucgagggcagagugagaggcuaccccgagccccaggugaccuggcacagaaacggccagcccaucaccagcggcggcagauuccugcuggacugcggcaucagaggcaccuucagccuggugauccacgccgugcacgaggaggacagaggcaaguacaccugcgaggccaccaacggcagcggcgccagacaggugaccguggagcugaccguggagggcagcuucgccaagcagcugggccagcccguggugagcaagacccugggcgacagauucagcgcccccgccguggagaccagacccagcaucuggggcgagugcccccccaaguucgccaccaagcugggcagagugguggugaaggagggccagaugggcagauucagcugcaagaucaccggcagaccccagccccaggugaccuggcugaagggcaacgugccccugcagcccagcgccagagugagcgugagcgagaagaacggcaugcaggugcuggagauccacggcgugaaccaggacgacgugggcguguacaccugccugguggugaacggcagcggcaaggccagcaugagcgccgagcugagcauccagggccuggacagcgccaacagaagcuucgugagagagaccaaggccaccaacagcgacgugagaaaggaggugaccaacgugaucagcaaggagagcaagcuggacagccuggaggccgccgccaagagcaagaacugcagcagcccccagagaggcggcagcccccccugggccgccaacagccagccccagccccccagagagagcaagcuggagagcugcaaggacagccccagaaccgccccccagacccccgugcugcagaagaccagcagcagcaucacccugcaggccgccagagugcagcccgagcccagagcccccggccugggcgugcugagccccagcggcgaggagagaaagagacccgccccccccagacccgccaccuuccccaccagacagcccggccugggcagccaggacguggugagcaaggccgccaacagaagaauccccauggagggccagagagacagcgccuuccccaaguucgagagcaagccccagagccaggaggugaaggagaaccagaccgugaaguucagaugcgaggugagcggcauccccaagcccgagguggccugguuccuggagggcacccccgugagaagacaggagggcagcaucgagguguacgaggacgccggcagccacuaccugugccugcugaaggccagaaccagagacagcggcaccuacagcugcaccgccagcaacgcccagggccagcugagcugcagcuggacccugcagguggagagacuggccgugauggagguggcccccagcuucagcagcgugcugaaggacugcgccgugaucgagggccaggacuucgugcugcagugcagcgugagaggcacccccgugcccagaaucaccuggcugcugaacggccagcccauccaguacgccagaagcaccugcgaggccggcguggccgagcugcacauccaggacgcccugcccgaggaccacggcaccuacaccugccuggccgagaacgcccugggccaggugagcugcagcgccugggugaccgugcacgagaagaagagcagcagaaagagcgaguaccugcugcccguggcccccagcaagcccaccgcccccaucuuccugcagggccugagcgaccugaaggugauggacggcagccaggugaccaugaccgugcaggugagcggcaaccccccccccgaggugaucuggcugcacaacggcaacgagauccaggagagcgaggacuuccacuucgagcagagaggcacccagcacagccugugcauccaggagguguuccccgaggacaccggcaccuacaccugcgaggccuggaacagcgccggcgaggugagaacccaggccgugcugaccgugcaggagccccacgacggcacccagcccugguucaucagcaagcccagaagcgugaccgccagccugggccagagcgugcugaucagcugcgccaucgccggcgaccccuuccccaccgugcacuggcugagagacggcaaggcccugugcaaggacaccggccacuucgaggugcugcagaacgaggacguguucacccuggugcugaagaaggugcagcccuggcacgccggccaguacgagauccugcugaagaacagagugggcgagugcagcugccaggugagccugaugcugcagaacagcagcgccagagcccugcccagaggcagagagcccgccagcugcgaggaccugugcggcggcggcgugggcgccgacggcggcggcagcgacagauacggcagccugagacccggcuggcccgccagaggccagggcuggcuggaggaggaggacggcgaggacgugagaggcgugcugaagagaagaguggagaccagacagcacaccgaggaggccaucagacagcaggagguggagcagcuggacuucagagaccugcugggcaagaaggugagcaccaagacccugagcgaggacgaccugaaggagauccccgccgagcagauggacuucagagccaaccugcagagacaggugaagcccaagaccgugagcgaggaggagagaaaggugcacagcccccagcagguggacuucagaagcgugcuggccaagaagggcaccagcaagacccccgugcccgagaaggugcccccccccaagcccgccacccccgacuucagaagcgugcugggcggcaagaagaagcugcccgccgagaacggcagcagcagcgccgagacccugaacgccaaggccguggagagcagcaagccccugagcaacgcccagcccagcggcccccugaagcccgugggcaacgccaagcccgccgagacccugaagcccaugggcaacgccaagcccgccgagacccugaagcccaugggcaacgccaagcccgacgagaaccugaagagcgccagcaaggaggagcugaagaaggacgugaagaacgacgugaacugcaagagaggccacgccggcaccaccgacaacgagaagagaagcgagagccagggcaccgcccccgccuucaagcagaagcugcaggacgugcacguggccgagggcaagaagcugcugcugcagugccaggugagcagcgacccccccgccaccaucaucuggacccugaacggcaagacccugaagaccaccaaguucaucauccugagccaggagggcagccugugcagcgugagcaucgagaaggcccugcccgaggacagaggccuguacaagugcguggccaagaacgacgccggccaggccgagugcagcugccaggugaccguggacgacgcccccgccagcgagaacaccaaggcccccgagaugaagagcagaagacccaagagcagccugccccccgugcugggcaccgagagcgacgccaccgugaagaagaagcccgcccccaagaccccccccaaggccgccaugcccccccagaucauccaguuccccgaggaccagaaggugagagccggcgagagcguggagcuguucggcaaggugaccggcacccagcccaucaccugcaccuggaugaaguucagaaagcagauccaggagagcgagcacaugaagguggagaacagcgagaacggcagcaagcugaccauccuggccgccagacaggagcacugcggcugcuacacccugcugguggagaacaagcugggcagcagacaggcccaggugaaccugaccgugguggacaagcccgacccccccgccggcacccccugcgccagcgacaucagaagcagcagccugacccugagcugguacggcagcagcuacgacggcggcagcgccgugcagagcuacagcaucgagaucugggacagcgccaacaagaccuggaaggagcuggccaccugcagaagcaccagcuucaacgugcaggaccugcugcccgaccacgaguacaaguucagagugagagccaucaacguguacggcaccagcgagcccagccaggagagcgagcugaccaccgugggcgagaagcccgaggagcccaaggacgagguggaggugagcgacgacgacgagaaggagcccgagguggacuacagaaccgugaccaucaacaccgagcagaaggugagcgacuucuacgacaucgaggagagacugggcagcggcaaguucggccagguguucagacugguggagaagaagaccagaaaggugugggccggcaaguucuucaaggccuacagcgccaaggagaaggagaacaucagacaggagaucagcaucaugaacugccugcaccaccccaagcuggugcagugcguggacgccuucgaggagaaggccaacaucgugauggugcuggagaucgugagcggcggcgagcuguucgagagaaucaucgacgaggacuucgagcugaccgagagagagugcaucaaguacaugagacagaucagcgagggcguggaguacauccacaagcagggcaucgugcaccuggaccugaagcccgagaacaucaugugcgugaacaagaccggcaccagaaucaagcugaucgacuucggccuggccagaagacuggagaacgccggcagccugaaggugcuguucggcacccccgaguucguggcccccgaggugaucaacuacgagcccaucggcuacgccaccgacauguggagcaucggcgugaucugcuacauccuggugagcggccugagccccuucaugggcgacaacgacaacgagacccuggccaacgugaccagcgccaccugggacuucgacgacgaggccuucgacgagaucagcgacgacgccaaggacuucaucagcaaccugcugaagaaggacaugaagaacagacuggacugcacccagugccugcagcaccccuggcugaugaaggacaccaagaacauggaggccaagaagcugagcaaggacagaaugaagaaguacauggccagaagaaaguggcagaagaccggcaacgccgugagagccaucggcagacugagcagcauggccaugaucagcggccugagcggcagaaagagcagcaccggcagccccaccagcccccugaacgccgagaagcuggagagcgaggaggacgugagccaggccuuccuggaggccguggccgaggagaagccccacgugaagcccuacuucagcaagaccaucagagaccuggaggugguggagggcagcgccgccagauucgacugcaagaucgagggcuaccccgaccccgagguggugugguucaaggacgaccagagcaucagagagagcagacacuuccagaucgacuacgacgaggacggcaacugcagccugaucaucagcgacgugugcggcgacgacgacgccaaguacaccugcaaggccgugaacagccugggcgaggccaccugcaccgccgagcugaucguggagaccauggaggagggcgagggcgagggcgaggaggaggaggaguaa

SEQ ID NO: 20236 - RNA, 510 nt, Artificial Sequence
  MYLPF__Homo_sapiens__NP_037424
auggcccccaagagagccaagagaagaaccguggagggcggcagcagcagcguguucagcauguucgaccagacccagauccaggaguucaaggaggccuucaccgugaucgaccagaacagagacggcaucaucgacaaggaggaccugagagacaccuucgccgccaugggcagacugaacgugaagaacgaggagcuggacgccaugaugaaggaggccagcggccccaucaacuucaccguguuccugaccauguucggcgagaagcugaagggcgccgaccccgaggacgugaucaccggcgccuucaaggugcuggaccccgagggcaagggcaccaucaagaagaaguuccuggaggagcugcugaccacccagugcgacagauucagccaggaggagaucaagaacaugugggccgccuucccccccgacgugggcggcaacguggacuacaagaacaucugcuacgugaucacccacggcgacgccaaggaccaggaguaa

SEQ ID NO: 20237 - RNA, 1746 nt, Artificial Sequence
  MYNN__Homo_sapiens__NP_001172048
augcaguacagccaccacugcgagcaccugcuggagagacugaacaagcagagagaggccggcuuccugugcgacugcaccaucgugaucggcgaguuccaguucaaggcccacagaaacgugcuggccagcuucagcgaguacuucggcgccaucuacagaagcaccagcgagaacaacguguuccuggaccagagccaggugaaggccgacggcuuccagaagcugcuggaguucaucuacaccggcacccugaaccuggacagcuggaacgugaaggagauccaccaggccgccgacuaccugaagguggaggagguggugaccaagugcaagaucaagauggaggacuucgccuucaucgccaaccccagcagcaccgagaucagcagcaucaccggcaacaucgagcugaaccagcagaccugccugcugacccugagagacuacaacaacagagagaagagcgaggugagcaccgaccugauccaggccaaccccaagcagggcgcccuggccaagaagagcagccagaccaagaagaagaagaaggccuucaacagccccaagaccggccagaacaagaccgugcaguaccccagcgacauccuggagaacgccagcguggagcuguuccuggacgccaacaagcugcccacccccgugguggagcagguggcccagaucaacgacaacagcgagcuggagcugaccagcgugguggagaacaccuuccccgcccaggacaucgugcacaccgugaccgugaagagaaagagaggcaagagccagcccaacugcgcccugaaggagcacagcaugagcaacaucgccagcgugaagagccccuacgaggccgagaacagcggcgaggagcuggaccagagauacagcaaggccaagcccaugugcaacaccugcggcaagguguucagcgaggccagcagccugagaagacacaugagaauccacaagggcgugaagcccuacgugugccaccugugcggcaaggccuucacccagugcaaccagcugaagacccacgugagaacccacaccggcgagaagcccuacaagugcgagcugugcgacaagggcuucgcccagaagugccagcugguguuccacagcagaaugcaccacggcgaggagaagcccuacaagugcgacgugugcaaccugcaguucgccaccagcagcaaccugaagauccacgccagaaagcacagcggcgagaagcccuacgugugcgacagaugcggccagagauucgcccaggccagcacccugaccuaccacgugagaagacacaccggcgagaagcccuacgugugcgacaccugcggcaaggccuucgccgugagcagcagccugaucacccacagcagaaagcacaccggcgagaagcccuacaucugcggcaucugcggcaagagcuucaucagcagcggcgagcugaacaagcacuucagaagccacaccggcgccgacaagacccuggacagcagcgccgaggaccacacccugagcgagcaggacagcauccagaagagcccccugagcgagaccauggacgugaagcccagcgacaugacccugccccuggcccugccccugggcaccgaggaccaccacaugcugcugcccgugaccgacacccagagccccaccagcgacacccugcugagaagcaccgugaacggcuacagcgagccccagcugaucuuccugcagcagcuguacuaa

SEQ ID NO: 20238 - RNA, 6177 nt, Artificial Sequence
  MYO10__Homo_sapiens__NP_036466
auggacaacuucuucaccgagggcaccagaguguggcugagagagaacggccagcacuuccccagcaccgugaacagcugcgccgagggcaucgugguguucagaaccgacuacggccagguguucaccuacaagcagagcaccaucacccaccagaaggugaccgccaugcaccccaccaacgaggagggcguggacgacauggccagccugaccgagcugcacggcggcagcaucauguacaaccuguuccagagauacaagagaaaccagaucuacaccuacaucggcagcauccuggccagcgugaaccccuaccagcccaucgccggccuguacgagcccgccaccauggagcaguacagcagaagacaccugggcgagcugcccccccacaucuucgccaucgccaacgagugcuacagaugccuguggaagagacacgacaaccagugcauccugaucagcggcgagagcggcgccggcaagaccgagagcaccaagcugauccugaaguuccugagcgugaucagccagcagagccuggagcugagccugaaggagaagaccagcugcguggagagagccauccuggagagcagccccaucauggaggccuucggcaacgccaagaccguguacaacaacaacagcagcagauucggcaaguucgugcagcugaacaucugccagaagggcaacauccagggcggcagaaucguggacuaccugcuggagaagaacagaguggugagacagaaccccggcgagagaaacuaccacaucuucuacgcccugcuggccggccuggagcacgaggagagagaggaguucuaccugagcacccccgagaacuaccacuaccugaaccagagcggcugcguggaggacaagaccaucagcgaccaggagagcuucagagaggugaucaccgccauggacgugaugcaguucagcaaggaggaggugagagaggugagcagacugcuggccggcauccugcaccugggcaacaucgaguucaucaccgccggcggcgcccaggugagcuucaagaccgcccugggcagaagcgccgagcugcugggccuggaccccacccagcugaccgacgcccugacccagagaagcauguuccugagaggcgaggagauccugaccccccugaacgugcagcaggccguggacagcagagacagccuggccauggcccuguacgccugcugcuucgagugggugaucaagaagaucaacagcagaaucaagggcaacgaggacuucaagagcaucggcauccuggacaucuucggcuucgagaacuucgaggugaaccacuucgagcaguucaacaucaacuacgccaacgagaagcugcaggaguacuucaacaagcacaucuucagccuggagcagcuggaguacagcagagagggccuggugugggaggacaucgacuggaucgacaacggcgagugccuggaccugaucgagaagaagcugggccugcuggcccugaucaacgaggagagccacuucccccaggccaccgacagcacccugcuggagaagcugcacagccagcacgccaacaaccacuucuacgugaagcccagaguggccgugaacaacuucggcgugaagcacuacgccggcgaggugcaguacgacgugagaggcauccuggagaagaacagagacaccuucagagacgaccugcugaaccugcugagagagagcagauucgacuucaucuacgaccuguucgagcacgugagcagcagaaacaaccaggacacccugaagugcggcagcaagcacagaagacccaccgugagcagccaguucaaggacagccugcacagccugauggccacccugagcagcagcaaccccuucuucgugagaugcaucaagcccaacaugcagaagaugcccgaccaguucgaccaggccguggugcugaaccagcugagauacagcggcaugcuggagaccgugagaaucagaaaggccggcuacgccgugagaagacccuuccaggacuucuacaagagauacaaggugcugaugagaaaccuggcccugcccgaggacgugagaggcaagugcaccagccugcugcagcuguacgacgccagcaacagcgaguggcagcugggcaagaccaagguguuccugagagagagccuggagcagaagcuggagaagagaagagaggaggaggugagccacgccgccauggugaucagagcccacgugcugggcuuccuggccagaaagcaguacagaaaggugcuguacugcguggugaucauccagaagaacuacagagccuuccugcugagaagaagauuccugcaccugaagaaggccgccaucguguuccagaagcagcugagaggccagaucgccagaagaguguacagacagcugcuggccgagaagagagagcaggaggagaagaagaagcaggaggaggaggagaagaagaagagagaggaggaggagagagagagagagagagagagaagagaggccgagcugagagcccagcaggaggaggagaccagaaagcagcaggagcuggaggcccugcagaagagccagaaggaggccgagcugaccagagagcuggagaagcagaaggagaacaagcagguggaggagauccugagacuggagaaggagaucgaggaccugcagagaaugaaggagcagcaggagcugagccugaccgaggccagccugcagaagcugcaggagagaagagaccaggagcugagaagacuggaggaggaggccugcagagccgcccaggaguuccuggagagccugaacuucgacgagaucgacgagugcgugagaaacaucgagagaagccugagcgugggcagcgaguucagcagcgagcuggccgagagcgccugcgaggagaagcccaacuucaacuucagccagcccuaccccgaggaggagguggacgagggcuucgaggccgacgacgacgccuucaaggacagccccaaccccagcgagcacggccacagcgaccagagaaccagcggcaucagaaccagcgacgacagcagcgaggaggaccccuacaugaacgacaccguggugcccaccagccccagcgccgacagcaccgugcugcuggcccccagcgugcaggacagcggcagccugcacaacagcagcagcggcgagagcaccuacugcaugccccagaacgccggcgaccugcccagccccgacggcgacuacgacuacgaccaggacgacuacgaggacggcgccaucaccagcggcagcagcgugaccuucagcaacagcuacggcagccaguggagccccgacuacagaugcagcgugggcaccuacaacagcagcggcgccuacagauucagcagcgagggcgcccagagcagcuucgaggacagcgaggaggacuucgacagcagauucgacaccgacgacgagcugagcuacagaagagacagcguguacagcugcgugacccugcccuacuuccacagcuuccuguacaugaagggcggccugaugaacagcuggaagagaagauggugcgugcugaaggacgagaccuuccugugguucagaagcaagcaggaggcccugaagcagggcuggcugcacaagaagggcggcggcagcagcacccugagcagaagaaacuggaagaagagaugguucgugcugagacagagcaagcugauguacuucgagaacgacagcgaggagaagcugaagggcaccguggaggugagaaccgccaaggagaucaucgacaacaccaccaaggagaacggcaucgacaucaucauggccgacagaaccuuccaccugaucgccgagagccccgaggacgccagccagugguucagcgugcugagccaggugcacgccagcaccgaccaggagauccaggagaugcacgacgagcaggccaacccccagaacgccgugggcacccuggacgugggccugaucgacagcgugugcgccagcgacagccccgacagacccaacagcuucgugaucaucaccgccaacagagugcugcacugcaacgccgacacccccgaggagaugcaccacuggaucacccugcugcagagaagcaagggcgacaccagaguggagggccaggaguucaucgugagaggcuggcugcacaaggaggugaagaacagccccaagaugagcagccugaagcugaagaagagaugguucgugcugacccacaacagccuggacuacuacaagagcagcgagaagaacgcccugaagcugggcacccuggugcugaacagccugugcagcguggugccccccgacgagaagaucuucaaggagaccggcuacuggaacgugaccguguacggcagaaagcacugcuacagacuguacaccaagcugcugaacgaggccaccagauggagcagcgccauccagaacgugaccgacaccaaggcccccaucgacacccccacccagcagcugauccaggacaucaaggagaacugccugaacagcgacgugguggagcagaucuacaagagaaaccccauccugagauacacccaccacccccugcacagcccccugcugccccugcccuacggcgacaucaaccugaaccugcugaaggacaagggcuacaccacccugcaggacgaggccaucaagaucuucaacagccugcagcagcuggagagcaugagcgaccccauccccaucauccagggcauccugcagaccggccacgaccugagaccccugagagacgagcuguacugccagcugaucaagcagaccaacaaggugccccaccccggcagcgugggcaaccuguacagcuggcagauccugaccugccugagcugcaccuuccugcccagcagaggcauccugaaguaccugaaguuccaccugaagagaaucagagagcaguuccccggcagcgagauggagaaguacgcccuguucaccuacgagagccugaagaagaccaagugcagagaguucgugcccagcagagacgagaucgaggcccugauccacagacaggagaugaccagcaccguguacugccacggcggcggcagcugcaagaucaccaucaacagccacaccaccgccggcgaggugguggagaagcugaucagaggccuggccauggaggacagcagaaacauguucgcccuguucgaguacaacggccacguggacaaggccaucgagagcagaaccgugguggccgacgugcuggccaaguucgagaagcuggccgccaccagcgaggugggcgaccugcccuggaaguucuacuucaagcuguacugcuuccuggacaccgacaacgugcccaaggacagcguggaguucgccuucauguucgagcaggcccacgaggccgugauccacggccaccaccccgcccccgaggagaaccugcaggugcuggccgcccugagacugcaguaccugcagggcgacuacacccugcacgccgccauccccccccuggaggagguguacagccugcagagacugaaggccagaaucagccagagcaccaagaccuucacccccugcgagagacuggagaagagaagaaccagcuuccuggagggcacccugagaagaagcuucagaaccggcagcguggugagacagaagguggaggaggagcagaugcuggacauguggaucaaggaggaggugagcagcgccagagccagcaucaucgacaaguggagaaaguuccagggcaugaaccaggagcaggccauggccaaguacauggcccugaucaaggaguggcccggcuacggcagcacccuguucgacguggagugcaaggagggcggcuucccccaggagcuguggcugggcgugagcgccgacgccgugagcguguacaagagaggcgagggcagaccccuggagguguuccaguacgagcacauccugagcuucggcgccccccuggccaacaccuacaagaucgugguggacgagagagagcugcuguucgagaccagcgaggugguggacguggccaagcugaugaaggccuacaucagcaugaucgugaagaagagauacagcaccaccagaagcgccagcagccagggcagcagcagauaa

SEQ ID NO: 20239 - RNA, 10593 nt, Artificial Sequence
  MYO15A__Homo_sapiens__NP_057323
auggccaaggaggaggacgaggagaagaaggccaagaagggcaagaagggcaagaaggcccccgagcccgagaagcccaagagaagccugaagggcaccagcagacuguucaugggcuucagagacagaacccccaagaucagcaagaagggccaguucagaagcgccagcgccuucuucuggggccugcacaccggcccccagaagaccaagagaaagagaaaggccagaaccgugcugaagagcaccagcaagcugaugacccagaugagaaugggcaagaagaagagagccaugaagggcaagaagcccagcuucauggugaucagauuccccggcagaagaggcuacggcagacugagacccagagccagaagccugagcaaggccagcaccgccaucaacuggcugaccaagaaguuccugcugaagaaggccgaggagagcggcagcgagcaggccaccguggacgccuggcugcagagaagcagcagcagaaugggcagcagaaagcugcccuuccccagcggcgccgagauccugagacccggcggcagacugagaagauuccccagaagcagaagcaucuacgccagcggcgagccccugggcuuccugcccuucgaggacgaggcccccuuccaccacagcggcagcagaaagagccuguacggccuggagggcuuccaggaccugggcgaguacuacgacuaccacagagacggcgacgacuacuacgacagacagagccugcacagauacgaggagcaggagcccuaccuggccggccugggccccuacagccccgccuggccccccuacggcgaccacuacuacggcuacccccccgaggaccccuacgacuacuaccaccccgacuacuacggcggccccuucgaccccggcuacaccuacggcuacggcuacgacgacuacgagccccccuacgccccccccagcggcuacagcagccccuacagcuaccacgacggcuacgagggcgaggcccaccccuacggcuacuaccuggaccccuacgcccccuacgacgcccccuacccccccuacgaccugcccuaccacacccccuacgacgugcccuacuucgaccccuacggcgugcacuacaccgugcccuacgccgagggcguguacggcggcggcgacgaggccaucuacccccccgaggugcccuacuucuaccccgaggagagcgccagcgccuucguguaccccugggugcccccccccauccccagcccccacaaccccuacgcccacgccauggacgacaucgccgagcuggaggagcccgaggacgccggcguggagagacagggcaccagcuucagacugcccagcgccgccuucuucgagcagcagggcauggacaagcccgccagaagcaagcugagccugaucagaaaguucagacuguuccccagaccccaggugaagcuguucggcaaggagaagcuggaggugccccugccccccagccuggacaucccccugccccugggcgacgccgacgaggaggaggacgaggaggagcugccccccgugagcgccgugcccuacggccaccccuucuggggcuuccugacccccagacagagaaaccugcagagagcccugagcgccuucggcgcccacagaggccugggcuucggccccgaguucggcagacccgugcccagacccgccaccagccuggccagauuccugaagaagacccugagcgagaagaagcccaucgccagacugagaggcagccagaaggccagagccggcggccccgccgugagagaggccgccuacaagagauucggcuacaagcuggccggcauggaccccgagaagcccggcacccccaucgugcugagaagagcccagcccagagccagaagcagcaacgacgccagaagaccccccgccccccagcccgcccccagaacccugagccacuggagcgcccugcugagcccccccgugccccccagaccccccagcagcggccccccccccgcccccccccugagccccgcccugagcggccugcccagacccgccagccccuacggcagccugagaagacaccccccccccugggccgcccccgcccacgugccccccgccccccaggccagcuggugggccuucguggagccccccgccgugagccccgaggugccccccgaccugcuggccuuccccggccccagacccagcuucagaggcagcagaagaagaggcgccgccuucggcuuccccggcgccagccccagagccagcagaagaagagccuggagcccccuggccagcccccagcccagccugagaagcagccccggccugggcuacugcagcccccuggccccccccagcccccagcugagccugagaaccggccccuuccagccccccuuccugccccccgccagaagacccagaagccugcaggagagccccgcccccagaagagccgccggcagacugggcccccccggcagcccccugcccggcagccccagaccccccagccccccccugggccugugccacagccccagaagaagcagccugaaccugcccagcagacugccccacaccuggagaagacugagcgagccccccaccagagccgugaagccccaggugagacugcccuuccacagaccccccagagccggcgccuggagagccccccuggagcacagagagagccccagagagcccgaggacagcgagacccccuggaccgugcccccccuggcccccagcugggacguggacaugccccccacccagagaccccccagccccuggcccggcggcgccggcagcagaagaggcuucagcagacccccccccgugcccgagaaccccuuccugcagcugcugggccccgugcccagccccacccugcagcccgaggaccccgccgccgacaugaccagaguguuccugggcagacaccacgagcccggccccggccagcugaccaagagcgccggccccacccccgagaagcccgaggaggaggccacccugggcgacccccagcugcccgccgagaccaagccccccacccccgccccccccaaggacgugaccccccccaaggacaucaccccccccaaggacgugcugcccgagcagaagacccugagacccagccugagcuacccccuggccgccugcgaccagaccagagccaccuggccccccuggcacagauggggcacccugccccaggccgccgccccccuggcccccaucagagcccccgagccccugcccaagggcggcgagagaagacaggccgcccccggcagauucgccguggugaugcccagagugcagaagcugagcagcuuccagagagugggccccgccacccugaagccccaggugcagcccauccaggaccccaagcccagagccugcagccugagauggagcugccuguggcugagagccgacgccuacggccccuggcccagagugcacacccacccccagagcugccaccugggccccggcgccgccugccugagccugagaggcagcugggaggaggugggcccccccagcuggagaaacaagaugcacagcaucagaaaccugcccagcaugagauucagagagcagcacggcgaggacggcguggaggacaugacccagcuggaggaccugcaggagaccaccgugcugagcaaccugaagaucagauucgagagaaaccugaucuacaccuacaucggcagcauccuggugagcgugaaccccuaccagauguucggcaucuacggccccgagcaggugcagcaguacaacggcagagcccugggcgagaaccccccccaccuguucgccguggccaaccuggccuucgccaagaugcuggacgccaagcagaaccagugcaucaucaucagcggcgagagcggcagcggcaagaccgaggccaccaagcugauccugagauaccuggccgccaugaaccagaagagagaggugaugcagcagaucaagauccuggaggccaccccccugcuggagagcuucggcaacgccaagaccgugagaaacgacaacagcagcagauucggcaaguucguggagaucuuccuggagggcggcgugaucagcggcgccaucaccagccaguaccugcuggagaagagcagaaucguguuccaggccaagaacgagagaaacuaccacaucuucuacgagcugcuggccggccugcccgcccagcugagacaggccuucagccugcaggaggccgagaccuacuacuaccugaaccagggcggcaacugcgagaucgccggcaagagcgacgccgacgacuucagaagacugcuggccgccauggaggugcugggcuucagcagcgaggaccaggacagcaucuucagaauccuggccagcauccugcaccugggcaacguguacuucgagaaguacgagaccgacgcccaggagguggccagcguggugagcgccagagagauccaggccguggccgagcugcugcagaucagccccgagggccugcagaaggccaucaccuucaaggugaccgagaccaugagagagaagaucuucaccccccugaccguggagagcgccguggacgccagagacgccaucgccaaggugcuguacgcccugcuguucagcuggcugaucaccagagugaacgcccuggugagccccagacaggacacccugagcaucgccauccuggacaucuacggcuucgaggaccugagcuucaacagcuucgagcagcugugcaucaacuacgccaacgagaaccugcaguaccuguucaacaagaucguguuccaggaggagcaggaggaguacaucagagagcagaucgacuggcaggagaucaccuucgccgacaaccagcccugcaucaaccugaucagccugaagcccuacggcauccugagaauccuggacgaccagugcugcuucccccaggccaccgaccacaccuuccugcagaagugccacuaccaccacggcgccaacccccuguacagcaagcccaagaugccccugcccgaguucaccaucaagcacuacgccggcaaggugaccuaccaggugcacaaguuccuggacaagaaccacgaccaggugagacaggacgugcuggaccuguucgugagaagcagaaccagagugguggcccaccuguucagcagccacgccccccaggccgccccccagagacugggcaagagcagcagcgugaccagacuguacaaggcccacaccguggccgccaaguuccagcagagccugcuggaccugguggagaagauggagagaugcaacccccuguucaugagaugccugaagcccaaccacaagaaggagcccggccuguucgagcccgacguggugauggcccagcugagauacagcggcgugcuggagaccgugagaaucagaaaggagggcuuccccgugagacugcccuuccagggcuucaucgacagauacugcugccugguggcccugaagcacgaccugcccgccaacggcgacaugugcgugagcgugcugagcagacugugcaaggugaugcccaacauguacagagugggcgugagcaagcuguuccugaaggagcaccuguaccagcugcuggagagcaugagagagcacgugcugaaccuggccgcccugacccugcagagaugccugagaggcuucuucaucaagagaagauucagaagccugagacacaagaucauccugcugcagagcagagccagaggcuaccuggccagacagagauaccagcagaugagaagaagccuggugaaguucagaagccuggugcacgccuacgugagcagaagaagauaccugaagcugagagccgaguggagaugccagguggagggcgcccugcugugggagcaggaggagcugagcaagagagaggugguggccgugggccaccuggaggugcccgccgagcuggccggccugcugcaggccguggccggccugggccuggcccaggugccccagguggcccccgugagaacccccagacugcaggccgagcccagagugacccugccccuggacaucaacaacuaccccauggccaaguucgugcagugccacuucaaggagcccgccuucggcaugcugaccgugccccugagaaccccccugacccagcugcccgccgagcaccacgccgaggccgugagcaucuucaagcugauccugagauucaugggcgacccccaccugcacggcgccagagagaacaucuucggcaacuacaucgugcagaagggccuggccgugcccgagcugagagacgagauccuggcccagcuggccaaccagguguggcacaaccacaacgcccacaacgccgagagaggcuggcugcugcuggccgccugccugagcggcuucgcccccagccccugcuucaacaaguaccugcugaaguucgugagcgacuacggcagaaacggcuuccaggccgugugccagcacagacugaugcaggccaugggcagagcccagcagcagggcagcggcgccgccagaacccugccccccacccagcuggaguggaccgccaccuacgagaaggccagcauggcccuggacgugggcugcuucaacggcgaccaguucagcugccccgugcacagcuggagcaccggcgaggagguggccggcgacauccugagacacagaggccuggccgacggcuggagaggcuggaccguggccaugaagaacggcgugcagugggccgagcuggccggccacgacuacgugcuggaccuggugagcgaccuggagcugcugagagacuuccccagacagaagagcuacuucaucgugggcaccgagggccccgccgccagcagaggcggccccaaggugguguucggcaacagcugggacagcgacgaggacaugagcaccagaccccagccccaggagcacaugcccaaggugcuggacagcgacggcuacagcagccacaaccaggacggcaccaacggcgagaccgaggcccagagaggcaccgccacccaccaggagagcgacagccugggcgagcccgccgugccccacaagggccuggacugcuaccuggacagccuguucgaccccgugcugagcuacggcgacgccgaccuggagaagcccaccgccaucgccuacagaaugaagggcggcggccagcccggcggcggcagcagcagcggcaccgaggacacccccagaagaccccccgagcccaagcccauccccggccuggacgccagcacccuggcccugcagcaggccuucauccacaagcaggccgugcugcuggccagagagaugacccugcaggccaccgcccugcagcagcagccccugagcgccgcccugagaagccugcccgccgagaagccccccgcccccgaggcccagcccaccagcgugggcaccggcccccccgccaagcccgugcugcugagagccacccccaagccccuggcccccgccccccuggccaaggcccccagacugcccaucaagcccguggccgcccccgugcuggcccaggaccaggccagccccgagaccaccagccccagccccgagcuggugagauacagcacccugaacagcgagcacuucccccagcccacccagcagaucaagaacaucgugagacaguaccagcagcccuucagaggcggcagacccgaggcccugagaaaggacggcggcaagguguucaugaagagacccgacccccacgaggaggcccugaugauccugaagggccagaugacccaccuggccgccgcccccggcacccaggugagcagagaggccguggcccuggugaagcccgugaccagcgcccccagacccagcauggcccccaccagcgcccugcccagcagaagccuggagccccccgaggagcugacccagaccagacugcacagacugaucaaccccaacuucuacggcuaccaggacgcccccuggaagaucuuccugagaaaggagguguucuaccccaaggacagcuacagccaccccgugcagcuggaccugcuguucagacagauccugcacgacacccugagcgaggccugccugagaaucagcgaggacgagagacugagaaugaaggcccuguucgcccagaaccagcuggacacccagaagccccuggugaccgagagcgugaagagagccguggugagcaccgccagagacaccugggagguguacuucagcagaaucuuccccgccaccggcagcgugggcaccggcgugcagcugcuggccgugagccacgugggcaucaagcugcugagaauggugaagggcggccaggaggccggcggccagcugagagugcugagagccuacagcuucgccgacauccuguucgugaccaugcccagccagaacaugcuggaguucaaccuggccagcgagaaggugauccuguucagcgccagagcccaccaggugaagacccugguggacgacuucauccuggagcugaagaaggacagcgacuacgugguggccgugagaaacuuccugcccgaggaccccgcccugcuggccuuccacaagggcgacaucauccaccugcagccccuggagccccccagagugggcuacagcgccggcugcguggugagaagaaaggugguguaccuggaggagcugagaagaagaggccccgacuucggcuggagauucggcaccauccacggcagagugggcagauuccccagcgagcuggugcagcccgccgccgcccccgacuuccugcagcugcccaccgagcccggcagaggcagagccgccgccguggccgccgccguggccagcgccgccgccgcccaggaggugggcagaagaagagagggcccccccgugagagccagaagcgccgaccacggcgaggacgcccuggcccugccccccuacaccaugcuggaguucgcccagaaguacuucagagacccccagagaagaccccaggacggccugagacugaagagcaaggagcccagagagagcagaacccuggaggacaugcugugcuucaccaagaccccccugcaggagagccugaucgagcugagcgacagcagccugagcaagauggccaccgacauguuccuggccgugaugagauucaugggcgacgccccccugaagggccagagcgaccuggacgugcugugcaaccugcugaagcugugcggcgaccacgaggugaugagagacgagugcuacugccagguggugaagcagaucaccgacaacaccagcagcaagcaggacagcugccagagaggcuggagacugcuguacaucgugaccgccuaccacagcugcagcgaggugcugcacccccaccugaccagauuccugcaggacgugagcagaacccccggccugcccuuccagggcaucgccaaggccugcgagcagaaccugcagaagacccugagauucggcggcagacuggagcugcccagcagcaucgagcugagagccaugcuggccggcagaagcagcaagagacagcuguuccugcugcccggcggccuggagagacaccugaagaucaagaccugcaccguggcccuggacgugguggaggagaucugcgccgagauggcccugaccagacccgaggccuucaacgaguacgugaucuucguggugaccaacagaggccagcacgugugcccccugagcagaagagccuacauccuggacguggccagcgagauggagcagguggacggcggcuacaugcugugguucagaagagugcugugggaccagccccugaaguucgagaacgagcuguacgugaccaugcacuacaaccaggugcugcccgacuaccugaagggccuguucagcagcgugcccgccagcagacccagcgagcagcugcugcagcaggugagcaagcuggccagccugcagcacagagccaaggaccacuucuaccugcccagcgugagagaggugcaggaguacauccccgcccagcuguacagaaccaccgccggcagcaccuggcugaaccuggugagccagcacagacagcagacccaggcccugagcccccaccaggccagagcccaguuccugggccugcugagcgcccugcccauguucggcagcagcuucuucuucauccagagcugcagcaacaucgccgugcccgcccccugcauccuggccaucaaccacaacggccugaacuuccugagcaccgagacccacgagcugauggugaaguucccccugaaggagauccagagcaccagaacccagagacccaccgccaacagcagcuaccccuacguggagaucgcccugggcgacguggccgcccagagaacccugcagcugcagcuggagcagggccuggagcugugcagagugguggccgugcacguggagaaccugcugagcgcccacgagaagagacugacccugccccccagcgagaucacccugcuguaa

SEQ ID NO: 20240 - RNA, 5643 nt, Artificial Sequence
  MYO16__Homo_sapiens__NP_001185879
augagccacuaccacuucaucaagugcugcugcuuccagcugugcaacguguucagaagccacgagauggagaucgaccagugccugcuggagagccugccccugggccagagacagagacuggugaagagaaugagaugcgagcagaucaaggccuacuacgagagagagaaggccuuccagaagcaggagggcuuccugaagagacugaagcacgccaagaaccccaaggugcacuucaaccugaccgacaugcugcaggacgccaucauccaccacaacgacaaggaggugcugagacugcugaaggagggcgccgacccccacacccuggugagcagcggcggcagccugcugcaccugugcgccagauacgacaacgccuucaucgccgagauccugaucgacagaggcgugaacgugaaccaccaggacgaggacuucuggacccccaugcacaucgccugcgccugcgacaaccccgacaucgugcugcugcuggugcuggccggcgccaacgugcugcugcaggacgugaacggcaacaucccccuggacuacgccguggagggcaccgagagcagcagcauccugcugaccuaccuggacgagaacggcguggaccugaccagccugagacagaugaagcugcagagacccaugagcaugcugaccgacgugaagcacuuccugagcagcggcggcaacgugaacgagaagaacgacgagggcgugacccugcugcacauggccugcgccagcggcuacaaggagguggugagccugauccuggagcacggcggcgaccugaacaucguggacgaccaguacuggaccccccugcaccuggccgccaaguacggccagaccaaccuggugaagcugcugcugaugcaccaggccaacccccaccuggugaacugcaacgaggagaaggccagcgacaucgccgccagcgaguucaucgaggagaugcugcugaaggccgagaucgccugggaggagaagaugaaggagccccugagcgccagcacccuggcccaggaggagcccuacgaggagaucauccacgaccugcccgugcugagcagcaagcugagcccccuggugcugcccaucgccaagcaggacagccugcuggagaaggacaucauguucaaggacgccaccaagggccugugcaagcagcagagccaggacagcauccccgagaaccccaugaugagcggcagcaccaagcccgagcaggugaagcugaugccccccgcccccaacgacgaccuggccacccugagcgagcugaacgacggcagccugcuguacgagauccagaagagauucggcaacaaccagaucuacaccuucaucggcgacauccugcugcuggugaaccccuacaaggagcugcccaucuacagcagcauggugagccagcuguacuucagcagcagcggcaagcugugcagcagccugcccccccaccuguucagcugcguggagagagccuuccaccagcuguucagagagcagagaccccagugcuucauccugagcggcgagagaggcagcggcaagagcgaggccagcaagcagaucaucagacaccugaccugcagagccggcgccagcagagccacccuggacagcagauucaagcacguggugugcauccuggaggccuucggccacgccaagaccacccugaacgaccugagcagcugcuucaucaaguacuucgagcugcaguucugcgagagaaagcagcagcugaccggcgccagaaucuacaccuaccugcuggagaagagcagacuggugagccagccccugggccagagcaacuuccugaucuucuaccugcugauggacggccugagcgccgaggagaaguacggccugcaccugaacaaccugugcgcccacagauaccugaaccagaccauccaggacgacgccagcaccggcgagagaagccugaacagagagaagcuggccgugcugaagagagcccugaacguggugggcuucagcagccuggagguggagaaccuguucgugauccuggccgccauccugcaccugggcgacaucagauucaccgcccugaacgagggcaacagcgccuucgugagcgaccugcagcugcuggagcagguggccggcaugcugcaggugagcaccgacgagcuggccagcgcccugaccaccgacauccaguacuucaagggcgacaugaucaucagaagacacaccauccagaucgccgaguucuucagagaccugcuggccaagagccuguacagcagacuguucagcuuccuggugaacaccaugaacagcugccugcacagccaggacgagcagaagagcaugcagacccuggacaucggcauccuggacaucuucggcuucgaggaguuccagaagaacgaguucgagcagcugugcgugaacaugaccaacgagaagaugcaccacuacaucaacgaggugcuguuccugcacgagcagguggagugcgugcaggagggcgugaccauggagaccgccuacagccccggcaaccagaacggcgugcuggacuucuucuuccagaagcccagcggcuuccugacccugcuggacgaggagagccagaugaucuggagcguggagagcaacuuccccaagaagcugcagagccugcuggagagcagcaacaccaacgccguguacagccccaugaaggacggcaacggcaacguggcccugaaggaccacggcaccgccuucaccaucaugcacuacgccggcagagugauguacgacguggugggcgccaucgagaagaacaaggacagccugagccagaaccugcuguucgugaugaagaccagcgagaacguggugaucaaccaccuguuccagagcaagcugagccagaccggcagccuggugagcgccuaccccagcuucaaguucagaggccacaagagcgcccugcugagcaagaagaugaccgccagcagcaucaucggcgagaacaagaacuaccuggagcugagcaagcugcugaagaagaagggcaccagcaccuuccugcagagacuggagagaggcgaccccgugaccaucgccagccagcugagaaagagccugauggacaucaucggcaagcugcagaagugcaccccccacuucauccacugcaucagacccaacaacagcaagcugcccgacaccuucgacaacuucuacgugagcgcccagcugcaguacaucggcgugcuggagauggugaagaucuucagauacggcuaccccgugagacugagcuucagcgacuuccugagcagauacaagccccuggccgacaccuuccugagagagaagaaggagcagagcgccgccgagagaugcagacuggugcugcagcagugcaagcugcagggcuggcagaugggcgugagaaagguguuccugaaguacuggcacgccgaccagcugaacgaccugugccugcagcugcagagaaagaucaucaccugccagaaggugaucagaggcuuccuggccagacagcaccugcugcagagaaucagcaucagacagcaggaggugaccagcaucaacagcuuccugcagaacaccgaggacaugggccugaagaccuacgacgcccuggugauccagaacgccagcgacaucgccagagagaacgacagacugagaagcgagaugaacgcccccuaccacaaggagaagcuggaggugagaaacaugcaggaggagggcagcaagagaaccgacgacaagagcggccccagacacuuccaccccagcagcaugagcgugugcgccgccguggacggccugggccagugccuggugggccccagcaucuggagccccagccugcacagcguguucagcauggacgacagcagcagccugcccagccccagaaagcagcccccccccaagcccaagagagaccccaacaccagacugagcgccagcuacgaggccgugagcgccugccugagcgccgccagagaggccgccaacgaggcccuggccagacccagaccccacagcgacgacuacagcaccaugaagaagaucccccccagaaagcccaagagaagccccaacaccaagcugagcggcagcuacgaggagaucagcggcagcagacccggcgacgccagacccgccggcgcccccggcgccgccgccagagugcugacccccggcaccccccagugcgcccugccccccgccgccccccccggcgacgaggacgacagcgagcccguguacaucgagaugcugggccacgccgccagacccgacagccccgaccccggcgagagcguguacgaggagaugaagugcugccugcccgacgacggcggccccggcgccggcagcuuccugcugcacggcgccagccccccccugcugcacagagcccccgaggacgaggccgccggcccccccggcgacgccugcgacauccccccccccuuccccaaccugcugccccacagacccccccugcugguguucccccccacccccgugaccugcagccccgccagcgacgagagcccccugaccccccuggaggugaagaagcugcccgugcuggagaccaaccugaaguaccccgugcagcccgagggcagcagcccccugagcccccaguacagcaagagccagaagggcgacggcgacagacccgccagccccggccuggcccuguucaacggcagcggcagagccagcccccccagcaccccccccccccccccccccccccccggccccccccccgcccccuacagacccugcgcccaccuggccuucccccccgagcccgcccccgugaacgccggcaaggccggccccagcgccgaggcccccaaggugcaccccaagcccaacagcgcccccguggccggccccugcagcagcuuccccaagauccccuacagccccgugaaggccaccagagccgacgccagaaaggccggcagcagcgccagcccccccgcccccuacagcccccccagcagcagaccccugagcagcccccuggacgagcuggccagccuguucaacagcggcagaagcgugcugagaaagagcgccgccggcagaaagaucagagaggccgagggcuucgagaccaacaugaacaucagcagcagagacgaccccagcaccagcgagaucaccagcgagacccaggacagaaacgccaacaaccacggcauccagcugagcaacagccugagcagcgccaucaccgccgagaacggcaacagcaucagcaacggccugcccgaggaggacggcuacagcagacugagcaucagcggcaccggcaccagcaccuuccagagacacagagacagccacaccacccaggugauccaccagcugagacugagcgagaacgagagcguggcccugcaggagcugcuggacuggagaagaaagcugugcgaggagggccaggacuggcagcagauccugcaccacgccgagcccagagugcccccccccccccccugcaagaagcccagccugcugaagaagcccgagggcgccagcugcaacagacugcccagcgagcugugggacaccaccaucuaa

SEQ ID NO: 20241 - RNA, 7704 nt, Artificial Sequence
  MYO18B__Homo_sapiens__NP_115997
auggccaucagcagcagacuggcccugugggagcagaagaucagagaggaggacaagagccccccccccagcagcccccccccccuguucagcgugauccccggcggcuucaucaagcagcuggugagaggcaccgagaaggaggccaaggaggccagacagagaaagcagcuggccguggccagccccgagagagagauccccgagaucagcaucagccagcccaacagcaagagcagcagcggcaccagaagcggcagccagcagaucagccaggacgaccagagcagcagccccggcagcagcgacauccugggcaaggagagcgagggcagcagaagccccgaccccgagcagaugaccagcaucaacggcgagaaggcccaggagcugggcagcagcgccacccccaccaagaagaccgugcccuucaagagaggcgugagaagaggcgacgugcugcugaugguggccaagcuggaccccgacagcgccaagcccgagaagacccacccccacgacgccccccccugcaagaccagcccccccgccaccgacaccggcaaggagaagaagggcgagaccagcagaacccccugcggcagccaggccagcaccgagauccuggcccccaaggccgagaagaccagaaccggcggccugggcgaccccggccagggcaccguggcccugaagaagggcgaggagggccagagcaucgugggcaagggccugggcacccccaagaccaccgagcugaaggaggccgagccccagggcaaggacagacagggcaccagaccccaggcccagggccccggcgagggcgugagacccggcaaggccgagaaggagggcgccgagcccaccaacaccguggagaagggcaacgugagcaaggacgugggcagcgagggcaagcacgugagaccccagauccccggcagaaaguggggcggcuuccugggcagaagaagcaagugggacggcccccagaacaagaaggacaaggagggcgugcugcugagcaaggccgagaagaccggcgagccccagacccagauggagaagaccagccaggugcagggcgagcugggcgacgaccugagaaugggcgagaaggccggcgagcugagaagcaccaccggcaaggccggcgagagcugggacaagaaggagaagaugggccagccccagggcaagagcggcaacgccggcgaggccagaagccagaccgagaagggcugcgaggcccccaaggaggugagcaccaugguggagagccccgccgcccccggcaagggcggcuggcccggcagcagaggccaggaggccgaggagcccugcagcagagccggcgacggcgccggcgcccuggagaccgagcuggagggccccagccagcccgcccuggagaaggacgccgagagacccagaaucagaaaggagaaccaggacggccccgccccccaggaggagggcaagggcggccagagcagagacagcgaccaggcccccgaggacagaugguacgaggccgagaagguguggcuggcccagaaggacggcuucacccuggccaccgugcugaagcccgacgagggcaccgccgaccugcccgccggcagagugagacuguggaucgacgccgacaagaccaucaccgagguggacgaggagcacgugcacagagccaacccccccgagcuggaccagguggaggaccuggccagccugaucagcgugaacgagagcagcgugcugaacacccugcugcagagauacaaggcccagcugcugcacaccugcaccggccccgaccugaucgugcugcagcccagaggccccagcgugcccagcgccggcaaggugcccaagggcagaagagacggccugcccgcccacaucggcagcauggcccagagagccuacugggcccugcugaaccagagaagagaccagagcaucguggcccugggcuggagcggcgccggcaagaccaccugcugcgagcaggugcuggagcaccuggugggcauggccggcagcguggacggcagagugagcguggagaagaucagagccaccuucaccgugcugagagccuucggcagcgugagcauggcccacagcagaagcgccaccagauucagcauggugaugagccuggacuucaacgccaccggcagaaucaccgccgcccagcugcagaccaugcugcuggagaagagcagaguggccagacagcccgagggcgagagcaacuuccugguguucagccagaugcuggccggccuggaccuggaccugagaaccgagcugaaccugcaccagauggccgacagcagcagcuucggcaugggcguguggagcaagcccgaggacaagcagaaggccgccgccgccuucgcccagcugcagggcgccauggagaugcugggcaucagcgagagcgagcagagagccguguggagagugcuggccgccaucuaccaccugggcgccgccggcgccugcaaggugggcagaaagcaguucaugagauucgagugggccaacuacgccgccgaggcccugggcugcgaguacgaggagcugaacaccgccaccuucaagcaccaccugagacagaucauccagcagaugaccuucggccccagcagauggggccuggaggacgaggagaccagcagcggccugaagaugaccggcguggacugcguggagggcauggccagcggccuguaccaggagcuguucgccgccguggugagccugaucaacagaagcuucagcagccaccaccugagcauggccagcaucauggugguggacagccccggcuuccagaaccccagacaccagggcaaggacagagccgccaccuucgaggagcugugccacaacuacgcccacgagagacugcagcugcuguucuaccagagaaccuucgugagcacccugcagagauaccaggaggagggcgugcccgugcaguucgaccugcccgaccccagccccggcaccaccguggccgugguggaccagaaccccagccaggugagacugcccgccggcggcggcgcccaggacgccagaggccuguucugggugcuggacgaggaggugcacguggagggcagcagcgacagcguggugcuggagagacugugcgccgccuucgagaagaagggcgccggcaccgagggcagcagcgcccugagaaccugcgagcagccccugcagugcgagaucuuccaccagcugggcugggaccccgugagauacgaccugaccggcuggcugcacagagccaagcccaaccugagcgcccuggacgccccccaggugcugcaccagagcaagagagaggagcugagaagccuguuccaggccagagccaagcugccccccgugugcagagccguggccggccuggagggcaccagccagcaggcccugcagagaagcagaauggugagaagaaccuucgccagcagccuggccgccgugagaagaaaggcccccugcagccagaucaagcugcagauggacgcccugaccagcaugaucaagagaagcagacugcacuucauccacugccuggugcccaaccccgugguggagagcagaagcggccaggagagccccccccccccccagcccggcagagacaagcccggcgccggcggcccccuggcccuggacauccccgcccugagagugcagcuggccggcuuccacauccuggaggcccugagacugcacagaaccggcuacgccgaccacaugggccugaccagauucagaagacaguuccaggugcuggacgccccccugcugaagaagcugaugagcaccagcgagggcaucgacgagagaaaggccguggaggagcugcuggagacccuggaccuggagaagaaggccguggccgugggccacagccagguguuccugaaggccggcgugaucagcagacuggagaagcagagagagaagcuggugagccagagcaucgugcuguuccaggccgccugcaagggcuuccugagcagacaggaguucaagaagcugaagaucagaagacuggccgcccagugcauccagaagaacguggccguguuccuggccgugaaggacuggcccugguggcagcugcugggcagccugcagccccugcugagcgccaccaucggcaccgagcagcugagagccaaggaggaggagcugaccacccugagaagaaagcuggagaagagcgagaagcugagaaacgagcugagacagaacaccgaccugcuggagagcaagaucgccgaccugaccagcgaccuggccgacgagagauucaagggcgacguggccugccaggugcuggagagcgagagagccgagagacugcaggccuucagagaggugcaggagcugaagagcaagcacgagcaggugcagaagaagcugggcgacgugaacaagcagcuggaggaggcccagcagaagauccagcugaacgaccuggagagaaaccccaccggcggcgccgacgaguggcagaugagauucgacugcgcccagauggagaacgaguuccugagaaagagacugcagcagugcgaggagagacuggacagcgagcugaccgccagaaaggagcuggagcagaagcugggcgagcugcagagcgccuacgacggcgccaagaagauggcccaccagcugaagagaaagugccaccaccugaccugcgaccuggaggacaccugcgugcugcuggagaaccagcagagcagaaaccacgagcuggagaagaagcagaagaaguucgaccugcagcuggcccaggcccugggcgagagcguguucgagaagggccugagagagaaggugacccaggagaacaccagcgugagaugggagcugggccagcugcagcagcagcugaagcagaaggagcaggaggccagccagcugaagcagcagguggagaugcugcaggaccacaagagagagcugcugggcagccccagccugggcgagaacugcguggccggccugaaggagagacuguggaagcuggagagcagcgcccuggagcagcagaagauccagagccagcaggagaacaccaucaagcagcuggagcagcugagacagagauucgagcuggagaucgagagaaugaagcagaugcaccagaaggacagagaggaccaggaggaggagcuggaggacgugagacagagcugccagaagagacugcaccagcuggagaugcagcuggagcaggaguacgaggagaagcagauggugcugcacgagaagcaggaccuggagggccugaucggcacccugugcgaccagaucggccacagagacuucgacguggagaagagacugagaagagaccugagaagaacccacgcccugcugagcgacgugcagcugcugcugggcaccauggaggacggcaagaccagcgugagcaaggaggagcuggagaaggugcacagccagcuggagcagagcgaggccaagugcgaggaggcccugaagacccagaaggugcugaccgccgaccuggagagcaugcacagcgagcuggagaacaugaccagaaacaagagccugguggacgagcagcuguacagacugcaguucgagaaggccgaccugcugaagagaaucgacgaggaccaggacgaccugaacgagcugaugcagaagcacaaggaccugaucgcccagagcgccgccgacaucggccagauccaggagcugcagcugcagcuggaggaggccaagaaggagaagcacaagcugcaggagcagcugcagguggcccagaugagaaucgaguaccuggagcagagcaccguggacagagccaucgugagcagacaggaggccgugaucugcgaccuggagaacaagaccgaguuccagaaggugcagaucaagagauucgaggugcuggugaucagacugagagacagccugaucaagaugggcgaggagcugagccaggccgccaccagcgagagccagcagagagagagcagccaguacuaccagagaagacuggaggagcugaaggccgacauggaggagcuggugcagagagaggccgaggccagcagaagaugcauggagcuggagaaguacguggaggagcuggccgccgugagacagacccugcagaccgaccuggagaccagcaucagaagaaucgccgaccugcaggccgcccuggaggagguggccagcagcgacagcgacaccgagagcgugcagaccgccguggacugcggcagcagcggcagaaaggagauggacaacgugagcauccugagcagccagcccgagggcagccugcagagcuggcugagcugcacccugagccuggccaccgacaccaugagaacccccagcagacagagcgccaccagcagcagaauccugagccccagaaucaacgaggaggccggcgacaccgagagaacccagagcgcccuggcccugagcagagccagaagcaccaacgugcacagcaagaccagcggcgacaagcccgugagcccccacuucgugagaagacagaaguacugccacuucggcgacggcgaggugcuggccgugcagagaaagagcaccgagagacuggagcccgccagcagcccccuggccagcagaagcaccaacaccagcccccugagcagagagaagcugcccagccccagcgccgcccugagcgaguucguggagggccugagaagaaagagagcccagagaggccagggcagcacccugggccuggaggacuggcccacccugcccaucuaccagaccaccggcgccagcacccugagaagaggcagagccggcagcgacgagggcaaccugagccugagagugggcgccaagagcccccuggagaucgagggcgccgccggcggccugcugagaagcaccagccugaagugcaucagcagcgacggcgugggcggcaccacccugcugcccgagaagagcaagacccaguucagcagcugcgagagccugcuggagagcagacccagcaugggcagaaagcugagcagccccaccacccccagagacaugcugcugagccccacccugagacccagaagaagaugccuggagagcagcguggacgacgccggcugccccgaccugggcaaggagccccugguguuccagaacagacaguucgcccaccugauggaggagccccugggcagcgaccccuucagcuggaagcugcccagccuggacuacgagagaaagaccaagguggacuucgacgacuuccugcccgccaucagaaagccccagacccccaccagccuggccggcagcgccaagggcggccaggacggcagccagagaagcagcauccacuucgagaccgaggaggccaacagaagcuuccugagcggcaucaagaccauccugaagaagagccccgagcccaaggaggaccccgcccaccugagcgacagcagcagcagcagcggcagcaucgugagcuucaagagcgccgacagcaucaagagcagacccggcauccccagacuggccggcgacggcggcgagagaaccagccccgagagaagagagcccggcaccggcagaaaggacgacgacguggccagcaucaugaagaaguaccugcagaaguaa

SEQ ID NO: 20242 - RNA, 3132 nt, Artificial Sequence
  MYO1A__Homo_sapiens__NP_005370
augccccugcuggagggcagcgugggcguggaggaccuggugcugcuggagccccugguggaggagagccugcugaagaaccugcagcugagauacgagaacaaggagaucuacaccuacaucggcaacguggugaucagcgugaaccccuaccagcagcugcccaucuacggccccgaguucaucgccaaguaccaggacuacaccuucuacgagcugaagccccacaucuacgcccuggccaacguggccuaccagagccugagagacagagacagagaccagugcauccugaucaccggcgagagcggcagcggcaagaccgaggccagcaagcuggugaugagcuacguggccgccgugugcggcaagggcgagcaggugaacagcgugaaggagcagcugcugcagagcaaccccgugcuggaggccuucggcaacgccaagaccaucagaaacaacaacagcagcagauucggcaaguacauggacaucgaguucgacuucaagggcagcccccugggcggcgugaucaccaacuaccugcuggagaagagcagacuggugaagcagcugaagggcgagagaaacuuccacaucuucuaccagcugcuggccggcgccgacgagcagcugcugaaggcccugaagcuggagagagacaccaccggcuacgccuaccugaaccacgaggugagcagaguggacggcauggacgacgccagcagcuucagagccgugcagagcgccauggccgugaucggcuucagcgaggaggagaucagacaggugcuggaggugaccagcauggugcugaagcugggcaacgugcugguggccgacgaguuccaggccagcggcauccccgccagcggcaucagagacggcagaggcgugagagagaucggcgagauggugggccugaacagcgaggagguggagagagcccugugcagcagaaccauggagaccgccaaggagaagguggugaccgcccugaacgugaugcaggcccaguacgccagagacgcccuggccaagaacaucuacagcagacuguucgacuggaucgugaacagaaucaacgagagcaucaaggugggcaucggcgagaagaagaaggugaugggcgugcuggacaucuacggcuucgagauccuggaggacaacagcuucgagcaguucgugaucaacuacugcaacgagaagcugcagcagguguucaucgagaugacccugaaggaggagcaggaggaguacaagagagagggcauccccuggaccaagguggacuacuucgacaacggcaucaucugcaagcugaucgagcacaaccagagaggcauccuggccaugcuggacgaggagugccugagacccggcguggugagcgacagcaccuuccuggccaagcugaaccagcuguucagcaagcacggccacuacgagagcaaggugacccagaacgcccagagacaguacgaccacaccaugggccugagcugcuucagaaucugccacuacgccggcaaggugaccuacaacgugaccagcuucaucgacaagaacaacgaccugcuguucagagaccugcugcaggccauguggaaggcccagcacccccugcugagaagccuguuccccgagggcaaccccaagcaggccagccugaagagaccccccaccgccggcgcccaguucaagagcagcguggccauccugaugaagaaccuguacagcaagagccccaacuacaucagaugcaucaagcccaacgagcaccagcagagaggccaguucagcagcgaccugguggccacccaggccagauaccugggccugcuggagaacgugagagugagaagagccggcuacgcccacagacagggcuacggccccuuccuggagagauacagacugcugagcagaagcaccuggccccacuggaacggcggcgacagagagggcguggagaaggugcugggcgagcugagcaugagcagcggcgagcuggccuucggcaagaccaagaucuucaucagaagccccaagacccuguucuaccuggaggagcagagaagacugagacugcagcagcuggccacccugauccagaagaucuacagaggcuggagaugcagaacccacuaccagcugaugagaaagagccagauccugaucagcagcugguucagaggcaacaugcagaagaagugcuacggcaagaucaaggccagcgugcugcugauccaggccuucgugagaggcuggaaggccagaaagaacuacagaaaguacuucagaagcgaggccgcccugacccuggccgacuucaucuacaagagcauggugcagaaguuccugcugggccugaagaacaaccugcccagcaccaacgugcuggacaagaccuggcccgccgcccccuacaagugccugagcaccgccaaccaggagcugcagcagcuguucuaccaguggaagugcaagagauucagagaccagcugagccccaagcagguggagauccugagagagaagcugugcgccagcgagcuguucaagggcaagaaggccagcuacccccagagcgugcccauccccuucugcggcgacuacaucggccugcagggcaaccccaagcugcagaagcugaagggcggcgaggagggccccgugcugauggccgaggccgugaagaaggugaacagaggcaacggcaagaccagcagcagaauccugcugcugaccaagggccacgugauccugaccgacaccaagaagagccaggccaagaucgugaucggccuggacaacguggccggcgugagcgugaccagccugaaggacggccuguucagccugcaccugagcgagaugagcagcgugggcagcaagggcgacuuccugcuggugagcgagcacgugaucgagcugcugaccaagauguacagagccgugcuggacgccacccagagacagcugaccgugaccgugaccgagaaguucagcgugagauucaaggagaacagcguggccgugaagguggugcagggccccgccggcggcgacaacagcaagcugagauacaagaagaagggcagccacugccuggaggugaccgugcaguaa

SEQ ID NO: 20243 - RNA, 3237 nt, Artificial Sequence
  MYO1B__Homo_sapiens__NP_036355
auggccaagauggaggugaagaccagccugcuggacaacaugaucggcgugggcgacauggugcugcuggagccccugaacgaggagaccuucaucaacaaccugaagaagagauucgaccacagcgagaucuacaccuacaucggcagcguggugaucagcgugaaccccuacagaagccugcccaucuacagccccgagaagguggaggaguacagaaacagaaacuucuacgagcugagcccccacaucuucgcccugagcgacgaggccuacagaagccugagagaccaggacaaggaccagugcauccugaucaccggcgagagcggcgccggcaagaccgaggccagcaagcuggugaugagcuacguggccgccgugugcggcaagggcgccgaggugaaccaggugaaggagcagcugcugcagagcaaccccgugcuggaggccuucggcaacgccaagaccgugagaaacgacaacagcagcagauucggcaaguacauggacaucgaguucgacuucaagggcgacccccugggcggcgugaucagcaacuaccugcuggagaagagcagaguggugaagcagcccagaggcgagagaaacuuccacguguucuaccagcugcugagcggcgccagcgaggagcugcugaacaagcugaagcuggagagagacuucagcagauacaacuaccugagccuggacagcgccaaggugaacggcguggacgacgccgccaacuucagaaccgugagaaacgccaugcagaucgugggcuucauggaccacgaggccgagagcgugcuggccgugguggccgccgugcugaagcugggcaacaucgaguucaagcccgagagcagagugaacggccuggacgagagcaagaucaaggacaagaacgagcugaaggagaucugcgagcugaccggcaucgaccagagcgugcuggagagagccuucagcuucagaaccguggaggccaagcaggagaaggugagcaccacccugaacguggcccaggccuacuacgccagagacgcccuggccaagaaccuguacagcagacuguucagcuggcuggugaacagaaucaacgagagcaucaaggcccagaccaaggugagaaagaaggugaugggcgugcuggacaucuacggcuucgagaucuucgaggacaacagcuucgagcaguucaucaucaacuacugcaacgagaagcugcagcagaucuucaucgagcugacccugaaggaggagcaggaggaguacaucagagaggacaucgaguggacccacaucgacuacuucaacaacgccaucaucugcgaccugaucgagaacaacaccaacggcauccuggccaugcuggacgaggagugccugagacccggcaccgugaccgacgagaccuuccuggagaagcugaaccaggugugcgccacccaccagcacuucgagagcagaaugagcaagugcagcagauuccugaacgacaccagccugccccacagcugcuucagaauccagcacuacgccggcaaggugcuguaccagguggagggcuucguggacaagaacaacgaccugcuguacagagaccugagccaggccauguggaaggccagccacgcccugaucaagagccuguuccccgagggcaaccccgccaagaucaaccugaagagaccccccaccgccggcagccaguucaaggccagcguggccacccugaugaagaaccugcagaccaagaaccccaacuacaucagaugcaucaagcccaacgacaagaaggccgcccacaucuucaacgaggcccuggugugccaccagaucagauaccugggccugcuggagaacgugagagugagaagagccggcuacgccuucagacaggccuacgagcccugccuggagagauacaagaugcugugcaagcagaccuggccccacuggaagggccccgccagaagcggcguggaggugcuguucaacgagcuggagauccccguggaggaguacagcuucggcagaagcaagaucuucaucagaaaccccagaacccuguucaagcuggaggaccugagaaagcagagacuggaggaccuggccacccugauccagaagaucuacagaggcuggaagugcagaacccacuuccugcugaugaagaagagccagaucgugaucgccgccugguacagaagauacgcccagcagaagagauaccagcagaccaagagcagcgcccuggugauccagagcuacaucagaggcuggaaggccagaaagauccugagagagcugaagcaccagaagagaugcaaggaggccgugaccaccaucgccgccuacuggcacggcacccaggugagaagagaguacagaaaguucuucagagccaacgccggcaagaagaucuacgaguucacccugcagagaaucgugcagaaguacuuccuggagaugaagaacaagaugcccagccugagccccaucgacaagaacuggcccagcagacccuaccuguuccuggacagcacccacaaggagcugaagagaaucuuccaccuguggagaugcaagaaguacagagaccaguucaccgaccagcagaagcugaucuacgaggagaagcuggaggccagcgagcuguucaaggacaagaaggcccuguaccccagcagcgugggccagcccuuccagggcgccuaccuggagaucaacaagaaccccaaguacaagaagcugaaggacgccaucgaggagaagaucaucaucgccgagguggugaacaagaucaacagagccaacggcaagagcaccagcagaaucuuccugcugaccaacaacaaccugcugcuggccgaccagaagagcggccagaucaagagcgaggugccccugguggacgugaccaaggugagcaugagcagccagaacgacggcuucuucgccgugcaccugaaggagggcagcgaggccgccagcaagggcgacuuccuguucagcagcgaccaccugaucgagauggccaccaagcuguacagaaccacccugagccagaccaagcagaagcugaacaucgagaucagcgacgaguuccuggugcaguucagacaggacaaggugugcgugaaguucauccagggcaaccagaagaacggcagcgugcccaccugcaagagaaagaacaacagacugcuggagguggccgugcccuaa

SEQ ID NO: 20244 - RNA, 3192 nt, Artificial Sequence
  MYO1C__Homo_sapiens__NP_001074248
auggcccugcagguggagcuggugcccaccggcgagaucaucagaguggugcacccccacagacccugcaagcuggcccugggcagcgacggcgugagagugaccauggagagcgcccugaccgccagagacagagugggcgugcaggacuucgugcugcuggagaacuucaccagcgaggccgccuucaucgagaaccugagaagaagauucagagagaaccugaucuacaccuacaucggccccgugcuggugagcgugaaccccuacagagaccugcagaucuacagcagacagcacauggagagauacagaggcgugagcuucuacgaggugcccccccaccuguucgccguggccgacaccguguacagagcccugagaaccgagagaagagaccaggccgugaugaucagcggcgagagcggcgccggcaagaccgaggccaccaagagacugcugcaguucuacgccgagaccugccccgcccccgagagaggcggcgccgugagagacagacugcugcagagcaaccccgugcuggaggccuucggcaacgccaagacccugagaaacgacaacagcagcagauucggcaaguacauggacgugcaguucgacuucaagggcgcccccgugggcggccacauccugagcuaccugcuggagaagagcagaguggugcaccagaaccacggcgagagaaacuuccacaucuucuaccagcugcuggagggcggcgaggaggagacccugagaagacugggccuggagagaaacccccagagcuaccuguaccuggugaagggccagugcgccaaggugagcagcaucaacgacaagagcgacuggaagguggugagaaaggcccugaccgugaucgacuucaccgaggacgagguggaggaccugcugagcaucguggccagcgugcugcaccugggcaacauccacuucgccgccaacgaggagagcaacgcccaggugaccaccgagaaccagcugaaguaccugaccagacugcugagcguggagggcagcacccugagagaggcccugacccacagaaagaucaucgccaagggcgaggagcugcugagcccccugaaccuggagcaggccgccuacgccagagacgcccuggccaaggccguguacagcagaaccuucaccuggcuggugggcaagaucaacagaagccuggccagcaaggacguggagagccccagcuggagaagcaccaccgugcugggccugcuggacaucuacggcuucgagguguuccagcacaacagcuucgagcaguucugcaucaacuacugcaacgagaagcugcagcagcuguucaucgagcugacccugaagagcgagcaggaggaguacgaggccgagggcaucgccugggagcccgugcaguacuucaacaacaagaucaucugcgaccugguggaggagaaguucaagggcaucaucagcauccuggacgaggagugccugagacccggcgaggccaccgaccugaccuuccuggagaagcuggaggacaccgugaagcaccacccccacuuccugacccacaagcuggccgaccagagaaccagaaagagccugggcagaggcgaguucagacugcugcacuacgccggcgaggugaccuacagcgugaccggcuuccuggacaagaacaacgaccugcuguucagaaaccugaaggagaccaugugcagcagcaagaaccccaucaugagccagugcuucgacagaagcgagcugagcgacaagaagagacccgagaccguggccacccaguucaagaugagccugcugcagcugguggagauccugcagagcaaggagcccgccuacgugagaugcaucaagcccaacgacgccaagcagcccggcagauucgacgaggugcugaucagacaccaggugaaguaccugggccugcuggagaaccugagagugagaagagccggcuucgccuacagaagaaaguacgaggccuuccugcagagauacaagagccugugccccgagaccuggcccaccugggccggcagaccccaggacggcguggccgugcuggugagacaccugggcuacaagcccgaggaguacaagaugggcagaaccaagaucuucaucagauuccccaagacccuguucgccaccgaggacgcccuggaggugagaagacagagccuggccaccaagauccaggccgccuggagaggcuuccacuggagacagaaguuccugagagugaagagaagcgccaucugcauccagagcugguggagaggcacccugggcagaagaaaggccgccaagagaaagugggccgcccagaccaucagaagacugaucagaggcuucgugcugagacacgcccccagaugccccgagaacgccuucuuccuggaccacgugagaaccagcuuccugcugaaccugagaagacagcugccccagaacgugcuggacaccagcuggcccacccccccccccgcccugagagaggccagcgagcugcugagagagcugugcaucaagaacaugguguggaaguacugcagaagcaucagccccgaguggaagcagcagcugcagcagaaggccguggccagcgagaucuucaagggcaagaaggacaacuacccccagagcgugcccagacuguucaucagcaccagacugggcaccgacgagaucagccccagagugcugcaggcccugggcagcgagcccauccaguacgccgugcccguggugaaguacgacagaaagggcuacaagcccagaagcagacagcugcugcugacccccaacgccguggugaucguggaggacgccaaggugaagcagagaaucgacuacgccaaccugaccggcaucagcgugagcagccugagcgacagccuguucgugcugcacgugcagagagccgacaacaagcagaagggcgacguggugcugcagagcgaccacgugaucgagacccugaccaagaccgcccugagcgccaacagagugaacagcaucaacaucaaccagggcagcaucaccuucgccggcggccccggcagagacggcaccaucgacuucacccccggcagcgagcugcugaucaccaaggccaagaacggccaccuggccgugguggcccccagacugaacagcagauaa

SEQ ID NO: 20245 - RNA, 3021 nt, Artificial Sequence
  MYO1D__Homo_sapiens__NP_056009
auggccgagcaggagagccuggaguucggcaaggccgacuucgugcugauggacaccgugagcaugcccgaguucauggccaaccugagacugagauucgagaagggcagaaucuacaccuucaucggcgaggugguggugagcgugaaccccuacaagcugcugaacaucuacggcagagacaccaucgagcaguacaagggcagagagcuguacgagagacccccccaccuguucgccaucgccgacgccgccuacaaggccaugaagagaagaagcaaggacaccugcaucgugaucagcggcgagagcggcgccggcaagaccgaggccagcaaguacaucaugcaguacaucgccgccaucaccaaccccagccagagagccgagguggagagagugaagaacaugcugcugaagagcaacugcgugcuggaggccuucggcaacgccaagaccaacagaaacgacaacagcagcagauucggcaaguacauggacaucaacuucgacuucaagggcgaccccaucggcggccacaucaacaacuaccugcuggagaagagcagagugaucgugcagcagcccggcgagagaagcuuccacagcuucuaccagcugcugcagggcggcagcgagcagaugcugagaagccugcaccugcagaagagccugagcagcuacaacuacauccacgugggcgcccagcugaagagcagcaucaacgacgccgccgaguucagagugguggccgacgccaugaaggugaucggcuucaagcccgaggagauccagaccguguacaagauccuggccgccauccugcaccugggcaaccugaaguucgugguggacggcgacaccccccugaucgagaacggcaagguggugagcaucaucgccgagcugcugagcaccaagaccgacaugguggagaaggcccugcuguacagaaccguggccaccggcagagacaucaucgacaagcagcacaccgagcaggaggccagcuacggcagagacgccuucgccaaggccaucuacgagagacuguucugcuggaucgugaccagaaucaacgacaucaucgaggugaagaacuacgacaccaccauccacggcaagaacaccgugaucggcgugcuggacaucuacggcuucgagaucuucgacaacaacagcuucgagcaguucugcaucaacuacugcaacgagaagcugcagcagcuguucauccagcuggugcugaagcaggagcaggaggaguaccagagagagggcauccccuggaagcacaucgacuacuucaacaaccagaucaucguggaccugguggagcagcagcacaagggcaucaucgccauccuggacgacgccugcaugaacgugggcaaggugaccgacgagauguuccuggaggcccugaacagcaagcugggcaagcacgcccacuucagcagcagaaagcugugcgccagcgacaagauccuggaguucgacagagacuucagaaucagacacuacgccggcgacgugguguacagcgugaucggcuucaucgacaagaacaaggacacccuguuccaggacuucaagagacugauguacaacagcagcaaccccgugcugaagaacauguggcccgagggcaagcugagcaucaccgaggugaccaagagaccccugaccgccgccacccuguucaagaacagcaugaucgcccugguggacaaccuggccagcaaggagcccuacuacgugagaugcaucaagcccaacgacaagaagagcccccagaucuucgacgacgagagaugcagacaccagguggaguaccugggccugcuggagaacgugagagugagaagagccggcuucgccuucagacagaccuacgagaaguuccugcacagauacaagaugaucagcgaguucaccuggcccaaccacgaccugcccagcgacaaggaggccgugaagaagcugaucgagagaugcggcuuccaggacgacguggccuacggcaagaccaagaucuucaucagaacccccagaacccuguucacccuggaggagcugagagcccagaugcugaucagaaucgugcuguuccugcagaagguguggagaggcacccuggccagaaugagauacaagagaaccaaggccgcccugaccaucaucagauacuacagaagauacaaggugaagagcuacauccacgagguggccagaagauuccacggcgugaagaccaugagagacuacggcaagcacgugaaguggcccagcccccccaaggugcugagaagauucgaggaggcccugcagaccaucuucaacagauggagagccagccagcugaucaagagcauccccgccagcgaccugccccaggugagagccaagguggccgccguggagaugcugaagggccagagagccgaccugggccugcagagagccugggagggcaacuaccuggccagcaagcccgacaccccccagaccagcggcaccuucgugcccguggccaacgagcugaagagaaaggacaaguacaugaacgugcuguucagcugccacgugagaaaggugaacagauucagcaagguggaggacagagccaucuucgugaccgacagacaccuguacaagauggaccccaccaagcaguacaaggugaugaagaccaucccccuguacaaccugaccggccugagcgugagcaacggcaaggaccagcuggugguguuccacaccaaggacaacaaggaccugaucgugugccuguucagcaagcagcccacccacgagagcagaaucggcgagcuggugggcgugcuggugaaccacuucaagagcgagaagagacaccugcaggugaacgugaccaaccccgugcagugcagccugcacggcaagaagugcaccgugagcguggagaccagacugaaccagccccagcccgacuucaccaagaacagaagcggcuucauccugagcgugcccggcaacuaa

SEQ ID NO: 20246 - RNA, 3327 nt, Artificial Sequence
  MYO1E__Homo_sapiens__NP_004989
augggcagcaagggcguguaccaguaccacuggcagagccacaacgugaagcacagcggcguggacgacauggugcugcugagcaagaucaccgagaacagcaucguggagaaccugaagaagagauacauggacgacuacaucuucaccuacaucggcagcgugcugaucagcgugaaccccuucaagcagaugcccuacuucggcgagaaggagaucgagauguaccagggcgccgcccaguacgagaaccccccccacaucuacgcccuggccgacaacauguacagaaacaugaucaucgacagagagaaccagugcgugaucaucagcggcgagagcggcgccggcaagaccguggccgccaaguacaucaugagcuacaucagcagagugagcggcggcggcaccaaggugcagcacgugaaggacaucauccugcagagcaacccccugcuggaggccuucggcaacgccaagaccgugagaaacaacaacagcagcagauucggcaaguacuucgagauccaguucagccccggcggcgagcccgacggcggcaagaucagcaacuuccugcuggagaagagcagaguggugaugagaaaccccggcgagagaagcuuccacaucuucuaccagcugaucgagggcgccagcgccgagcagaagcacagccugggcaucaccagcauggacuacuacuacuaccugagccugagcggcagcuacaagguggacgacaucgacgacagaagagaguuccaggagacccugcacgccaugaacgugaucggcaucuucgccgaggagcagacccuggugcugcagaucguggccggcauccugcaccugggcaacaucagcuucaaggaggugggcaacuacgccgccguggagagcgaggaguuccuggccuuccccgccuaccugcugggcaucaaccaggacagacugaaggagaagcugaccagcagacagauggacagcaaguggggcggcaagagcgagagcauccacgugacccugaacguggagcaggccugcuacaccagagacgcccuggccaaggcccugcacgccagaguguucgacuuccugguggacagcaucaacaaggccauggagaaggaccacgaggaguacaacaucggcgugcuggacaucuacggcuucgagaucuuccagaagaacggcuucgagcaguucugcaucaacuucgugaacgagaagcugcagcagaucuucaucgagcugacccugaaggccgagcaggaggaguacgugcaggagggcaucagauggacccccaucgaguacuucaacaacaagaucgugugcgaccugaucgagaacaaggugaacccccccggcaucaugagcauccuggacgacgugugcgccaccaugcacgccgugggcgagggcgccgaccagacccugcugcagaagcugcagaugcagaucggcagccacgagcacuucaacagcuggaaccagggcuucaucauccaccacuacgccggcaaggugagcuacgacauggacggcuucugcgagagaaacagagacgugcuguucauggaccugaucgagcugaugcagagcagcgagcugcccuucaucaagagccuguuccccgagaaccugcaggccgacaagaagggcagacccaccaccgccggcagcaagaucaagaagcaggccaacgaccuggugagcacccugaugaagugcaccccccacuacaucagaugcaucaagcccaacgagaccaagaagcccagagacugggaggagagcagagugaagcaccagguggaguaccugggccugaaggagaacaucagagugagaagagccggcuacgccuacagaagaaucuuccagaaguuccugcagagauacgccauccugaccaaggccaccuggcccagcuggcagggcgaggagaagcagggcgugcugcaccugcugcagagcgugaacauggacagcgaccaguuccagcugggcagaagcaagguguucaucaaggcccccgagagccuguuccugcuggaggagaugagagagagaaaguacgacggcuacgccagagugauccagaagagcuggagaaaguucguggccagaaagaaguacgugcagaugagagaggaggccagcgaccugcugcugaacaagaaggagagaagaagaaacagcaucaacagaaacuucaucggcgacuacaucggcauggaggagcaccccgagcugcagcaguucgugggcaagagagagaagaucgacuucgccgacaccgugaccaaguacgacagaagauucaagggcgugaagagagaccugcugcugacccccaagugccuguaccugaucggcagagagaaggugaagcagggccccgacaagggccuggugaaggaggugcugaagagaaagaucgagaucgagagaauccugagcgugagccugagcaccaugcaggacgacaucuucauccugcacgagcaggaguacgacagccugcuggagagcguguucaagaccgaguuccugagccugcuggccaagagauacgaggagaagacccagaagcagcugccccugaaguucagcaacacccuggagcugaagcugaagaaggagaacuggggccccuggagcgccggcggcagcagacaggugcaguuccaccagggcuucggcgaccuggccgugcugaagcccagcaacaaggugcugcaggugagcaucggccccggccugcccaagaacagcagacccaccagaagaaacaccacccagaacaccggcuacagcagcggcacccagaacgccaacuaccccgugagagccgccccccccccccccggcuaccaccagaacggcgugaucagaaaccaguacgugcccuacccccacgcccccggcagccagagaagcaaccagaagagccuguacaccagcauggccagacccccccugcccagacagcagagcaccagcagcgacagagugagccagacccccgagagccuggacuuccugaaggugcccgaccagggcgccgccggcgugagaagacagaccaccagcagacccccccccgccggcggcagacccaagccccagcccaagcccaagccccaggugccccagugcaaggcccuguacgccuacgacgcccaggacaccgacgagcugagcuucaacgccaacgacaucaucgacaucaucaaggaggaccccagcggcugguggaccggcagacugagaggcaagcagggccuguuccccaacaacuacgugaccaagaucuaa

SEQ ID NO: 20247 - RNA, 3297 nt, Artificial Sequence
  MYO1F__Homo_sapiens__NP_036467
augggcagcaaggagagauuccacuggcagagccacaacgugaagcagagcggcguggacgacauggugcugcugccccagaucaccgaggacgccaucgccgccaaccugagaaagagauucauggacgacuacaucuucaccuacaucggcagcgugcugaucagcgugaaccccuucaagcagaugcccuacuucaccgacagagagaucgaccuguaccagggcgccgcccaguacgagaaccccccccacaucuacgcccugaccgacaacauguacagaaacaugcugaucgacugcgagaaccagugcgugaucaucagcggcgagagcggcgccggcaagaccguggccgccaaguacaucaugggcuacaucagcaaggugagcggcggcggcgagaaggugcagcacgugaaggacaucauccugcagagcaacccccugcuggaggccuucggcaacgccaagaccgugagaaacaacaacagcagcagauucggcaaguacuucgagauccaguucagcagaggcggcgagcccgacggcggcaagaucagcaacuuccugcuggagaagagcagaguggugaugcagaacgagaacgagagaaacuuccacaucuacuaccagcugcuggagggcgccagccaggagcagagacagaaccugggccugaugacccccgacuacuacuacuaccugaaccagagcgacaccuaccagguggacggcaccgacgacagaagcgacuucggcgagacccugagcgccaugcaggugaucggcaucccccccagcauccagcagcuggugcugcagcugguggccggcauccugcaccugggcaacaucagcuucugcgaggacggcaacuacgccagaguggagagcguggaccugcuggccuuccccgccuaccugcugggcaucgacagcggcagacugcaggagaagcugaccagcagaaagauggacagcagauggggcggcagaagcgagagcaucaacgugacccugaacguggagcaggccgccuacaccagagacgcccuggccaagggccuguacgccagacuguucgacuuccugguggaggccaucaacagagccaugcagaagccccaggaggaguacagcaucggcgugcuggacaucuacggcuucgagaucuuccagaagaacggcuucgagcaguucugcaucaacuucgugaacgagaagcugcagcagaucuucaucgagcugacccugaaggccgagcaggaggaguacgugcaggagggcaucagauggacccccauccaguacuucaacaacaagguggugugcgaccugaucgagaacaagcugagcccccccggcaucaugagcgugcuggacgacgugugcgccaccaugcacgccaccggcggcggcgccgaccagacccugcugcagaagcugcaggccgccgugggcacccacgagcacuucaacagcuggagcgccggcuucgugauccaccacuacgccggcaaggugagcuacgacgugagcggcuucugcgagagaaacagagacgugcuguucagcgaccugaucgagcugaugcagaccagcgagcaggccuuccugagaaugcuguuccccgagaagcuggacggcgacaagaagggcagacccagcaccgccggcagcaagaucaagaagcaggccaacgaccugguggccacccugaugagaugcaccccccacuacaucagaugcaucaagcccaacgagaccaagagacccagagacugggaggagaacagagugaagcaccagguggaguaccugggccugaaggagaacaucagagugagaagagccggcuucgccuacagaagacaguucgccaaguuccugcagagauacgccauccugacccccgagaccuggcccagauggagaggcgacgagagacagggcgugcagcaccugcugagagccgugaacauggagcccgaccaguaccagaugggcagcaccaagguguucgugaagaaccccgagagccuguuccugcuggaggaggugagagagagaaaguucgacggcuucgccagaaccauccagaaggccuggagaagacacguggccgugagaaaguacgaggagaugagagaggaggccagcaacauccugcugaacaagaaggagagaagaagaaacagcaucaacagaaacuucgugggcgacuaccugggccuggaggagagacccgagcugagacaguuccugggcaagagagagagaguggacuucgccgacagcgugaccaaguacgacagaagauucaagcccaucaagagagaccugauccugacccccaagugcguguacgugaucggcagagagaaggugaagaagggccccgagaagggccaggugugcgaggugcugaagaagaagguggacauccaggcccugagaggcgugagccugagcaccagacaggacgacuucuucauccugcaggaggacgccgccgacagcuuccuggagagcguguucaagaccgaguucgugagccugcugugcaagagauucgaggaggccaccagaagaccccugccccugaccuucagcgacacccugcaguucagagugaagaaggagggcuggggcggcggcggcaccagaagcgugaccuucagcagaggcuucggcgaccuggccgugcugaaggugggcggcagaacccugaccgugagcgugggcgacggccugcccaagagcagcaagcccaccagaaagggcauggccaagggcaagcccagaagaagcagccaggcccccaccagagccgcccccgccccccccagaggcauggacagaaacggcgugccccccagcgccagaggcggcccccugccccuggagaucaugagcggcggcggcacccacagaccccccagaggcccccccagcaccagccugggcgccagcagaagacccagagccagaccccccagcgagcacaacaccgaguuccugaacgugcccgaccagggcauggccggcaugcagagaaagagaagcgugggccagagacccgugcccggcgugggcagacccaagccccagcccagaacccacggccccagaugcagagcccuguaccaguacgugggccaggacguggacgagcugagcuucaacgugaacgaggugaucgagauccugauggaggaccccagcggcugguggaagggcagacugcacggccaggagggccuguuccccggcaacuacguggagaagaucuaa

SEQ ID NO: 20248 - RNA, 4851 nt, Artificial Sequence
  MYO3A__Homo_sapiens__XP_011517803
auguucccccugaucggcaagaccaucaucuucgacaacuuccccgaccccagcgacaccugggagaucaccgagaccaucggcaagggcaccuacggcaagguguucaaggugcugaacaagaagaacggccagaaggccgccgugaagauccuggaccccauccacgacaucgacgaggagaucgaggccgaguacaacauccugaaggcccugagcgaccaccccaacguggugagauucuacggcaucuacuucaagaaggacaaggugaacggcgacaagcuguggcuggugcuggagcugugcagcggcggcagcgugaccgaccuggugaagggcuuccugaagagaggcgagagaaugagcgagccccugaucgccuacauccugcacgaggcccugaugggccugcagcaccugcacaacaacaagaccauccacagagacgugaagggcaacaacauccugcugaccaccgagggcggcgugaagcugguggacuucggcgugagcgcccagcugaccagcaccagacacagaagaaacaccagcgugggcacccccuucuggauggcccccgaggugaucgccugcgagcagcagcuggacaccaccuacgacgccagaugcgacaccuggagccugggcaucaccgccaucgagcugggcgacggcgaccccccccuggccgaccugcaccccaugagagcccuguucaagauccccagaaaccccccccccaagcugagacagcccgagcuguggagcgccgaguucaacgacuucaucagcaagugccugaccaaggacuacgagaagagacccaccgugagcgagcugcugcagcacaaguucaucacccagaucgagggcaaggacgugaugcugcagaagcagcugaccgaguucaucggcauccaccagugcaugggcggcaccgagaaggccagaagagagagaauccacaccaagaagggcaacuucaacagaccccugaucagcaaccugaaggacguggacgaccuggccacccuggagauccuggacgagaacaccgugagcgagcagcuggagaagugcuacagcagagaccagaucuacguguacgugggcgacauccugaucgcccugaaccccuuccagagccugggccuguacagcaccaagcacagcaagcuguacaucggcagcaagagaaccgccagccccccccacaucuucgccauggccgaccugggcuaccagagcaugaucaccuacaacagcgaccagugcaucgugaucagcggcgagagcggcgccggcaagaccgagaacgcccaccugcuggugcagcagcugaccgugcugggcaaggccaacaacagaacccugcaggagaagauccugcaggugaacaaccugguggaggccuucggcaacgccugcaccaucaucaacgacaacagcagcagauucggcaaguaccuggagaugaaguucaccagcagcggcgccguggugggcgcccagaucagcgaguaccugcuggagaagagcagagugauccaccaggccaucggcgagaagaacuuccacaucuucuacuacaucuacgccggccuggccgagaagaagaagcuggcccacuacaagcugcccgagaacaagccccccagauaccugcagaacgaccaccugagaaccgugcaggacaucaugaacaacagcuucuacaagagccaguacgagcugaucgagcagugcuucaaggugaucggcuucaccauggagcagcugggcagcaucuacagcauccuggccgccauccugaacgugggcaacaucgaguucagcagcguggccaccgagcaccagaucgacaagagccacaucagcaaccacaccgcccuggagaacugcgccagccugcugugcaucagagccgacgagcugcaggaggcccugaccagccacugcguggugaccagaggcgagaccaucaucagacccaacaccguggagaaggccaccgacgugagagacgccauggccaagacccuguacggcagacuguucagcuggaucgugaacugcaucaacagccugcugaagcacgacagcagccccagcggcaacggcgacgagcugagcaucggcauccuggacaucuucggcuucgagaacuucaagaagaacagcuucgagcagcugugcaucaacaucgccaacgagcagauccaguacuacuacaaccagcacguguucgccugggagcagaacgaguaccugaacgaggacguggacgccagagugaucgaguacgaggacaacuggccccugcuggacauguuccugcagaagcccaugggccugcugagccugcuggacgaggagagcagauuccccaaggccaccgaccagacccugguggagaaguucgagggcaaccugaagagccaguacuucuggagacccaagagaauggagcugagcuucggcauccaccacuacgccggcaaggugcuguacaacgccagcggcuuccuggccaagaacagagacacccugcccaccgacaucgugcugcugcugagaagcagcgacaacagcgugaucagacagcuggugaaccacccccugaccaagaccggcaaccugccccacagcaagaccaagaacgugaucaacuaccagaugagaaccagcgagaagcugaucaaccuggccaagggcgacaccggcgaggccaccagacacgccagagagaccaccaacaugaagacccagaccguggccagcuacuucagauacagccugauggaccugcugagcaagaugguggugggccagccccacuucgugagaugcaucaagcccaacagcgagagacaggccagaaaguacgacaaggagaaggugcugcugcagcugagauacaccggcauccuggagaccgccagaaucagaagacugggcuucagccacagaauccuguucgccaacuucaucaagagauacuaccugcugugcuacaagagcagcgaggagcccagaaugagccccgacaccugcgccaccauccuggagaaggccggccuggacaacugggcccugggcaagaccaagguguuccugaaguacuaccacguggagcagcugaaccugaugagaaaggaggccaucgacaagcugauccugauccaggccugcgugagagccuuccugugcagcagaagauaccagaagauccaggagaagagaaaggagagcgccaucaucauccagagcgccgccagaggccaccuggugagaaagcagagaaaggagaucguggacaugaagaacaccgccgugaccaccauccagaccagcgaccaggaguucgacuacaagaagaacuucgagaacaccagagagagcuucgugaagaagcaggccgagaacgccaucagcgccaacgagagauucaucagcgcccccaacaacaagggcagcgugagcguggugaagaccagcaccuucaagcccgaggaggagaccaccaacgccguggagagcaacaacagaguguaccagacccccaagaagaugaacaacguguacgaggaggaggugaagcaggaguucuaccuggugggccccgaggugagccccaagcagaagagcgugaaggaccuggaggagaacagcaaccugagaaagguggagaaggaggaggccaugauccagagcuacuaccagagauacaccgaggagagaaacugcgaggagagcaaggccgccuaccuggagagaaaggccaucagcgagagacccagcuaccccgugcccuggcuggccgagaacgagaccagcuucaagaagacccuggagcccacccugagccagagaagcaucuaccagaacgccaacagcauggagaaggagaagaagaccagcguggugacccagagagcccccaucugcagccaggaggagggcagaggcagacugagacacgagaccgugaaggagagacagguggagcccgugacccaggcccaggaggaggaggacaaggccgccguguucauccagagcaaguacagaggcuacaagagaagacagcagcugagaaaggacaagaugagcagcuucaagcaccagagaaucgugaccacccccaccgagguggccagaaacacccacaaccuguacagcuaccccaccaagcacgaggagaucaacaacaucaagaagaaggacaacaaggacagcaaggccaccagcgagagagaggccugcggccuggccaucuucagcaagcagaucagcaagcugagcgaggaguacuucauccugcagaagaagcugaacgagaugauccugagccagcagcugaagagccuguaccugggcgugagccaccacaagcccaucaacagaagagugagcagccagcagugccugagcggcgugugcaagggcgaggagcccaagauccugagaccccccagaagacccagaaagcccaagacccugaacaaccccgaggacagcaccuacuacuaccugcugcacaagagcauccaggaggagaagagaagacccagaaaggacagccagggcaagcugcuggaccuggaggacuucuacuacaaggaguuccugcccagcagaagcggccccaaggagcacagccccagccugagagagagaagaccccagcaggagcugcagaaccagugcaucaaggccaacgagagaugcugggccgccgagagccccgagaaggaggaggagagagagcccgccgccaaccccuacgacuucagaagacugcugagaaagaccagccagagaagaagacuggugcagcagagcuaa

SEQ ID NO: 20249 - RNA, 3945 nt, Artificial Sequence
  MYO3B__Homo_sapiens__NP_001077084
augaagcaccuguacggccuguuccacuacaaccccaugaugcugggccuggagagccugcccgaccccaccgacaccugggagaucaucgagaccaucggcaagggcaccuacggcaagguguacaaggugaccaacaagagagacggcagccuggccgccgugaagauccuggaccccgugagcgacauggacgaggagaucgaggccgaguacaacauccugcaguuccugcccaaccaccccaacguggugaaguucuacggcauguucuacaaggccgaccacugcgugggcggccagcuguggcuggugcuggagcugugcaacggcggcagcgugaccgagcuggugaagggccugcugagaugcggccagagacuggacgaggccaugaucagcuacauccuguacggcgcccugcugggccugcagcaccugcacaacaacagaaucauccacagagacgugaagggcaacaacauccugcugaccaccgagggcggcgugaagcugguggacuucggcgugagcgcccagcugaccagcaccagacugagaagaaacaccagcgugggcacccccuucuggauggcccccgaggugaucgccugcgagcagcaguacgacagcagcuacgacgccagaugcgacguguggagccugggcaucaccgccaucgagcugggcgacggcgaccccccccuguucgacaugcaccccgugaagacccuguucaagauccccagaaaccccccccccacccugcugcaccccgagaaguggugcgaggaguucaaccacuucaucagccagugccugaucaaggacuucgagagaagacccagcgugacccaccugcuggaccaccccuucaucaagggcgugcacggcaaggugcuguuccugcagaagcagcuggccaaggugcugcaggaccagaagcaccagaaccccguggccaagaccagacacgagagaaugcacaccagaagacccuaccacguggaggacgccgagaaguacugccuggaggacgaccuggugaaccuggaggugcuggacgaggacaccaucauccaccagcugcagaagagauacgccgaccugcugaucuacaccuacgugggcgacauccugaucgcccugaaccccuuccagaaccugagcaucuacagcccccaguucagcagacuguaccacggcgugaagagagccagcaaccccccccacaucuucgccagcgccgacgccgccuaccagugcauggugacccugagcaaggaccagugcaucgugaucagcggcgagagcggcagcggcaagaccgagagcgcccaccugaucgugcagcaccugaccuuccugggcaaggccaacaaccagacccugagagagaagauccugcaggugaacagccugguggaggccuucggcaacagcugcaccgccaucaacgacaacagcagcagauucggcaaguaccuggagaugauguucacccccaccggcguggugaugggcgccagaaucagcgaguaccugcuggagaagagcagagugaucaagcaggccgccagagagaagaacuuccacaucuucuacuacaucuacgccggccugcaccaccagaagaagcugagcgacuucagacugcccgaggagaagccccccagauacaucgccgacgagaccggcagagugaugcacgacaucaccagcaaggagagcuacagaagacaguucgaggccauccagcacugcuucagaaucaucggcuucaccgacaaggaggugcacagcguguacagaauccuggccggcauccugaacaucggcaacaucgaguucgccgccaucagcagccagcaccagaccgacaagagcgaggugcccaacgccgaggcccugcagaacgccgccagcgugcugugcaucagccccgaggagcugcaggaggcccugaccagccacugcguggugaccagaggcgagaccaucaucagagccaacaccguggacagagccgccgacgugagagacgccaugagcaaggcccuguacggcagacuguucagcuggaucgugaacagaaucaacacccugcugcagcccgacgagaacaucugcagcgccggcggcggcaugaacgugggcauccuggacaucuucggcuucgagaacuuccagagaaacagcuucgagcagcugugcaucaacaucgccaacgagcagauccaguacuacuucaaccagcacguguucgcccuggagcagauggaguaccagaacgagggcaucgacgccgugcccguggaguacgaggacaacagaccccugcuggacauguuccugcagaagccccugggccugcuggcccugcuggacgaggagagcagauucccccaggccaccgaccagacccugguggacaaguucgaggacaaccugagaugcaaguacuucuggagacccaagggcguggagcugugcuucggcauccagcacuacgccggcaaggugcuguacgacgccagcggcgugcuggagaagaacagagacacccugcccgccgacguggugguggugcugagaaccagcgagaacaagcugcugcagcagcuguucagcaucccccugaccaagaccggcaaccuggcccagaccagagccagaaucaccguggccagcagcagccugcccccccacuucagcgccggcaaggccaagguggacacccuggaggugaucagacaccccgaggagaccaccaacaugaagagacagaccguggccagcuacuucagauacagccugauggaccugcugagcaagaugguggugggccagccccacuucgugagaugcaucaagcccaacgacgacagagaggcccugcaguucagcagagagagagugcuggcccagcugagaagcaccggcauccuggagaccgugagcaucagaagacagggcuacagccacagaauccuguucgaggaguucgugaagagauacuacuaccuggccuucaccgcccaccagaccccccuggccagcaaggagagcugcguggccauccuggagaagagcagacuggaccacugggugcugggcaagaccaagguguuccugaaguacuaccacguggagcagcugaaccugcugcugagagaggugaucggcagagugguggugcugcaggccuacaccaagggcuggcugggcgccagaagauacaagagagugagagagaagagagagaagggcgccaucgccauccagagcggcgacaccagcaaccagagcagcggcccccacagccccguggccgccggcaccagaggcagcgccgaggugcaggacugcagcgagcccggcgaccacaaggugcugagaggcagcgugcacagaagaagccacagccaggccgagagcaacaacggcagaacccagaccagcagcaacagccccgccgugaccgagaagaacggccacagccaggcccagagcagccccaagggcugcgacaucuucgccggccacgccaacaagcacagcgugagcggcaccgaccugcugagcagcagaaucugccaccccgcccccgaccagcagggccugagccuguggggcgccccccagaagcccggcagcgagaacggccuggcccagaagcacagaacccccagaagaagaugccagcagcccaagaugcugagcagccccgaggacaccauguacuacaaccagcugaacggcacccuggaguaccagggcagcaagagaaagcccagaaagcugggccagaucaaggugcuggacggcgaggacgaguacuacaagagccugagccccguggacugcauccccgaggagaacaacagcgcccaccccagcuucuucagcagcagcagcaagggcgacagcuucgcccagcacuaa

SEQ ID NO: 20250 - RNA, 5568 nt, Artificial Sequence
  MYO5A__Homo_sapiens__NP_000250
auggccgccagcgagcuguacaccaaguucgccagaguguggauccccgaccccgaggagguguggaagagcgccgagcugcugaaggacuacaagcccggcgacaaggugcugcugcugcaccuggaggagggcaaggaccuggaguaccaccuggaccccaagaccaaggagcugccccaccugagaaaccccgacauccuggugggcgagaacgaccugaccgcccugagcuaccugcacgagcccgccgugcugcacaaccugagagugagauucaucgacagcaagcugaucuacaccuacugcggcaucgugcugguggccaucaaccccuacgagcagcugcccaucuacggcgaggacaucaucaacgccuacagcggccagaacaugggcgacauggacccccacaucuucgccguggccgaggaggccuacaagcagauggccagagacgagagaaaccagagcaucaucgugagcggcgagagcggcgccggcaagaccgugagcgccaaguacgccaugagauacuucgccaccgugagcggcagcgccagcgaggccaacguggaggagaaggugcuggccagcaaccccaucauggagagcaucggcaacgccaagaccaccagaaacgacaacagcagcagauucggcaaguacaucgagaucggcuucgacaagagauacagaaucaucggcgccaacaugagaaccuaccugcuggagaagagcagagugguguuccaggccgaggaggagagaaacuaccacaucuucuaccagcugugcgccagcgccaagcugcccgaguucaagaugcugagacugggcaacgccgacaacuucaacuacaccaagcagggcggcagccccgugaucgagggcguggacgacgccaaggagauggcccacaccagacaggccugcacccugcugggcaucagcgagagccaccagaugggcaucuucagaauccuggccggcauccugcaccugggcaacgugggcuucaccagcagagacgccgacagcugcaccaucccccccaagcacgagccccugugcaucuucugcgaccugaugggcguggacuacgaggagaugugccacuggcugugccacagaaagcuggccaccgccaccgagaccuacaucaagcccaucagcaagcugcaggccaccaacgccagagacgcccuggccaagcacaucuacgccaagcuguucaacuggaucguggacaacgugaaccaggcccugcacagcgccgugaagcagcacagcuucaucggcgugcuggacaucuacggcuucgagaccuucgagaucaacagcuucgagcaguucugcaucaacuacgccaacgagaagcugcagcagcaguucaacaugcacguguucaagcuggagcaggaggaguacaugaaggagcagauccccuggacccugaucgacuucuacgacaaccagcccugcaucaaccugaucgagagcaagcugggcauccuggaccugcuggacgaggagugcaagaugcccaagggcaccgacgacaccugggcccagaagcuguacaacacccaccugaacaagugcgcccuguucgagaagcccagacugagcaacaaggccuucaucauccagcacuucgccgacaagguggaguaccagugcgagggcuuccuggagaagaacaaggacaccguguucgaggagcagaucaaggugcugaagagcagcaaguucaagaugcugcccgagcuguuccaggacgacgagaaggccaucagccccaccagcgccaccagcagcggcagaaccccccugaccagaacccccgccaagcccaccaagggcagacccggccagauggccaaggagcacaagaagaccgugggccaccaguucagaaacagccugcaccugcugauggagacccugaacgccaccaccccccacuacgugagaugcaucaagcccaacgacuucaaguuccccuucaccuucgacgagaagagagccgugcagcagcugagagccugcggcgugcuggagaccaucagaaucagcgccgccggcuuccccagcagauggaccuaccaggaguucuucagcagauacagagugcugaugaagcagaaggacgugcugagcgacagaaagcagaccugcaagaacgugcuggagaagcugauccuggacaaggacaaguaccaguucggcaagaccaagaucuucuucagagccggccagguggccuaccuggagaagcugagagccgacaagcugagagccgccugcaucagaauccagaagaccaucagaggcuggcugcugagaaagaaguaccugagaaugagaaaggccgccaucaccaugcagagauacgugagaggcuaccaggccagaugcuacgccaaguuccugagaagaaccaaggccgccaccaucauccagaaguacuggagaauguacguggugagaagaagauacaagaucagaagagccgccaccaucgugcugcagagcuaccugagaggcuuccuggccagaaacagauacagaaagauccugagagagcacaaggccgugaucauccagaagagagugagaggcuggcuggccagaacccacuacaagagaagcaugcacgccaucaucuaccugcagugcugcuucagaagaaugauggccaagagagagcugaagaagcugaagaucgaggccagaagcguggagagauacaagaagcugcacaucggcauggagaacaagaucaugcagcugcagagaaagguggacgagcagaacaaggacuacaagugccugguggagaagcugaccaaccuggagggcaucuacaacagcgagaccgagaagcugagaagcgaccuggagagacugcagcugagcgaggaggaggccaagguggccaccggcagagugcugagccugcaggaggagaucgccaagcugagaaaggaccuggagcagaccagaagcgagaagaagugcaucgaggagcacgccgacagauacaagcaggagaccgagcagcuggugagcaaccugaaggaggagaacacccugcugaagcaggagaaggaggcccugaaccacagaaucgugcagcaggccaaggagaugaccgagaccauggagaagaagcugguggaggagaccaagcagcuggagcuggaccugaacgacgagagacugagauaccagaaccugcugaacgaguucagcagacuggaggagagauacgacgaccugaaggaggagaugacccugauggugcacgugcccaagcccggccacaagagaaccgacagcacccacagcagcaacgagagcgaguacaucuucagcagcgagaucgccgagauggaggacauccccagcagaaccgaggagcccagcgagaagaaggugccccuggacaugagccuguuccugaagcugcagaagagagugaccgagcuggagcaggagaagcaggugaugcaggacgagcuggacagaaaggaggagcaggugcugagaagcaaggccaaggaggaggagagaccccagaucagaggcgccgagcuggaguacgagagccugaagagacaggagcuggagagcgagaacaagaagcugaagaacgagcugaacgagcugagaaaggcccugagcgagaagagcgcccccgaggugaccgcccccggcgcccccgccuacagagugcugauggagcagcugaccagcgugagcgaggagcuggacgugagaaaggaggaggugcugauccugagaagccagcuggugagccagaaggaggccauccagcccaaggacgacaagaacaccaugaccgacagcaccauccugcuggaggacgugcagaagaugaaggacaagggcgagaucgcccaggccuacaucggccugaaggagaccaacagaagcagcgcccuggacuaccacgagcugaacgaggacggcgagcuguggcugguguacgagggccugaagcaggccaacagacugcuggagagccagcugcagagccagaagagaagccacgagaacgaggccgaggcccugagaggcgagauccagagccugaaggaggagaacaacagacagcagcagcugcuggcccagaaccugcagcugccccccgaggccagaaucgaggccagccugcagcacgagaucaccagacugaccaacgagaaccuggaccugauggagcagcuggagaagcaggacaagaccgugagaaagcugaagaagcagcugaagguguucgccaagaagaucggcgagcuggaggugggccagauggagaacaucagccccggccagaucaucgacgagcccaucagacccgugaacauccccagaaaggagaaggacuuccagggcaugcuggaguacaagaaggaggacgagcagaagcuggugaagaaccugauccuggagcugaagcccagaggcguggccgugaaccugauccccggccugcccgccuacauccuguucaugugcgugagacacgccgacuaccugaacgacgaccagaaggugagaagccugcugaccagcaccaucaacagcaucaagaaggugcugaagaagagaggcgacgacuucgagaccgugagcuucuggcugagcaacaccugcagauuccugcacugccugaagcaguacagcggcgaggagggcuucaugaagcacaacaccagcagacagaacgagcacugccugaccaacuucgaccuggccgaguacagacaggugcugagcgaccuggccauccagaucuaccagcagcuggugagagugcuggagaacauccugcagcccaugaucgugagcggcaugcuggagcacgagaccauccagggcgugagcggcgugaagcccaccggccugagaaagagaaccagcagcaucgccgacgagggcaccuacacccuggacagcauccugagacagcugaacagcuuccacagcgugaugugccagcacggcauggaccccgagcugaucaagcagguggugaagcagauguucuacaucaucggcgccaucacccugaacaaccugcugcugagaaaggacaugugcagcuggagcaagggcaugcagaucagauacaacgugagccagcuggaggaguggcugagagacaagaaccugaugaacagcggcgccaaggagacccuggagccccugauccaggccgcccagcugcugcaggugaagaagaagaccgacgacgacgccgaggccaucugcagcaugugcaacgcccugaccaccgcccagaucgugaaggugcugaaccuguacacccccgugaacgaguucgaggagagagugagcgugagcuucaucagaaccauccagaugagacugagagacagaaaggacagcccccagcugcugauggacgccaagcacaucuuccccgugaccuuccccuucaaccccagcagccuggcccuggagaccauccagauccccgccagccugggccugggcuucaucagcagaguguaa

SEQ ID NO: 20251 - RNA, 5547 nt, Artificial Sequence
  MYO5B__Homo_sapiens__NP_001073936
augagcgugggcgagcuguacagccagugcaccagaguguggauccccgaccccgacgagguguggagaagcgccgagcugaccaaggacuacaaggagggcgacaagagccugcagcugagacuggaggacgagaccauccuggaguaccccaucgacgugcagagaaaccagcugcccuuccugagaaaccccgacauccuggugggcgagaacgaccugaccgcccugagcuaccugcacgagcccgccgugcugcacaaccugaaggugagauuccuggagagcaaccacaucuacaccuacugcggcaucgugcugguggccaucaaccccuacgagcagcugcccaucuacggccaggacgugaucuacaccuacagcggccagaacaugggcgacauggacccccacaucuucgccguggccgaggaggccuacaagcagauggccagagacgagaagaaccagagcaucaucgugagcggcgagagcggcgccggcaagaccgugagcgccaaguacgccaugagauacuucgccaccgugggcggcagcgccagcgagaccaacaucgaggagaaggugcuggccagcagccccaucauggaggccaucggcaacgccaagaccaccagaaacgacaacagcagcagauucggcaaguacauccagaucggcuucgacaagagauaccacaucaucggcgccaacaugagaaccuaccugcuggagaagagcagagugguguuccaggccgacgacgagagaaacuaccacaucuucuaccagcugugcgccgccgccggccugcccgaguucaaggagcuggcccugaccagcgccgaggacuucuucuacaccagccagggcggcgacaccagcaucgagggcguggacgacgccgaggacuucgagaagaccagacaggccuucacccugcugggcgugaaggagagccaccagaugagcaucuucaagaucaucgccagcauccugcaccugggcagcguggccauccaggccgagagagacggcgacagcugcagcaucagcccccaggacguguaccugagcaacuucugcagacugcugggcguggagcacagccagauggagcacuggcugugccacagaaagcuggugaccaccagcgagaccuacgugaagaccaugagccugcagcaggugaucaacgccagaaacgcccuggccaagcacaucuacgcccagcuguucggcuggaucguggagcacaucaacaaggcccugcacaccagccugaagcagcacagcuucaucggcgugcuggacaucuacggcuucgagaccuucgaggugaacagcuucgagcaguucugcaucaacuacgccaacgagaagcugcagcagcaguucaacagccacguguucaagcuggagcaggaggaguacaugaaggagcagauccccuggacccugaucgacuucuacgacaaccagcccugcaucgaccugaucgaggccaagcugggcauccuggaccugcuggacgaggagugcaaggugcccaagggcaccgaccagaacugggcccagaagcuguacgacagacacagcagcagccagcacuuccagaagcccagaaugagcaacaccgccuucaucaucgugcacuucgccgacaagguggaguaccugagcgacggcuuccuggagaagaacagagacaccguguacgaggagcagaucaacauccugaaggccagcaaguucccccugguggccgaccuguuccacgacgacaaggaccccgugcccgccaccacccccggcaagggcagcagcagcaagaucagcgugagaagcgccagaccccccaugaaggugagcaacaaggagcacaagaagaccgugggccaccaguucagaaccagccugcaccugcugauggagacccugaacgccaccaccccccacuacgugagaugcaucaagcccaacgacgagaagcugcccuuccacuucgaccccaagagagccgugcagcagcugagagccugcggcgugcuggagaccaucagaaucagcgccgccggcuaccccagcagaugggccuaccacgacuucuucaacagauacagagugcuggugaagaagagagagcuggccaacaccgacaagaaggccaucugcagaagcgugcuggagaaccugaucaaggaccccgacaaguuccaguucggcagaaccaagaucuucuucagagccggccagguggccuaccuggagaagcugagagccgacaaguucagaaccgccaccaucaugauccagaagaccgugagaggcuggcugcagaaggugaaguaccacagacugaagggcgccacccugacccugcagagauacugcagaggccaccuggccagaagacuggccgagcaccugagaagaaucagagccgccguggugcugcagaagcacuacagaaugcagagagccagacaggccuaccagagagugagaagagccgccguggugauccaggccuucaccagagccauguucgugagaagaaccuacagacaggugcugauggagcacaaggccaccaccauccagaagcacgugagaggcuggauggccagaagacacuuccagagacugagagacgccgccaucgugauccagugcgccuucagaaugcugaaggccagaagagagcugaaggcccugagaaucgaggccagaagcgccgagcaccugaagagacugaacgugggcauggagaacaagguggugcagcugcagagaaagaucgacgagcagaacaaggaguucaagacccugagcgagcagcugagcgugaccaccagcaccuacaccauggagguggagagacugaagaaggagcuggugcacuaccagcagagccccggcgaggacaccagccugagacugcaggaggagguggagagccugagaaccgagcugcagagagcccacagcgagagaaagauccuggaggacgcccacagcagagagaaggacgagcugagaaagagaguggccgaccuggagcaggagaacgcccugcugaaggacgagaaggagcagcugaacaaccagauccugugccagagcaaggacgaguucgcccagaacagcgugaaggagaaccugaugaagaaggagcuggaggaggagagaagcagauaccagaaccuggugaaggaguacagccagcuggagcagagauacgacaaccugagagacgagaugaccaucaucaagcagacccccggccacagaagaaaccccagcaaccagagcagccuggagagcgacagcaacuaccccagcaucagcaccagcgagaucggcgacaccgaggacgcccugcagcagguggaggagaucggccuggagaaggccgccauggacaugaccguguuccugaagcugcagaagagagugagagagcuggagcaggagagaaagaagcugcaggugcagcuggagaagagagagcagcaggacagcaagaaggugcaggccgagcccccccagaccgacaucgaccuggaccccaacgccgaccuggccuacaacagccugaagagacaggagcuggagagcgagaacaagaagcugaagaacgaccugaacgagcugagaaaggccguggccgaccaggccacccagaacaacagcagccacggcagccccgacagcuacagccugcugcugaaccagcugaagcuggcccacgaggagcuggaggugagaaaggaggaggugcugauccugagaacccagaucgugagcgccgaccagagaagacuggccggcagaaacgccgagcccaacaucaacgccagaagcagcuggcccaacagcgagaagcacguggaccaggaggacgccaucgaggccuaccacggcgugugccagaccaacagcaagaccgaggacuggggcuaccugaacgaggacggcgagcugggccuggccuaccagggccugaagcagguggccagacugcuggaggcccagcugcaggcccagagccuggagcacgaggaggagguggagcaccugaaggcccagcuggaggcccugaaggaggagauggacaagcagcagcagaccuucugccagacccugcugcugagccccgaggcccagguggaguucggcgugcagcaggagaucagcagacugaccaacgagaaccuggaccugaaggagcugguggagaagcuggagaagaacgagagaaagcugaagaagcagcugaagaucuacaugaagaaggcccaggaccuggaggccgcccaggcccuggcccagagcgagagaaagagacacgagcugaacagacaggugaccgugcagagaaaggagaaggacuuccagggcaugcuggaguaccacaaggaggacgaggcccugcugaucagaaaccuggugaccgaccugaagccccagaugcugagcggcaccgugcccugccugcccgccuacauccuguacaugugcaucagacacgccgacuacaccaacgacgaccugaaggugcacagccugcugaccagcaccaucaacggcaucaagaaggugcugaagaagcacaacgacgacuucgagaugaccagcuucuggcugagcaacaccugcagacugcugcacugccugaagcaguacagcggcgacgagggcuucaugacccagaacaccgccaagcagaacgagcacugccugaagaacuucgaccugaccgaguacagacaggugcugagcgaccugagcauccagaucuaccagcagcugaucaagaucgccgagggcgugcugcagcccaugaucgugagcgccaugcuggagaacgagagcauccagggccugagcggcgugaagcccaccggcuacagaaagagaagcagcagcauggccgacggcgacaacagcuacugccuggaggccaucaucagacagaugaacgccuuccacaccgugaugugcgaccagggccuggaccccgagaucauccugcagguguucaagcagcuguucuacaugaucaacgccgugacccugaacaaccugcugcugagaaaggacgugugcagcuggagcaccggcaugcagcugagauacaacaucagccagcuggaggaguggcugagaggcagaaaccugcaccagagcggcgccgugcagaccauggagccccugauccaggccgcccagcugcugcagcugaagaagaagacccaggaggacgccgaggccaucugcagccugugcaccagccugagcacccagcagaucgugaagauccugaaccuguacaccccccugaacgaguucgaggagagagugaccguggccuucaucagaaccauccaggcccagcugcaggagagaaacgacccccagcagcugcugcuggacgccaagcacauguuccccgugcuguuccccuucaaccccagcagccugaccauggacagcauccacauccccgccugccugaaccuggaguuccugaacgagguguaa

SEQ ID NO: 20252 - RNA, 5229 nt, Artificial Sequence
  MYO5C__Homo_sapiens__NP_061198
auggccguggccgagcuguacacccaguacaacagaguguggauccccgaccccgaggagguguggaagagcgccgagaucgccaaggacuacagagugggcgacaaggugcugagacugcugcuggaggacggcaccgagcuggacuacagcgugaaccccgagagccugcccccccugagaaaccccgacauccuggugggcgagaacgaccugaccgcccugagcuaccugcacgagcccgccgugcugcacaaccugagaaucagauucgccgagagcaagcugaucuacaccuacagcggcaucauccugguggccaugaaccccuacaagcagcugcccaucuacggcgacgccaucauccacgccuacagcggccagaacaugggcgacauggacccccacaucuucgccguggccgaggaggccuacaagcagauggccagaaacaacagaaaccagagcaucaucgugagcggcgagagcggcgccggcaagaccgugagcgccagauacgccaugagauacuucgccaccgugagcaagagcggcagcaacgcccacguggaggacaaggugcuggccagcaaccccaucaccgaggccgugggcaacgccaagaccaccagaaacgacaacagcagcagauucggcaaguacaccgagaucagcuucgacgagcagaaccagaucaucggcgccaacaugagcaccuaccugcuggagaagagcagagugguguuccagagcgagaacgagagaaacuaccacaucuucuaccagcugugcgccagcgcccagcagagcgaguucaagcaccugaagcugggcagcgccgaggaguucaacuacaccagaaugggcggcaacaccgugaucgagggcgugaacgacagagccgagaugguggagacccagaagaccuucacccugcugggcuucaaggaggacuuccagauggacguguucaagauccuggccgccauccugcaccugggcaacgugcagaucaccgccgugggcaacgagagaagcagcgugagcgaggacgacagccaccugaagguguucugcgagcugcugggccuggagagcggcagaguggcccaguggcugugcaacagaaagaucgugaccagcagcgagaccguggugaagcccaugaccagaccccaggccgugaacgccagagacgcccuggccaagaagaucuacgcccaccuguucgacuucaucguggagagaaucaaccaggcccugcaguucagcggcaagcagcacaccuucaucggcgugcuggacaucuacggcuucgagaccuucgacgugaacagcuucgagcaguucugcaucaacuacgccaacgagaagcugcagcagcaguucaacaugcacguguucaagcuggagcaggaggaguacaugaaggaggacauccccuggacccugaucgacuucuacgacaaccagcccgugaucgaccugaucgaggccaagaugggcauccuggagcugcuggacgaggagugccugcugccccacggcaccgacgagaacuggcugcagaagcuguacaacaacuucgugaacagaaacccccuguucgagaagcccagaaugagcaacaccagcuucgugauccagcacuucgccgacaagguggaguacaagugcgagggcuuccuggagaagaacagagacaccguguacgacaugcugguggagauccugagagccagcaaguuccaccugugcgccaacuucuuccaggagaaccccaccccccccagccccuucggcagcaugaucaccgugaagagcgccaagcaggugaucaagcccaacagcaagcacuucagaaccaccgugggcagcaaguucagaagcagccuguaccugcugauggagacccugaacgccaccaccccccacuacgugagaugcaucaagcccaacgacgagaagcugcccuucgaguucgacagcaagagaaucgugcagcagcugagagccugcggcgugcuggagaccaucagaaucagcgcccagagcuaccccagcagauggaccuacaucgaguucuacagcagauacggcauccugaugaccaagcaggagcugagcuucagcgacaagaaggaggugugcaagguggugcugcacagacugauccaggacagcaaccaguaccaguucggcaagaccaagaucuucuucagagccggccagguggccuaccuggagaagcugagacuggacaagcugagacagagcugcgugauggugcagaagcacaugagaggcuggcugcagagaaagaaguuccugagagagagaagagccgcccugaucauccagcaguacuucagaggccagcagaccgugagaaaggccaucaccgccguggcccugaaggaggccugggccgccaucaucauccagaagcacugcagaggcuaccuggugagaagccuguaccagcugaucagaauggccaccaucaccaugcaggccuacagcagaggcuuccuggccagaagaagauacagaaagaugcuggaggagcacaaggccgugauccugcagaaguacgccagagccuggcuggccagaagaagauuccagagcaucagaagauucgugcugaacauccagcugaccuacagagugcagagacugcagaagaagcuggaggaccagaacaaggagaaccacggccugguggagaagcugaccagccuggccgcccugagagccggcgacguggagaagauccagaagcuggaggccgagcuggagaaggccgccacccacagaagaaacuacgaggagaagggcaagagauacagagacgccguggaggagaagcuggccaagcugcagaagcacaacagcgagcuggagacccagaaggagcagauccagcugaagcugcaggagaagaccgaggagcugaaggagaagauggacaaccugaccaagcagcuguucgacgacgugcagaaggaggagagacagagaaugcugcuggagaagagcuucgagcugaagacccaggacuacgagaagcagauccagagccugaaggaggagaucaaggcccugaaggacgagaagaugcagcugcagcaccugguggagggcgagcacgugaccagcgacggccugaaggccgagguggccagacugagcaagcaggugaagaccaucagcgaguucgagaaggagaucgagcugcugcaggcccagaagaucgacguggagaagcacgugcagagccagaagagagagaugagagagaagaugagcgagaucaccaagcagcugcuggagagcuacgacaucgaggacgugagaagcagacugagcguggaggaccuggagcaccugaacgaggacggcgagcugugguucgccuacgagggccugaagaaggccaccagagugcuggagagccacuuccagagccagaaggacugcuacgagaaggagaucgaggcccugaacuucaagguggugcaccugagccaggagaucaaccaccugcagaagcuguucagagaggagaacgacaucaacgagagcaucagacacgaggugaccagacugaccagcgagaacaugaugauccccgacuucaagcagcagaucagcgagcuggagaagcagaagcaggaccuggagaucagacugaacgagcaggccgagaagaugaagggcaagcuggaggagcugagcaaccagcugcacagaagccaggaggaggagggcacccagagaaaggcccuggaggcccagaacgagauccacaccaaggagaaggagaagcugaucgacaagauccaggagaugcaggaggccagcgaccaccugaagaagcaguucgagaccgagagcgaggugaagugcaacuucagacaggaggccagcagacugacccuggagaacagagaccuggaggaggagcuggacaugaaggacagagugaucaagaagcugcaggaccaggugaagacccugagcaagaccaucggcaaggccaacgacgugcacagcagcagcggccccaaggaguaccugggcaugcugcaguacaagagagaggacgaggccaagcugauccagaaccugauccuggaccugaagcccagaggcgugguggugaacaugauccccggccugcccgcccacauccuguucaugugcgugagauacgccgacagccugaacgacgccaacaugcugaagagccugaugaacagcaccaucaacggcaucaagcagguggugaaggagcaccuggaggacuucgagaugcugagcuucuggcugagcaacaccugccacuuccugaacugccugaagcaguacagcggcgaggaggaguucaugaagcacaacagcccccagcagaacaagaacugccugaacaacuucgaccugagcgaguacagacagauccugagcgacguggccaucagaaucuaccaccaguucaucaucaucauggagaagaacauccagcccaucaucgugcccggcaugcuggaguacgagagccugcagggcaucagcggccugaagcccaccggcuucagaaagagaagcagcagcaucgacgacaccgacggcuacaccaugaccagcgugcugcagcagcugagcuacuucuacaccaccaugugccagaacggccuggaccccgagcuggugagacaggccgugaagcagcuguucuuccugaucggcgccgugacccugaacagccuguuccugagaaaggacaugugcagcugcagaaagggcaugcagaucagaugcaacaucagcuaccuggaggaguggcugaaggacaagaaccugcagaacagccuggccaaggagacccuggagccccugagccaggccgccuggcugcugcaggugaagaagaccaccgacagcgacgccaaggagaucuacgagagaugcaccagccugagcgccgugcagaucaucaagauccugaacagcuacacccccaucgacgacuucgagaagagagugacccccagcuucgugagaaaggugcaggcccugcugaacagcagagaggacagcagccagcugaugcuggacaccaaguaccuguuccaggugaccuuccccuucacccccagcccccacgcccuggagaugauccagauccccagcagcuucaagcugggcuuccugaacagacuguaa

SEQ ID NO: 20253 - RNA, 3789 nt, Artificial Sequence
  MYO6__Homo_sapiens__NP_001287828
auggaggacggcaagcccgugugggccccccaccccaccgacggcuuccagaugggcaacaucguggacaucggccccgacagccugaccaucgagccccugaaccagaagggcaagaccuuccuggcccugaucaaccagguguuccccgccgaggaggacagcaagaaggacguggaggacaacugcagccugauguaccugaacgaggccacccugcugcacaacaucaaggugagauacagcaaggacagaaucuacaccuacguggccaacauccugaucgccgugaaccccuacuucgacauccccaagaucuacagcagcgaggccaucaagagcuaccagggcaagagccugggcaccagacccccccacguguucgccaucgccgacaaggccuucagagacaugaaggugcugaagaugagccagagcaucaucgugagcggcgagagcggcgccggcaagaccgagaacaccaaguucgugcugagauaccugaccgagagcuacggcaccggccaggacaucgacgacagaaucguggaggccaacccccugcuggaggccuucggcaacgccaagaccgugagaaacaacaacagcagcagauucggcaaguucguggagauccacuucaacgagaagagcagcguggugggcggcuucgugagccacuaccugcuggagaagagcagaaucugcgugcagggcaaggaggagagaaacuaccacaucuucuacagacugugcgccggcgccagcgaggacaucagagagaagcugcaccugagcagccccgacaacuucagauaccugaacagaggcugcaccagauacuucgccaacaaggagaccgacaagcagauccugcagaacagaaagagccccgaguaccugaaggccggcagcaugaaggacccccugcuggacgaccacggcgacuucaucagaaugugcaccgccaugaagaagaucggccuggacgacgaggagaagcuggaccuguucagagugguggccggcgugcugcaccugggcaacaucgacuucgaggaggccggcagcaccagcggcggcugcaaccugaagaacaagagcgcccagagccuggaguacugcgccgagcugcugggccuggaccaggacgaccugagagugagccugaccaccagagugaugcugaccaccgccggcggcaccaagggcaccgugaucaaggugccccugaagguggagcaggccaacaacgccagagacgcccuggccaagaccguguacagccaccuguucgaccacguggugaacagagugaaccagugcuuccccuucgagaccagcagcuacuucaucggcgugcuggacaucgccggcuucgaguacuucgagcacaacagcuucgagcaguucugcaucaacuacugcaacgagaagcugcagcaguucuucaacgagagaauccugaaggaggagcaggagcuguaccagaaggagggccugggcgugaacgaggugcacuacguggacaaccaggacugcaucgaccugaucgaggccaagcuggugggcauccuggacauccuggacgaggagaacagacugccccagcccagcgaccagcacuucaccagcgccgugcaccagaagcacaaggaccacuucagacugaccauccccagaaagagcaagcuggccgugcacagaaacaucagagacgacgagggcuucaucaucagacacuucgccggcgccgugugcuacgagaccacccaguucguggagaagaacaacgacgcccugcacaugagccuggagagccugaucugcgagagcagagacaaguucaucagagagcuguucgagagcagcaccaacaacaacaaggacaccaagcagaaggccggcaagcugagcuucaucagcgugggcaacaaguucaagacccagcugaaccugcugcuggacaagcugagaagcaccggcgccagcuucaucagaugcaucaagcccaaccugaagaugaccagccaccacuucgagggcgcccagauccugagccagcugcagugcagcggcauggugagcgugcuggaccugaugcagggcggcuaccccagcagagccagcuuccacgagcuguacaacauguacaagaaguacaugcccgacaagcuggccagacuggaccccagacuguucugcaaggcccuguucaaggcccugggccugaacgagaacgacuacaaguucggccugaccaagguguucuucagacccggcaaguucgccgaguucgaccagaucaugaagagcgaccccgaccaccuggccgagcuggugaagagagugaaccacuggcugaccugcagcagauggaagaaggugcaguggugcagccugagcgugaucaagcugaagaacaagaucaaguacagagccgaggccugcaucaagaugcagaagaccaucagaauguggcugugcaagagaagacacaagcccagaaucgacggccuggugaaggugggcacccugaagaagagacuggacaaguucaacgagguggugagcgugcugaaggacggcaagcccgagaugaacaagcagaucaagaaccuggagaucagcaucgacacccugauggccaagaucaagagcaccaugaugacccaggagcagauccagaaggaguacgacgcccuggugaagagcagcgaggagcugcugagcgcccugcagaagaagaagcagcaggaggaggaggccgagagacugagaagaauccaggaggagauggagaaggagagaaagagaagagaggaggacgagaagagaagaagaaaggaggaggaggagagaagaaugaagcuggagauggaggccaagagaaagcaggaggaggaggagagaaagaagagagaggacgacgagaagagaauccaggccgagguggaggcccagcuggccagacagaaggaggaggagagccagcagcaggccgugcuggagcaggagagaagagacagagagcuggcccugagaaucgcccagagcgaggccgagcugaucagcgacgaggcccaggccgaccuggcccugagaagaggccccgccgugcuggccaccaaggccgccgccggcaccaagaaguacgaccugagcaaguggaaguacgccgagcugagagacaccaucaacaccagcugcgacaucgagcugcuggccgccugcagagaggaguuccacagaagacugaagguguaccacgccuggaagagcaagaacaagaagagaaacaccgagaccgagcagagagcccccaagagcgugaccgacuacgacuucgcccccuuccugaacaacagcccccagcagaaccccgccgcccagauccccgccagacagagagagaucgagaugaacagacagcagagauucuucagaauccccuucaucagacccgccgaccaguacaaggacccccagagcaagaagaagggcuggugguacgcccacuucgacggccccuggaucgccagacagauggagcugcaccccgacaagccccccauccugcugguggccggcaaggacgacauggagaugugcgagcugaaccuggaggagaccggccugaccagaaagagaggcgccgagauccugcccagacaguucgaggagaucugggagagaugcggcggcauccaguaccugcagaacgccaucgagagcagacaggccagacccaccuacgccaccgccaugcugcagagccugcugaaguaa

SEQ ID NO: 20254 - RNA, 6648 nt, Artificial Sequence
  MYO7A__Homo_sapiens__NP_000251
auggugauccugcagcagggcgaccacguguggauggaccugagacugggccaggaguucgacgugcccaucggcgccguggugaagcugugcgacagcggccaggugcaggugguggacgacgaggacaacgagcacuggaucagcccccagaacgccacccacaucaagcccaugcaccccaccagcgugcacggcguggaggacaugaucagacugggcgaccugaacgaggccggcauccugagaaaccugcugaucagauacagagaccaccugaucuacaccuacaccggcagcauccugguggccgugaaccccuaccagcugcugagcaucuacagccccgagcacaucagacaguacaccaacaagaagaucggcgagaugcccccccacaucuucgccaucgccgacaacugcuacuucaacaugaagagaaacagcagagaccagugcugcaucaucagcggcgagagcggcgccggcaagaccgagagcaccaagcugauccugcaguuccuggccgccaucagcggccagcacagcuggaucgagcagcaggugcuggaggccacccccauccuggaggccuucggcaacgccaagaccaucagaaacgacaacagcagcagauucggcaaguacaucgacauccacuucaacaagagaggcgccaucgagggcgccaagaucgagcaguaccugcuggagaagagcagagugugcagacaggcccuggacgagagaaacuaccacguguucuacugcaugcuggagggcaugagcgaggaccagaagaagaagcugggccugggccaggccagcgacuacaacuaccuggccaugggcaacugcaucaccugcgagggcagaguggacagccaggaguacgccaacaucagaagcgccaugaaggugcugauguucaccgacaccgagaacugggagaucagcaagcugcuggccgccauccugcaccugggcaaccugcaguacgaggccagaaccuucgagaaccuggacgccugcgaggugcuguucagccccagccuggccaccgccgccagccugcuggaggugaacccccccgaccugaugagcugccugaccagcagaacccugaucaccagaggcgagaccgugagcaccccccugagcagagagcaggcccuggacgugagagacgccuucgugaagggcaucuacggcagacuguucguguggaucguggacaagaucaacgccgccaucuacaagccccccagccaggacgugaagaacagcagaagaagcaucggccugcuggacaucuucggcuucgagaacuucgccgugaacagcuucgagcagcugugcaucaacuucgccaacgagcaccugcagcaguucuucgugagacacguguucaagcuggagcaggaggaguacgaccuggagagcaucgacuggcugcacaucgaguucaccgacaaccaggacgcccuggacaugaucgccaacaagcccaugaacaucaucagccugaucgacgaggagagcaaguuccccaagggcaccgacaccaccaugcugcacaagcugaacagccagcacaagcugaacgccaacuacaucccccccaagaacaaccacgagacccaguucggcaucaaccacuucgccggcaucguguacuacgagacccagggcuuccuggagaagaacagagacacccugcacggcgacaucauccagcuggugcacagcagcagaaacaaguucaucaagcagaucuuccaggccgacguggccaugggcgccgagaccagaaagagaagccccacccugagcagccaguucaagagaagccuggagcugcugaugagaacccugggcgccugccagcccuucuucgugagaugcaucaagcccaacgaguucaagaagcccaugcuguucgacagacaccugugcgugagacagcugagauacagcggcaugauggagaccaucagaaucagaagagccggcuaccccaucagauacagcuucguggaguucguggagagauacagagugcugcugcccggcgugaagcccgccuacaagcagggcgaccugagaggcaccugccagagaauggccgaggccgugcugggcacccacgacgacuggcagaucggcaagaccaagaucuuccugaaggaccaccacgacaugcugcuggagguggagagagacaaggccaucaccgacagagugauccugcugcagaaggugaucagaggcuucaaggacagaagcaacuuccugaagcugaagaacgccgccacccugauccagagacacuggagaggccacaacugcagaaagaacuacggccugaugagacugggcuuccugagacugcaggcccugcacagaagcagaaagcugcaccagcaguacagacuggccagacagagaaucauccaguuccaggccagaugcagagccuaccuggugagaaaggccuucagacacagacugugggccgugcugaccgugcaggccuacgccagaggcaugaucgccagaagacugcaccagagacugagagccgaguaccuguggagacuggaggccgagaagaugagacuggccgaggaggagaagcugagaaaggagaugagcgccaagaaggccaaggaggaggccgagagaaagcaccaggagagacuggcccagcuggccagagaggacgccgagagagagcugaaggagaaggaggccgccagaagaaagaaggagcugcuggagcagauggagagagccagacacgagcccgugaaccacagcgacaugguggacaagauguucggcuuccugggcaccagcggcggccugcccggccaggagggccaggcccccagcggcuucgaggaccuggagagaggcagaagagagaugguggaggaggaccuggacgccgcccugccccugcccgacgaggacgaggaggaccugagcgaguacaaguucgccaaguucgccgccaccuacuuccagggcaccaccacccacagcuacaccagaagaccccugaagcagccccugcuguaccacgacgacgagggcgaccagcuggccgcccuggccguguggaucaccauccugagauucaugggcgaccugcccgagcccaaguaccacaccgccaugagcgacggcagcgagaagauccccgugaugaccaagaucuacgagacccugggcaagaagaccuacaagagagagcugcaggcccugcagggcgagggcgaggcccagcugcccgagggccagaagaagagcagcgugagacacaagcuggugcaccugacccugaagaagaagagcaagcugaccgaggaggugaccaagagacugcacgacggcgagagcaccgugcagggcaacagcaugcuggaggacagacccaccagcaaccuggagaagcugcacuucaucaucggcaacggcauccugagacccgcccugagagacgagaucuacugccagaucagcaagcagcugacccacaaccccagcaagagcagcuacgccagaggcuggauccuggugagccugugcgugggcugcuucgcccccagcgagaaguucgugaaguaccugagaaacuucauccacggcggcccccccggcuacgcccccuacugcgaggagagacugagaagaaccuucgugaacggcaccagaacccagccccccagcuggcuggagcugcaggccaccaagagcaagaagcccaucaugcugcccgugaccuucauggacggcaccaccaagacccugcugaccgacagcgccaccaccgccaaggagcugugcaacgcccuggccgacaagaucagccugaaggacagauucggcuucagccuguacaucgcccuguucgacaaggugagcagccugggcagcggcagcgaccacgugauggacgccaucagccagugcgagcaguacgccaaggagcagggcgcccaggagagaaacgcccccuggagacuguucuucagaaaggagguguucacccccuggcacagccccagcgaggacaacguggccaccaaccugaucuaccagcagguggugagaggcgugaaguucggcgaguacagaugcgagaaggaggacgaccuggccgagcuggccagccagcaguacuucguggacuacggcagcgagaugauccuggagagacugcugaaccuggugcccaccuacauccccgacagagagaucaccccccugaagacccuggagaagugggcccagcuggccaucgccgcccacaagaagggcaucuacgcccagagaagaaccgacgcccagaaggugaaggaggacguggugagcuacgccagauucaaguggccccugcuguucagcagauucuacgaggccuacaaguucagcggccccagccugcccaagaacgacgugaucguggccgugaacuggaccggcguguacuucguggacgagcaggagcaggugcugcuggagcugagcuuccccgagaucauggccgugagcagcagcagagagugcagaguguggcugagccugggcugcagcgaccugggcugcgccgccccccacagcggcugggccggccugacccccgccggccccugcagccccugcuggagcugcagaggcgccaagaccaccgcccccagcuucacccuggccaccaucaagggcgacgaguacaccuucaccagcagcaacgccgaggacaucagagaccugguggugaccuuccuggagggccugagaaagagaagcaaguacgugguggcccugcaggacaaccccaaccccgccggcgaggagagcggcuuccugagcuucgccaagggcgaccugaucauccuggaccacgacaccggcgagcaggugaugaacagcggcugggccaacggcaucaacgagagaaccaagcagagaggcgacuuccccaccgacagcguguacgugaugcccaccgugaccaugccccccagagagaucguggcccuggugaccaugacccccgaccagagacaggacguggugagacugcugcagcugagaaccgccgagcccgaggugagagccaagcccuacacccuggaggaguucagcuacgacuacuucagacccccccccaagcacacccugagcagagugauggugagcaaggccagaggcaaggacagacuguggagccacaccagagagccccugaagcaggcccugcugaagaagcugcugggcagcgaggagcugagccaggaggccugccuggccuucaucgccgugcugaaguacaugggcgacuaccccagcaagagaaccagaagcgugaacgagcugaccgaccagaucuucgagggcccccugaaggccgagccccugaaggacgaggccuacgugcagauccugaagcagcugaccgacaaccacaucagauacagcgaggagagaggcugggagcugcuguggcugugcaccggccuguucccccccagcaacauccugcugccccacgugcagagauuccugcagagcagaaagcacugcccccuggccaucgacugccugcagagacugcagaaggcccugagaaacggcagcagaaaguaccccccccaccugguggagguggaggccauccagcacaagaccacccagaucuuccacaagguguacuuccccgacgacaccgacgaggccuucgagguggagagcagcaccaaggccaaggacuucugccagaacaucgccaccagacugcugcugaagagcagcgagggcuucagccuguucgugaagaucgccgacaaggugcugagcgugcccgagaacgacuucuucuucgacuucgugagacaccugaccgacuggaucaagaaggccagacccaucaaggacggcaucgugcccagccugaccuaccagguguucuucaugaagaagcuguggaccaccaccgugcccggcaaggaccccauggccgacagcaucuuccacuacuaccaggagcugcccaaguaccugagaggcuaccacaagugcaccagagaggaggugcugcagcugggcgcccugaucuacagagugaaguucgaggaggacaagagcuacuuccccagcauccccaagcugcugagagagcuggugccccaggaccugaucagacaggugagccccgacgacuggaagagaagcaucguggccuacuucaacaagcacgccggcaagagcaaggaggaggccaagcuggccuuccugaagcugaucuucaaguggcccaccuucggcagcgccuucuucgaggugaagcagaccaccgagcccaacuuccccgagauccugcugaucgccaucaacaaguacggcgugagccugaucgaccccaagaccaaggacauccugaccacccaccccuucaccaagaucagcaacuggagcagcggcaacaccuacuuccacaucaccaucggcaaccuggugagaggcagcaagcugcugugcgagaccagccugggcuacaagauggacgaccugcugaccagcuacaucagccagaugcugaccgccaugagcaagcagagaggcagcagaagcggcaaguaa

SEQ ID NO: 20255 - RNA, 6351 nt, Artificial Sequence
  MYO7B__Homo_sapiens__NP_001073996
augagcggcuucagacugggcgaccacguguggcuggagccccccagcacccacaagaccggcguggccaucggcggcaucaucaaggaggccaagcccggcaaggugcugguggaggacgacgagggcaaggagcacuggaucagagccgaggacuucggcgugcugagccccaugcaccccaacagcgugcagggcguggacgacaugaucagacugggcgaccugaacgaggccggcauggugcacaaccugcugaucagauaccagcagcacaagaucuacaccuacaccggcagcauccugguggccgugaaccccuuccaggugcugccccuguacacccuggagcaggugcagcuguacuacagcagacacaugggcgagcugcccccccacguguucgccaucgccaacaacugcuacuucagcaugaagagaaacaagagagaccagugcugcaucaucagcggcgagagcggcgccggcaagaccgagaccaccaagcugauccugcaguuccuggccaccaucagcggccagcacagcuggaucgagcagcaggugcuggaggccaaccccauccuggaggccuucggcaacgccaagaccaucagaaacgacaacagcagcagauucggcaaguacaucgacaucuacuucaaccccagcggcgugaucgagggcgccagaaucgagcaguuccugcuggagaagagcagagugugcagacaggcccccgaggagagaaacuaccacaucuucuacugcaugcugaugggcgugagcgccgaggacaagcagcugcugagccugggcacccccagcgaguaccacuaccugaccaugggcaacugcaccagcugcgagggccugaacgacgccaaggacuacgcccacaucagaagcgccaugaagauccugcaguucagcgacagcgagagcugggacgugaucaagcugcuggccgccauccugcaccugggcaacgugggcuucauggccagcguguucgagaaccuggacgccagcgacgugauggagacccccgccuuccccaccgugaugaagcugcuggaggugcagcaccaggagcugagagacugccugaucaagcacaccauccugaucagaggcgaguucgugaccagaagccugaacaucgcccaggccgccgacagaagagacgccuucgugaagggcaucuacggccaccuguuccuguggaucgugaagaagaucaacgccgccaucuucaccccccccgcccaggaccccaagaacgugagaagagccaucggccugcuggacaucuucggcuucgagaacuucgagaacaacagcuucgagcagcugugcaucaacuucgccaacgagcaccugcagcaguucuucgugcagcacguguucaccauggagcaggaggaguacagaagcgagaacaucagcugggacuacauccacuacaccgacaacagacccacccuggaccugcuggcccugaagcccaugagcaucaucagccugcuggacgaggagagcagauucccccagggcaccgaccugaccaugcugcagaagcugaacagcgugcacgccaacaacaaggccuuccugcagcccaagaacauccacgacgccagauucggcaucgcccacuucgccggcgagguguacuaccaggccgagggcuuccuggagaagaacagagacgugcugagcaccgacauccugacccugguguacagcagcaagaacaaguuccugagagagaucuucaaccuggagcuggccgagaccaagcugggccacggcaccaucagacaggccaaggccggcaaccaccuguucaagagcgccgacagcaacaagagacccagcacccugggcagccaguucaagcagagccuggaccagcugaugaagauccugaccaacugccagcccuacuucaucagaugcaucaagcccaacgaguacaagaagccccugcuguucgacagagagcugugccugagacagcugagauacagcggcaugauggagaccgugcacaucagaaagagcggcuuccccaucagauacaccuucgaggaguucagccagagauucggcgugcugcugcccaacgccaugagaaugcagcugcagggcaagcugagacagaugacccugggcaucaccgacguguggcugagaaccgacaaggacuggaaggccggcaagaccaagaucuuccugagagaccaccaggacacccugcuggaggugcagagaagccaggugcuggacagagccgcccugagcauccagaaggugcugagaggcuacagauacagaaaggaguuccugagacagagaagagccgccgugacccugcaggccugguggagaggcuacugcaacagaagaaacuucaagcugauccuggugggcuucgagagacugcaggccaucgccagaagccagccccuggccagacaguaccaggccaugagacagagaaccgugcagcugcaggcccugugcagaggcuaccuggugagacagcaggugcaggccaagagaagagccgugguggugauccaggcccacgccagaggcauggccgccagaagaaacuuccagcagagaaaggccaacgccccccuggugauccccgccgagggccagaagagccagggcgcccugcccgccaagaagagaagaagcaucuacgacaccgugaccgacaccgagaugguggagaagguguucggcuuccugcccgccaugaucggcggccaggagggccaggccagcccccacuucgaggaccuggagagcaagacccagaagcugcuggagguggaccuggacaccgugcccauggccgaggagcccgaggaggacguggacggccuggccgaguacaccuuccccaaguucgccgugaccuacuuccagaagagcgccagccacacccacaucagaagaccccugagauacccccugcuguaccacgaggacgacaccgacugccuggccgcccuggugaucuggaacgugauccugagauucaugggcgaccugcccgagcccgugcuguacgccagaagcagccagcagggcagcagcgugaugagacagauccacgacacccugggcagagagcacggcgcccaggugccccagcacagcagaagcgcccagguggccagccagcugaacaucggcgaggaggcccuggagcccgacggccugggcgccgacagacccaugagcaaccuggagaaggugcacuucaucgugggcuacgccauccugagacccagccugagagacgagaucuacugccagaucugcaagcagcugagcgagaacuucaagaccagcagccuggccagaggcuggauccugcugagccugugccugggcugcuucccccccagcgagagauucaugaaguaccugcugaacuucaucggccagggccccgccaccuacggccccuucugcgccgagagacugagaagaaccuacgccaacggcgugagagccgagccccccaccuggcuggagcugcaggccgugaagagcaagaagcacauccccauccaggugauccuggccaccggcgagagccugaccgugcccguggacagcgccagcaccagcagagagaugugcaugcacaucgcccacaagcagggccugagcgaccaccugggcuucagccugcagguggccguguacgacaaguucuggagccugggcagcggcagagaccacaugauggacgccaucgccagaugcgagcagauggcccaggagagaggcgagagccagagacagagccccuggagaaucuacuucagaaaggaguucuucacccccuggcacgacagcagagaggaccccgugagcaccgagcugaucuacagacaggugcugagaggcguguggagcggcgaguacagcuucgagaaggaggaggagcugguggagcugcuggccagacacugcuacgugcagcugggcgccagcgccgagagcaaggccgugcaggagcugcugcccagcugcaucccccacaagcuguacagaaccaagccccccgacagaugggccagccuggugaccgccgccugcgccaaggcccccuacacccagaagcaggugaccccccuggccgugagagagcaggugguggacgccgccagacugcaguggccccugcuguucagcagacuguucgaggugaucacccugagcggccccagacugcccaagacccagcugauccuggccgugaacuggaagggccugugcuuccuggaccagcaggagaagaugcugcuggagcugagcuuccccgaggugaugggccuggccaccaacagagaggcccagggcggccagagacugcugcugagcaccaugcacgaggaguacgaguucgugagccccagcagcguggccaucgccgagcugguggcccuguuccuggagggccugaaggagagaagcaucuucgccauggcccugcaggacagaaaggccaccgacgacaccacccugcuggccuucaagaagggcgaccugcuggugcugaccaagaagcagggccugcuggccagcgagaacuggacccugggccagaacgacagaaccggcaagaccggccuggugcccauggccugccuguacaccauccccaccgugaccaagcccagcgcccagcugcugagccugcuggccaugagccccgagaagagaaagcuggccgcccaggagggccaguucaccgagcccagacccgaggagccccccaaggagaagcugcacacccuggaggaguucagcuacgaguucuucagagcccccgagaaggacauggugagcauggccgugcugccccuggccagagccagaggccaccugugggccuacagcugcgagccccugagacagccccugcugaagagagugcacgccaacguggaccugugggacaucgccugccagaucuucguggccauccugagauacaugggcgacuaccccagcagacaggccuggcccacccuggagcugaccgaccagaucuucacccuggcccugcagcaccccgcccugcaggacgagguguacugccagauccugaagcagcugacccacaacagcaacagacacagcgaggagagaggcuggcagcugcuguggcugugcaccggccuguucccccccagcaagggccugcugccccacgcccagaaguucaucgacaccagaagaggcaagcugcuggcccccgacugcagcagaagaauccagaaggugcugagaaccggccccagaaagcagcccccccaccagguggagguggaggccgccgagcagaacgugagcagaaucugccacaagaucuacuuccccaacgacaccagcgagaugcuggaggugguggccaacaccagagugagagacgugugcgacagcaucgccaccagacugcagcuggccagcugggagggcugcagccuguucaucaagaucagcgacaaggugaucagccagaaggagggcgacuucuucuucgacagccugagagaggugagcgacugggugaagaagaacaagccccagaaggagggcgcccccgugacccugcccuaccagguguacuucaugagaaagcuguggcugaacaucagccccggcaaggacgugaacgccgacaccauccugcacuaccaccaggagcugcccaaguaccugagaggcuuccacaagugcagcagagaggacgccauccaccuggccggccugaucuacaaggcccaguucaacaacgacagaagccagcuggccagcgugcccaagauccugagagagcuggugcccgagaaccugaccagacugaugagcagcgaggaguggaagaagagcauccugcuggccuacgacaagcacaaggacaagaccguggaggaggccaagguggccuuccugaaguggaucugcagauggcccaccuucggcagcgccuucuucgaggugaagcagaccagcgagcccagcuaccccgacgugauccugaucgccaucaacagacacggcgugcugcugauccaccccaagaccaaggaccugcugaccaccuaccccuucaccaagaucagcagcuggagcagcggcagcaccuacuuccacauggcccugggcagccugggcagaggcagcagacugcugugcgagaccagccugggcuacaagauggacgaccugcugaccagcuacgugcagcagcugcugagcgccaugaacaagcagagaggcagcaaggcccccgcccuggccagcaccuaa

SEQ ID NO: 20256 - RNA, 7647 nt, Artificial Sequence
  MYO9A__Homo_sapiens__NP_008832
augaacaucaacgacggcggcagaagaagauucgaggacaacgagcacacccugagaaucuaccccggcgccaucagcgagggcaccaucuacugccccauccccgccagaaagaacagcaccgccgccgaggugaucgagagccugaucaacaagcugcaccuggacaagaccaagugcuacgugcuggccgaggugaaggaguucggcggcgaggaguggauccugaaccccaccgacugccccgugcagagaaugaugcuguggcccagaauggcccuggagaacagacugagcggcgaggacuacagauuccugcugagagagaagaaccuggacggcagcauccacuacggcagccugcagagcuggcugagagugaccgaggagagaagaagaaugauggagagaggcuuccugccccagccccagcagaaggacuucgacgaccugugcagccugcccgaccugaacgagaagacccugcuggagaaccugagaaacagauucaagcacgagaagaucuacaccuacgugggcagcauccugaucgugaucaaccccuucaaguuccugcccaucuacaaccccaaguacgugaagauguacgacaaccaccagcugggcaagcuggagccccacaucuacgccguggccgacguggccuaccacgccaugcugcagagaaagaagaaccagugcaucgugaucagcggcgagagcggcagcggcaagacccagagcaccaacuuccugauccaccaccugaccgcccugagccagaagggcuucgccagcggcguggagcagaucauccugggcgccggccccgugcuggaggccuucggcaacgccaagaccgcccacaacaacaacagcagcagauucggcaaguucauccaggugaacuaccaggagaccggcaccgugcugggcgccuacguggagaaguaccugcuggagaagagcagacugguguaccaggagcacaacgagagaaacuaccacguguucuacuaccugcuggccggcgccagcgaggacgagagaagcgccuuccaccugaagcagcccgaggaguaccacuaccugaaccagaucaccaagaagccccugagacagagcugggacgacuacugcuacgacagcgagcccgacugcuucaccguggagggcgaggaccugagacacgacuucgagagacugcagcuggccauggagauggugggcuuccugcccaagaccagaagacagaucuucagccugcugagcgccauccugcaccugggcaacaucugcuacaagaagaagaccuacagagacgacagcaucgacaucugcaaccccgaggugcugcccaucgugagcgagcugcuggaggugaaggaggagaugcuguucgaggcccuggugaccagaaagaccgugaccgugggcgagaagcugauccugcccuacaagcuggccgaggccgugaccgugagaaacagcauggccaagagccuguacagcgcccuguucgacuggaucguguucagaaucaaccacgcccugcugaacagcaaggaccuggagcacaacaccaagacccugagcaucggcgugcuggacaucuucggcuucgaggacuacgagaacaacagcuucgagcaguucugcaucaacuucgccaacgagagacugcagcacuacuucaaccagcacaucuucaagcuggagcaggaggaguacagaaccgagggcaucagcuggcacaacaucgacuacaucgacaacaccugcugcaucaaccugaucagcaagaagcccaccggccugcugcaccugcuggacgaggagagcaacuucccccaggccaccaaccagacccugcuggacaaguucaagcaccagcacgaggacaacagcuacaucgaguuccccgccgugauggagcccgccuucaucaucaagcacuacgccggcaaggugaaguacggcgugaaggacuucagagagaagaacaccgaccacaugagacccgacaucguggcccugcugagaagcagcaagaacgccuucaucagcggcaugaucggcaucgaccccguggccguguucagaugggccauccugagagccuucuucagagccaugguggccuucagagaggccggcaagagaaacauccacagaaagaccggccacgacgacaccgcccccugcgccauccugaagagcauggacagcuucagcuuccugcagcaccccgugcaccagagaagccuggagauccugcagagaugcaaggaggagaaguacagcaucaccagaaagaaccccagaaccccccugagcgaccugcagggcaugaacgcccugaacgagaagaaccagcacgacaccuucgacaucgccuggaacggcagaaccggcaucagacagagcagacugagcagcggcaccagccugcuggacaaggacggcaucuucgccaacagcaccagcagcaagcugcuggagagagcccacggcauccugaccagaaacaagaacuucaagagcaagcccgcccugcccaagcaccugcuggaggugaacagccugaagcaccugaccagacugacccugcaggacagaaucaccaagagccugcugcaccugcacaagaagaagaagccccccagcaucagcgcccaguuccaggccagccugagcaagcugauggagacccugggccaggccgagcccuacuucgugaagugcaucagaagcaacgccgagaagcugccccugagauucagcgacgugcuggugcugagacagcugagauacaccggcaugcuggagaccgugagaaucagacagagcggcuacagcagcaaguacagcuuccaggacuucgugagccacuuccacgugcugcugcccagaaacaucauccccagcaaguucaacauccaggacuucuucagaaagaucaaccugaaccccgacaacuaccaggugggcaagaccaugguguuccugaaggagcaggagagacagcaccugcaggaccugcugcaccaggaggugcugagaagaaucauccugcugcagagaugguucagagugcugcugugcagacagcacuuccugcaccugagacaggccagcgugaucauccagagauucuggagaaacuaccugaaccagaagcaggugagagacgccgccgugcagaaggacgccuucgugauggccagcgccgccgcccugcugcaggccagcuggagagcccaccuggagagacagagauaccuggagcugagagccgccgccaucgugauccagcagaaguggagagacuacuacagaagaagacacauggccgccaucugcauccaggccagauggaaggccuacagagagagcaagagauaccaggagcagagaaagaagaucauccugcugcagagcaccugcagaggcuucagagccagacagagauucaaggcccugaaggagcagagacugagagagaccaagcccgaggugggccuggugaacaucaagggcuacggcagccuggagauccagggcagcgaccccagcggcugggaggacugcagcuucgacaacagaaucaaggccaucgaggagugcaagagcgugaucgagagcaacagaaucagcagagagagcagcguggacugccugaaggagagccccaacaagcagcaggagagagcccagagccagagcggcguggaccugcaggaggacgugcuggugagagagagacccagaagccuggaggaccugcaccagaagaaggugggcagagccaagagagagagcagaagaaugagagagcuggagcaggccaucuucagccuggagcugcugaaggugagaagccugggcggcaucagccccagcgaggacagaagauggagcaccgagcuggugcccgagggccugcagagccccagaggcacccccgacagcgagagcagccagggcagccuggagcugcugagcuacgaggagagccagaagagcaagcuggagagcgugaucagcgacgagggcgaccugcaguuccccagccccaagaucagcagcagccccaaguucgacagcagagacaacgcccugagcgccagcaacgagaccagcagcgccgagcaccugaaggacggcaccaugaaggagaugguggugugcagcagcgagagcaucaccugcaagccccagcugaaggacagcuucaucagcaacagccugcccaccuucuucuacaucccccagcaggacccccugaagaccaacagccagcuggacaccagcauccagagaaacaagcugcuggagaacgaggacaccgccggcgaggcccugacccuggacaucaacagagagaccagaagauaccacugcagcggcaaggaccagaucgugcccagccugaacaccgagagcagcaaccccgugcugaagaagcuggagaagcugaacaccgagaaggaggagagacagaagcagcugcagcagcagaacgagaaggagaugauggagcagaucagacagcagaccgacauccuggagaaggagagaaaggccuucaagaccaucgagaagcccagaaucggcgagugccugguggcccccagcagcuaccagagcaagcagagaguggagagacccagcagccugcugagccugaacaccagcaacaagggcgagcugaacgugcugggcagccugagccugaaggacgccgcccuggcccagaaggacagcagcagcgcccaccugccccccaaggacagacccgugaccguguucuucgagagaaagggcagccccugccagagcagcaccgugaaggagcugagcaagaccgacagaaugggcacccagcugaacguggccugcaagcugagcaacaacagaaucagcaagagagagcacuucagacccacccagagcuacagccacaacagcgacgaccugagcagagagggcaacgccagacccaucuucuucacccccaaggacaacaugagcaucccccuggugagcaaggaggcccugaacagcaagaacccccagcugcacaaggaggacgagcccgccuggaagcccgugaagcuggccggccccggccagagagagaccagccagagauucagcagcguggacgagcaggccaagcugcacaagaccaugagccagggcgagaucaccaagcuggccgugagacagaaggccagcgacagcgacaucagaccccagagagccaagaugagauucugggccaagggcaagcagggcgagaagaagaccaccagagugaagcccaccacccagagcgaggugagcccccuguucgccggcaccgacgugauccccgcccaccaguuccccgacgagcuggccgccuaccaccccacccccccccugagccccgagcugcccggcagcugcagaaaggaguucaaggagaacaaggagcccagccccaaggccaagagaaagagaagcgugaagaucagcaacguggcccuggacagcaugcacuggcagaacgacagcgugcagaucaucgccagcgugagcgaccugaagagcauggacgaguuccugcugaagaaggugaacgaccuggacaacgaggacagcaagaaggacacccugguggacgugguguucaagaaggcccugaaggaguucagacagaacaucuucagcuucuacagcagcgcccuggccauggacgacggcaagagcaucagauacaaggaccuguacgcccuguucgagcagauccuggagaagaccaugagacuggagcagagagacagccugggcgagagccccgugagagugugggugaacaccuucaagguguuccuggacgaguacaugaacgaguucaagaccagcgacugcaccgccaccaaggugcccaagaccgagagaaagaagagaagaaagaaggagaccgaccugguggaggagcacaacggccacaucuucaaggccacccaguacagcauccccaccuacugcgaguacugcagcagccugaucuggaucauggacagagccagcgugugcaagcugugcaaguacgccugccacaagaagugcugccugaagaccaccgccaagugcagcaagaaguacgaccccgagcugagcagcagacaguucggcguggagcugagcagacugaccagcgaggacagaaccgugccccuggugguggagaagcugaucaacuacaucgagaugcacggccuguacaccgagggcaucuacagaaagagcggcagcaccaacaagaucaaggagcugagacagggccuggacaccgacgccgagagcgugaaccuggacgacuacaacauccacgugaucgccagcguguucaagcaguggcugagagaccugcccaacccccugaugaccuucgagcuguacgaggaguuccugagagccaugggccugcaggagagaaaggagaccaucagaggcguguacagcgugaucgaccagcugagcagaacccaccugaacacccuggagagacugaucuuccaccuggugagaaucgcccugcaggaggacaccaacagaaugagcgccaacgcccuggccaucguguucgcccccugcauccugagaugccccgacaccaccgacccccugcagagcgugcaggacaucagcaagaccaccaccugcguggagcugaucgugguggagcagaugaacaaguacaaggccagacugaaggacaucagcagccuggaguucgccgagaacaaggccaagaccagacugagccugaucagaagaagcaugggcaagggcagaaucagaagaggcaacuaccccggccccagcagccccgugguggugagacugcccagcgugagcgacgugagcgaggagacccugaccagcgaggccgccauggagaccgacaucaccgagcagcagcaggccgccaugcagcaggaggagagagugcugaccgagcagaucgagaaccugcagaaggagaaggaggagcugaccuucgagaugcuggugcuggagcccagagccagcgacgacgagacccuggagagcgaggccagcaucggcaccgccgacagcagcgagaaccugaacauggagagcgaguacgccaucagcgagaagagcgagagaagccuggcccugagcagccugaagaccgccggcaagagcgagcccagcagcaagcugagaaagcagcugaagaagcagcaggacagccuggacgugguggacagcagcgugagcagccugugccugagcaacaccgccagcagccacggcaccagaaagcuguuccagaucuacagcaagagccccuucuacagagccgccagcggcaacgaggcccugggcauggagggcccccugggccagaccaaguuccuggaggacaagccccaguucaucagcagaggcaccuucaaccccgagaagggcaagcagaagcugaagaacgugaagaacagcccccagaagaccaaggagacccccgagggcaccgugaugagcggcagaagaaagaccguggaccccgacugcaccagcaaccagcagcuggcccuguucggcaacaacgaguucaugguguaa

SEQ ID NO: 20257 - RNA, 6069 nt, Artificial Sequence
  MYO9B__Homo_sapiens__NP_001123537
augagcgugaaggaggccggcagcagcggcagaagagagcaggccgccuaccaccugcacaucuacccccagcugagcaccaccgagagccaggccagcugcagagugaccgccaccaaggacagcaccaccagcgacgugaucaaggacgccaucgccagccugagacuggacggcaccaagugcuacgugcugguggaggugaaggagagcggcggcgaggagugggugcuggacgccaacgacagccccgugcacagagugcugcuguggcccagaagagcccaggacgagcacccccaggaggacggcuacuacuuccugcugcaggagagaaacgccgacggcaccaucaaguacgugcacaugcagcugguggcccaggccaccgccaccagaagacugguggagagaggccugcugcccagacagcaggccgacuucgacgaccugugcaaccugcccgagcugaccgagggcaaccugcugaagaaccugaagcacagauuccugcagcagaagaucuacaccuacgccggcagcauccugguggccaucaaccccuucaaguuccugcccaucuacaaccccaaguacgugaagauguacgagaaccagcagcugggcaagcuggagccccacguguucgcccuggccgacguggccuacuacaccaugcugagaaagagagugaaccagugcaucgugaucagcggcgagagcggcagcggcaagacccagagcaccaacuuccugauccacugccugaccgcccugagccagaagggcuacgccagcggcguggagagaaccauccugggcgccggccccgugcuggaggccuucggcaacgccaagaccgcccacaacaacaacagcagcagauucggcaaguucauccaggugagcuaccuggagagcggcaucgugagaggcgccgugguggagaaguaccugcuggagaagagcagacuggugagccaggagaaggacgagagaaacuaccacguguucuacuaccugcugcugggcgugagcgaggaggagagacaggaguuccagcugaagcagcccgaggacuacuucuaccugaaccagcacaaccugaagaucgaggacggcgaggaccugaagcacgacuucgagagacugaagcaggccauggagauggugggcuuccugcccgccaccaagaagcagaucuucgccgugcugagcgccauccuguaccugggcaacgugaccuacaagaagagagccaccggcagagaggagggccuggaggugggcccccccgaggugcuggacacccugagccagcugcugaaggugaagagagagauccugguggaggugcugaccaagagaaagaccgugaccgugaacgacaagcugauccugcccuacagccugagcgaggccaucaccgccagagacagcauggccaagagccuguacagcgcccuguucgacuggaucgugcugagaaucaaccacgcccugcugaacaagaaggacguggaggaggccgugagcugccugagcaucggcgugcuggacaucuucggcuucgaggacuucgagagaaacagcuucgagcaguucugcaucaacuacgccaacgagcagcugcaguacuacuucaaccagcacaucuucaagcuggagcaggaggaguaccagggcgagggcaucaccuggcacaacaucggcuacaccgacaacgugggcugcauccaccugaucagcaagaagcccaccggccuguucuaccugcuggacgaggagagcaacuucccccacgccaccagccagacccugcuggccaaguucaagcagcagcacgaggacaacaaguacuuccugggcacccccgugauggagcccgccuucaucauccagcacuucgccggcaaggugaaguaccagaucaaggacuucagagagaagaacauggacuacaugagacccgacaucguggcccugcugagaggcagcgacagcagcuacgugagagagcugaucggcauggaccccguggccguguucagaugggccgugcugagagccgccaucagagccauggccgugcugagagaggccggcagacugagagccgagagagccgagaaggccgccggcaugagcagccccggcgcccagagccaccccgaggagcugcccagaggcgccagcacccccagcgagaagcuguacagagaccugcacaaccagaugaucaagagcaucaagggccugcccuggcagggcgaggaccccagaagccugcugcagagccugagcagacugcagaagcccagagccuucauccugaagagcaagggcaucaagcagaagcagaucauccccaagaaccugcuggacagcaagagccugaagcugaucaucagcaugacccugcacgacagaaccaccaagagccugcugcaccugcacaagaagaagaagccccccagcaucagcgcccaguuccagaccagccugaacaagcugcuggaggcccugggcaaggccgagcccuucuucaucagaugcaucagaagcaacgccgagaagaaggagcugugcuucgacgacgagcuggugcugcagcagcugagauacaccggcaugcuggagaccgugagaaucagaagaagcggcuacagcgccaaguacaccuuccaggacuucaccgagcaguuccaggugcugcugcccaaggacgcccagcccugcagagaggugaucagcacccugcuggagaagaugaagaucgacaagagaaacuaccagaucggcaagaccaagguguuccugaaggagaccgagagacaggcccugcaggagacccugcacagagagguggugagaaagauccugcugcugcagagcugguucagaauggugcuggagagaagacacuuccugcagaugaagagagccgccgugaccauccaggccugcuggagaagcuacagagugagaagagcccuggagagaacccaggccgccguguaccugcaggccagcuggagaggcuacuggcagagaaagcuguacagacaccagaagcagagcaucaucagacugcagagccugugcagaggccaccugcagagaaagagcuucagccagaugaucagcgagaagcagaaggccgaggagaaggagagagaggcccuggaggccgccagagccggcgccgaggagggcggccagggccaggccgccggcggccagcagguggccgagcagggccccgagcccgccgaggacggcggccaccuggccagcgagcccgaggugcagcccagcgacagaagcccccuggagcacagcagccccgagaaggaggcccccagccccgagaagacccugcccccccagaagaccguggccgccgagagccacgagaaggugcccagcagcagagagaagagagagagcagaagacagagaggccuggagcacgugaaguuccagaacaagcacauccagagcugcaaggaggagagcgcccugagagagcccagcagaagagugacccaggagcagggcgugagccugcuggaggacaagaaggagagcagagaggacgagacccugcuggugguggagaccgaggccgagaacaccagccagaagcagcccaccgagcagccccaggccauggccgugggcaaggugagcgaggagaccgagaagacccugcccagcggcagccccagacccggccagcuggagagacccaccagccuggcccuggacagcagagugagcccccccgcccccggcagcgcccccgagacccccgaggacaagagcaagcccugcggcagccccagagugcaggagaagcccgacagccccggcggcagcacccagauccagagauaccuggacgccgagagacuggccagcgccguggagcuguggagaggcaagaagcugguggccgccgccagccccagcgccaugcugagccagagccuggaccugagcgacagacacagagccaccggcgccgcccugacccccaccgaggagagaagaaccagcuucagcaccagcgacgugagcaagcugcugcccagccuggccaaggcccagcccgccgccgagaccaccgacggcgagagaagcgccaagaagcccgccgugcagaagaagaagcccggcgacgccagcagccugcccgacgccggccugagccccggcagccagguggacagcaagagcaccuucaagagacuguuccugcacaagaccaaggacaagaaguacagccuggagggcgccgaggagcuggagaacgccgugagcggccacguggugcuggaggccaccaccaugaagaagggccuggaggcccccagcggccagcagcacagacacgccgccggcgagaagagaaccaaggagcccggcggcaagggcaagaagaacagaaacgugaagaucggcaagaucaccgugagcgagaaguggagagagagcguguucagacagaucaccaacgccaacgagcugaaguaccuggacgaguuccugcugaacaagaucaacgaccugagaagccagaagacccccaucgagagccuguucaucgaggccaccgagaaguucagaagcaacaucaagaccauguacagcgugcccaacggcaagauccacgugggcuacaaggaccugauggagaacuaccagaucguggugagcaaccuggccaccgagagaggccagaaggacaccaaccuggugcugaaccuguuccagagccugcuggacgaguucaccagaggcuacaccaagaacgacuucgagcccgugaagcagagcaaggcccagaagaagaagagaaagcaggagagagccgugcaggagcacaacggccacguguucgccagcuaccaggugagcaucccccagagcugcgagcagugccugagcuacaucuggcugauggacaaggcccugcugugcagcgugugcaagaugaccugccacaagaagugcgugcacaagauccagagccacugcagcuacaccuacggcagaaagggcgagcccggcguggagcccggccacuucggcgugugcguggacagccugaccagcgacaaggccagcgugcccaucgugcuggagaagcugcuggagcacguggagaugcacggccuguacaccgagggccuguacagaaagagcggcgccgccaacagaaccagagagcugagacaggcccugcagaccgaccccgccgccgugaagcuggagaacuuccccauccacgccaucaccggcgugcugaagcaguggcugagagagcugcccgagccccugaugaccuucgcccaguacggcgacuuccugagagccguggagcugcccgagaagcaggagcagcuggccgccaucuacgccgugcuggagcaccugcccgaggccaaccacaacagccuggagagacugaucuuccaccuggugaagguggcccugcuggaggacgugaacagaaugagccccggcgcccuggccaucaucuucgcccccugccugcugagaugccccgacaacagcgacccccugaccagcaugaaggacgugcugaagaucaccaccugcguggagaugcugaucaaggagcagaugagaaaguacaaggugaagauggaggagaucagccagcuggaggccgccgagagcaucgccuucagaagacugagccugcugagacagaacgcccccuggccccugaagcugggcuucagcagccccuacgagggcgugcugaacaagagccccaagaccagagacauccaggaggaggagcuggaggugcugcuggaggaggaggccgccggcggcgacgaggacagagagaaggagauccugaucgagagaauccagagcaucaaggaggagaaggaggacaucaccuacagacugcccgagcuggaccccagaggcagcgacgaggagaaccuggacagcgagaccagcgccagcaccgagagccugcuggaggagagagccggcagaggcgccagcgagggccaguacuaa

SEQ ID NO: 20258 - RNA, 2961 nt, Artificial Sequence
  MYOCD__Homo_sapiens__NP_001139784
augacccugcugggcagcgagcacagccugcugaucagaagcaaguucagaagcgugcugcagcugagacugcagcagagaagaacccaggagcagcuggccaaccagggcaucauccccccccugaagagacccgccgaguuccacgagcagagaaagcaccuggacagcgacaaggccaagaacagccugaagagaaaggccagaaacagaugcaacagcgccgaccuggugaacaugcacauccugcaggccagcaccgccgagagaagcauccccaccgcccagaugaagcugaagagagccagacuggccgacgaccugaacgagaagaucgcccugagacccggcccccuggagcugguggagaagaacauccugcccguggacagcgccgugaaggaggccaucaagggcaaccaggugagcuucagcaagagcaccgacgccuucgccuucgaggaggacagcagcagcgacggccugagccccgaccagaccagaagcgaggacccccagaacagcgccggcagcccccccgacgccaaggccagcgacacccccagcaccggcagccugggcaccaaccaggaccuggccagcggcagcgagaacgacagaaacgacagcgccagccagcccagccaccagagcgacgccggcaagcagggccugggcccccccagcacccccaucgccgugcacgccgccgugaagagcaagagccugggcgacagcaagaacagacacaagaagcccaaggaccccaagcccaaggugaagaagcugaaguaccaccaguacaucccccccgaccagaaggccgagaagagccccccccccauggacagcgccuacgccagacugcugcagcagcagcagcuguuccugcagcugcagauccugagccagcagcagcagcagcagcagcacagauucagcuaccugggcaugcaccaggcccagcugaaggagcccaacgagcagauggugagaaaccccaacagcagcagcaccccccugagcaacaccccccugagccccgugaagaacagcuucagcggccagaccggcgugagcagcuucaagcccggcccccugccccccaaccuggacgaccugaaggugagcgagcugagacagcagcugagaaucagaggccugcccgugagcggcaccaagaccgcccugauggacagacugagacccuuccaggacugcagcggcaaccccgugcccaacuucggcgacaucaccaccgugaccuuccccgugacccccaacacccugcccaacuaccagagcagcagcagcaccagcgcccugagcaacggcuucuaccacuucggcagcaccagcagcagcccccccaucagccccgccagcagcgaccugagcguggccggcagccugcccgacaccuucaacgacgccagccccagcuucggccugcaccccagccccgugcacgugugcaccgaggagagccugaugagcagccugaacggcggcagcgugcccagcgagcuggacggccuggacagcgagaaggacaagaugcugguggagaagcagaaggugaucaacgagcugaccuggaagcugcagcaggagcagagacagguggaggagcugagaaugcagcugcagaagcagaagagaaacaacugcagcgagaagaagccccugcccuuccuggccgccagcaucaagcaggaggaggccgugagcagcugccccuucgccagccaggugcccgugaagagacagagcagcagcagcgagugccacccccccgccugcgaggccgcccagcugcagccccugggcaacgcccacugcguggagagcagcgaccagaccaacgugcugagcagcaccuuccugagcccccagugcagcccccagcacagcccccugggcgccgugaagagcccccagcacaucagccugccccccagccccaacaacccccacuuccugcccagcagcagcggcgcccagggcgagggccacagagugagcagccccaucagcagccaggugugcaccgcccagaacagcggcgcccacgacggccacccccccagcuucagcccccacagcagcagccugcacccccccuucagcggcgcccaggccgacagcagccacggcgccggcggcaaccccugccccaagagccccugcgugcagcagaagauggccggccugcacagcagcgacaaggugggccccaaguucagcauccccagccccaccuucagcaagagcagcagcgccaucagcgaggugacccagccccccagcuacgaggacgccgugaagcagcagaugaccagaagccagcagauggacgagcugcuggacgugcugaucgagagcggcgagaugcccgccgacgccagagaggaccacagcugccugcagaaggugcccaagauccccagaagcagcagaagccccaccgccgugcugaccaagcccagcgccagcuucgagcaggccagcagcggcagccagauccccuucgaccccuacgccaccgacagcgacgagcaccuggaggugcugcugaacagccagagcccccugggcaagaugagcgacgugacccugcugaagaucggcagcgaggagccccacuucgacggcaucauggacggcuucagcggcaaggccgccgaggaccuguucaacgcccacgagauccugcccggcccccugagccccaugcagacccaguucagccccagcagcguggacagcaacggccugcagcugagcuucaccgagagccccugggagaccauggaguggcuggaccugaccccccccaacagcacccccggcuucagcgcccugaccaccagcagccccagcaucuucaacaucgacuuccuggacgugaccgaccugaaccugaacagcagcauggaccugcaccugcagcagugguaa

SEQ ID NO: 20259 - RNA, 1515 nt, Artificial Sequence
  MYOC__Homo_sapiens__NP_000252
augagauucuucugcgccagaugcugcagcuucggccccgagaugcccgccgugcagcugcugcugcuggccugccuggugugggacgugggcgccagaaccgcccagcugagaaaggccaacgaccagagcggcagaugccaguacaccuucagcguggccagccccaacgagagcagcugccccgagcagagccaggccaugagcgugauccacaaccugcagagagacagcagcacccagagacuggaccuggaggccaccaaggccagacugagcagccuggagagccugcugcaccagcugacccuggaccaggccgccagaccccaggagacccaggagggccugcagagagagcugggcacccugagaagagagagagaccagcuggagacccagaccagagagcuggagaccgccuacagcaaccugcugagagacaagagcgugcuggaggaggagaagaagagacugagacaggagaacgagaaccuggccagaagacuggagagcagcagccaggagguggccagacugagaagaggccagugcccccagaccagagacaccgccagagccgugccccccggcagcagagaggugagcaccuggaaccuggacacccuggccuuccaggagcugaagagcgagcugaccgaggugcccgccagcagaauccugaaggagagccccagcggcuaccugagaagcggcgagggcgacaccggcugcggcgagcuggugugggugggcgagccccugacccugagaaccgccgagaccaucaccggcaaguacggcguguggaugagagaccccaagcccaccuaccccuacacccaggagaccaccuggagaaucgacaccgugggcaccgacgugagacagguguucgaguacgaccugaucagccaguucaugcagggcuaccccagcaaggugcacauccugcccagaccccuggagagcaccggcgccgugguguacagcggcagccuguacuuccagggcgccgagagcagaaccgugaucagauacgagcugaacaccgagaccgugaaggccgagaaggagauccccggcgccggcuaccacggccaguuccccuacagcuggggcggcuacaccgacaucgaccuggccguggacgaggccggccugugggugaucuacagcaccgacgaggccaagggcgccaucgugcugagcaagcugaaccccgagaaccuggagcuggagcagaccugggagaccaacaucagaaagcagagcguggccaacgccuucaucaucugcggcacccuguacaccgugagcagcuacaccagcgccgacgccaccgugaacuucgccuacgacaccggcaccggcaucagcaagacccugaccauccccuucaagaacagauacaaguacagcagcaugaucgacuacaacccccuggagaagaagcuguucgccugggacaaccugaacauggugaccuacgacaucaagcugagcaagauguaa

SEQ ID NO: 20260 - RNA, 963 nt, Artificial Sequence
  MYOD1__Homo_sapiens__NP_002469
auggagcugcugagccccccccugagagacguggaccugaccgcccccgacggcagccugugcagcuucgccaccaccgacgacuucuacgacgaccccugcuucgacagccccgaccugagauucuucgaggaccuggaccccagacugaugcacgugggcgcccugcugaagcccgaggagcacagccacuuccccgccgccgugcaccccgcccccggcgccagagaggacgagcacgugagagcccccagcggccaccaccaggccggcagaugccugcugugggccugcaaggccugcaagagaaagaccaccaacgccgacagaagaaaggccgccaccaugagagagagaagaagacugagcaaggugaacgaggccuucgagacccugaagagaugcaccagcagcaaccccaaccagagacugcccaagguggagauccugagaaacgccaucagauacaucgagggccugcaggcccugcugagagaccaggacgccgccccccccggcgccgccgccgccuucuacgcccccggcccccugccccccggcagaggcggcgagcacuacagcggcgacagcgacgccagcagccccagaagcaacugcagcgacggcaugauggacuacagcggcccccccagcggcgccagaagaagaaacugcuacgagggcgccuacuacaacgaggcccccagcgagcccagacccggcaagagcgccgccgugagcagccuggacugccugagcagcaucguggagagaaucagcaccgagagccccgccgcccccgcccugcugcuggccgacgugcccagcgagagcccccccagaagacaggaggccgccgcccccagcgagggcgagagcagcggcgaccccacccagagccccgacgccgccccccagugccccgccggcgccaaccccaaccccaucuaccaggugcuguaa

SEQ ID NO: 20261 - RNA, 6186 nt, Artificial Sequence
  MYOF__Homo_sapiens__NP_038479
augcugagagugaucguggagagcgccagcaacauccccaagaccaaguucggcaagcccgaccccaucgugagcgugaucuucaaggacgagaagaagaagaccaagaagguggacaacgagcugaaccccguguggaacgagauccuggaguucgaccugagaggcaucccccuggacuucagcagcagccugggcaucaucgugaaggacuucgagaccaucggccagaacaagcugaucggcaccgccaccguggcccugaaggaccugaccggcgaccagagcagaagccugcccuacaagcugaucagccugcugaacgagaagggccaggacaccggcgccaccaucgaccuggugaucggcuacgacccccccagcgccccccaccccaacgaccugagcggccccagcgugcccggcaugggcggcgacggcgaggaggacgagggcgacgaggacagacuggacaacgccgugagaggccccggccccaagggccccgugggcaccgugagcgaggcccagcuggccagaagacugaccaaggugaagaacagcagaagaaugcugagcaacaagccccaggacuuccagaucagagugagagugaucgagggcagacagcugagcggcaacaacaucagacccguggugaaggugcacgugugcggccagacccacagaaccagaaucaagagaggcaacaaccccuucuucgacgagcuguucuucuacaacgugaacaugacccccagcgagcugauggacgagaucaucagcaucagaguguacaacagccacagccugagagccgacugccugaugggcgaguucaagaucgacgugggcuucguguacgacgagcccggccacgccgugaugagaaaguggcugcugcugaacgaccccgaggacaccagcagcggcagcaagggcuacaugaaggugagcauguucgugcugggcaccggcgacgagcccccccccgagagaagagacagagacaacgacagcgacgacguggagagcaaccugcugcugcccgccggcaucgcccugagaugggugaccuuccugcugaagaucuacagagccgaggacaucccccagauggacgacgccuucagccagaccgugaaggagaucuucggcggcaacgccgacaagaagaaccugguggaccccuucguggaggugagcuucgccggcaagaaggugugcaccaacaucaucgagaagaacgccaaccccgaguggaaccagguggugaaccugcagaucaaguuccccagcgugugcgagaagaucaagcugaccaucuacgacugggacagacugaccaagaacgacguggugggcaccaccuaccugcaccugagcaagaucgccgccagcggcggcgagguggaggacuucagcagcagcggcaccggcgccgccagcuacaccgugaacaccggcgagaccgaggugggcuucgugcccaccuucggccccugcuaccugaaccuguacggcagccccagagaguacaccggcuuccccgaccccuacgacgagcugaacaccggcaagggcgagggcguggccuacagaggcagaauccugguggagcuggccaccuuccuggagaagaccccccccgacaagaagcuggagcccaucagcaacgacgaccugcuggugguggagaaguaccagagaagaagaaaguacagccugagcgccguguuccacagcgccaccaugcugcaggacgugggcgaggccauccaguucgaggugagcaucggcaacuacggcaacaaguucgacaccaccugcaagccccuggccagcaccacccaguacagcagagccguguucgacggcaacuacuacuacuaccugcccugggcccacaccaagcccguggugacccugaccagcuacugggaggacaucagccacagacuggacgccgugaacacccugcuggccauggccgagagacugcagaccaacaucgaggcccugaagagcggcauccagggcaagauccccgccaaccagcuggccgagcuguggcugaagcugaucgacgaggugaucgaggacaccagauacacccugccccugaccgagggcaaggccaacgugaccgugcuggacacccagaucagaaagcugagaagcagaagccugagccagauccacgaggccgccgugagaaugagaagcgaggccaccgacgugaagagcacccuggccgagaucgaggacuggcuggacaagcugaugcagcugaccgaggagccccagaacagcaugcccgacaucaucaucuggaugaucagaggcgagaagagacuggccuacgccagaauccccgcccaccaggugcuguacagcaccagcggcgagaacgccagcggcaaguacugcggcaagacccagaccaucuuccugaaguacccccaggagaagaacaacggccccaaggugcccguggagcugagagugaacaucuggcugggccugagcgccguggagaagaaguucaacagcuucgccgagggcaccuucaccguguucgccgagauguacgagaaccaggcccugauguucggcaaguggggcaccagcggccuggugggcagacacaaguucagcgacgugaccggcaagaucaagcugaagagagaguucuuccugccccccaagggcugggagugggagggcgaguggaucguggaccccgagagaagccugcugaccgaggccgacgccggccacaccgaguucaccgacgagguguaccagaacgagagcagauaccccggcggcgacuggaagcccgccgaggacaccuacaccgacgccaacggcgacaaggccgccagccccagcgagcugaccugcccccccggcugggagugggaggacgacgccuggagcuacgacaucaacagagccguggacgagaagggcugggaguacggcaucaccaucccccccgaccacaagcccaagagcuggguggccgccgagaagauguaccacacccacagaagaagaagacuggugagaaagagaaagaaggaccugacccagaccgccagcagcaccgccagagccauggaggagcugcaggaccaggagggcugggaguacgccagccugaucggcuggaaguuccacuggaagcagagaagcagcgacaccuucagaagaagaagauggagaagaaagauggcccccagcgagacccacggcgccgccgccaucuucaagcuggagggcgcccugggcgccgacaccaccgaggacggcgacgagaagagccuggagaagcagaagcacagcgccaccaccguguucggcgccaacacccccaucgugagcugcaacuucgacagaguguacaucuaccaccugagaugcuacguguaccaggccagaaaccugcuggcccuggacaaggacagcuucagcgaccccuacgcccacaucugcuuccugcacagaagcaagaccaccgagaucauccacagcacccugaaccccaccugggaccagaccaucaucuucgacgagguggagaucuacggcgagccccagaccgugcugcagaacccccccaaggugaucauggagcuguucgacaacgaccaggugggcaaggacgaguuccugggcagaagcaucuucagccccguggugaagcugaacagcgagauggacaucacccccaagcugcuguggcaccccgugaugaacggcgacaaggccugcggcgacgugcuggugaccgccgagcugauccugagaggcaaggacggcagcaaccugcccauccugcccccccagagagcccccaaccuguacauggugccccagggcaucagacccguggugcagcugaccgccaucgagauccuggccuggggccugagaaacaugaagaacuuccagauggccagcaucaccagccccagccuggugguggagugcggcggcgagagaguggagagcguggugaucaagaaccugaagaagacccccaacuuccccagcagcgugcuguucaugaagguguuccugcccaaggaggagcuguacaugcccccccuggugaucaaggugaucgaccacagacaguucggcagaaagcccguggugggccagugcaccaucgagagacuggacagauucagaugcgaccccuacgccggcaaggaggacaucgugccccagcugaaggccagccugcugagcgccccccccugcagagacaucgugaucgagauggaggacaccaagccccugcuggccagcaagcugaccgagaaggaggaggagaucguggacugguggagcaaguucuacgccagcagcggcgagcacgagaagugcggccaguacauccagaagggcuacagcaagcugaagaucuacaacugcgagcuggagaacguggccgaguucgagggccugaccgacuucagcgacaccuucaagcuguacagaggcaagagcgacgagaacgaggaccccagcguggugggcgaguucaagggcagcuucagaaucuacccccugcccgacgaccccagcgugcccgccccccccagacaguucagagagcugcccgacagcgugccccaggagugcaccgugagaaucuacaucgugagaggccuggagcugcagccccaggacaacaacggccugugcgaccccuacaucaagaucacccugggcaagaaggugaucgaggacagagaccacuacauccccaacacccugaaccccguguucggcagaauguacgagcugagcugcuaccugccccaggagaaggaccugaagaucagcguguacgacuacgacaccuucaccagagacgagaaggugggcgagaccaucaucgaccuggagaacagauuccugagcagauucggcagccacugcggcauccccgaggaguacugcgugagcggcgugaacaccuggagagaccagcugagacccacccagcugcugcagaacguggccagauucaagggcuucccccagcccauccugagcgaggacggcagcagaaucagauacggcggcagagacuacagccuggacgaguucgaggccaacaagauccugcaccagcaccugggcgcccccgaggagagacuggcccugcacauccugagaacccagggccuggugcccgagcacguggagaccagaacccugcacagcaccuuccagcccaacaucagccagggcaagcugcagauguggguggacguguuccccaagagccugggcccccccggcccccccuucaacaucacccccagaaaggccaagaaguacuaccugagagugaucaucuggaacaccaaggacgugauccuggacgagaagagcaucaccggcgaggagaugagcgacaucuacgugaagggcuggauccccggcaacgaggagaacaagcagaagaccgacgugcacuacagaagccuggacggcgagggcaacuucaacuggagauucguguuccccuucgacuaccugcccgccgagcagcugugcaucguggccaagaaggagcacuucuggagcaucgaccagaccgaguucagaaucccccccagacugaucauccagaucugggacaacgacaaguucagccuggacgacuaccugggcuuccuggagcuggaccugagacacaccaucauccccgccaagagccccgagaagugcagacuggacaugauccccgaccugaaggccaugaacccccugaaggccaagaccgccagccuguucgagcagaagagcaugaagggcugguggcccugcuacgccgagaaggacggcgccagagugauggccggcaagguggagaugacccuggagauccugaacgagaaggaggccgacgagagacccgccggcaagggcagagacgagcccaacaugaaccccaagcuggaccugcccaacagacccgagaccagcuuccugugguucaccaaccccugcaagaccaugaaguucaucguguggagaagauucaagugggugaucaucggccugcuguuccugcugauccugcugcuguucguggccgugcugcuguacagccugcccaacuaccugagcaugaagaucgugaagcccaacguguaa

SEQ ID NO: 20262 - RNA, 675 nt, Artificial Sequence
  MYOG__Homo_sapiens__NP_002470
auggagcuguacgagaccagccccuacuucuaccaggagcccagauucuacgacggcgagaacuaccugcccgugcaccugcagggcuucgagccccccggcuacgagagaaccgagcugacccugagccccgaggcccccggcccccuggaggacaagggccugggcacccccgagcacugccccggccagugccugcccugggccugcaaggugugcaagagaaagagcgugagcguggacagaagaagagccgccacccugagagagaagagaagacugaagaaggugaacgaggccuucgaggcccugaagagaagcacccugcugaaccccaaccagagacugcccaagguggagauccugagaagcgccauccaguacaucgagagacugcaggcccugcugagcagccugaaccaggaggagagagaccugagauacagaggcggcggcggcccccagcccggcgugcccagcgagugcagcagccacagcgccagcugcagccccgaguggggcagcgcccuggaguucagcgccaaccccggcgaccaccugcugaccgccgaccccaccgacgcccacaaccugcacagccugaccagcaucguggacagcaucaccguggaggacgugagcguggccuuccccgacgagaccaugcccaacuaa

SEQ ID NO: 20263 - RNA, 5058 nt, Artificial Sequence
  MYOM1__Homo_sapiens__NP_003794
augagccugcccuucuaccagagaugccaccagcacuacgaccugagcuacagaaacaaggacgugagaagcaccgugagccacuaccagagagagaagaagagaagcgccguguacacccagggcagcaccgccuacagcagcagaagcagcgccgcccacagaagagagagcgaggccuucagaagagccagcgccagcagcagccagcagcaggccagccagcacgcccugagcagcgaggugagcagaaaggccgccagcgccuacgacuacggcagcagccacggccugaccgacagcagccugcugcuggacgacuacagcagcaagcugagccccaagcccaagagagccaagcacagccugcugagcggcgaggagaaggagaaccugcccagcgacuacauggugcccaucuucagcggcagacagaagcacgugagcggcaucaccgacaccgaggaggagagaaucaaggaggccgccgccuacaucgcccagagaaaccugcuggccagcgaggagggcaucaccaccagcaagcagagcaccgccagcaagcagaccaccgccagcaagcagagcaccgccagcaagcagagcaccgccagcaagcagagcaccgccagcagacagagcaccgccagcagacagagcguggugagcaagcaggccaccagcgcccugcagcaggaggagaccagcgagaagaagagcagaaagguggugaucagagagaaggccgagagacugagccugagaaagacccuggaggagaccgagaccuaccacgccaagcugaacgaggaccaccugcugcacgcccccgaguucaucaucaagcccagaagccacaccgugugggagaaggagaacgugaagcugcacugcagcaucgccggcuggcccgagcccagagugaccugguacaagaaccaggugcccaucaacgugcacgccaaccccggcaaguacaucaucgagagcagauacggcaugcacacccuggagaucaacggcugcgacuucgaggacaccgcccaguacagagccagcgccaugaacgugaagggcgagcugagcgccuacgccagcgugguggugaagagauacaagggcgaguucgacgagaccagauuccacgccggcgccagcaccaugccccugagcuucggcgugacccccuacggcuacgccagcagauucgagauccacuucgacgacaaguucgacgugagcuucggcagagagggcgagaccaugagccugggcugcagaguggugaucacccccgagaucaagcacuuccagcccgagauccagugguacagaaacggcgugccccugagccccagcaagugggugcagacccuguggagcggcgagagagccacccugaccuucagccaccugaacaaggaggacgagggccuguacaccaucagagugagaaugggcgaguacuacgagcaguacagcgccuacguguucgugagagacgccgacgccgagaucgagggcgcccccgccgccccccuggacgugaagugccuggaggccaacaaggacuacaucaucaucagcuggaagcagcccgccguggacggcggcagccccauccugggcuacuucaucgacaagugcgaggugggcaccgacagcuggagccagugcaacgacacccccgugaaguucgccagauuccccgugaccggccugaucgagggcagaagcuacaucuucagagugagagccgugaacaagaugggcaucggcuuccccagcagagugagcgagcccguggccgcccuggaccccgccgagaaggccagacugaagagcagacccagcgcccccuggaccggccagaucaucgugaccgaggaggagcccagcgagggcaucgugcccggcccccccaccgaccugagcgugaccgaggccaccagaagcuacguggugcugagcuggaagccccccggccagagaggccacgagggcaucauguacuucguggagaagugcgaggccggcaccgagaacuggcagagagugaacaccgagcugcccgugaagagccccagauucgcccuguucgaccuggccgagggcaagagcuacugcuucagagugagaugcagcaacagcgccggcgugggcgagcccagcgaggccaccgaggugaccguggugggcgacaagcuggacauccccaaggcccccggcaagaucauccccagcagaaacaccgacaccagcgugguggugagcugggaggagagcaaggacgccaaggagcuggugggcuacuacaucgaggccagcguggccggcagcggcaagugggagcccugcaacaacaaccccgugaagggcagcagauucaccugccacggccuggugaccggccagagcuacaucuucagagugagagccgugaacgccgccggccugagcgaguacagccaggacagcgaggccaucgaggugaaggccgccaucggcggcggcgugagccccgacgugugccccgcccugagcgacgagcccggcggccugaccgccagcagaggcagagugcacgaggccagcccccccaccuuccagaaggacgcccugcugggcagcaagcccaacaagcccagccugcccagcagcagccagaaccugggccagaccgaggugagcaaggugagcgagaccgugcaggaggagcugaccccccccccccagaaggccgccccccagggcaagagcaagagcgacccccugaagaagaagaccgacagagccccccccagcccccccugcgacaucaccugccuggagagcuucagagacagcauggugcugggcuggaagcagcccgacaagaucggcggcgccgagaucaccggcuacuacgugaacuacagagaggugaucgacggcgugcccggcaaguggagagaggccaacgugaaggccgugagcgaggaggccuacaagaucagcaaccugaaggagaacaugguguaccaguuccagguggccgccaugaacauggccggccugggcgcccccagcgccgugagcgagugcuucaagugcgaggaguggaccaucgccgugcccggccccccccacagccugaagugcagcgaggugagaaaggacagccuggugcugcaguggaagccccccgugcacagcggcagaacccccgugaccggcuacuucguggaccugaaggaggccaaggccaaggaggaccaguggagaggccugaacgaggccgccaucaagaacguguaccugaaggugagaggccugaaggagggcgugagcuacguguucagagugagagccaucaaccaggccggcgugggcaagcccagcgaccuggccggccccgugguggccgagaccagacccggcaccaaggaggugguggugaacguggacgacgacggcgugaucagccugaacuucgagugcgacaagaugacccccaagagcgaguucagcuggagcaaggacuacgugagcaccgaggacagccccagacuggagguggagagcaagggcaacaagaccaagaugaccuucaaggaccugggcauggacgaccugggcaucuacagcugcgacgugaccgacaccgacggcaucgccagcagcuaccugaucgacgaggaggagcugaagagacugcuggcccugagccacgagcacaaguuccccaccgugcccgugaagagcgagcuggccguggagauccuggagaagggccaggugagauucuggaugcaggccgagaagcugagcggcaacgccaaggugaacuacaucuucaacgagaaggagaucuucgagggccccaaguacaagaugcacaucgacagaaacaccggcaucaucgagauguucauggagaagcugcaggacgaggacgagggcaccuacaccuuccagcugcaggacggcaaggccaccaaccacagcaccguggugcuggugggcgacguguucaagaagcugcagaaggaggccgaguuccagagacaggaguggaucagaaagcagggcccccacuucguggaguaccugagcugggaggugaccggcgagugcaacgugcugcugaagugcaagguggccaacaucaagaaggagacccacaucgugugguacaaggacgagagagagaucagcguggacgagaagcacgacuucaaggacggcaucugcacccugcugaucaccgaguucagcaagaaggacgccggcaucuacgaggugauccugaaggacgacagaggcaaggacaagagcagacugaagcugguggacgaggccuucaaggagcugaugauggaggugugcaagaagaucgcccugagcgccaccgaccugaagauccagagcaccgccgagggcauccagcuguacagcuucgugaccuacuacguggaggaccugaaggugaacuggagccacaacggcagcgccaucagauacagcgacagagugaagaccggcgugaccggcgagcagaucuggcugcagaucaacgagcccacccccaacgacaagggcaaguacgugauggagcuguucgacggcaagaccggccaccagaagaccguggaccugagcggccaggccuacgacgaggccuacgccgaguuccagagacugaagcaggccgccaucgccgagaagaacagagccagagugcugggcggccugcccgacguggugaccauccaggagggcaaggcccugaaccugaccugcaacguguggggcgaccccccccccgaggugagcuggcugaagaacgagaaggcccuggccagcgacgaccacugcaaccugaaguucgaggccggcagaaccgccuacuucaccaucaacggcgugagcaccgccgacagcggcaaguacggccugguggugaagaacaaguacggcagcgagaccagcgacuucaccgugagcguguucauccccgaggaggaggccagaauggccgcccuggagagccugaagggcggcaagaaggccaaguaa

SEQ ID NO: 20264 - RNA, 4398 nt, Artificial Sequence
  MYOM2__Homo_sapiens__NP_003961
augagccuggugaccgugcccuucuaccagaagagacacagacacuucgaccagagcuacagaaacauccagaccagauaccugcuggacgaguacgccagcaagaagagagccagcacccaggccagcagccagaagagccugagccagagaagcagcagccagagagccagcagccagaccagccugggcggcaccaucugcagagugugcgccaagagagugagcacccaggaggacgaggagcaggagaacagaagcagauaccagagccugguggccgccuacggcgaggccaagagacagagauuccugagcgagcuggcccaccuggaggaggacgugcaccuggccagaagccaggccagagacaagcuggacaaguacgccauccagcagaugauggaggacaagcuggccugggagagacacaccuucgaggagagaaucagcagagcccccgagauccuggugagacugagaagccacaccgugugggagagaaugagcgugaagcugugcuucaccgugcagggcuuccccacccccguggugcagugguacaaggacggcagccugaucugccaggccgccgagcccggcaaguacagaaucgagagcaacuacggcgugcacacccuggagaucaacagagccgacuucgacgacaccgccaccuacagcgccguggccaccaacgcccacggccaggugagcaccaacgccgccgugguggugagaagauucagaggcgacgaggagcccuucagaagcgugggccugcccaucggccugccccugagcagcaugauccccuacacccacuucgacgugcaguuccuggagaaguucggcgugaccuucagaagagagggcgagaccgugacccugaagugcaccaugcuggugacccccgaccugaagagagugcagcccagagccgagugguacagagacgacgugcugcugaaggagagcaaguggaccaagauguucuucggcgagggccaggccagccugagcuucagccaccugcacaaggacgacgagggccuguacacccugagaaucgugagcagaggcggcgugagcgaccacagcgccuuccuguucgugagagacgccgacccccuggugaccggcgcccccggcgcccccauggaccugcagugccacgacgccaacagagacuacgugaucgugaccuggaagccccccaacaccaccaccgagagccccgugaugggcuacuucguggacagaugcgaggugggcaccaacaacugggugcagugcaacgacgcccccgugaagaucugcaaguaccccgugaccggccuguucgagggcagaagcuacaucuucagagugagagccgugaacagcgccggcaucagcagacccagcagagugagcgacgccguggccgcccuggacccccuggaccugagaagacugcaggccgugcaccuggagggcgagaaggagaucgccaucuaccaggacgaccuggagggcgacgcccaggugcccggcccccccaccggcgugcacgccagcgagaucagcagaaacuacguggugcugagcugggagccccccacccccagaggcaaggacccccugauguacuucaucgagaagagcguggugggcagcggcagcuggcagagagugaacgcccagaccgccgugagaagccccagauacgccguguucgaccugauggagggcaagagcuacguguucagagugcugagcgccaacagacacggccugagcgagcccagcgagaucaccagccccauccaggcccaggacgugaccguggugcccagcgcccccggcagagugcuggccagcagaaacaccaagaccagcgugguggugcagugggacagacccaagcacgaggaggaccugcugggcuacuacguggacugcugcguggccggcaccaaccugugggagcccugcaaccacaagcccaucggcuacaacagauucguggugcacggccugaccaccggcgagcaguacaucuucagagugaaggccgugaacgccgugggcaugagcgagaacagccaggagagcgacgugaucaaggugcaggccgcccugaccgugcccagccaccccuacggcaucacccugcugaacugcgacggccacagcaugacccugggcuggaaggugcccaaguucagcggcggcagccccauccugggcuacuaccuggacaagagagaggugcaccacaagaacuggcacgaggugaacagcagccccagcaagcccaccauccugaccguggacggccugaccgagggcagccuguacgaguucaagaucgccgccgugaaccuggccggcaucggcgagcccagcgaccccagcgagcacuucaagugcgaggccuggaccaugcccgagcccggccccgccuacgaccugaccuucugcgaggugagagacaccagccuggugaugcuguggaaggcccccguguacagcggcagcagccccgugagcggcuacuucguggacuucagagaggaggacgccggcgaguggaucaccgugaaccagaccaccaccgccagcagauaccugaaggugagcgaccugcagcagggcaagaccuacguguucagagugagagccgugaacgccaacggcgugggcaagcccagcgacaccagcgagcccgugcugguggaggccagacccggcaccaaggagaucagcgccggcguggacgagcagggcaacaucuaccugggcuucgacugccaggagaugaccgacgccagccaguucaccuggugcaagagcuacgaggagaucagcgacgacgagagauucaagaucgagaccgugggcgaccacagcaagcuguaccugaagaaccccgacaaggaggaccugggcaccuacagcgugagcgugagcgacaccgacggcgugagcagcagcuucgugcuggaccccgaggagcuggagagacugauggcccugagcaacgagaucaagaaccccaccaucccccugaagagcgagcuggccuacgagaucuucgacaagggcagagugagauucuggcugcaggccgagcaccugagccccgacgccagcuacagauucaucaucaacgacagagaggugagcgacagcgagauccacagaaucaagugcgacaaggccaccggcaucaucgagauggugauggacagauucagcaucgagaacgagggcaccuacaccgugcagauccacgacggcaaggccaagagccagagcagccuggugcugaucggcgacgccuucaagaccgugcuggaggaggccgaguuccagagaaaggaguuccugagaaagcagggcccccacuucgccgaguaccugcacugggacgugaccgaggagugcgaggugagacuggugugcaagguggccaacaccaagaaggagaccguguucaaguggcugaaggacgacgugcuguacgagaccgagacccugcccaaccuggagagaggcaucugcgagcugcugauccccaagcugagcaagaaggaccacggcgaguacaaggccacccugaaggacgacagaggccaggacgugagcauccuggagaucgccggcaagguguacgacgacaugauccuggccaugagcagagugugcggcaagagcgccagcccccugaaggugcugugcacccccgagggcaucagacugcagugcuucaugaaguacuucaccgacgagaugaaggugaacuggugccacaaggacgccaagaucagcagcagcgagcacaugagaaucggcggcagcgaggagauggccuggcugcagaucugcgagcccaccgagaaggacaagggcaaguacaccuucgagaucuucgacggcaaggacaaccaccagagaagccuggaccugagcggccaggccuucgacgaggccuucgccgaguuccagcaguucaaggccgccgccuucgccgagaagaacagaggcagacugaucggcggccugcccgacguggugaccaucauggagggcaagacccugaaccugaccugcaccguguucggcaaccccgaccccgaggugaucugguucaagaacgaccaggacauccagcugagcgagcacuucagcgugaagguggagcaggccaaguacgugagcaugaccaucaagggcgugaccagcgaggacagcggcaaguacagcaucaacaucaagaacaaguacggcggcgagaagaucgacgugaccgugagcguguacaagcacggcgagaagauccccgacauggcccccccccagcaggccaagcccaagcugauccccgccagcgccagcgccgccggccaguaa

SEQ ID NO: 20265 - RNA, 945 nt, Artificial Sequence
  MYOT__Homo_sapiens__NP_001129412
auggccagaagacugcugggcccccagaacgccgccgccguguuccaggcccaggacgacagcggcgcccaggacagccagcagcacaacagcgagcacgccagacugcaggugcccaccagccaggugagaagcagaagcaccagcagaggcgacgugaacgaccaggacgccauccaggagaaguucuacccccccagauucauccaggugcccgagaacaugagcaucgacgagggcagauucugcagaauggacuucaaggugagcggccugcccgcccccgacgugagcugguaccugaacggcagaaccgugcagagcgacgaccugcacaagaugaucgugagcgagaagggccugcacagccugaucuucgagguggugagagccagcgacgccggcgccuacgccugcguggccaagaacagagccggcgaggccaccuucaccgugcagcuggacgugcuggccaaggagcacaagagagcccccauguucaucuacaagccccagagcaagaaggugcuggagggcgacagcgugaagcuggagugccagaucagcgccauccccccccccaagcuguucuggaagagaaacaacgagauggugcaguucaacaccgacagaaucagccuguaccaggacaacaccggcagagugacccugcugaucaaggacgugaacaagaaggacgccggcugguacaccgugagcgccgugaacgaggccggcgugaccaccugcaacaccagacuggacgugaccgccagacccaaccagacccugcccgcccccaagcagcugagagugagacccaccuucagcaaguaccuggcccugaacggcaagggccugaacgugaagcaggccuucaaccccgagggcgaguuccagagacuggccgcccagagcggccuguacgagagcgaggagcuguaa

SEQ ID NO: 20266 - RNA, 900 nt, Artificial Sequence
  MYOZ1__Homo_sapiens__NP_067068
augccccugagcggcacccccgcccccaacaagaagagaaagagcagcaagcugaucauggagcugaccggcggcggccaggagagcagcggccugaaccugggcaagaagaucagcgugcccagagacgugaugcuggaggagcugagccugcugaccaacagaggcagcaagauguucaagcugagacagaugagaguggagaaguucaucuacgagaaccaccccgacguguucagcgacagcagcauggaccacuuccagaaguuccugcccaccgugggcggccagcugggcaccgccggccagggcuucagcuacagcaagagcaacggcagaggcggcagccaggccggcggcagcggcagcgccggccaguacggcagcgaccagcagcaccaccugggcagcggcagcggcgccggcggcaccggcggccccgccggccaggccggcagaggcggcgccgccggcaccgccggcgugggcgagaccggcagcggcgaccaggccggcggcgagggcaagcacaucaccguguucaagaccuacaucagccccugggagagagccaugggcguggacccccagcagaagauggagcugggcaucgaccugcuggccuacggcgccaaggccgagcugcccaaguacaagagcuucaacagaaccgccaugcccuacggcggcuacgagaaggccagcaagagaaugaccuuccagaugcccaaguucgaccugggcccccugcugagcgagccccuggugcuguacaaccagaaccugagcaacagacccagcuucaacagaacccccauccccuggcugagcagcggcgagcccguggacuacaacguggacaucggcaucccccuggacggcgagaccgaggagcuguaa

SEQ ID NO: 20267 - RNA, 795 nt, Artificial Sequence
  MYOZ2__Homo_sapiens__NP_057683
augcugagccacaacaccaugaugaagcagagaaagcagcaggccaccgccaucaugaaggaggugcacggcaacgacguggacggcauggaccugggcaagaaggugagcauccccagagacaucaugcuggaggagcugagccaccugagcaacagaggcgccagacuguucaagaugagacagagaagaagcgacaaguacaccuucgagaacuuccaguaccagagcagagcccagaucaaccacagcaucgccaugcagaacggcaagguggacggcagcaaccuggagggcggcagccagcaggccccccugaccccccccaacacccccgaccccagaagcccccccaaccccgacaacaucgcccccggcuacagcggcccccugaaggagaucccccccgagaaguucaacaccaccgccgugcccaaguacuaccagagccccugggagcaggccaucagcaacgaccccgagcugcuggaggcccuguaccccaagcuguucaagcccgagggcaaggccgagcugcccgacuacagaagcuucaacagaguggccacccccuucggcggcuucgagaaggccagcagaauggugaaguucaaggugcccgacuucgagcugcugcugcugaccgaccccagauucaugagcuucgugaacccccugagcggcagaagaagcuucaacagaacccccaagggcuggaucagcgagaacauccccaucgugaucaccaccgagcccaccgacgacaccaccgugcccgagagcgaggaccuguaa

SEQ ID NO: 20268 - RNA, 756 nt, Artificial Sequence
  MYOZ3__Homo_sapiens__XP_011536006
augauccccaaggagcagaagggccccgugauggccgccaugggcgaccugaccgagcccgugcccacccuggaccugggcaagaagcugagcgugccccaggaccugaugauggaggagcugagccugagaaacaacagaggcagccugcuguuccagaagagacagagaagagugcagaaguucaccuucgagcuggccgccagccagagagccaugcuggccggcagcgccagaagaaaggugaccggcaccgccgagagcggcaccguggccaacgccaacggccccgagggccccaacuacagaagcgagcugcacaucuuccccgccagccccggcgccagccugggcggccccgagggcgcccaccccgccgccgcccccgccggcugcgugcccagccccagcgcccuggcccccggcuacgccgagccccugaagggcgugccccccgagaaguucaaccacaccgccaucagcaagggcuacagaugccccuggcaggaguucgugagcuacagagacuaccagagcgacggcagaagccacacccccagccccaacgacuacagaaacuucaacaagacccccgugcccuucggcggcccccuggugggcggcaccuuccccagacccggcacccccuucauccccgagccccugagcggccuggagcugcugagacugagacccagcuucaacagaguggcccagggcugggugagaaaccugcccgagagcgaggagcuguaa

SEQ ID NO: 20269 - RNA, 3963 nt, Artificial Sequence
  MYPN__Homo_sapiens__NP_001243196
augcaggacgacagcaucgaggccagcaccagcaucagccagcugcugagagagagcuaccuggccgagaccagacacagaggcaacaacgagagaagcagagccgagcccagcagcaaccccugccacuucggcagccccagcggcgccgccgagggcggcggcggccaggacgaccugcccgaccugagcgccuuccugagccaggaggagcuggacgagagcgugaaccuggccagacuggccaucaacuacgacccccuggagaaggccgacgagacccaggccagaaagagacugagccccgaccagaugaagcacagccccaaccugagcuucgagcccaacuucugccaggacaaccccagaagccccaccagcagcaaggagagcccccaggaggccaagagaccccaguacugcagcgagacccagagcaagaagguguuccugaacaaggccgccgacuucaucgaggagcugagcagccuguucaagagccacagcagcaagagaaucagacccagagccugcaagaaccacaagagcaagcuggagagccagaacaaggugaugcaggagaacagcagcagcuucagcgaccugagcgagagaagagagagaagcagcgugcccauccccauccccgccgacaccagagacaacgaggugaaccacgcccuggagcagcaggaggccaagagaagagaggccgagcaggccgccagcgaggccgccggcggcgacaccacccccggcagcagccccagcagccuguacuacgaggagccccugggccagccccccagauucacccagaagcugagaagcagagaggugcccgagggcaccagagugcagcuggacugcaucguggugggcaucccccccccccaggugagaugguacugcgagggcaaggagcuggagaacagccccgacauccacaucgugcaggccggcaaccugcacagccugaccaucgccgaggccuucgaggaggacaccggcagauacagcugcuucgccagcaacaucuacggcaccgacagcaccagcgccgagaucuacaucgagggcgugagcagcagcgacagcgagggcgaccccaacaaggaggagaugaacagaauccagaagcccaacgaggugagcagcccccccaccaccagcgccgugaucccccccgccgugccccaggcccagcaccugguggcccagcccagaguggccaccauccagcagugccagagccccaccaacuaccugcagggccuggacggcaagcccaucaucgccgcccccguguucaccaagaugcugcagaaccugagcgccagcgagggccagcuggugguguucgagugcagagugaagggcgcccccagccccaagguggagugguacagagagggcacccugaucgaggacagccccgacuucagaauccugcagaagaagcccagaagcauggccgagcccgaggagaucugcacccuggugaucgccgagguguucgccgaggacagcggcugcuucaccugcaccgccagcaacaaguacggcaccgugagcagcaucgcccagcugcacgugagaggcaacgaggaccugagcaacaacggcagccugcacagcgccaacagcaccaccaaccuggccgccaucgagccccagcccagccccccccacagcgagccccccagcguggagcagccccccaagcccaagcuggagggcgugcuggugaaccacaacgagcccagaagcagcagcagaaucggccugagagugcacuucaaccugcccgaggacgacaagggcagcgaggccagcagcgaggccggcguggugaccaccagacagaccagacccgacagcuuccaggagagauucaacggccaggccaccaagacccccgagcccagcagccccgugaaggagcccccccccgugcuggccaagcccaagcuggacagcacccagcugcagcagcugcacaaccaggugcugcuggagcagcaccagcugcagaaccccccccccagcagccccaaggaguuccccuucagcaugaccgugcugaacagcaacgccccccccgccgugaccaccagcagcaagcaggugaaggcccccagcagccagaccuucagccuggccagacccaaguacuucuuccccagcaccaacaccaccgccgccaccguggcccccagcagcagccccguguucacccugagcagcaccccccagaccauccagagaaccgugagcaaggagagccugcuggugagccaccccagcgugcagaccaagagccccggcggccugagcauccagaacgagccccugccccccggccccaccgagcccacccccccccccuucaccuucagcauccccagcggcaaccaguuccagcccagaugcgugagccccauccccgugagccccaccagcagaauccagaaccccguggccuuccugagcagcgugcugcccagccugcccgccaucccccccaccaacgccaugggccugcccagaagcgcccccagcaugcccagccagggccuggccaagaagaacaccaagagcccccagcccgugaacgacgacaacaucagagagaccaagaacgccgugaucagagaccugggcaagaagaucaccuucagcgacgugagacccaaccagcaggaguacaagaucagcagcuucgagcagagacugaugaacgagaucgaguucagacuggagagaacccccguggacgagagcgacgacgagauccagcacgacgagauccccaccggcaagugcaucgcccccaucuucgacaagagacugaagcacuucagagugaccgagggcagccccgugaccuucaccugcaagaucgugggcauccccgugcccaagguguacugguucaaggacggcaagcagaucagcaagagaaacgagcacugcaagaugagaagagagggcgacggcaccugcagccugcacaucgagagcaccaccagcgacgacgacggcaacuacaccaucauggccgccaacccccagggcagaaucagcugcagcggccaccugauggugcagagccugcccaucagaagcagacugaccagcgccggccagagccacagaggcagaagcagagugcaggagagagacaaggagccccugcaggagagauucuucagaccccacuuccugcaggcccccggcgacaugguggcccacgagggcagacugugcagacuggacugcaaggugagcggccugcccccccccgagcugaccuggcugcugaacggccagcccgugcugcccgacgccagccacaagaugcuggugagagagaccggcgugcacagccugcugaucgacccccugacccagagagacgccggcaccuacaagugcaucgccaccaacaagaccggccagaacagcuucagccuggagcugagcgugguggccaaggaggugaagaaggcccccgugauccuggagaagcugcagaacugcggcgugcccgagggccaccccgugagacuggagugcagagugaucggcaugcccccccccguguucuacuggaagaaggacaacgagaccauccccugcaccagagagagaaucagcaugcaccaggacaccaccggcuacgccugccugcugauccagcccgccaagaagagcgacgccggcugguacacccugagcgccaagaacgaggccggcaucgugagcugcaccgccagacuggacaucuacgcccaguggcaccaccagauccccccccccaugagcgugagacccagcggcagcagauacggcagccugaccagcaagggccuggacaucuucagcgccuucagcagcauggagagcaccaugguguacagcugcagcagcagaagcgugguggagagcgacgagcuguaa

SEQ ID NO: 20270 - RNA, 3456 nt, Artificial Sequence
  MYRF__Homo_sapiens__NP_001120864
auggaggugguggacgagaccgaggcccugcagagauucuucgagggccacgacaucaacggcgcccuggagcccagcaacaucgacaccagcauccuggaggaguacaucagcaaggaggacgccagcgaccugugcuuccccgacaucagcgcccccgccagcagcgccagcuacagccacggccagcccgccaugcccggcagcagcggcgugcaccaccugagcccccccggcggcggccccagccccggcagacacggcccccugcccccccccggcuacggcaccccccugaacugcaacaacaacaacggcaugggcgccgcccccaagcccuuccccggcggcaccggcccccccaucaaggccgagcccaaggcccccuacgcccccggcacccugcccgacagcccccccgacagcggcagcgaggccuacagcccccagcaggugaacgagccccaccugcugagaaccaucacccccgagacccugugccacgugggcgugcccagcagacuggagcaccccccccccccccccgcccaccugcccggcccccccccccccccccccccccccccccacuaccccgugcugcagagagaccuguacaugaaggccgagccccccaucccccacuacgccgccaugggccagggccuggugcccaccgaccugcaccacacccagcagagccagaugcugcaccagcugcugcagcagcacggcgccgagcugcccacccaccccagcaagaagagaaagcacagcgagagcccccccagcacccugaacgcccagaugcugaacggcaugaucaagcaggagcccggcaccgugaccgcccugccccugcaccccaccagagcccccagcccccccuggcccccccagggcccccugagccccggccccggcagccugccccugagcaucgccagagugcagaccccccccuggcacccccccggcgcccccagccccggccugcugcaggacagcgacagccugagcggcagcuaccuggaccccaacuaccagagcaucaaguggcagccccaccagcagaacaagugggccacccuguacgacgccaacuacaaggagcugcccaugcugaccuacagaguggacgccgacaagggcuucaacuucagcgugggcgacgacgccuucgugugccagaagaagaaccacuuccaggugaccguguacaucggcaugcugggcgagcccaaguacgugaagacccccgagggccugaagccccuggacugcuucuaccugaagcugcacggcgugaagcuggaggcccugaaccagagcaucaacaucgagcagagccagagcgacagaagcaagagacccuucaaccccgugaccgugaaccugccccccgagcaggugaccaaggugaccgugggcagacugcacuucagcgagaccaccgccaacaacaugagaaagaagggcaagcccaaccccgaccagagauacuucaugcuggugguggcccugcaggcccacgcccagaaccagaacuacacccuggccgcccagaucagcgagagaaucaucgugagagccagcaaccccggccaguucgagagcgacagcgacgugcuguggcagagagcccaggugcccgacaccguguuccaccacggcagagugggcaucaacaccgacagacccgacgaggcccugguggugcacggcaacgugaaggugaugggcagccugaugcaccccagcgaccugagagccaaggagcacgugcaggagguggacaccaccgagcagcugaagagaaucagcagaaugagacuggugcacuacagauacaagcccgaguucgccgccagcgccggcaucgaggccaccgcccccgagaccggcgugaucgcccaggaggugaaggagauccugcccgaggccgugaaggacaccggcgacaugguguucgccaacggcaagaccaucgagaacuuccugguggugaacaaggagagaaucuucauggagaacgugggcgccgugaaggagcugugcaagcugaccgacaaccuggagaccagaaucgacgagcuggagagauggagccacaagcuggccaagcugagaagacuggacagccugaagagcaccggcagcagcggcgccuucagccacgccggcagccaguucagcagagccggcagcgugccccacaagaagagaccccccaagguggccagcaagagcagcagcguggugcccgaccaggccugcaucagccagagauuccugcagggcaccaucaucgcccuggugguggugauggccuucagcguggugagcaugagcacccuguacgugcugagccugagaaccgaggaggaccugguggacaccgacggcagcuucgccgugagcaccagcugccugcuggcccugcugagaccccagccccccggcggcagcgaggcccugugccccuggagcagccagagcuucggcaccacccagcugagacagagcccccugaccaccggccugcccggcauccagcccagccugcugcuggugaccaccagccugaccagcagcgcccccggcagcgccgugagaacccuggacaugugcagcagccaccccugccccgugaucugcugcagcagccccaccaccaaccccaccaccggccccagccugggccccagcuucaaccccggccacgugcugagccccagccccagccccagcaccaacagaagcggccccagccagauggcccugcugcccgugaccaacaucagagccaagagcuggggccugagcgugaacggcaucggccacagcaagcaccacaagagccuggagccccuggccagccccgccgugcccuuccccggcggccagggcaaggccaagaacagccccagccugggcuuccacggcagagccagaagaggcgcccugcagagcagcgugggccccgccgagcccaccugggcccagggccagagcgccagccugcuggccgagcccgugcccagccugaccagcauccaggugcuggagaacagcaugagcaucaccagccaguacugcgcccccggcgacgccugcagacccggcaacuucaccuaccacauccccgugagcagcggcaccccccugcaccugagccugacccugcagaugaacagcagcagccccgugagcguggugcugugcagccugagaagcaaggaggagcccugcgaggagggcagccugccccagagccugcacacccaccaggacacccagggcaccagccacagauggcccaucaccauccugagcuucagagaguucaccuaccacuucagaguggcccugcugggccaggccaacugcagcagcgaggcccuggcccagcccgccaccgacuaccacuuccacuucuacagacugugcgacuaa

SEQ ID NO: 20271 - RNA, 2208 nt, Artificial Sequence
  MYRFL__Homo_sapiens__XP_011537358
augaacuucaccgccaccacccagaccgagaugaccagcagaagcagaagcagcgaggugcaggaccccgacagcgagggccagaacagaaugcccaccgaccagugcagccccgcccugaaguggcagcccugccacagcgugcccuggcacagccugcugaacagccacuacgagaagcugcccgacgugggcuacagaguggugaccgacaagggcuucaacuucagccccgccgacgaggccuucgugugccagaagaagaaccacuuccagaucaccauccacauccagguguggggcagccccaaguucguggagaccgagaugggccugaagcccaucgagauguucuaccugaagguguucggcaccaagguggaggccaccaaccagaucaucgccaucgagcagagccaggccgacagaagcaagaagaucuucaaccccgugaagaucgaccugcuggccgaccaggugaccaaggugacccugggcagacugcacuucagcgagaccaccgccaacaacaugagaaagaagggcaagcccaaccccgaccagagauacuucaugcugguggugggccuguacgccgccaaccaggaccaguucuaccugcugagcgcccacaucagcgagagaaucaucgugagagccagcaaccccggccaguucgagaacgacagcgacgcccuguggcagagaggccaggugcccgagagcaucgugugccacggcagagugggcaucaacaccgacgcccccgacgaggcccugguggugugcggcaacaugaaggugaugggcaccaucaugcaccccagcgacagcagagccaagcagaacauccaggagguggacaccaacgagcagcugaagagaaucgcccagaugagaaucguggaguacgacuacaagcccgaguucgccagcgccaugggcaucaacaccgcccaccagaccggcaugaucgcccaggaggugcaggagauccugcccagagccgugagagaggugggcgacgugaccugcggcaacggcgagacccuggagaacuuccugaugguggacaaggaccagaucuucauggagaacgugggcgccgugaagcagcugugcaagcugaccaacaaccuggaggagagaaucgaggagcuggagaucuggaacagaaagcuggccagacugaagagacugagcagcuggaagagcagcgccagcgaggccagcaccaucagcaagagcagcagagccgugagcgccagcagccccagaagagccgugcacaagaagaacaacaagguguacuucagcggcaagagacaggccugccccaacuggguguuccagacccuggugaucacccugaucgccgugauggccuucugcgcccugaccaucguggcccuguacauccugagccugaaggaccaggacagaagagugcccaaccugccccccagcaacaucaccagcagccaggagcccgcccugcugcccaccgccagcagcagcgcccccaacaccagccuggugaccacccccgccagccugcaggugcccgagaucaccuucugcgagauccugcccugccaggagaccuacugcugccccaucagaggcaugaaggaggugagcagcagccccgugcagagacagagcgaggagaaggaguuccaccagagaagauggagcgaggacaagagcaagagcgugcuggccagaaacgcccugagcggccccgacugggagagcgacuggaucgacaccaccaucagcagcauccagaucauggagauccagcagaucaucgaccaccaguacugcauccagagccugcagugcggcagcggcaacuacaacuacaacauccccgugaacaagcacacccccaccaacgugaaguucagccuggagaucaacaccaccgagccccugaucguguuccagugcaaguucacccugggcaacaucugcuuccacagcaagagaggcaccaagggccuggagagccacagagagaucagccaggagaugacccagggcuaccagcacaucuggagccugcccguggcccccuucagcgacagcauguuccacuucagaguggccgcccccgaccuggccgacugcagcaccgaccccuacuucgccggcaucuucuucaccgacuacuucuucuacuucuacagaagaugcgccuaa

SEQ ID NO: 20272 - RNA, 2580 nt, Artificial Sequence
  MYRIP__Homo_sapiens__NP_001271352
augggcagaaagcuggaccugagcggccugaccgacgacgagaccgagcacgugcugcagguggugcagagagacuucaaccugagaaagaaggaggaggagagacugagcgagcugaagcagaagcuggacgaggagggcagcaagugcagcauccugagcaagcaccagcaguucguggagcacugcugcaugagaugcugcagccccuucaccuuccuggugaacaccaagagacagugcggcgacugcaaguucaacgugugcaagagcugcugcagcuaccagaagcacgagaaggccugggugugcugcgugugccagcaggccagacugcugagagcccagagccuggagugguucuacaacaacgugaagagcagauucaagagauucggcagcgccaaggugcugaagaaccuguacagaaagcacagacuggagagcggcgccugcuucgacauccugggcggcagccuguucgagagcaaccuggagaacgagggcagcaucagcggcagcgacagcaccuucuacagacagagcgagggccacagcgugauggacacccuggccguggcccugagaguggccgaggaggccaucgaggaggccaucagcaaggccgaggccuacggcgacagccuggacaagcagaacgaggccagcuaccugagagaccacaaggaggagcugaccgaggagcuggccaccaccauccugcagaagaucaucagaaagcagaagagcaagagcgagcagcagguggaggaggagcccggcuggccccacccccagagcugcagcaccaagguggccgacgagggcaccagcgccagccccggcggcuacagagcccccgccgcccuguggagaagccagagcgccuucagcaucaccggcgaggaggcccugaagaccccccccguggaggcccccagcagacagcccagagaccagggccagcaccccagagccgagagcgcccugcccagcuggaagagcguggacagacuggacgagaccaaccuggcccccgugcugcagagccccgacggcaacuggguggcccugaaggacggcgcccccccccccaccagacugcuggccaagcccaagagcggcaccuuccaggcccuggagguggccagcagcguggccagcgccuacgacgagaugggcagcgacagcgaggaggacuucgacuggagcgaggcccugagcaagcugugccccagaagcagagcccugcccagaaacccccagccccagcccacccaggcccagagcagcgaccagggccccaucgccgccagccccagcagcgcccugagccccaaccccgaggccaugugcagcgacagcgagaccagcagcgccggcagcagcagagaggugggccaccaggccagacugagcuggcugcagagaaaggcccccagaaaccccgccgccgagaagaugagacugcacggcgagcuggacgugaacuucaacccccagcuggccagcagagagaccagcgacagcagcgagcccgaggaggccccccacaccaccgacagaagagccagaagauggagaagagccagacugggcagcgaggagcccagcaaggagcccagcagccccagcgcccagcugagagaccuggacacccaccaggugagcgacgaccugagcgagaccgacaucagcaacgaggccagagacccccagacccugaccgacaccaccgaggagaagagaagaaacagacuguacgagcuggccaugaagaugagcgagaaggagaccagcagcggcgaggaccaggagagcgagcccaagaccgagagcgagaaccagaaggagagccugagcagcgaggacaacagccagagcgugcaggaggagcugaagaagaaguucagcgccgugagccugugcaacaucagcaccgaggugcugaaggugaucaacgccaccgaggagcugaucgccggcagcaccggccccugggagagcccccaggugccccccgacagacagaagggcauguuccccagaggcaccgaccaggugagacuggacgagcagcugaccagccuggaggagaacguguaccuggccgccggcaccguguacggccuggagacccagcugaccgagcuggaggacgccgccagaugcauccacagcggcaccgacgagacccaccuggccgaccuggaggaccagguggccaccgccgccgcccaggugcaccacgccgagcugcagaucagcgacaucgagagcagaaucagcgcccugaccaucgccggccugaacaucgcccccugcgugagauucaccagaagaagagaccagaagcagagaacccaggugcagaccaucgacaccagcagacagcagagaagaaagcugcccgccccccccgugaaggccgagaagaucgagaccagcagcgugaccaccaucaagaccuucaaccacaacuucauccugcagggcagcagcaccaacagaaccaaggagagaaagggcaccaccaaggaccugauggagcccgcccuggagagcgccgugauguacuaa

SEQ ID NO: 20273 - RNA, 3366 nt, Artificial Sequence
  MYT1__Homo_sapiens__NP_004526
augagccuggagaacgaggacaagagagccagaaccagaagcaaggcccugagaggcccccccgagaccaccgccgccgaccugagcugccccacccccggcugcaccggcagcggccacgugagaggcaaguacagcagacacagaagccugcagagcugcccccuggccaagaagagaaagcuggagggcgccgaggccgagcaccuggugagcaagagaaagagccacccccugaagcuggcccuggacgagggcuacggcguggacagcgacggcagcgaggacaccgaggugaaggacgccagcgugagcgacgagagcgagggcacccuggagggcgccgaggccgagaccagcggccaggacgagauccacagacccgagaccgccgagggcagaagccccgugaagagccacuucggcagcaaccccaucggcagcgccaccgccagcagcaagggcagcuacagcagcuaccagggcaucaucgccaccagccugcugaaccugggccagaucgccgaggagacccugguggaggaggaccugggccaggccgccaagcccggccccggcaucgugcaccugcugcaggaggccgccgagggcgccgccagcgaggagggcgagaagggccuguucauccagcccgaggacgccgaggaggugguggaggugaccaccgagagaagccaggaccugugcccccagagccuggaggacgccgccagcgaggagagcagcaagcagaagggcauccugagccacgaggaggaggacgaggaggaggaggaggaggaggaggaggaggaggaggacgaggaggaggaggaggaggaggaggaggaggaggaggaggaggaggaggaggaggaggaggaggaggaggaggaggaggaggaggaggaggaggaggccgcccccgacgugaucuuccaggaggacaccagccacaccagcgcccagaaggcccccgagcugagaggccccgagagccccagccccaagcccgaguacagcgugaucguggaggugagaagcgacgacgacaaggacgaggacacccacagcagaaagagcaccgugaccgacgagagcgagaugcaggacaugaugaccagaggcaaccugggccugcuggagcaggccaucgcccugaaggccgagcaggugagaaccgugugcgagcccggcugcccccccgccgagcagagccagcugggccugggcgagcccggcaaggccgccaagccccuggacaccgugagaaagagcuacuacagcaaggaccccagcagagccgagaagagagagaucaagugccccacccccggcugcgacggcaccggccacgugaccggccuguacccccaccacagaagccugagcggcugcccccacaaggacagaaucccccccgagauccuggccaugcacgagaacgugcugaagugccccacccccggcugcaccggccagggccacgugaacagcaacagaaacacccacagaagccugagcggcugccccaucgccgccgccgagaagcuggccaagagccacgagaagcagcagccccagaccggcgaccccagcaagagcagcagcaacagcgacagaauccugagacccaugugcuucgugaagcagcuggaggugccccccuacggcagcuacagacccaacguggcccccgccacccccagagccaaccuggccaaggagcuggagaaguucagcaaggugaccuucgacuacgccagcuucgacgcccagguguucggcaagagaaugcuggcccccaagauccagaccagcgagaccagccccaaggccuuccagugcuucgacuacagccaggacgccgaggccgcccacauggccgccaccgccauccugaaccugagcaccagaugcugggagaugcccgagaaccugagcaccaagccccaggaccugcccagcaagagcguggacaucgagguggacgagaacggcacccuggaccugagcaugcacaagcacagaaagagagagaacgccuuccccagcagcagcagcugcagcagcagccccggcgugaagagccccgacgccagccagagacacagcagcaccagcgcccccagcagcagcaugaccagcccccagagcagccaggccagcagacaggacgagugggacagaccccuggacuacaccaagcccagcagacugagagaggaggagcccgaggagagcgagcccgccgcccacagcuucgccagcagcgaggccgacgaccaggaggugagcgaggagaacuucgaggagagaaaguaccccggcgaggugacccugaccaacuucaagcugaaguuccugagcaaggacaucaagaaggagcugcugaccugccccacccccggcugcgacggcagcggccacaucaccggcaacuacgccagccacagaagccugagcggcugcccccuggccgacaagagccugagaaaccugauggccgcccacagcgccgaccugaagugccccacccccggcugcgacggcagcggccacaucaccggcaacuacgccagccacagaagccugagcggcugccccagagccaagaagagcggcgugaagguggcccccaccaaggacgacaaggaggaccccgagcugaugaagugccccgugcccggcugcgugggccugggccacaucagcggcaaguacgccagccacagaagcgccagcggcugcccccuggccgccagaagacagaaggagggcagccugaacggcagcagcuucagcuggaagagccugaagaacgagggccccaccugccccacccccggcugcgacggcagcggccacgccaacggcagcuuccugacccacagaagccugagcggcugccccagagccaccuucgccggcaagaagggcaagcugagcggcgacgaggugcugagccccaaguucaagaccagcgacgugcuggagaacgacgaggagaucaagcagcugaaccaggagaucagagaccugaacgagagcaacagcgagauggaggccgccauggugcagcugcagagccagaucagcagcauggagaagaaccugaagaacaucgaggaggagaacaagcugaucgaggagcagaacgaggcccuguuccuggagcugagcggccugagccaggcccugauccagagccuggccaacaucagacugccccacauggagcccaucugcgagcagaacuucgacgccuacgugagcacccugaccgacauguacagcaaccaggaccccgagaacaaggaccugcuggagagcaucaagcaggccgugagaggcauccagguguaa

SEQ ID NO: 20274 - RNA, 3561 nt, Artificial Sequence
  MYT1L__Homo_sapiens__NP_001289981
auggagguggacaccgaggagaagagacacagaaccagaagcaagggcgugagagugcccguggagcccgccauccaggagcuguucagcugccccacccccggcugcgacggcagcggccacgugagcggcaaguacgccagacacagaagcguguacggcugcccccuggccaagaagagaaagacccaggacaagcagccccaggagcccgcccccaagagaaagcccuucgccgugaaggccgacagcagcagcguggacgagugcgacgacagcgacggcaccgaggacauggacgagaaggaggaggacgagggcgaggaguacagcgaggacaacgacgagcccggcgacgaggacgaggaggacgaggagggcgacagagaggaggaggaggagaucgaggaggaggacgaggacgacgacgaggacggcgaggacguggaggacgaggaggaggaggaggaggaggaggaggaggaggaggaggaggaggagaacgaggaccaccagaugaacugccacaacaccagaaucaugcaggacaccgagaaggacgacaacaacaacgacgaguacgacaacuacgacgagcugguggccaagagccugcugaaccugggcaagaucgccgaggacgccgccuacagagccagaaccgagagcgagaugaacagcaacaccagcaacagccuggaggacgacagcgacaagaacgagaaccugggcagaaagagcgagcugagccuggaccuggacagcgacguggugagagagaccguggacagccugaagcugcuggcccagggccacggcguggugcugagcgagaacaugaacgacagaaacuacgccgacagcaugagccagcaggacagcagaaacaugaacuacgugaugcugggcaagcccaugaacaacggccugauggagaagaugguggaggagagcgacgaggaggugugccugagcagccuggagugccugagaaaccagugcuucgaccuggccagaaagcugagcgagaccaacccccaggagagaaacccccagcagaacaugaacaucagacagcacgugagacccgaggaggacuuccccggcagaacccccgacagaaacuacagcgacaugcugaaccugaugagacuggaggagcagcugagccccagaagcagaguguucgccagcugcgccaaggaggacggcugccacgagagagacgacgacaccaccagcgugaacagcgacagaagcgaggagguguucgacaugaccaagggcaaccugacccugcuggagaaggccaucgcccuggagaccgagagagccaaggccaugagagagaagauggccauggaggccggcagaagagacaacaugagaagcuacgaggaccagagccccagacagcugcccggcgaggacagaaagcccaagagcagcgacagccacgugaagaagcccuacuacggcaaggaccccagcagaaccgagaagaaggagagcaagugccccacccccggcugcgacggcaccggccacgugaccggccuguacccccaccacagaagccugagcggcugcccccacaaggacagagugccccccgagauccuggccaugcacgagagcgugcugaagugccccacccccggcugcaccggcagaggccacgugaacagcaacagaaacagccacagaagccugagcggcugccccaucgccgccgccgagaagcuggccaaggcccaggagaagcaccagagcugcgacgugagcaagagcagccaggccagcgacagagugcugagacccaugugcuucgugaagcagcuggagaucccccaguacggcuacagaaacaacgugcccaccaccacccccagaagcaaccuggccaaggagcuggagaaguacagcaagaccagcuucgaguacaacagcuacgacaaccacaccuacggcaagagagccaucgcccccaaggugcagaccagagacaucagccccaagggcuacgacgacgccaagagauacugcaaggaccccagccccagcagcagcagcaccagcagcuacgcccccagcagcagcagcaaccugagcugcggcggcggcagcagcgccagcagcaccugcagcaagagcagcuucgacuacacccacgacauggaggccgcccacauggccgccaccgccauccugaaccugagcaccagaugcagagagaugccccagaaccugagcaccaagccccaggaccugugcgccaccagaaaccccgacauggagguggacgagaacggcacccuggaccugagcaugaacaagcagagacccagagacagcugcugccccauccugaccccccuggagcccaugagcccccagcagcaggccgugaugaacaacagaugcuuccagcugggcgagggcgacugcugggaccugcccguggacuacaccaagaugaagcccagaagaaucgacgaggacgagagcaaggacaucacccccgaggaccuggaccccuuccaggaggcccuggaggagagaagauaccccggcgaggugaccauccccagccccaagcccaaguacccccagugcaaggagagcaagaaggaccugaucacccugagcggcugcccccuggccgacaagagcaucagaagcaugcuggccaccagcagccaggagcugaagugccccacccccggcugcgacggcagcggccacaucaccggcaacuacgccagccacagaagccugagcggcugccccagagccaagaagagcggcaucagaaucgcccagagcaaggaggacaaggaggaccaggagcccaucagaugccccgugcccggcugcgacggccagggccacaucaccggcaaguacgccagccacagaagcgccagcggcugcccccuggccgccaagagacagaaggacggcuaccugaacggcagccaguucagcuggaagagcgugaagaccgagggcaugagcugccccacccccggcugcgacggcagcggccacgugagcggcagcuuccugacccacagaagccugagcggcugccccagagccaccagcgccaugaagaaggccaagcugagcggcgagcagaugcugaccaucaagcagagagccagcaacggcaucgagaacgacgaggagaucaagcagcuggacgaggagaucaaggagcugaacgagagcaacagccagauggaggccgacaugaucaagcugagaacccagaucaccaccauggagagcaaccugaagaccaucgaggaggagaacaaggugaucgagcagcagaacgagagccugcugcacgagcuggccaaccugagccagagccugauccacagccuggccaacauccagcugccccacauggaccccaucaacgagcagaacuucgacgccuacgugaccacccugaccgagauguacaccaaccaggacagauaccagagccccgagaacaaggcccugcuggagaacaucaagcaggccgugagaggcauccagguguaa

SEQ ID NO: 20275 - RNA, 1401 nt, Artificial Sequence
  MYZAP__Homo_sapiens__NP_001018110
augcugagaagcaccagcaccgugacccugcugagcggcggcgccgccagaacccccggcgcccccagcagaagagccaacgugugcagacugagacugaccgugccccccgagagccccgugcccgagcagugcgagaagaagaucgagagaaaggagcagcugcuggaccugagcaacggcgagcccaccagaaagcugccccagggcgugguguacggcguggugagaagaagcgaccagaaccagcagaaggagauggugguguacggcuggagcaccagccagcugaaggaggagaugaacuacaucaaggacgugagagccacccuggagaaggugagaaagagaauguacggcgacuacgacgagaugagacagaagaucagacagcugacccaggagcugagcgugagccacgcccagcaggaguaccuggagaaccacauccagacccagagcagcgcccuggacagauucaacgccaugaacagcgcccuggccagcgacagcaucggccugcagaagacccugguggacgugacccuggagaacagcaacaucaaggaccagaucagaaaccugcagcagaccuacgaggccagcauggacaagcugagagagaagcagagacagcuggagguggcccagguggagaaccagcugcugaagaugaagguggagagcagccaggaggccaacgccgaggugaugagagagaugaccaagaagcuguacagccaguacgaggagaagcugcaggaggagcagagaaagcacagcgccgagaaggaggcccugcuggaggagaccaacagcuuccugaaggccaucgaggaggccaacaagaagaugcaggccgccgagaucagccuggaggagaaggaccagagaaucggcgagcuggacagacugaucgagagaauggagaaggagagacaccagcugcagcugcagcugcuggagcacgagaccgagaugagcggcgagcugaccgacagcgacaaggagagauaccagcagcuggaggaggccagcgccagccugagagagagaaucagacaccuggacgacauggugcacugccagcagaagaaggugaagcagaugguggaggagaucgagagccugaagaagaagcugcagcagaagcagcugcugauccugcagcugcuggagaagaucagcuuccuggagggcgagaacaacgagcugcagagcagacuggacuaccugaccgagacccaggccaagaccgagguggagaccagagagaucggcgugggcugcgaccugcugcccagccagaccggcagaaccagagagaucgugaugcccagcagaaacuacacccccuacaccagagugcuggagcugaccaugaagaagacccugaccuaa

SEQ ID NO: 20276 - RNA, 570 nt, Artificial Sequence
  MZB1__Homo_sapiens__NP_057543
augagacugagccugccccugcugcugcugcugcugggcgccugggccauccccggcggccugggcgacagagccccccugaccgccaccgccccccagcuggacgacgaggagauguacagcgcccacaugcccgcccaccugagaugcgacgccugcagagccguggccuaccagauguggcagaaccuggccaaggccgagaccaagcugcacaccagcaacagcggcggcagaagagagcugagcgagcugguguacaccgacgugcuggacagaagcugcagcagaaacuggcaggacuacggcgugagagagguggaccaggugaagagacugaccggccccggccugagcgagggccccgagcccagcaucagcgugauggugaccggcggccccuggcccaccagacugagcagaaccugccugcacuaccugggcgaguucggcgaggaccagaucuacgaggcccaccagcagggcagaggcgcccuggaggcccugcugugcggcggcccccagggcgccugcagcgagaaggugagcgccaccagagaggagcuguaa

SEQ ID NO: 20277 - RNA, 873 nt, Artificial Sequence
  MZF1__Homo_sapiens__NP_001253962
augagacccgccgugcugggcagccccgacagagccccccccgaggacgagggccccgugauggugaagcuggaggacagcgaggaggagggcgaggccgcccugugggaccccggccccgaggccgccagacugagauucagaugcuucagauacgaggaggccaccggcccccaggaggcccuggcccagcugagagagcugugcagacaguggcugagacccgaggugagaagcaaggagcagaugcuggagcugcuggugcuggagcaguuccugggcgcccugccccccgagauccaggccagagugcagggccagagacccggcagccccgaggaggccgccgcccugguggacggccugagaagagagcccggcggccccagaagaugggugaccgugcaggugcagggccaggaggugcugagcgagaagauggagcccagcagcuuccagccccugcccgagaccgagccccccacccccgagcccggccccaagaccccccccagaaccaugcaggagagcccccugggccugcaggugaaggaggagagcgaggugaccgaggacagcgacuuccuggagagcggcccccuggccgccacccaggagagcgugcccacccugcugcccgaggaggcccagagaugcggcaccgugcuggaccagaucuucccccacagcaagaccggccccgagggccccagcuggagagagcaccccagagcccuguggcacgaggaggccggcggcaucuucagccccggcgccggcgccggcgccgcccccgcccugggcgccggcuggcugggcgccgccguggccauguacguggccagaugcagcgccaacgccgccaccugcuaa

SEQ ID NO: 20278 - RNA, 2691 nt, Artificial Sequence
  N4BP1__Homo_sapiens__NP_694574
auggccgccagagccgugcuggacgaguucaccgcccccgccgagaaggccgagcugcuggagcagagcagaggcagaaucgagggccuguucggcgugagccuggccgugcugggcgcccugggcgccgaggagccccugcccgccagaaucuggcugcagcugugcggcgcccaggaggccgugcacagcgccaaggaguacaucaagggcaucugcgagcccgagcuggaggagagagagugcuaccccaaggacaugcacugcaucuucgugggcgccgagagccuguuccugaagagccugauccaggacaccugcgccgaccugugcauccuggacaucggccugcugggcaucagaggcagcgccgaggccguggugauggccagaagccacauccagcaguucgugaagcuguucgagaacaaggagaaccugcccagcagccagaaggagagcgaggugaagagagaguucaagcaguucguggaggcccacgccgacaacuacaccauggaccugcugauccugcccaccagccugaagaaggagcugcugacccugacccagggcgaggagaaccuguucgagaccggcgacgacgaggugaucgagaugagagacagccagcagaccgaguucacccagaacgccgccaccggccugaacaucagcagagacgagaccgugcugcaggaggaggccagaaacaaggccggcacccccgugagcgagcugaccaagcagauggacaccgugcugagcagcagccccgacgugcuguucgaccccaucaacggccugacccccgacgaggaggcccugagcaacgagagaaucugccagaagagaagauucagcgacagcgaggagagacacaccaagaagcaguucagccuggagaacgugcaggagggcgagauccugcacgacgccaagacccuggccggcaacgugaucgccgaccugagcgacagcagcgccgacagcgagaaccugagccccgacaucaaggagaccaccgaggagauggaguacaacauccuggugaacuucuucaagaccaugggcuacagccaggagaucguggagaaggugaucaagguguacggccccagcaccgagccccugcugcugcuggaggagaucgagaaggagaacaagagauuccaggaggacagagaguucagcgccggcaccguguaccccgagaccaacaagaccaagaacaagggcguguacagcagcaccaacgagcugaccaccgacagcacccccaagaagacccaggcccacacccagcagaacaugguggagaaguucagccagcugcccuucaagguggaggccaagcccugcaccagcaacugcagaaucaacaccuucagaaccgugcccaucgagcagaagcacgagguguggggcagcaaccagaacuacaucugcaacaccgaccccgagaccgacggccugagccccagcguggccagccccagccccaaggaggugaacuucgugagcagaggcgccagcagccaccagcccagagugccccuguuccccgagaacggccugcaccagcagcccgagccccugcugcccaacaacaugaagagcgccugcgagaagagacugggcugcugcagcagcccccacagcaagcccaacugcagcacccugagcccccccaugccccugccccagcugcugcccagcgugaccgacgccagaagcgccggccccagcgaccacaucgacagcagcgugaccggcgugcagagauucagagacacccugaagauccccuacaagcuggagcugaagaacgagcccggcagaaccgaccugaagcacaucgugaucgacggcagcaacguggccaucacccacggccugaagaaguucuucagcugcagaggcaucgccaucgccguggaguacuucuggaagcugggcaacagaaacaucaccguguucgugccccaguggagaaccagaagagaccccaacgugaccgagcagcacuuccugacccagcugcaggagcugggcauccugagccugacccccgccagaaugguguucggcgagagaaucgccagccacgacgacagauuccugcugcaccuggccgacaagaccggcggcaucaucgugaccaacgacaacuucagagaguucgugaacgagagcgugagcuggagagagaucaucaccaagagacugcugcaguacaccuucgugggcgacaucuucauggugcccgacgacccccugggcagaagcggccccagacuggaggaguuccugcagaaggaggugugccugagagacaugcagccccugcugagcgcccugcccaacgugggcauguucgaccccagcuucagagugcccggcacccaggccgccagcaccagccaccagccccccaccagaauccagggcgcccccagcagccacuggcugccccagcagccccacuucccccugcugcccgcccugcccagccugcagcagaaccugcccaugcccgcccagagaagcagcgccgagaccaacgagcugagagaggcccugcugaagaucuuccccgacagcgagcagagacugaagaucgaccagauccugguggcccaccccuacaugaaggaccugaacgcccugagcgccauggugcuggacuaa

SEQ ID NO: 20279 - RNA, 522 nt, Artificial Sequence
  N4BP2L1__Homo_sapiens__NP_001073159
auggaggacagcuuccugcagagcuucggcagacugagccugcagccccagcagcagcagcagagacagagaccccccagacccccccccagaggcaccccccccagaagacacagcuucagaaagcaccuguaccugcugagaggccugcccggcagcggcaagaccacccuggccagacagcugcagcacgacuuccccagagcccugaucuucagcaccgacgacuucuucuucagagaggacggcgccuacgaguucaaccccgacuuccuggaggaggcccacgaguggaaccagaagagagccagaaaggccaugagaaacggcaucagccccaucaucaucgacaacaccaaccugcacgccugggagaugaagcccuacgccgugaugguguuccagaccgagcagaagaaccuguucagacuggagauggacauggugguguucagacccgagaugaagaagcacagcuggugccugaagagaaagaacccccccaacgagagaaccguguaa

SEQ ID NO: 20280 - RNA, 2214 nt, Artificial Sequence
  N4BP2L2__Homo_sapiens__NP_001265361
auggcccugugcagcgcccugaugaccaucuucaccaucaagaugggcaccgccaagcaggccaucgaccagggcagaagccccgugaucaucgacaacaccaacauccaggccugggagaugaagcccuacguggagguggccaucggcaagggcuacagaguggaguuccacgagcccgagaccugguggaaguucgaccccgaggagcuggagaagagaaacaagcacggcgugagcagaaagaagaucgcccagaugcuggacagauacgaguaccagaugagcaucagcaucgugaugaacagcguggagcccagccacaagagcacccagagacccccccccccccagggcagacagagagagagagugcugaagaagaccggccacagacugagcaagaccaagcagaagagaaacagaaagagaaacaagaagcagaacagccagaacagaaucauggaggagaacagccuggaguuccugagcgaccugacccccggcgaccaggaccccagccagagcgaggaggaggacaucgagaagaccagaagagagagcgaguaccccuucaucgacggccugcagaacgaggugggcgacuucgugaccggcuacaaggagaagagauggaagaacaaggaccccaaggacagcuuccagaacgugaugagcaucguggagcuggacaacacccccaagaacuaccugagcaaggagggcgacaaccuguucgugagccugcugcugagacccaacgagaucagcgugaccugccccauccugacccagaaccugagcugcgugaccaccgacgacugcagcggcaugaagguggagaagcacaucagaaacagacacaccaucgcccuggacacccaggaccugagcgccgagaccagcugccuguucaugaagaagagagagaucguggacaagaaccugagccacgagcccauccugugccaccagcacggcaucagaaugagcgacaaggugcugagagaggagcagguguacaccaccaagaucaaccacugggccuucuucaccaccaaccugagcgacgaggaccugcagcugggcagcgacagacagcccuacuucggcagcuggcccgccggcccccacaaguucaucugcgagcagagacccaagaaggacagagccugcaagcuggccggccccgacagcagaggccaguggauccagaugaucuucaccagcguggccgccagcgagcccggcaacaaccccgagauccugaccgacaagcugcugaucggcaacgaggacuucagccccccccccgagaccauggacagcuucaucgagaccaaccuguucagaagcugccugccccagcccgacauccccaagaacgcccuggagagcaccaagaacaagaagagaagaaagaagagaaucuucaaccuggugcccaacuucgaccugcugggccagagcagaaucggcgugaaggagagagagaagugcgaccugcugaccaagaaccacggccugaagaucacccugggcgaggagaaggacagaaucagcgagagaaacagcgaggaggagaacaagcagaagcugaugaccuucgaccaccacccccugugguucuaccuggacaucaucaaggccaccccccugaacaucgacggccagagauacagccacugccugagcuucaacagacugagaugcagcgccagccuguacaagaacuacauccccagcuucgugcugcacaaccugagcagcaucuggaagcccagcuucaccaacaagaagcuguuccugaccuucgagagccagaccagagugggcaacaagcugaacgacgccggcuucaucagccccgagauccugcacagccaccccgacaccagcugcagccugggcgugaccagcgacuuccacuuccugaacgagagauucgacagaaagcugaagagaugggaggagcccaaggagcugcccgccgaggacagccaggaccugaccagcaccgacuacagaagccuggagcugccccugagccagggcuucgccuuccagcuggugaagcuguucggcagccccggcgugcccauggagagccugcugcccgacgacuacguggugccccuggacuggaagacccugaagaugaucuaccugcaguggaagaugagcguggagaagagacagaagaagaucggcuaa

SEQ ID NO: 20281 - RNA, 663 nt, Artificial Sequence
  NAA10__Homo_sapiens__NP_001243048
augaacaucagaaacgccagacccgaggaccugaugaacaugcagcacugcaaccugcugugccugcccgagaacuaccagaugaaguacuacuucuaccacggccugagcuggccccagcugagcuacaucgccgaggacgagaacggcaagaucgugggcuacgugcuggccaagauggaggaggaccccgacgacgugccccacggccacaucaccagccuggccgugaagagaagccacagaagacugggccuggcccagaagcugauggaccaggccagcagagccaugaucgagaacuucaacgccaaguacgugagccugcacgugagaaagagaaucagcgagguggagcccaaguacuacgccgacggcgaggacgccuacgccaugaagagagaccugacccagauggccgacgagcugagaagacaccuggagcugaaggagaagggcagacacguggugcugggcgccaucgagaacaagguggagagcaagggcaacagcccccccagcagcggcgaggccugcagagaggagaagggccuggccgccgaggacagcggcggcgacagcaaggaccugagcgaggugagcgagaccaccgagagcaccgacgugaaggacagcagcgaggccagcgacagcgccagcuaa

SEQ ID NO: 20282 - RNA, 2601 nt, Artificial Sequence
  NAA15__Homo_sapiens__NP_476516
augcccgccgugagccugccccccaaggagaacgcccuguucaagagaauccugagaugcuacgagcacaagcaguacagaaacggccugaaguucugcaagcagauccugagcaaccccaaguucgccgagcacggcgagacccuggccaugaagggccugacccugaacugccugggcaagaaggaggaggccuacgagcuggugagaagaggccugagaaacgaccugaagagccacgugugcuggcacguguacggccugcugcagagaagcgacaagaaguacgacgaggccaucaagugcuacagaaacgcccugaagugggacaaggacaaccugcagauccugagagaccugagccugcugcagauccagaugagagaccuggagggcuacagagagaccagauaccagcugcugcagcugagacccgcccagagagccagcuggaucggcuacgccaucgccuaccaccugcuggaggacuacgagauggccgccaagauccuggaggaguucagaaagacccagcagaccagccccgacaagguggacuacgaguacagcgagcugcugcuguaccagaaccaggugcugagagaggccggccuguacagagaggcccuggagcaccugugcaccuacgagaagcagaucugcgacaagcuggccguggaggagaccaagggcgagcugcugcugcagcugugcagacuggaggacgccgccgacguguacagaggccugcaggagagaaaccccgagaacugggccuacuacaagggccuggagaaggcccugaagcccgccaacaugcuggagagacugaagaucuacgaggaggccuggaccaaguaccccagaggccuggugcccagaagacugccccugaacuuccugagcggcgagaaguucaaggagugccuggacaaguuccugagaaugaacuucagcaagggcugcccccccguguucaacacccugagaagccuguacaaggacaaggagaagguggccaucaucgaggagcugguggugggcuacgagaccagccugaagagcugcagacuguucaaccccaacgacgacggcaaggaggagccccccaccacccugcugugggugcaguacuaccuggcccagcacuacgacaagaucggccagcccagcaucgcccuggaguacaucaacaccgccaucgagagcacccccacccugaucgagcuguuccuggugaaggccaagaucuacaagcacgccggcaacaucaaggaggccgccagauggauggacgaggcccaggcccuggacaccgccgacagauucaucaacagcaagugcgccaaguacaugcugaaggccaaccugaucaaggaggccgaggagaugugcagcaaguucaccagagagggcaccagcgccguggagaaccugaacgagaugcagugcaugugguuccagaccgagugcgcccaggccuacaaggccaugaacaaguucggcgaggcccugaagaagugccacgagaucgagagacacuucaucgagaucaccgacgaccaguucgacuuccacaccuacugcaugagaaagaucacccugagaagcuacguggaccugcugaagcuggaggacgugcugagacagcaccccuucuacuucaaggccgccagaaucgccaucgagaucuaccugaagcugcacgacaacccccugaccgacgagaacaaggagcacgaggccgacaccgccaacaugagcgacaaggagcugaagaagcugagaaacaagcagagaagagcccagaagaaggcccagaucgaggaggagaagaagaacgccgagaaggagaagcagcagagaaaccagaagaagaagaaggacgacgacgacgaggagaucggcggccccaaggaggagcugauccccgagaagcuggccaagguggagaccccccuggaggaggccaucaaguuccugaccccccugaagaaccuggugaagaacaagaucgagacccaccuguucgccuucgagaucuacuucagaaaggagaaguuccugcugaugcugcagagcgugaagagagccuucgccaucgacagcagccaccccuggcugcacgagugcaugaucagacuguucaacaccgccgugugcgagagcaaggaccugagcgacaccgugagaaccgugcugaagcaggagaugaacagacuguucggcgccaccaaccccaagaacuucaacgagaccuuccugaagagaaacagcgacagccugccccacagacugagcgccgccaagaugguguacuaccuggaccccagcagccagaagagagccaucgagcuggccaccacccuggacgagagccugaccaacagaaaccugcagaccugcauggaggugcuggaggcccuguacgacggcagccugggcgacugcaaggaggccgccgagaucuacagagccaacugccacaagcuguuccccuacgcccuggccuucaugccccccggcuacgaggaggacaugaagaucaccgugaacggcgacagcagcgccgaggccgaggagcuggccaacgagaucuaa

SEQ ID NO: 20283 - RNA, 1290 nt, Artificial Sequence
  NAA16__Homo_sapiens__NP_001104268
augcccaacgugcugcugccccccaaggagagcaaccuguucaagagaauccugaagugcuacgagcagaagcaguacaagaacggccugaaguucugcaagaugauccugagcaaccccaaguucgccgagcacggcgagacccuggccaugaagggccugacccugaacugccugggcaagaaggaggaggccuacgaguucgugagaaagggccugagaaacgacgugaagagccacgugugcuggcacguguacggccugcugcagagaagcgacaagaaguacgacgaggccaucaagugcuacagaaacgcccugaagcuggacaaggacaaccugcagauccugagagaccugagccugcugcagauccagaugagagaccuggagggcuacagagagaccagauaccagcugcugcagcugagacccacccagagagccagcuggaucggcuacgccaucgccuaccaccugcugaaggacuacgacauggcccugaagcugcuggaggaguucagacagacccagcaggugccccccaacaagaucgacuacgaguacagcgagcugauccuguaccagaaccaggugaugagagaggccgaccugcugcaggagagccuggagcacaucgagauguacgagaagcagaucugcgacaagcugcugguggaggagaucaagggcgagauccugcugaagcugggcagacugaaggaggccagcgagguguucaagaaccugaucgacagaaacgccgagaacuggugcuacuacgagggccuggagaaggcccugcagaucagcacccuggaggagagacugcagaucuacgaggagaucagcaagcagcaccccaaggccaucacccccagaagacugccccugacccuggugcccggcgagagauucagagagcugauggacaaguuccugagagugaacuucagcaagggcugccccccccuguucaccacccugaagagccuguacuacaacaccgagaaggugagcaucauccaggagcuggugaccaacuacgaggccagccugaagaccugcgacuucuucagccccuacgagaacggcgagaaggagccccccaccacccugcugugggugcaguacuuccuggcccagcacuucgacaagcugggccaguacagccuggcccuggacuacaucaacgccgccaucgccagcacccccacccugaucgagcuguucuacaugaaggccaagaucuacaaggugaagagcgagagcugcuuccugagcagcuaa

SEQ ID NO: 20284 - RNA, 537 nt, Artificial Sequence
  NAA20__Homo_sapiens__NP_057184
augaccacccugagagccuucaccugcgacgaccuguucagauucaacaacaucaaccuggacccccugaccgagaccuacggcauccccuucuaccugcaguaccuggcccacuggcccgaguacuucaucguggccgaggcccccggcggcgagcugaugggcuacaucaugggcaaggccgagggcagcguggccagagaggaguggcacggccacgugaccgcccugagcguggcccccgaguucagaagacugggccuggccgccaagcugauggagcugcuggaggagaucagcgagagaaagggcggcuucuucguggaccuguucgugagagugagcaaccagguggccgugaacauguacaagcagcugggcuacagcguguacagaaccgugaucgaguacuacagcgccagcaacggcgagcccgacgaggacgccuacgacaugagaaaggcccugagcagagacaccgagaagaagagcaucaucccccugccccaccccgugagacccgaggacaucgaguaa

SEQ ID NO: 20285 - RNA, 2919 nt, Artificial Sequence
  NAA25__Homo_sapiens__NP_079229
auggccaccagaggccacgugcaggaccccaacgacagaagacugagacccaucuacgacuaccuggacaacggcaacaacaagauggccauccagcaggccgacaagcugcugaagaagcacaaggaccugcacugcgccaaggugcugaaggccaucggccugcagagaaccggcaagcaggaggaggccuucacccuggcccaggagguggccgcccuggagcccaccgacgacaacagccugcaggcccugaccauccuguacagagagaugcacagacccgagcuggugaccaagcuguacgaggccgccgugaagaaggugcccaacagcgaggaguaccacagccaccuguucauggccuacgccagagugggcgaguacaagaagaugcagcaggccggcauggcccuguacaagaucgugcccaagaaccccuacuacuucuggagcgugaugagccugaucaugcagagcaucagcgcccaggacgagaaccugagcaagaccauguuccugccccuggccgagagaaugguggagaagauggugaaggaggacaagaucgaggccgaggccgagguggagcuguacuacaugauccuggagagacugggcaaguaccaggaggcccuggacgugaucagaggcaagcugggcgagaagcugaccagcgagauccagagcagagagaacaagugcauggccauguacaagaagcugagcagauggcccgagugcaacgcccugagcagaagacugcugcugaagaacagcgacgacuggcaguucuaccugaccuacuucgacagcguguucagacugaucgaggaggccuggagcccccccgccgagggcgagcacagccuggagggcgaggugcacuacagcgccgagaaggccgugaaguucaucgaggacagaaucaccgaggagagcaagagcagcagacaccugagaggcccccaccuggccaagcuggagcugaucagaagacugagaagccagggcugcaacgacgaguacaagcugggcgaccccgaggagcugauguuccaguacuucaagaaguucggcgacaagcccugcugcuucaccgaccugaagguguucguggaccugcugcccgccacccagugcaccaaguucaucaaccagcugcugggcguggugccccugagcacccccaccgaggacaagcuggcccugcccgccgacaucagagcccugcagcagcaccugugcguggugcagcugaccagacugcugggccuguaccacaccauggacaagaaccagaagcugagcguggugagagagcugaugcugagauaccagcacggccuggaguucggcaagaccugccugaagaccgagcugcaguucagcgacuacuacugccugcuggccgugcacgcccugaucgacguguggagagagaccggcgacgagaccaccguguggcaggcccugacccugcuggaggagggccugacccacagccccagcaacgcccaguucaagcugcugcuggugagaaucuacugcaugcugggcgccuucgagcccgugguggaccuguacagcagccuggacgccaagcacauccagcacgacaccaucggcuaccugcugaccagauacgccgagagccugggccaguacgccgccgccagccagagcugcaacuucgcccugagauucuuccacagcaaccagaaggacaccagcgaguacaucauccaggccuacaaguacggcgccuucgagaagauccccgaguucaucgccuucagaaacagacugaacaacagccugcacuucgcccaggugagaaccgagagaaugcugcuggaccugcugcuggaggccaacaucagcaccagccuggccgagagcaucaagagcaugaaccugagacccgaggaggacgacauccccugggaggaccugagagacaacagagaccugaacguguucuucagcugggaccccaaggacagagacgugagcgaggagcacaagaagcugagccuggaggaggagacccuguggcugagaaucagaagccugacccugagacugaucagcggccugcccagccugaaccaccccguggagcccaagaacagcgagaagaccgccgagaacggcgugagcagcagaaucgacauccugagacugcugcugcagcagcuggaggccacccuggagaccggcaagagauucaucgagaaggacauccaguaccccuuccugggccccgugcccaccagaaugggcggcuucuucaacagcggcugcagccagugccagaucagcagcuucuaccuggugaacgacaucuacgagcuggacaccagcggccuggaggacaccauggagauccaggagagaaucgagaacagcuucaagagccugcuggaccagcugaaggacguguucagcaagugcaagggcgaccugcuggaggugaaggacggcaaccugaagacccaccccacccugcuggagaaccugguguucuucguggagaccaucagcgugauccugugggugagcagcuacugcgagagcgugcugagacccuacaagcugaaccugcagaagaagaagaagaagaagaaggagaccagcaucaucaugccccccguguucaccagcuuccaggacuacgugaccggccugcagacccugaucagcaacgugguggaccacaucaagggccuggagacccaccugaucgcccugaagcuggaggagcugauccuggaggacaccagccugagccccgaggagagaaaguucagcaagaccgugcagggcaaggugcagagcagcuaccugcacagccugcuggagaugggcgagcugcugaagaagagacuggagaccaccaagaagcugaagaucuaa

SEQ ID NO: 20286 - RNA, 1089 nt, Artificial Sequence
  NAA30__Homo_sapiens__NP_001011713
auggccgaggugccccccggccccagcagccugcugcccccccccgccccccccgcccccgccgccguggagcccagaugccccuuccccgccggcgccgcccuggccugcugcagcgaggacgaggaggacgacgaggagcacgagggcggcggcagcagaagccccgccggcggcgagagcgccaccguggccgccaagggccaccccugccugagaugcccccagcccccccaggagcagcagcagcugaacggccugaucagccccgagcugagacaccugagagccgccgccagccugaagagcaaggugcugagcguggccgagguggccgccaccaccgccacccccgacggcggccccagagccaccgccaccaagggcgccggcgugcacagcggcgagagacccccccacagccugagcagcaacgccagaaccgccgugcccagccccguggaggccgccgccgccagcgaccccgccgccgccagaaacggccuggccgagggcaccgagcaggaggaggaggaggaggacgagcaggugagacugcugagcagcagccugaccgccgacugcagccugagaagccccagcggcagagagguggagcccggcgaggacagaaccaucagauacgugagauacgagagcgagcugcagaugcccgacaucaugagacugaucaccaaggaccugagcgagcccuacagcaucuacaccuacagauacuucauccacaacuggccccagcugugcuuccuggccauggugggcgaggagugcgugggcgccaucgugugcaagcuggacaugcacaagaagauguucagaagaggcuacaucgccaugcuggccguggacagcaaguacagaagaaacggcaucggcaccaaccuggugaagaaggccaucuacgccaugguggagggcgacugcgacgagguggugcuggagaccgagaucaccaacaagagcgcccugaagcuguacgagaaccugggcuucgugagagacaagagacuguucagauacuaccugaacggcguggacgcccugagacugaagcuguggcugagauaa

SEQ ID NO: 20287 - RNA, 2178 nt, Artificial Sequence
  NAA35__Homo_sapiens__NP_078911
auggugaugaaggccagcguggacgacgacgacagcggcugggagcugagcaugcccgagaagauggagaagagcaacaccaacuggguggacaucacccaggacuucgaggaggccugcagagagcugaagcugggcgagcugcugcacgacaagcuguucggccuguucgaggccaugagcgccaucgagaugauggaccccaagauggacgccggcaugaucggcaaccaggugaacagaaaggugcugaacuucgagcaggccaucaaggacggcaccaucaagaucaaggaccugacccugcccgagcugaucggcaucauggacaccugcuucugcugccugaucaccuggcuggagggccacagccuggcccagaccguguucaccugccuguacauccacaaccccgacuucaucgaggaccccgccaugaaggccuucgcccugggcauccugaagaucugcgacaucgccagagagaaggugaacaaggccgccguguucgaggaggaggacuuccagagcaugaccuacggcuucaagauggccaacagcgugaccgaccugagagugaccggcaugcugaaggacguggaggacgacaugcagagaagagugaagagcaccagaagcagacagggcgaggagagagaccccgagguggagcuggagcaccagcagugccuggccguguucagcagagugaaguucaccagagugcugcugaccgugcugaucgccuucaccaagaaggagaccagcgccguggccgaggcccagaagcugauggugcaggccgccgaccugcugagcgccauccacaacagccugcaccacggcauccaggcccagaacgacaccaccaagggcgaccaccccaucaugaugggcuucgagccccuggugaaccagagacugcugccccccaccuuccccagauacgccaagaucaucaagagagaggagauggugaacuacuucgccagacugaucgacagaaucaagaccgugugcgagguggugaaccugaccaaccugcacugcauccuggacuucuucugcgaguucagcgagcagagccccugcgugcugagcagaagccugcugcagaccaccuuccugguggacaacaagaagguguucggcacccaccugaugcaggacauggugaaggacgcccugagaagcuucgugagcccccccgugcugagccccaagugcuaccuguacaacaaccaccaggccaaggacugcaucgacagcuucgugacccacugcgugagacccuucugcagccugauccagauccacggccacaacagagccagacagagagacaagcugggccacauccuggaggaguucgccacccugcaggacgaggccgagaagguggacgccgcccugcacaccaugcugcugaagcaggagccccagagacagcaccuggccugccugggcaccugggugcuguaccacaaccugagaaucaugauccaguaccugcugagcggcuucgagcuggagcuguacagcaugcacgaguacuacuacaucuacugguaccugagcgaguuccuguacgccuggcugaugagcacccugagcagagccgacggcagccagauggccgaggagagaaucauggaggagcagcagaagggcagaagcagcaagaagaccaagaagaagaagaaggugagaccccugagcagagagaucaccaugagccaggccuaccagaacaugugcgccggcauguucaagaccaugguggccuucgacauggacggcaaggugagaaagcccaaguucgagcuggacagcgagcaggugagauacgagcacagauucgcccccuucaacagcgugaugacccccccccccgugcacuaccugcaguucaaggagaugagcgaccugaacaaguacagcccccccccccagagccccgagcuguacguggccgccagcaagcacuuccagcaggccaagaugauccuggagaacauccccaaccccgaccacgaggugaacagaauccugaagguggccaagcccaacuucguggugaugaagcugcuggccggcggccacaagaaggagagcaaggugccccccgaguucgacuucagcgcccacaaguacuuccccguggugaagcugguguaa

SEQ ID NO: 20288 - RNA, 651 nt, Artificial Sequence
  NAA40__Homo_sapiens__NP_001287729
auggacgccgugugcgccaagguggacgccgccaacagacugggcgacccccuggaggccuuccccguguucaagaaguacgacagaaacggccugaacgugagcaucgagugcaagagagugagcggccuggagcccgccaccguggacugggccuucgaccugaccaagaccaacaugcagaccauguacgagcagagcgaguggggcuggaaggacagagagaagagagaggagaugaccgacgacagagccugguaccugaucgccugggagaacagcagcgugcccguggccuucagccacuucagauucgacguggagugcggcgacgaggugcuguacugcuacgaggugcagcuggagagcaaggugagaagaaagggccugggcaaguuccugauccagauccugcagcugauggccaacagcacccagaugaagaaggugaugcugaccguguucaagcacaaccacggcgccuaccaguucuucagagaggcccugcaguucgagaucgacgacagcagccccagcaugagcggcugcugcggcgaggacugcagcuacgagauccugagcagaagaaccaaguucggcgacagccaccacagccacgccggcggccacugcggcggcugcugccacuaa

SEQ ID NO: 20289 - RNA, 510 nt, Artificial Sequence
  NAA50__Homo_sapiens__NP_079422
augaagggcagcagaaucgagcugggcgacgugaccccccacaacaucaagcagcugaagagacugaaccaggugaucuuccccgugagcuacaacgacaaguucuacaaggacgugcuggaggugggcgagcuggccaagcuggccuacuucaacgacaucgccgugggcgccgugugcugcagaguggaccacagccagaaccagaagagacuguacaucaugacccugggcugccuggcccccuacagaagacugggcaucggcaccaagaugcugaaccacgugcugaacaucugcgagaaggacggcaccuucgacaacaucuaccugcacgugcagaucagcaacgagagcgccaucgacuucuacagaaaguucggcuucgagaucaucgagaccaagaagaacuacuacaagagaaucgagcccgccgacgcccacgugcugcagaagaaccugaaggugcccagcggccagaacgccgacgugcagaagaccgacaacuaa

SEQ ID NO: 20290 - RNA, 729 nt, Artificial Sequence
  NAA60__Homo_sapiens__NP_001077069
augaccgagguggugcccagcagcgcccugagcgaggugagccugagacugcugugccacgacgacaucgacaccgugaagcaccugugcggcgacugguuccccaucgaguaccccgacagcugguacagagacaucaccagcaacaagaaguucuucagccuggccgccaccuacagaggcgccaucgugggcaugaucguggccgagaucaagaacagaaccaagauccacaaggaggacggcgacauccuggccagcaacuucagcguggacacccagguggccuacauccugagccugggcguggugaaggaguucagaaagcacggcaucggcagccugcugcuggagagccugaaggaccacaucagcaccaccgcccaggaccacugcaaggccaucuaccugcacgugcugaccaccaacaacaccgccaucaacuucuacgagaacagagacuucaagcagcaccacuaccugcccuacuacuacagcaucagaggcgugcugaaggacggcuucaccuacgugcuguacaucaacggcggccacccccccuggaccauccuggacuacauccagcaccugggcagcgcccuggccagccugagccccugcagcaucccccacagaguguacagacaggcccacagccugcugugcagcuuccugcccuggagcggcaucagcagcaagagcggcaucgaguacagcagaaccauguaa

SEQ ID NO: 20291 - RNA, 972 nt, Artificial Sequence
  NAAA__Homo_sapiens__NP_001035861
augagaaccgccgacagagaggccagacccggccugcccagccugcugcugcugcugcuggccggcgccggccugagcgccgccagcccccccgccgcccccagauucaacgugagccuggacagcgugcccgagcugagauggcugcccgugcugagacacuacgaccuggaccuggugagagccgccauggcccaggugaucggcgacagagugcccaagugggugcacgugcugaucggcaagguggugcuggagcuggagagauuccugccccagcccuucaccggcgagaucagaggcaugugcgacuucaugaaccugagccuggccgacugccugcuggugaaccuggccuacgagagcagcguguucugcaccagcaucguggcccaggacagcagaggccacaucuaccacggcagaaaccuggacuaccccuucggcaacgugcugagaaagcugaccguggacgugcaguuccugaagaacggccagaucgccuucaccggcaccaccuucaucggcuacgugggccuguggaccggccagagcccccacaaguucaccgugagcggcgacgagagagacaagggcugguggugggagaacgccaucgccgcccuguucagaagacacauccccgugagcuggcugaucagagccacccugagcgagagcgagaacuucgaggccgccgugggcaagcuggccaagaccccccugaucgccgacguguacuacaucgugggcggcaccagccccagagagggcguggugaucaccagaaacagagacggccccgccgacaucuggccccuggacccccugaacggcgccugguucagaguggagaccaacuacgaccacuggaagcccgcccccaaggaggacgacagaagaaccagcgccaucaaggcccugaacgccaccggccaggccaaccugagccuggaggcccuguuccaguaa

SEQ ID NO: 20292 - RNA, 2328 nt, Artificial Sequence
  NAALAD2__Homo_sapiens__XP_011540854
auggccuuccaggacugcagaugcagacugcagagaagacagagcuaccugagccccgaggccagagagugcagcagaagacccaagcugggcccccaggaggccauggccgagagcagaggcagacuguaccuguggaugugccuggccgccgcccuggccagcuuccugaugggcuucauggugggcugguucaucaagccccugaaggagaccaccaccagcgugagauaccaccagagcaucagauggaagcuggugagcgagaugaaggccgagaacaucaagagcuuccugagaagcuucaccaagcugccccaccuggccggcaccgagcagaacuuccugcuggccaagaagauccagacccaguggaagaaguucggccuggacagcgccaagcuggugcacuacgacgugcugcugagcuaccccaacgagaccaacgccaacuacaucagcaucguggacgagcacgagaccgagaucuucaagaccagcuaccuggagcccccccccgacggcuacgagaacgugaccaacaucgugccccccuacaacgccuucagcgcccagggcaugcccgagggcgaccugguguacgugaacuacgccagaaccgaggacuucuucaagcuggagagagagaugggcaucaacugcaccggcaagaucgugaucgccagauacggcaagaucuucagaggcaacaaggugaagaacgccaugcuggccggcgccaucggcaucauccuguacagcgaccccgccgacuacuucgcccccgaggugcagcccuaccccaagggcuggaaccugcccggcaccgccgcccagagaggcaacgugcugaaccugaacggcgccggcgacccccugacccccggcuaccccgccaaggaguacaccuucagacuggacguggaggagggcgugggcauccccagaauccccgugcaccccaucggcuacaacgacgccgagauccugcugagauaccugggcggcaucgccccccccgacaagagcuggaagggcgcccugaacgugagcuacagcaucggccccggcuucaccggcagcgacagcuucagaaaggugagaaugcacguguacaacaucaacaagaucaccagaaucuacaacguggugggcaccaucagaggcagcguggagcccgacagauacgugauccugggcggccacagagacagcuggguguucggcgccaucgaccccaccagcggcguggccgugcugcaggagaucgccagaagcuucggcaagcugaugagcaagggcuggagacccagaagaaccaucaucuucgccagcugggacgccgaggaguucggccugcugggcagcaccgagugggccgaggagaacgugaagauccugcaggagagaagcaucgccuacaucaacagcgacagcagcaucgagggcaacuacacccugagaguggacugcaccccccugcuguaccagcugguguacaagcugaccaaggagauccccagccccgacgacggcuucgagagcaagagccuguacgagagcuggcuggagaaggaccccagccccgagaacaagaaccugcccagaaucaacaagcugggcagcggcagcgacuucgaggccuacuuccagagacugggcaucgccagcggcagagccagauacaccaagaacaagaagaccgacaaguacagcagcuaccccguguaccacaccaucuacgagaccuucgagcugguggagaaguucuacgaccccaccuucaagaagcagcugagcguggcccagcugagaggcgcccugguguacgagcugguggacagcaagaucauccccuucaacauccaggacuacgccgaggcccugaagaacuacgccgccagcaucuacaaccugagcaagaagcacgaccagcagcugaccgaccacggcgugagcuucgacagccuguucagcgccgugaagaacuucagcgaggccgccagcgacuuccacaagagacugauccagguggaccugaacaaccccaucgccgugagaaugaugaacgaccagcugaugcugcuggagagagccuucaucgacccccugggccugcccggcaagcuguucuacagacacaucaucuucgcccccagcagccacaacaaguacgccggcgagagcuuccccggcaucuacgacgccaucuucgacaucgagaacaaggccaacagcagacuggccuggaaggaggugaagaagcacaucagcaucgccgccuucaccauccaggccgccgccggcacccugaaggaggugcuguaa

SEQ ID NO: 20293 - RNA, 2223 nt, Artificial Sequence
  NAALADL1__Homo_sapiens__NP_005459
augcaguggaccaaggugcugggccugggccugggcgccgccgcccugcugggccugggcaucauccugggccacuucgccauccccaagaaggccaacagccuggccccccaggaccuggaccuggagauccuggagaccgugaugggccagcuggacgcccacagaaucagagagaaccugagagagcugagcagagagccccaccuggccagcagccccagagacgaggaccuggugcagcugcugcugcagagauggaaggaccccgagagcggccuggacagcgccgaggccagcaccuacgaggugcugcugagcuuccccagccaggagcagcccaacgugguggacaucgugggccccaccggcggcaucauccacagcugccacagaaccgaggagaacgugaccggcgagcagggcggccccgacguggugcagcccuacgccgccuacgcccccagcggcaccccccagggccugcugguguacgccaacagaggcgccgaggaggacuucaaggagcugcagacccagggcaucaagcuggagggcaccaucgcccugaccagauacggcggcgugggcagaggcgccaaggccgugaacgccgccaagcacggcguggccggcgugcugguguacaccgaccccgccgacaucaacgacggccugagcagccccgacgagaccuuccccaacagcugguaccugccccccagcggcguggagagaggcagcuacuacgaguacuucggcgacccccugacccccuaccugcccgccgugcccagcagcuucagaguggaccuggccaacgugagcggcuucccccccauccccacccagcccaucggcuuccaggacgccagagaccugcugugcaaccugaacggcacccuggcccccgccaccuggcagggcgcccugggcugccacuacagacugggccccggcuucagacccgacggcgacuuccccgccgacagccaggugaacgugagcguguacaacagacuggagcugagaaacagcagcaacgugcugggcaucaucagaggcgccguggagcccgacagauacgugcuguacggcaaccacagagacagcugggugcacggcgccguggaccccagcagcggcaccgccgugcugcuggagcugagcagagugcugggcacccugcugaagaagggcaccuggagacccagaagaagcaucguguucgccagcuggggcgccgaggaguucggccugaucggcagcaccgaguucaccgaggaguucuucaacaagcugcaggagagaaccguggccuacaucaacguggacaucagcguguucgccaacgccacccugagagugcagggcaccccccccgugcagagcgugguguucagcgccaccaaggagaucagaagccccggccccggcgaccugagcaucuacgacaacuggaucagauacuucaacagaagcagccccguguacggccuggugcccagccugggcagccugggcgccggcagcgacuacgcccccuucgugcacuuccugggcaucagcagcauggacaucgccuacaccuacgacagaagcaagaccagcgccagaaucuaccccaccuaccacaccgccuucgacaccuucgacuacguggacaaguuccuggaccccggcuucagcagccaccaggccguggccagaaccgccggcagcgugauccugagacugagcgacagcuucuuccugccccugaaggugagcgacuacagcgagacccugagaagcuuccugcaggccgcccagcaggaccugggcgcccugcuggagcagcacagcaucagccugggcccccuggugaccgccguggagaaguucgaggccgaggccgccgcccugggccagagaaucagcacccugcagaagggcagccccgacccccugcaggugagaaugcugaacgaccagcugaugcugcuggagagaaccuuccugaaccccagagccuuccccgaggagagauacuacagccacgugcugugggcccccagaaccggcagcguggugaccuuccccggccugagcaacgccugcagcagagccagagacaccgccagcggcagcgaggccugggccgaggugcagagacagcugagcaucguggugaccgcccuggagggcgccgccgccacccugagacccguggccgaccuguaa

SEQ ID NO: 20294 - RNA, 2388 nt, Artificial Sequence
  NAALADL2__Homo_sapiens__NP_996898
augggcgagaacgaggccagccugcccaacaccagccugcagggcaagaagauggccuaccagaaggugcacgccgaccagagagcccccggccacagccaguaccuggacaacgacgaccugcaggccaccgcccuggaccuggagugggacauggagaaggagcuggaggagagcggcuucgaccaguuccagcuggacggcgccgagaaccagaaccugggccacagcgagaccaucgaccugaaccuggacagcauccagcccgccaccagccccaagggcagauuccagagacugcaggaggagagcgacuacaucacccacuacaccagaagcgcccccaagagcaacagaugcaacuucugccacgugcugaagauccugugcaccgccaccauccuguucaucuucggcauccugaucggcuacuacgugcacaccaacugccccagcgacgcccccagcagcggcaccguggacccccagcuguaccaggagauccugaagaccauccaggccgaggacaucaagaagagcuucagaaaccuggugcagcuguacaagaacgaggacgacauggagaucagcaagaagaucaagacccaguggaccagccugggccuggaggacgugcaguucgugaacuacagcgugcugcuggaccugcccggccccagccccagcaccgugacccugagcagcagcggccagugcuuccaccccaacggccagcccugcagcgaggaggccagaaaggacagcagccaggaccugcuguacagcuacgccgccuacagcgccaagggcacccugaaggccgaggugaucgacgugagcuacggcauggccgacgaccugaagagaaucagaaagaucaagaacgugaccaaccagaucgcccugcugaagcugggcaagcugccccugcuguacaagcugagcagccuggagaaggccggcuucggcggcgugcugcuguacaucgaccccugcgaccugcccaagaccgugaaccccagccacgacaccuucauggugagccugaaccccggcggcgaccccagcacccccggcuaccccagcguggacgagagcuucagacagagcagaagcaaccugaccagccugcuggugcagcccaucagcgccccccugguggccaagcugaucagcagccccaaggccagaaccaagaacgaggccugcagcagccuggagcugcccaacaacgagaucagaguggugagcaugcaggugcagaccgugaccaagcugaagaccgugaccaacguggugggcuucgugaugggccugaccagccccgacagauacaucaucgugggcagccaccaccacaccgcccacagcuacaacggccaggagugggccagcagcaccgccaucaucaccgccuucaucagagcccugaugagcaaggugaagagaggcuggagacccgacagaaccaucguguucugcagcuggggcggcaccgccuucggcaacaucggcagcuacgaguggggcgaggacuucaagaaggugcugcagaagaacgugguggccuacaucagccugcacagccccaucagaggcaacagcagccuguaccccguggccagccccagccugcagcagcuggugguggagaagaacaacuucaacugcaccagaagagcccagugccccgagaccaacaucagcagcauccagauccagggcgacgccgacuacuucaucaaccaccugggcgugcccaucgugcaguucgccuacgaggacaucaagacccuggagggccccagcuuccugagcgaggccagauucagcaccagagccaccaagaucgaggagauggaccccagcuucaaccugcacgagaccaucaccaagcugagcggcgaggugauccugcagaucgccaacgagcccgugcugcccuucaacgcccuggacaucgcccuggaggugcagaacaaccugaagggcgaccagcccaacacccaccagcugcuggccauggcccugagacugagagagagcgccgagcuguuccagagcgacgagaugagacccgccaacgaccccaaggagagagcccccaucagaaucagaaugcugaacgacauccugcaggacauggagaagagcuuccuggugaagcaggccccccccggcuucuacagaaacauccuguaccaccuggacgagaagaccagcagauucagcauccugaucgaggccugggagcacugcaagccccuggccagcaacgagacccugcaggaggcccugagcgaggugcugaacagcaucaacagcgcccagguguacuucaaggccggccuggacguguucaagagcgugcuggacggcaagaacuaa

SEQ ID NO: 20295 - RNA, 1464 nt, Artificial Sequence
  NAB1__Homo_sapiens__NP_005957
auggccgccgcccugcccagaacccugggcgagcugcagcuguacagaauccugcagaaggccaaccugcugagcuacuucgacgccuucauccagcagggcggcgacgacgugcagcagcugugcgaggccggcgaggaggaguuccuggagaucauggcccuggugggcauggccagcaagccccugcacgugagaagacugcagaaggcccugagagacugggugaccaaccccggccuguucaaccagccccugaccagccugcccgugagcagcauccccaucuacaagcugcccgagggcagccccaccuggcugggcaucagcugcagcagcuacgagagaagcagcaacgccagagagccccaccugaagauccccaagugcgccgccaccaccugcgugcagagccugggccagggcaagagcgacguggugggcagccuggcccugcagagcgugggcgagagcagacuguggcagggccaccacgccaccgagagcgagcacagccugagccccgccgaccugggcagccccgccagccccaaggagagcagcgaggcccuggacgccgccgccgcccugagcguggccgagugcguggagagaauggcccccacccugcccaagagcgaccugaacgaggugaaggagcugcugaagaccaacaagaagcuggccaagaugaucggccacaucuucgagaugaacgacgacgacccccacaaggaggaggagaucagaaaguacagcgccaucuacggcagauucgacagcaagagaaaggacggcaagcaccugacccugcacgagcugaccgugaacgaggccgccgcccagcugugcgugaaggacaacgcccugcugaccagaagagacgagcuguucgcccuggccagacagaucagcagagaggugaccuacaaguacaccuacagaaccaccaagagcaagugcggcgagagagacgagcugagccccaagagaaucaagguggaggacggcuuccccgacuuccaggacagcgugcagacccuguuccagcaggccagagccaagagcgaggagcuggccgcccugagcagccagcagcccgagaaggugauggccaagcagauggaguuccugugcaaccaggccggcuacgagagacugcagcacgccgagagaagacugagcgccggccuguacagacagagcagcgaggagcacagccccaacggccugaccagcgacaacagcgacggccagggcgagagaccccugaaccugagaaugcccaaccugcagaacagacagccccaccacuucgugguggacggcgagcugagcagacuguaccccagcgaggccaagagccacagcagcgagagccugggcauccugaaggacuacccccacagcgccuucacccuggagaagaaggugaucaagaccgagcccgaggacagcagauaa

SEQ ID NO: 20296 - RNA, 1578 nt, Artificial Sequence
  NAB2__Homo_sapiens__NP_005958
augcacagagcccccagccccaccgccgagcagccccccggcggcggcgacagcgccagaagaacccugcagcccagacugaagcccagcgccagagccauggcccugcccagaacccugggcgagcugcagcuguacagagugcugcagagagccaaccugcugagcuacuacgagaccuucauccagcagggcggcgacgacgugcagcagcugugcgaggccggcgaggaggaguuccuggagaucauggcccuggugggcauggccaccaagccccugcacgugagaagacugcagaaggcccugagagagugggccaccaaccccggccuguucagccagcccgugcccgccgugcccgugagcagcaucccccuguucaagaucagcgagaccgccggcaccagaaagggcagcaugagcaacggccacggcagccccggcgagaaggccggcagcgccagaagcuucagccccaagagcccccuggagcugggcgagaagcugagcccccugcccggcggccccggcgccggcgaccccagaaucuggcccggcagaagcacccccgagagcgacgugggcgccggcggcgaggaggaggccggcagcccccccuucagcccccccgccggcggcggcgugcccgagggcaccggcgccggcggccuggccgccggcggcaccggcggcggccccgacagacuggagcccgagauggugagaauggugguggagagcguggagagaaucuucagaagcuuccccagaggcgacgccggcgaggugaccagccugcugaagcugaacaagaagcuggccagaagcgugggccacaucuucgagauggacgacaacgacagccagaaggaggaggagaucagaaaguacagcaucaucuacggcagauucgacagcaagagaagagagggcaagcagcugagccugcacgagcugaccaucaacgaggccgccgcccaguucugcaugagagacaacacccugcugcugagaagaguggagcuguucagccugagcagacagguggccagagagagcaccuaccugagcagccugaagggcagcagacugcaccccgaggagcugggcggccccccccugaagaagcugaagcaggaggugggcgagcagagccaccccgagauccagcagcccccccccggccccgagagcuacgugccccccuacagacccagccuggaggaggacagcgccagccugagcggcgagagccuggacggccaccugcaggccgugggcagcugccccagacugacccccccccccgccgaccugccccuggcccugcccgcccacggccuguggagcagacacauccugcagcagacccugauggacgagggccugagacuggccagacuggugagccacgacagagugggcagacugagccccugcgugcccgccaagcccccccuggccgaguucgaggagggccugcuggacagaugccccgcccccggcccccaccccgcccugguggagggcagaagaagcagcgugaagguggaggccgaggccagcagacaguaa

SEQ ID NO: 20297 - RNA, 615 nt, Artificial Sequence
  NABP1__Homo_sapiens__NP_001026886
augaacagagugaacgacccccugaucuucaucagagacaucaagcccggccugaagaaccugaacgugguguucaucgugcuggagaucggcagagugaccaagaccaaggacggccacgaggugagaagcugcaagguggccgacaagaccggcagcaucaccaucagcgugugggacgagaucggcggccugauccagcccggcgacaucaucagacugaccagaggcuacgccagcauguggaagggcugccugacccuguacaccggcagaggcggcgagcugcagaagaucggcgaguucugcaugguguacagcgaggugcccaacuucagcgagcccaaccccgacuacagaggccagcagaacaagggcgcccagagcgagcagaagaacaacagcaugaacagcaacaugggcaccggcaccuucggccccgugggcaacggcgugcacaccggccccgagagcagagagcaccaguucagccacgccggcagaagcaacggcagaggccugaucaacccccagcugcagggcaccgccagcaaccagaccgugaugaccaccaucagcaacggcagagaccccagaagagccuucaagagauaa

SEQ ID NO: 20298 - RNA, 636 nt, Artificial Sequence
  NABP2__Homo_sapiens__NP_076973
augaccaccgagaccuucgugaaggacaucaagcccggccugaagaaccugaaccugaucuucaucgugcuggagaccggcagagugaccaagaccaaggacggccacgaggugagaaccugcaagguggccgacaagaccggcagcaucaacaucagcgugugggacgacgugggcaaccugauccagcccggcgacaucaucagacugaccaagggcuacgccagcguguucaagggcugccugacccuguacaccggcagaggcggcgaccugcagaagaucggcgaguucugcaugguguacagcgaggugcccaacuucagcgagcccaaccccgaguacagcacccagcaggcccccaacaaggccgugcagaacgacagcaaccccagcgccagccagcccaccaccggccccagcgccgccagccccgccagcgagaaccagaacggcaacggccugagcgccccccccggccccggcggcggcccccaccccccccacacccccagccacccccccagcaccagaaucaccagaagccagcccaaccacacccccgccggcccccccggccccagcagcaaccccgugagcaacggcaaggagaccagaagaagcagcaagagauaa

SEQ ID NO: 20299 - RNA, 2778 nt, Artificial Sequence
  NACA__Homo_sapiens__NP_001106674
augcccggcgaggccaccgagaccgugcccgccaccgagcaggagcugccccagccccaggccgagaccgccgugcugcccaugagcagcgcccugagcgugaccgccgcccugggccagcccggccccacccugcccccccccugcagccccgccccccagcagugcccccugagcgccgccaaccaggccagccccuuccccagccccagcaccaucgccagcaccccccuggaggugcccuucccccagagcagcagcggcaccgcccugccccugggcaccgcccccgaggcccccaccuuccugcccaaccugaucggcccccccaucagccccgccgcccuggcccuggccagccccaugaucgcccccacccugaagggcacccccagcagcagcgccccccuggcccugguggcccuggccccccacagcgugcagaagagcagcgccuucccccccaaccugcugaccagcccccccagcguggccguggccgagagcggcagcgugaucacccugagcgcccccaucgcccccagcgagcccaagaccaaccugaacaaggugcccagcgagguggugcccaaccccaagggcacccccagcccccccugcaucgugagcaccgugcccuaccacugcgugacccccauggccagcauccagagcggcguggccagccugccccagaccacccccaccaccacccuggccaucgccagcccccaggugaaggacaccaccaucagcagcgugcugaucagcccccagaaccccggcagccugagccugaagggccccgugagcccccccgccgcccugagccugagcacccagagccugcccguggugaccagcagccagaagaccgccggccccaacaccccccccgacuuccccaucagccugggcagccaccuggccccccugcaccagagcagcuucggcagcgugcagcugcugggccagaccggccccagcgcccugagcgaccccaccgugaagaccaucagcguggaccacagcagcaccggcgccagcuaccccagccagagaagcgugauccccccccugcccagcagaaacgagguggugcccgccaccguggccgccuuccccgugguggcccccagcguggacaagggccccagcaccaucagcagcaucaccugcagccccagcggcagccugaacguggccaccagcuucagccugagccccaccaccagccugauccugaagagcagccccaacgccaccuaccacuacccccugguggcccagaugcccgugagcagcgugggcaccaccccccugguggugaccaaccccugcaccaucgccgccgcccccaccaccaccuucgagguggccaccugcgugagcccccccaugagcagcggccccaucagcaacaucgagcccaccagccccgccgcccuggugauggcccccguggcccccaaggagcccagcacccagguggccaccacccugagaauccccgugagccccccccugcccgaccccgaggaccugaagaaccugcccagcagcgugcuggugaaguuccccacccagaaggaccugcagaccgugcccgccagccuggagggcgcccccuucagccccgcccaggccggccugaccaccaagaaggaccccaccgugcugccccuggugcaggccgcccccaagaacagccccagcuuccagagcaccagcagcagccccgagaucccccugagccccgaggccacccuggccaagaagagccugggcgagccccugcccaucguggccgccuucccccuggagagcgccgaccccgccggcguggcccccaccaccgccaaggccgccgccuucgagaaggugcugcccaagcccgagagcgccagcgugagcgccgcccccagcccccccgugagccugccccuggcccccagccccgugcccacccugccccccaagcagcaguuccugcccagcagccccggccuggugcuggagagccccagcaagccccuggcccccgccgacgaggacgagcugcugccccugaucccccccgagcccaucagcggcggcgugcccuuccagagcgugcuggugaacaugcccacccccaagagcgccggcauccccgugcccacccccagcgccaagcagcccgugaccaagaacaacaagggcagcggcaccgagagcgacagcgacgagagcgugcccgagcuggaggagcaggacagcacccaggccaccacccagcaggcccagcuggccgccgccgccgagaucgacgaggagcccgugagcaaggccaagcagagcagaagcgagaagaaggccagaaaggccaugagcaagcugggccugagacaggugaccggcgugaccagagugaccaucagaaagagcaagaacauccuguucgugaucaccaagcccgacguguacaagagccccgccagcgacaccuacaucguguucggcgaggccaagaucgaggaccugagccagcaggcccagcuggccgccgccgagaaguucaaggugcagggcgaggccgugagcaacauccaggagaacacccagacccccaccgugcaggaggagagcgaggaggaggagguggacgagaccggcguggaggugaaggacaucgagcuggugaugagccaggccaacgugagcagagccaaggccgugagagcccugaagaacaacagcaacgacaucgugaacgccaucauggagcugaccauguaa

SEQ ID NO: 20300 - RNA, 1584 nt, Artificial Sequence
  NACC1__Homo_sapiens__XP_005259778
auggcccagacccugcagauggagauccccaacuucggcaacagcauccuggagugccugaacgagcagagacugcagggccuguacugcgacgugagcgugguggugaagggccacgccuucaaggcccacagagccgugcuggccgccagcagcagcuacuucagagaccuguucaacaacagcagaagcgccgugguggagcugcccgccgccgugcagccccagagcuuccagcagauccugagcuucugcuacaccggcagacugagcaugaacgugggcgaccaguuccugcugauguacaccgccggcuuccugcagauccaggagaucauggagaagggcaccgaguucuuccugaaggugagcagccccagcugcgacagccagggccugcacgccgaggaggcccccagcagcgagccccagagccccguggcccagaccagcggcuggcccgccugcagcaccccccugccccuggugagcagagugaagaccgagcagcaggagagcgacagcgugcagugcaugcccguggccaagagacugugggacagcggccagaaggaggccggcggcggcggcaacggcagcagaaagauggccaaguucagcacccccgaccuggccgccaacagaccccaccagcccccccccccccagcaggcccccgugguggccgccgcccagcccgccguggccgccggcgccggccagcccgccggcggcguggccgccgccggcggcguggugagcggccccagcaccagcgagagaaccagccccggcaccagcagcgccuacaccagcgacagccccggcagcuaccacaacgaggaggacgaggaggaggacggcggcgaggagggcauggacgagcaguacagacagaucugcaacauguacaccauguacagcaugaugaacgugggccagaccgccgagaagguggaggcccugcccgagcagguggcccccgagagcagaaacagaaucagagugagacaggaccuggccagccugcccgccgagcugaucaaccagaucggcaacagaugccaccccaagcuguacgacgagggcgaccccagcgagaagcuggagcuggugaccggcaccaacguguacaucaccagagcccagcugaugaacugccacgugagcgccggcaccagacacaaggugcugcugagaagacugcuggccagcuucuucgacagaaacacccuggccaacagcugcggcaccggcaucagaagcagcaccaacgaccccagaagaaagccccuggacagcagagugcugcacgccgugaaguacuacugccagaacuucgcccccaacuucaaggagagcgagaugaacgccaucgccgccgacaugugcaccaacgccagaagaguggugagaaagagcuggaugcccaaggugaaggugcugaaggccgaggacgacgccuacaccaccuucaucagcgagaccggcaagaucgagcccgacaugaugggcguggagcacggcuucgagaccgccagccacgagggcgaggccggccccagcgccgaggcccugcaguaa

SEQ ID NO: 20301 - RNA, 1764 nt, Artificial Sequence
  NACC2__Homo_sapiens__XP_011516523
augagccagaugcugcacaucgagauccccaacuucggcaacaccgugcugggcugccugaacgagcagagacugcugggccuguacugcgacgugagcaucguggugaagggccaggccuucaaggcccacagagccgugcuggccgccagcagccuguacuucagagaccuguucagcggcaacagcaagagcgccuucgagcugcccggcagcgugccccccgccugcuuccagcagauccugagcuucugcuacaccggcagacugaccaugaccgccagcgagcagcugguggugauguacaccgccggcuuccugcagauccagcacaucguggagagaggcaccgaccugauguucaaggugagcagcccccacugcgacagccagaccgccgugaucgaggacgccggcagcgagccccagagccccugcaaccagcugcagcccgccgccgccgccgccgcccccuacguggugagccccagcgugcccaucccccugcugaccagagugaagcacgaggccauggagcugccccccgccggccccggccuggcccccaagagaccccuggagaccggccccagagacggcguggccguggccgccggcgccgccguggccgccggcaccgccccccugaagcugcccagagugagcuacuacggcgugcccagccuggccacccugauccccggcauccagcagaugcccuacccccagggcgagagaaccagccccggcgccagcagccugcccaccaccgacagccccaccagcuaccacaacgaggaggacgaggaggacgacgaggccuacgacaccaugguggaggagcaguacggccagauguacaucaaggccagcggcagcuacgccgugcaggagaagcccgagcccgugccccuggagagcagaagcugcgugcugaucagaagagaccugguggcccugcccgccagccugaucagccagaucggcuacagaugccaccccaagcuguacagcgagggcgaccccggcgagaagcuggagcugguggccggcagcggcguguacaucaccagaggccagcugaugaacugccaccugugcgccggcgugaagcacaaggugcugcugagaagacugcuggccaccuucuucgacagaaacacccuggccaacagcugcggcaccggcaucagaagcagcaccagcgaccccagcagaaagccccuggacagcagagugcugaacgccgugaagcuguacugccagaacuucgcccccagcuucaaggagagcgagaugaacgugaucgccgccgacaugugcaccaacgccagaagagugagaaagagauggcugcccaagaucaagagcaugcugcccgagggcguggagauguacagaaccgugaugggcagcgccgccgccagcgugccccuggaccccgaguucccccccgccgccgcccagguguucgagcagagaaucuacgccgagagaagaggcgacgccgccaccaucguggcccugagaaccgacgccgugaacguggaccugagcgccgccgccaaccccgccuucgacgccggcgaggagguggacggcgccggcagcgugauccaggagguggccgcccccgagccccugcccgccgacggccagagccccccccagcccuucgagcagggcggcggcggccccagcagaccccagacccccgccgccgccgccagaagacccgagggcaccuacgccggcacccuguaa

SEQ ID NO: 20302 - RNA, 2121 nt, Artificial Sequence
  NADSYN1__Homo_sapiens__NP_060631
augggcagaaaggugaccguggccaccugcgcccugaaccagugggcccuggacuucgagggcaaccugcagagaauccugaagagcaucgagaucgccaagaacagaggcgccagauacagacugggccccgagcuggagaucugcggcuacggcugcugggaccacuacuacgagagcgacacccugcugcacagcuuccaggugcuggccgcccugguggagagccccgugacccaggacaucaucugcgacgugggcaugcccgugaugcacagaaacgugagauacaacugcagagugaucuuccugaacagaaagauccugcugaucagacccaagauggcccuggccaacgagggcaacuacagagagcugagaugguucacccccuggagcagaagcagacacaccgaggaguacuuccugcccagaaugauccaggaccugaccaagcaggagaccgugcccuucggcgacgccgugcuggugaccugggacaccugcaucggcagcgagaucugcgaggagcuguggaccccccacagcccccacaucgacaugggccuggacggcguggagaucaucaccaacgccagcggcagccaccaggugcugagaaaggccaacaccagaguggaccuggugaccauggugaccagcaagaacggcggcaucuaccugcuggccaaccagaagggcugcgacggcgacagacuguacuacgacggcugcgccaugaucgccaugaacggcagcguguucgcccagggcagccaguucagccuggacgacguggaggugcugaccgccacccuggaccuggaggacgugagaagcuacagagccgagaucagcagcagaaaccuggccgccagcagagccagccccuaccccagagugaagguggacuucgcccugagcugccacgaggaccugcuggcccccaucagcgagcccaucgaguggaaguaccacagccccgaggaggagaucagccugggccccgccugcuggcugugggacuuccugagaagaagccagcaggccggcuuccugcugccccugagcggcggcguggacagcgccgccaccgccugccugaucuacagcaugugcugccaggugugcgaggccgugagaagcggcaacgaggaggugcuggccgacgugagaaccaucgugaaccagaucagcuacaccccccaggaccccagagaccugugcggcagaauccugaccaccugcuacauggccagcaagaacagcagccaggagaccugcaccagagccagagagcuggcccagcagaucggcagccaccacaucagccugaacaucgaccccgccgugaaggccgugaugggcaucuucagccuggugaccggcaagagcccccuguucgccgcccacggcggcagcagcagagagaaccuggcccugcagaacgugcaggccagaaucagaauggugcuggccuaccuguucgcccagcugagccuguggagcagaggcgugcacggcggccugcuggugcugggcagcgccaacguggacgagagccugcugggcuaccugaccaaguacgacugcagcagcgccgacaucaaccccaucggcggcaucagcaagaccgaccugagagccuucgugcaguucugcauccagagauuccagcugcccgcccugcagagcauccugcuggcccccgccaccgccgagcuggagccccuggccgacggccaggugagccagaccgacgaggaggacaugggcaugaccuacgccgagcugagcguguacggcaagcugagaaagguggccaagaugggccccuacagcauguucugcaagcugcugggcauguggagacacaucugcacccccagacagguggccgacaaggugaagagauucuucagcaaguacagcaugaacagacacaagaugaccacccugacccccgccuaccacgccgagaacuacagccccgaggacaacagauucgaccugagacccuuccuguacaacaccagcuggcccuggcaguucagaugcaucgagaaccaggugcugcagcuggagagagccgagccccagagccuggacggcguggacuaa

SEQ ID NO: 20303 - RNA, 1587 nt, Artificial Sequence
  NAE1__Homo_sapiens__NP_001018169
auggacgcccagcagaccaagaccaacgaggccagacuguggggcgaccacggccaggaggcccuggagagcgcccacgugugccugaucaacgccaccgccaccggcaccgagauccugaagaaccuggugcugcccggcaucggcagcuucaccaucaucgacggcaaccaggugagcggcgaggacgccggcaacaacuucuuccugcagagaagcagcaucggcaagaacagagccgaggccgccauggaguuccugcaggagcugaacagcgacgugagcggcagcuucguggaggagagccccgagaaccugcuggacaacgaccccagcuucuucugcagauucaccguggugguggccacccagcugcccgagagcaccagccugagacuggccgacgugcuguggaacagccagaucccccugcugaucugcagaaccuacggccuggugggcuacaugagaaucaucaucaaggagcaccccgugaucgagagccaccccgacaacgcccuggaggaccugagacuggacaagcccuuccccgagcugagagagcacuuccagagcuacgaccuggaccacauggagaagaaggaccacagccacacccccuggaucgugaucaucgccaaguaccuggcccagugguacagcgagaccaacggcagaauccccaagaccuacaaggagaaggaggacuucagagaccugaucagacagggcauccugaagaacgagaacggcgcccccgaggacgaggagaacuucgaggaggccaucaagaacgugaacaccgcccugaacaccacccagauccccagcagcaucgaggacaucuucaacgacgacagaugcaucaacaucaccaagcagacccccagcuucuggauccuggccagagcccugaaggaguucguggccaaggagggccagggcaaccugcccgugagaggcaccauccccgacaugaucgccgacagcggcaaguacaucaagcugcagaacguguacagagagaaggccaagaaggacgccgccgccgugggcaaccacguggccaagcugcugcagagcaucggccaggcccccgagagcaucagcgagaaggagcugaagcugcugugcagcaacagcgccuuccugagaguggugagaugcagaagccuggccgaggaguacggccuggacaccaucaacaaggacgagaucaucagcagcauggacaaccccgacaacgagaucgugcuguaccugaugcugagagccguggacagauuccacaagcagcagggcagauaccccggcgugagcaacuaccagguggaggaggacaucggcaagcugaagagcugccugaccggcuuccugcaggaguacggccugagcgugauggugaaggacgacuacgugcacgaguucugcagauacggcgccgccgagccccacaccaucgccgccuuccugggcggcgccgccgcccaggaggugaucaagaucaucaccaagcaguucgugaucuucaacaacaccuacaucuacagcggcaugagccagaccagcgccaccuuccagcuguaa

SEQ ID NO: 20304 - RNA, 1170 nt, Artificial Sequence
  NAF1__Homo_sapiens__NP_001122403
auggaggugguggaggccgccgccgcccagcuggagacccugaaguucaacggcaccgacuucggcgugggcgagggccccgccgcccccagccccggcagcgcccccgugcccggcacccagcccccccugcagagcuucgagggcagccccgacgccggccagaccguggaggugaagcccgccggcgagcagccccugcagcccgugcugaacgccguggccgccggcacccccgccccccagccccagccccccgccgagagccccgccugcggcgacugcgugaccagccccggcgccgccgagcccgccagagcccccgacagccuggagaccagcgacagcgacagcgacagcgacagcgagaccgacagcgacagcagcagcagcagcagcagcagcagcagcagcagcagcagcagcagcagcagcugcaucagccugccccccgugcugagcgacggcgacgacgaccugcagaucgagaaggagaacaagaacuucccccugaagaccaaggacgagcugcugcugaacgagcugcccagcguggaggagcugaccaucauccugcccgaggacaucgagcugaagccccugggcauggugagcagcaucaucgagcagcuggugaucaucgagagcaugaccaaccugccccccgugaacgaggagaccgugaucuucaagagcgacagacaggccgccggcaagaucuucgagaucuucggccccguggcccaccccuucuacgugcugagauucaacagcagcgaccacaucgagagcaagggcaucaagaucaaggagaccauguacuucgcccccagcaugaaggacuucacccaguacaucuucaccgagaagcugaagcaggacaagggcagcgacgccagcuggaagaacgaccaggagcccccccccgaggcccuggacuucagcgacgacgagaaggagaaggaggccaagcagagaaagaagagccagauccagggcagaaagaagcugaagagcgaguucaacgagcccggcaccggcaucagccacagauacugcggccugggcagcagaccccugcagagcagcgagagccacaagcuguucggcuuccagaugcacaucaaggugaccuucaccugcuacuucagccugcugagcaugcaguaa

SEQ ID NO: 20305 - RNA, 1236 nt, Artificial Sequence
  NAGA__Homo_sapiens__XP_005261673
augcugcugaagaccgugcugcugcugggccacguggcccaggugcugaugcuggacaacggccugcugcagaccccccccaugggcuggcuggccugggagagauucagaugcaacaucaacugcgacgaggaccccaagaacugcaucagcgagcagcuguucauggagauggccgacagaauggcccaggacggcuggagagacaugggcuacaccuaccugaacaucgacgacugcuggaucggcggcagagacgccagcggcagacugaugcccgaccccaagagauucccccacggcauccccuuccuggccgacuacgugcacagccugggccugaagcugggcaucuacgccgacaugggcaacuucaccugcaugggcuaccccggcaccacccuggacaagguggugcaggacgcccagaccuucgccgaguggaagguggacaugcugaagcuggacggcugcuucagcacccccgaggagagagcccagggcuaccccaagauggccgccgcccugaacgccaccggcagacccaucgccuucagcugcagcuggcccgccuacgagggcggccugccccccagagugaacuacagccugcuggccgacaucugcaaccuguggagaaacuacgacgacauccaggacagcugguggagcgugcugagcauccugaacugguucguggagcaccaggacauccugcagcccguggccggccccggccacuggaacgaccccgacaugcugcugaucggcaacuucggccugagccuggagcagagcagagcccagauggcccuguggaccgugcuggccgccccccugcugaugagcaccgaccugagaaccaucagcgcccagaacauggacauccugcagaacccccugaugaucaagaucaaccaggacccccugggcauccagggcagaagaauccacaaggagaagagccugaucgagguguacaugagaccccugagcaacaaggccagcgcccugguguucuucagcugcagaaccgacaugcccuacagauaccacagcagccugggccagcugaacuucaccggcagcgugaucuacgaggcccaggacguguacagcggcgacaucaucagcggccugagagacgagaccaacuucaccgugaucaucaaccccagcggcguggugaugugguaccuguaccccaucaagaaccuggagaugagccagcaguaa

SEQ ID NO: 20306 - RNA, 1173 nt, Artificial Sequence
  NAGK__Homo_sapiens__NP_060037
augagaaccagaaccggcagccagcuggccgccagagaggugaccggcagcggcgccgugcccagacagcuggagggcagaagaugccaggccggcagagacgccaacggcggcaccagcagcgacggcagcagcagcauggccgccaucuacggcggcguggagggcggcggcaccagaagcgaggugcugcuggugagcgaggacggcaagauccuggccgaggccgacggccugagcaccaaccacuggcugaucggcaccgacaagugcguggagagaaucaacgagauggugaacagagccaagagaaaggccggcguggacccccuggugccccugagaagccugggccugagccugagcggcggcgaccaggaggacgccggcagaauccugaucgaggagcugagagacagauuccccuaccugagcgagagcuaccugaucaccaccgacgccgccggcagcaucgccaccgccacccccgacggcggcguggugcugaucagcggcaccggcagcaacugcagacugaucaaccccgacggcagcgagagcggcugcggcggcuggggccacaugaugggcgacgagggcagcgccuacuggaucgcccaccaggccgugaagaucguguucgacagcaucgacaaccuggaggccgccccccacgacaucggcuacgugaagcaggccauguuccacuacuuccaggugcccgacagacugggcauccugacccaccuguacagagacuucgacaagugcagauucgccggcuucugcagaaagaucgccgagggcgcccagcagggcgacccccugagcagauacaucuucagaaaggccggcgagaugcugggcagacacaucguggccgugcugcccgagaucgaccccgugcuguuccagggcaagaucggccugcccauccugugcgugggcagcguguggaagagcugggagcugcugaaggagggcuuccugcuggcccugacccagggcagagagauccaggcccagaacuucuucagcagcuucacccugaugaagcugagacacagcagcgcccugggcggcgccagccugggcgccagacacaucggccaccugcugcccauggacuacagcgccaacgccaucgccuucuacagcuacaccuucagcuaa

SEQ ID NO: 20307 - RNA, 2232 nt, Artificial Sequence
  NAGLU__Homo_sapiens__NP_000254
auggaggccguggccguggccgccgccgugggcgugcugcugcuggccggcgccggcggcgccgccggcgacgaggccagagaggccgccgccgugagagcccugguggccagacugcugggccccggccccgccgccgacuucagcgugagcguggagagagcccuggccgccaagcccggccuggacaccuacagccugggcggcggcggcgccgccagagugagagugagaggcagcaccggcguggccgccgccgccggccugcacagauaccugagagacuucugcggcugccacguggccuggagcggcagccagcugagacugcccagaccccugcccgccgugcccggcgagcugaccgaggccacccccaacagauacagauacuaccagaacgugugcacccagagcuacagcuucguguggugggacugggccagaugggagagagagaucgacuggauggcccugaacggcaucaaccuggcccuggccuggagcggccaggaggccaucuggcagagaguguaccuggcccugggccugacccaggccgagaucaacgaguucuucaccggccccgccuuccuggccuggggcagaaugggcaaccugcacaccugggacggcccccugccccccagcuggcacaucaagcagcuguaccugcagcacagagugcuggaccagaugagaagcuucggcaugacccccgugcugcccgccuucgccggccacgugcccgaggccgugaccagaguguucccccaggugaacgugaccaagaugggcagcuggggccacuucaacugcagcuacagcugcagcuuccugcuggcccccgaggaccccaucuuccccaucaucggcagccuguuccugagagagcugaucaaggaguucggcaccgaccacaucuacggcgccgacaccuucaacgagaugcagccccccagcagcgagcccagcuaccuggccgccgccaccaccgccguguacgaggccaugaccgccguggacaccgaggccguguggcugcugcagggcuggcuguuccagcaccagccccaguucuggggccccgcccagaucagagccgugcugggcgccgugcccagaggcagacugcuggugcuggaccuguucgccgagagccagcccguguacaccagaaccgccagcuuccagggccagcccuucaucuggugcaugcugcacaacuucggcggcaaccacggccuguucggcgcccuggaggccgugaacggcggccccgaggccgccagacuguuccccaacagcaccauggugggcaccggcauggcccccgagggcaucagccagaacgaggugguguacagccugauggccgagcugggcuggagaaaggaccccgugcccgaccuggccgccugggugaccagcuucgccgccagaagauacggcgugagccaccccgacgccggcgccgccuggagacugcugcugagaagcguguacaacugcagcggcgaggccugcagaggccacaacagaagcccccuggugagaagacccagccugcagaugaacaccagcaucugguacaacagaagcgacguguucgaggccuggagacugcugcugaccagcgcccccagccuggccaccagccccgccuucagauacgaccugcuggaccugaccagacaggccgugcaggagcuggugagccuguacuacgaggaggccagaagcgccuaccugagcaaggagcuggccagccugcugagagccggcggcgugcuggccuacgagcugcugcccgcccuggacgaggugcuggccagcgacagcagauuccugcugggcagcuggcuggagcaggccagagccgccgccgugagcgaggccgaggccgacuucuacgagcagaacagcagauaccagcugacccuguggggccccgagggcaacauccuggacuacgccaacaagcagcuggccggccugguggccaacuacuacacccccagauggagacuguuccuggaggcccugguggacagcguggcccagggcauccccuuccagcagcaccaguucgacaagaacguguuccagcuggagcaggccuucgugcugagcaagcagagauaccccagccagcccagaggcgacaccguggaccuggccaagaagaucuuccugaaguacuaccccagauggguggccggcagcugguaa

SEQ ID NO: 20308 - RNA, 1548 nt, Artificial Sequence
  NAGPA__Homo_sapiens__NP_057340
auggccaccagcaccggcagauggcugcugcugagacuggcccuguucggcuuccugugggaggccagcggcggccuggacagcggcgccagcagagacgacgaccugcugcugcccuaccccagagccagagccagacugcccagagacugcaccagagugagagccggcaacagagagcacgagagcuggccccccccccccgccacccccggcgccggcggccuggccgugagaaccuucgugagccacuucagagacagagccguggccggccaccugaccagagccguggagccccugagaaccuucagcgugcuggagcccggcggccccggcggcugcgccgccagaagaagagccaccguggaggagaccgccagagccgccgacugcagaguggcccagaacggcggcuucuucagaaugaacagcggcgagugccugggcaacguggugagcgacgagagaagagugagcagcagcggcggccugcagaacgcccaguucggcaucagaagagacggcacccuggugaccggcuaccugagcgaggaggaggugcuggacaccgagaaccccuucgugcagcugcugagcggcgugguguggcugaucagaaacggcagcaucuacaucaacgagagccaggccaccgagugcgacgagacccaggagaccggcagcuucagcaaguucgugaacgugaucagcgccagaaccgccaucggccacgacagaaagggccagcuggugcuguuccacgccgacggccagaccgagcagagaggcaucaaccugugggagauggccgaguuccugcugaagcaggacguggugaacgccaucaaccuggacggcggcggcagcgccaccuucgugcugaacggcacccuggccagcuaccccagcgaccacugccaggacaacauguggagaugccccagacaggugagcaccguggugugcgugcacgagcccagaugccagccccccgacugccacggccacggcaccugcguggacggccacugccagugcaccggccacuucuggagaggccccggcugcgacgagcuggacugcggccccagcaacugcagccagcacggccugugcaccgagaccggcugcagaugcgacgccggcuggaccggcagcaacugcagcgaggagugcccccugggcuggcacggccccggcugccagagacccugcaagugcgagcaccacugccccugcgaccccaagaccggcaacugcagcgugagcagagugaagcagugccugcagccccccgaggccacccugagagccggcgagcugagcuucuucaccagaaccgccuggcuggcccugacccuggcccuggccuuccugcugcugaucagcaccgccgccaaccugagccugcugcugagcagagccgagagaaacagaagacugcacggcgacuacgccuaccacccccugcaggagaugaacggcgagccccuggccgccgagaaggagcagcccggcggcgcccacaaccccuucaaggacuaa

SEQ ID NO: 20309 - RNA, 1605 nt, Artificial Sequence
  NAGS__Homo_sapiens__NP_694551
auggccaccgcccugauggccguggugcugagagccgccgccguggcccccagacugagaggcagaggcggcaccggcggcgccagaagacugagcugcggcgccagaagaagagccgccagaggcaccagccccggcagaagacugagcaccgccuggagccagccccagcccccccccgaggaguacgccggcgccgacgacgugagccagagccccguggccgaggagcccagcugggugcccagccccagaccccccgugccccacgagagccccgagccccccagcggcagaagccuggugcagagagacauccaggccuuccugaaccagugcggcgccagccccggcgaggccagacacuggcugacccaguuccagaccugccaccacagcgccgacaagcccuucgccgugaucgagguggacgaggaggugcugaagugccagcagggcgugagcagccuggccuucgcccuggccuuccugcagagaauggacaugaagccccugguggugcugggccugcccgcccccaccgcccccagcggcugccugagcuucugggaggccaaggcccagcuggccaagagcugcaaggugcugguggacgcccugagacacaacgccgccgccgccgugcccuucuucggcggcggcagcgugcugagagccgccgagcccgccccccacgccagcuacggcggcaucgugagcguggagaccgaccugcugcaguggugccuggagagcggcagcauccccauccugugccccaucggcgagaccgccgccagaagaagcgugcugcuggacagccuggaggugaccgccagccuggccaaggcccugagacccaccaagaucaucuuccugaacaacaccggcggccugagagacagcagccacaaggugcugagcaacgugaaccugcccgccgaccuggaccuggugugcaacgccgagugggugagcaccaaggagagacagcagaugagacugaucguggacgugcugagcagacugccccaccacagcagcgccgugaucaccgccgccagcacccugcugaccgagcuguucagcaacaagggcagcggcacccuguucaagaacgccgagagaaugcugagagugagaagccuggacaagcuggaccagggcagacugguggaccuggugaacgccagcuucggcaagaagcugagagacgacuaccuggccagccugagacccagacugcacagcaucuacgugagcgagggcuacaacgccgccgccauccugaccauggagcccgugcugggcggcacccccuaccuggacaaguucguggugagcagcagcagacagggccagggcagcggccagaugcugugggagugccugagaagagaccugcagacccuguucuggagaagcagagugaccaaccccaucaaccccugguacuucaagcacagcgacggcagcuucagcaacaagcaguggaucuucuucugguucggccuggccgacaucagagacagcuacgagcuggugaaccacgccaagggccugcccgacagcuuccacaagcccgccagcgaccccggcagcuaa

SEQ ID NO: 20310 - RNA, 4212 nt, Artificial Sequence
  NAIP__Homo_sapiens__NP_004527
auggccacccagcagaaggccagcgacgagagaaucagccaguucgaccacaaccugcugcccgagcugagcgcccugcugggccuggacgccgugcagcuggccaaggagcuggaggaggaggagcagaaggagagagccaagaugcagaagggcuacaacagccagaugagaagcgaggccaagagacugaagaccuucgugaccuacgagcccuacagcagcuggaucccccaggagauggccgccgccggcuucuacuucaccggcgugaagagcggcauccagugcuucugcugcagccugauccuguucggcgccggccugaccagacugcccaucgaggaccacaagagauuccaccccgacugcggcuuccugcugaacaaggacgugggcaacaucgccaaguacgacaucagagugaagaaccugaagagcagacugagaggcggcaagaugagauaccaggaggaggaggccagacuggccagcuucagaaacuggcccuucuacgugcagggcaucagccccugcgugcugagcgaggccggcuucguguucaccggcaagcaggacaccgugcagugcuucagcugcggcggcugccugggcaacugggaggagggcgacgaccccuggaaggagcacgccaagugguuccccaagugcgaguuccugagaagcaagaagagcagcgaggagaucacccaguacauccagagcuacaagggcuucguggacaucaccggcgagcacuucgugaacagcugggugcagagagagcugcccauggccagcgccuacugcaacgacagcaucuucgccuacgaggagcugagacuggacagcuucaaggacuggcccagagagagcgccgugggcguggccgcccuggccaaggccggccuguucuacaccggcaucaaggacaucgugcagugcuucagcugcggcggcugccuggagaaguggcaggagggcgacgacccccuggacgaccacaccagaugcuuccccaacugccccuuccugcagaacaugaagagcagcgccgaggugacccccgaccugcagagcagaggcgagcugugcgagcugcuggagaccaccagcgagagcaaccuggaggacagcaucgccgugggccccaucgugcccgagauggcccagggcgaggcccagugguuccaggaggccaagaaccugaacgagcagcugagagccgccuacaccagcgccagcuucagacacaugagccugcuggacaucagcagcgaccuggccaccgaccaccugcugggcugcgaccugagcaucgccagcaagcacaucagcaagcccgugcaggagccccuggugcugcccgagguguucggcaaccugaacagcgugaugugcguggagggcgaggccggcagcggcaagaccgugcugcugaagaagaucgccuuccugugggccagcggcugcugcccccugcugaacagauuccagcugguguucuaccugagccugagcagcaccagacccgacgagggccuggccagcaucaucugcgaccagcugcuggagaaggagggcagcgugaccgagaugugcgugagaaacaucauccagcagcugaagaaccaggugcuguuccugcuggacgacuacaaggagaucugcagcaucccccaggugaucggcaagcugauccagaagaaccaccugagcagaaccugccugcugaucgccgugagaaccaacagagccagagacaucagaagauaccuggagaccauccuggagaucaaggccuuccccuucuacaacaccgugugcauccugagaaagcuguucagccacaacaugaccagacugagaaaguucaugguguacuucggcaagaaccagagccugcagaagauccagaagaccccccuguucguggccgccaucugcgcccacugguuccaguaccccuucgaccccagcuucgacgacguggccguguucaagagcuacauggagagacugagccugagaaacaaggccaccgccgagauccugaaggccaccgugagcagcugcggcgagcuggcccugaagggcuucuucagcugcugcuucgaguucaacgacgacgaccuggccgaggccggcguggacgaggacgaggaccugaccaugugccugaugagcaaguucaccgcccagagacugagacccuucuacagauuccugagccccgccuuccaggaguuccuggccggcaugagacugaucgagcugcuggacagcgacagacaggagcaccaggaccugggccuguaccaccugaagcagaucaacagccccaugaugaccgugagcgccuacaacaacuuccugaacuacgugagcagccugcccagcaccaaggccggccccaagaucgugagccaccugcugcaccugguggacaacaaggagagccuggagaacaucagcgagaacgacgacuaccugaagcaccagcccgagaucagccugcagaugcagcugcugagaggccuguggcagaucugcccccaggccuacuucagcauggugagcgagcaccugcuggugcuggcccugaagaccgccuaccagagcaacaccguggccgccugcagccccuucgugcugcaguuccugcagggcagaacccugacccugggcgcccugaaccugcaguacuucuucgaccaccccgagagccugagccugcugagaagcauccacuuccccaucagaggcaacaagaccagccccagagcccacuucagcgugcuggagaccugcuucgacaagagccaggugcccaccaucgaccaggacuacgccagcgccuucgagcccaugaacgagugggagagaaaccuggccgagaaggaggacaacgugaagagcuacauggacaugcagagaagagccagccccgaccugagcaccggcuacuggaagcugagccccaagcaguacaagauccccugccuggagguggacgugaacgacaucgacguggugggccaggacaugcuggagauccugaugaccguguucagcgccagccagagaaucgagcugcaccugaaccacagcagaggcuucaucgagagcaucagacccgcccuggagcugagcaaggccagcgugaccaagugcagcaucagcaagcuggagcugagcgccgccgagcaggagcugcugcugacccugcccagccuggagagccuggaggugagcggcaccauccagagccaggaccagaucuuccccaaccuggacaaguuccugugccugaaggagcugagcguggaccuggagggcaacaucaacguguucagcgugauccccgaggaguuccccaacuuccaccacauggagaagcugcugauccagaucagcgccgaguacgaccccagcaagcuggugaagcugauccagaacagccccaaccugcacguguuccaccugaagugcaacuucuucagcgacuucggcagccugaugaccaugcuggugagcugcaagaagcugaccgagaucaaguucagcgacagcuucuuccaggccgugcccuucguggccagccugcccaacuucaucagccugaagauccugaaccuggagggccagcaguuccccgacgaggagaccagcgagaaguucgccuacauccugggcagccugagcaaccuggaggagcugauccugcccaccggcgacggcaucuacagaguggccaagcugaucauccagcagugccagcagcugcacugccugagagugcugagcuucuucaagacccugaacgacgacagcgugguggagaucgccaagguggccaucagcggcggcuuccagaagcuggagaaccugaagcugagcaucaaccacaagaucaccgaggagggcuacagaaacuucuuccaggcccuggacaacaugcccaaccugcaggagcuggacaucagcagacacuucaccgagugcaucaaggcccaggccaccaccgugaagagccugagccagugcgugcugagacugcccagacugaucagacugaacaugcugagcuggcugcuggacgccgacgacaucgcccugcugaacgugaugaaggagagacacccccagagcaaguaccugaccauccugcagaaguggauccugcccuucagccccaucauccagaaguaa

SEQ ID NO: 20311 - RNA, 5274 nt, Artificial Sequence
  NALCN__Homo_sapiens__XP_011519369
augcagagcgccgugcagaccguggugcugugccugcugaccaaggccaaccugagcaugcugaagagaaagcagagcagcagaguggaggcccagcccgugaccgacuucggccccgacgagagccugagcgacaacgccgacauccuguggaucaacaagcccugggugcacagccugcugagaaucugcgccaucaucagcgugaucagcgugugcaugaacacccccaugaccuucgagcacuaccccccccugcaguacgugaccuucacccuggacacccugcugauguuccuguacaccgccgagaugaucgccaagaugcacaucagaggcaucgugaagggcgacagcagcuacgugaaggacagauggugcguguucgacggcuucaugguguucugccugugggugagccuggugcugcagguguucgagaucgccgacaucguggaccagaugagccccuggggcaugcugagaauccccagaccccugaucaugaucagagccuucagaaucuacuucagauucgagcugcccagaaccagaaucaccaacauccugaagagaagcggcgagcagaucuggagcgugagcaucuuccugcuguucuuccugcugcuguacggcauccugggcgugcagauguucggcaccuucaccuaccacugcguggugaacgacaccaagcccggcaacgugaccuggaacagccuggccauccccgacacccacugcagccccgagcuggaggagggcuaccagugcccccccggcuucaagugcauggaccuggaggaccugggccugagcagacaggagcugggcuacagcggcuucaacgagaucggcaccagcaucuucaccguguacgaggccgccagccaggagggcuggguguuccugauguacagagccaucgacagcuuccccagauggagaagcuacuucuacuucaucacccugaucuucuuccuggccuggcuggugaagaacguguucaucgccgugaucaucgagaccuucgccgagaucagagugcaguuccagcagauguggggcagcagaagcagcaccaccagcaccgccaccacccagauguuccacgaggacgccgccggcggcuggcagcugguggccguggacgugaacaagccccagggcagagcccccgccugccugcagaagaugaugagaagcagcguguuccacauguucauccugagcauggugaccguggacgugaucguggccgccagcaacuacuacaagggcgagaacuucagaagacaguacgacgaguucuaccuggccgagguggccuucaccgugcuguucgaccuggaggcccugcugaagaucuggugccugggcuucaccggcuacaucagcagcagccugcacaaguucgagcugcugcuggugaucggcaccacccugcacguguaccccgaccuguaccacagccaguucaccuacuuccaggugcugagaguggugagacugaucaagaucagccccgcccuggaggacuucguguacaagaucuucggccccggcaagaagcugggcagccuggugguguucaccgccagccugcugaucgugaugagcgccaucagccugcagauguucugcuucguggaggagcuggacagauucaccaccuuccccagagccuucaugagcauguuccagauccugacccaggagggcuggguggacgugauggaccagacccugaacgccgugggccacaugugggcccccgugguggccaucuacuucauccuguaccaccuguucgccacccugauccugcugagccuguucguggccgugauccuggacaaccuggagcuggacgaggaccugaagaagcugaagcagcugaagcagagcgaggccaacgccgacaccaaggagaagcugccccugagacugagaaucuucgagaaguuccccaacagaccccagauggugaagaucagcaagcugcccagcgacuucaccgugcccaagaucagagagagcuucaugaagcaguucaucgacagacagcagcaggacaccugcugccugcugagaagccugcccaccaccagcagcagcagcugcgaccacagcaagagaagcgccaucgaggacaacaaguacaucgaccagaagcugagaaagagcguguucagcaucagagccagaaaccugcuggagaaggagaccgccgugaccaagauccugagagccugcaccagacagagaaugcugagcggcagcuucgagggccagcccgccaaggagagaagcauccugagcgugcagcaccacaucagacaggagagaagaagccugagacacggcagcaacagccagagaaucagcagaggcaagagccuggagacccugacccaggaccacagcaacaccgugagauacagaaacgcccagagagaggacagcgagaucaagaugauccaggagaagaaggagcaggccgagaugaagagaaaggugcaggaggaggagcugagagagaaccaccccuacuucgacaagccccuguucaucgugggcagagagcacagauucagaaacuucugcagagugguggugagagccagauucaacgccagcaagaccgaccccgugaccggcgccgugaagaacaccaaguaccaccagcuguacgaccugcugggccuggugaccuaccuggacugggugaugaucaucgugaccaucugcagcugcaucagcaugauguucgagagccccuucagaagagugaugcacgcccccacccugcagaucgccgaguacguguucgugaucuucaugagcaucgagcugaaccugaagaucauggccgacggccuguucuucacccccaccgccgugaucagagacuucggcggcgugauggacaucuucaucuaccuggugagccugaucuuccugugcuggaugccccagaacgugcccgccgagagcggcgcccagcugcugauggugcugagaugccugagaccccugagaaucuucaagcuggugccccagaugagaaagguggugagagagcuguucagcggcuucaaggagaucuuccuggugagcauccugcugcugacccugaugcugguguucgccagcuucggcgugcagcuguucgccggcaagcuggccaagugcaacgaccccaacaucaucagaagagaggacugcaacggcaucuucagaaucaacgugagcgugagcaagaaccugaaccugaagcugagacccggcgagaagaagcccggcuucugggugcccagagugugggccaaccccagaaacuucaacuucgacaacgugggcaacgccaugcuggcccuguucgaggugcugagccugaagggcuggguggaggugagagacgugaucauccacagagugggccccauccacggcaucuacauccacguguucguguuccugggcugcaugaucggccugacccuguucgugggcguggugaucgccaacuucaacgagaacaagggcaccgcccugcugaccguggaccagagaagaugggaggaccugaagagcagacugaagaucgcccagccccugcaccugccccccagacccgacaacgacggcuucagagccaagauguacgacaucacccagcaccccuucuucaagagaaccaucgcccugcuggugcuggcccagagcgugcugcugagcgugaagugggacguggaggaccccgugaccgugccccuggccaccaugagcgugguguucaccuucaucuucgugcuggaggugaccaugaagaucaucgccaugagccccgccggcuucuggcagagcagaagaaacagauacgaccugcuggugaccagccugggcgugguguggguggugcugcacuucgcccugcugaacgccuacaccuacaugaugggcgccugcgugaucguguucagauucuucagcaucugcggcaagcacgugacccugaagaugcugcugcugaccgugguggugagcauguacaagagcuucuucaucaucgugggcauguuccugcugcugcugugcuacgccuucgccggcguggugcuguucggcaccgugaaguacggcgagaacaucaacagacacgccaacuucagcagcgccggcaaggccaucaccgugcuguucagaaucgugaccggcgaggacuggaacaagaucaugcacgacugcauggugcagccccccuucugcacccccgacgaguucaccuacugggccaccgacugcggcaacuacgccggcgcccugauguacuucugcagcuucuacgugaucaucgccuacaucaugcugaaccugcugguggccaucaucguggagaacuucagccuguucuacagcaccgaggaggaccagcugcugagcuacaacgaccugagacacuuccagaucaucuggaacaugguggacgacaagagagagggcgugauccccaccuucagagugaaguuccugcugagacugcugagaggcagacuggagguggaccuggacaaggacaagcugcuguucaagcacaugugcuacgagauggagagacugcacaacggcggcgacgugaccuuccacgacgugcugagcaugcugagcuacagaagcguggacaucagaaagagccugcagcuggaggagcugcuggccagagagcagcuggaguacaccaucgaggaggagguggccaagcagaccaucagaauguggcugaagaagugccugaagagaaucagagccaagcagcagcagagcugcagcaucauccacagccugagagagagccagcagcaggagcugagcagauuccugaacccccccagcaucgagaccacccagcccagcgaggacaccaacgccaacagccaggacaacagcaugcagcccgagaccagcagccagcagcagcugcugagccccacccugagcgacagaggcggcagcagacaggacgccgccgacgccggcaagccccagagaaaguucggccaguggagacugcccagcgcccccaagcccaucagccacagcgugagcagcgugaaccugagauucggcggcagaaccaccaugaagagcguggugugcaagaugaaccccaugaccgacgccgccagcugcggcagcgaggugaagaagugguggaccagacagcugaccguggagagcgacgagagcggcgacgaccugcuggacaucuaa

SEQ ID NO: 20312 - RNA, 1476 nt, Artificial Sequence
  NAMPT__Homo_sapiens__XP_005250157
augaaccccgccgccgaggccgaguucaacauccugcuggccaccgacagcuacaaggugacccacuacaagcaguacccccccaacaccagcaagguguacagcuacuucgagugcagagagaagaagaccgagaacagcaagcugagaaaggugaaguacgaggagaccguguucuacggccugcaguacauccugaacaaguaccugaagggcaagguggugaccaaggagaagauccaggaggccaaggacguguacaaggagcacuuccaggacgacguguucaacgagaagggcuggaacuacauccuggagaaguacgacggccaccugcccaucgagaucaaggccgugcccgagggcuucgugauccccagaggcaacgugcuguucaccguggagaacaccgaccccgagugcuacuggcugaccaacuggaucgagaccauccuggugcagagcugguaccccaucaccguggccaccaacagcagagagcagaagaagauccuggccaaguaccugcuggagaccagcggcaaccuggacggccuggaguacaagcugcacgacuucggcuacagaggcgugagcagccaggagaccgccggcaucggcgccagcgcccaccuggugaacuucaagggcaccgacaccguggccggccuggcccugaucaagaaguacuacggcaccaaggaccccgugcccggcuacagcgugcccgccgccgagcacagcaccaucaccgccuggggcaaggaccacgagaaggacgccuucgagcacaucgugacccaguucagcagcgugcccgugagcguggugagcgacagcuacgacaucuacaacgccugcgagaagaucuggggcgaggaccugagacaccugaucgugagcagaagcacccaggccccccugaucaucagacccgacagcggcaacccccuggacaccgugcugaaggugcuggagauccugggcaagaaguuccccgugaccgagaacagcaagggcuacaagcugcugccccccuaccugagagugauccagggcgacggcguggacaucaacacccugcaggagaucguggagggcaugaagcagaagauguggagcaucgagaacaucgccuucggcagcggcggcggccugcugcagaagcugaccagagaccugcugaacugcagcuucaagugcagcuacguggugaccaacggccugggcaucaacguguucaaggaccccguggccgaccccaacaagagaagcaagaagggcagacugagccugcacagaacccccgccggcaacuucgugacccuggaggagggcaagggcgaccuggaggaguacggccaggaccugcugcacaccguguucaagaacggcaaggugaccaagagcuacagcuucgacgagaucagaaagaacgcccagcugaacaucgagcuggaggccgcccaccacuaa

SEQ ID NO: 20313 - RNA, 870 nt, Artificial Sequence
  NANOG__Homo_sapiens__NP_001284627
augagcguggaccccgccugcccccagagccugcccugcuucgaggccagcgacugcaaggagagcagccccaugcccgugaucugcggccccgaggagaacuaccccagccugcagaugagcagcgccgagaugccccacaccgagaccgugagcccccugcccagcagcauggaccugcugauccaggacagccccgacagcagcaccagccccaagggcaagcagcccaccagcgccgagaagagcguggccaagaaggaggacaaggugcccgugaagaagcagaagaccagaaccguguucagcagcacccagcugugcgugcugaacgacagauuccagagacagaaguaccugagccugcagcagaugcaggagcugagcaacauccugaaccugagcuacaagcaggugaagaccugguuccagaaccagagaaugaagagcaagagauggcagaagaacaacuggcccaagaacagcaacggcgugacccagggcugccuggugaaccccaccggcaaccugcccauguggagcaaccagaccuggaacaacagcaccuggagcaaccagacccagaacauccagagcuggagcaaccacagcuggaacacccagaccuggugcacccagagcuggaacaaccaggccuggaacagccccuucuacaacugcggcgaggagagccugcagagcugcaugcaguuccagcccaacagccccgccagcgaccuggaggccgcccuggaggccgccggcgagggccugaacgugauccagcagaccaccagauacuucagcaccccccagaccauggaccuguuccugaacuacagcaugaacaugcagcccgaggacguguaa

SEQ ID NO: 20314 - RNA, 879 nt, Artificial Sequence
  NANOS1__Homo_sapiens__NP_955631
auggaggccuuccccugggcccccagaagccccagaagaggcagagcccccccccccauggcccuggugcccagcgccagauacgugagcgcccccggccccgcccacccccagcccuucagcagcuggaacgacuaccugggccuggccacccugaucaccaaggccguggacggcgagcccagauucggcugcgccagaggcggcaacggcggcggcggcagcccccccagcagcagcagcagcagcugcugcagcccccacaccggcgccggccccggcgcccugggccccgcccugggcccccccgacuacgacgaggacgacgacgacgacagcgacgagcccggcagcagaggcagauaccugggcagcgcccuggagcugagagcccuggagcugugcgccggccccgccgaggccggccugcuggaggagagauucgccgagcugagccccuucgccggcagagccgccgccgugcugcugggcugcgcccccgccgccgccgccgccgccaccaccaccagcgaggccacccccagagaggagagagcccccgccugggccgccgagcccagacugcacgccgccagcggcgccgccgccgccagacugcugaagcccgagcugcaggugugcguguucugcagaaacaacaaggaggccauggcccuguacaccacccacauccugaagggccccgacggcagagugcugugccccgugcugagaagauacaccugcccccugugcggcgccagcggcgacaacgcccacaccaucaaguacugcccccugagcaaggugccccccccccccgccagacccccccccagaagcgccagagacggcccccccggcaagaagcugagauaa

SEQ ID NO: 20315 - RNA, 417 nt, Artificial Sequence
  NANOS2__Homo_sapiens__NP_001025032
augcagcugccccccuucgacauguggaaggacuacuucaaccugagccagguggugugggcccugaucgccagcagaggccagagacuggagacccaggagaucgaggagcccagccccggccccccccugggccaggaccagggccugggcgcccccggcgccaacggcggccugggcacccugugcaacuucugcaagcacaacggcgagagcagacacguguacagcagccaccagcugaagacccccgacggcgugguggugugccccauccugagacacuacgugugccccgugugcggcgccaccggcgaccaggcccacacccugaaguacugcccccugaacggcggccagcagagccuguacagaagaagcggcagaaacagcgccggcagaagagugaagagauaa

SEQ ID NO: 20316 - RNA, 579 nt, Artificial Sequence
  NANOS3__Homo_sapiens__NP_001092092
augggcaccuucgaccuguggaccgacuaccugggccuggcccaccuggugagagcccugagcggcaaggagggccccgagaccagacugagcccccagcccgagcccgagcccaugcuggagcccgugagcgcccuggagcccaugcccgcccccgagagcgugcccgugcccggccccaaggaccagaagagaagccuggagagcagccccgcccccgagagacugugcagcuucugcaagcacaacggcgagagcagagccaucuaccagagccacgugcugaaggacgaggccggcagagugcugugccccauccugagagacuacgugugcccccagugcggcgccaccagagagagagcccacaccagaagauucugcccccugaccggccagggcuacaccagcguguacagccacaccaccagaaacagcgccggcaagaagcuggugagacccgacaaggccaagacccaggacaccggccacagaagaggcggcggcggcggcgccggcuucagaggcgccggcaagagcgagcccagccccagcugcagccccagcaugagcaccuaa

SEQ ID NO: 20317 - RNA, 1080 nt, Artificial Sequence
  NANS__Homo_sapiens__NP_061819
augccccuggagcuggagcugugccccggcagaugggugggcggccagcaccccugcuucaucaucgccgagaucggccagaaccaccagggcgaccuggacguggccaagagaaugaucagaauggccaaggagugcggcgccgacugcgccaaguuccagaagagcgagcuggaguucaaguucaacagaaaggcccuggagagacccuacaccagcaagcacagcuggggcaagaccuacggcgagcacaagagacaccuggaguucagccacgaccaguacagagagcugcagagauacgccgaggaggugggcaucuucuucaccgccagcggcauggacgagauggccguggaguuccugcacgagcugaacgugcccuucuucaaggugggcagcggcgacaccaacaacuuccccuaccuggagaagaccgccaagaagggcagacccauggugaucagcagcggcaugcagagcauggacaccaugaagcagguguaccagaucgugaagccccugaaccccaacuucugcuuccugcagugcaccagcgccuacccccugcagcccgaggacgugaaccugagagugaucagcgaguaccagaagcuguuccccgacauccccaucggcuacagcggccacgagaccggcaucgccaucagcguggccgccguggcccugggcgccaaggugcuggagagacacaucacccuggacaagaccuggaagggcagcgaccacagcgccagccuggagcccggcgagcuggccgagcuggugagaagcgugagacugguggagagagcccugggcagccccaccaagcagcugcugcccugcgagauggccugcaacgagaagcugggcaagagcgugguggccaaggugaagauccccgagggcaccauccugaccauggacaugcugaccgugaaggugggcgagcccaagggcuacccccccgaggacaucuucaaccuggugggcaagaaggugcuggugaccguggaggaggacgacaccaucauggaggagcugguggacaaccacggcaagaagaucaagagcuaa

SEQ ID NO: 20318 - RNA, 1176 nt, Artificial Sequence
  NAP1L1__Homo_sapiens__NP_004528
auggccgacaucgacaacaaggagcagagcgagcuggaccaggaccuggacgacguggaggagguggaggaggaggagaccggcgaggagaccaagcugaaggccagacagcugaccgugcagaugaugcagaacccccagauccuggccgcccugcaggagagacuggacggccugguggagacccccaccggcuacaucgagagccugcccagaguggugaagagaagagugaacgcccugaagaaccugcaggugaagugcgcccagaucgaggccaaguucuacgaggaggugcacgaccuggagagaaaguacgccgugcuguaccagccccuguucgacaagagauucgagaucaucaacgccaucuacgagcccaccgaggaggagugcgaguggaagcccgacgaggaggacgagaucagcgaggagcugaaggagaaggccaagaucgaggacgagaagaaggacgaggagaaggaggaccccaagggcauccccgaguucuggcugaccguguucaagaacguggaccugcugagcgacauggugcaggagcacgacgagcccauccugaagcaccugaaggacaucaaggugaaguucagcgacgccggccagcccaugagcuucgugcuggaguuccacuucgagcccaacgaguacuucaccaacgaggugcugaccaagaccuacagaaugagaagcgagcccgacgacagcgaccccuucagcuucgacggccccgagaucaugggcugcaccggcugccagaucgacuggaagaagggcaagaacgugacccugaagaccaucaagaagaagcagaagcacaagggcagaggcaccgugagaaccgugaccaagaccgugagcaacgacagcuucuucaacuucuucgccccccccgaggugcccgagagcggcgaccuggacgacgacgccgaggccauccuggccgccgacuucgagaucggccacuuccugagagagagaaucauccccagaagcgugcuguacuucaccggcgaggccaucgaggacgacgacgacgacuacgacgaggagggcgaggaggccgacgaggagggcgaggaggagggcgacgaggagaacgaccccgacuacgaccccaagaaggaccagaaccccgccgagugcaagcagcaguaa

SEQ ID NO: 20319 - RNA, 1521 nt, Artificial Sequence
  NAP1L3__Homo_sapiens__NP_004529
auggccgaggccgacuucaagauggugagcgagcccguggcccacggcguggccgaggaggagauggccagcagcaccagcgacagcggcgaggagagcgacagcagcagcagcagcagcagcaccagcgacagcagcagcagcagcagcaccagcggcagcagcagcggcagcggcagcagcagcagcagcagcggcagcaccagcagcagaagcagacuguacagaaagaagagagugcccgagcccagcagaagagccagaagagccccccugggcaccaacuucguggacagacugccccaggccgugagaaacagagugcaggcccugagaaacauccaggacgagugcgacaagguggacacccuguuccugaaggccauccacgaccuggagagaaaguacgccgagcugaacaagccccuguacgacagaagauuccagaucaucaacgccgaguacgagcccaccgaggaggagugcgaguggaacagcgaggacgaggaguucagcagcgacgaggaggugcaggacaacacccccagcgagaugcccccccuggagggcgaggaggaggagaaccccaaggagaaccccgaggugaaggccgaggagaaggaggugcccaaggagauccccgaggugaaggacgaggagaaggaggugcccaaggagauccccgaggugaaggccgaggagaaggccgacagcaaggacugcauggaggccacccccgaggugaaggaggaccccaaggaggugccccaggugaaggccgacgacaaggagcagcccaaggccaccgaggccaaggccagagccgccgugagagagacccacaagagagugcccgaggagagacugcaggacagcguggaccugaagagagccagaaagggcaagcccaagagagaggaccccaagggcauccccgacuacuggcugaucgugcugaagaacguggacaagcugggccccaugauccagaaguacgacgagcccauccugaaguuccugagcgacgugagccugaaguucagcaagcccggccagcccgugagcuacaccuucgaguuccacuuccugcccaaccccuacuucagaaacgaggugcuggugaagaccuacaucaucaaggccaagcccgaccacaacgaccccuucuucagcuggggcugggagaucgaggacugcaagggcugcaagaucgacuggagaagaggcaaggacgugaccgugaccaccacccagagcagaaccaccgccaccggcgagaucgagauccagcccagaguggugcccaacgccagcuucuucaacuucuucagcccccccgagauccccaugaucggcaagcuggagcccagagaggacgccauccuggacgaggacuucgagaucggccagauccugcacgacaacgugauccugaagagcaucuacuacuacaccggcgaggugaacggcaccuacuaccaguucggcaagcacuacggcaacaagaaguacagaaaguaa

SEQ ID NO: 20320 - RNA, 1128 nt, Artificial Sequence
  NAP1L4__Homo_sapiens__NP_005960
auggccgaccacagcuucagcgacggcgugcccagcgacagcguggaggccgccaagaacgccagcaacaccgagaagcugaccgaccaggugaugcagaaccccagagugcuggccgcccugcaggagagacuggacaacgugccccacacccccagcagcuacaucgagacccugcccaaggccgugaagagaagaaucaacgcccugaagcagcugcaggugagaugcgcccacaucgaggccaaguucuacgaggaggugcacgaccuggagagaaaguacgccgcccuguaccagccccuguucgacaagagaagagaguucaucaccggcgacguggagcccaccgacgccgagagcgaguggcacagcgagaacgaggaggaggagaagcuggccggcgacaugaagagcaaggugguggugaccgagaaggccgccgccaccgccgaggagcccgaccccaagggcauccccgaguucugguucaccaucuucagaaacguggacaugcugagcgagcuggugcaggaguacgacgagcccauccugaagcaccugcaggacaucaaggugaaguucagcgaccccggccagcccaugagcuucgugcuggaguuccacuucgagcccaacgacuacuucaccaacagcgugcugaccaagaccuacaagaugaagagcgagcccgacaaggccgaccccuucagcuucgagggccccgagaucguggacugcgacggcugcaccaucgacuggaagaagggcaagaacgugaccgugaagaccaucaagaagaagcagaagcacaagggcagaggcaccgugagaaccaucaccaagcaggugcccaacgagagcuucuucaacuucuucaacccccugaaggccagcggcgacggcgagagccuggacgaggacagcgaguucacccuggccagcgacuucgagaucggccacuucuucagagagagaaucgugcccagagccgugcuguacuucaccggcgaggccaucgaggacgacgacaacuucgaggagggcgaggagggcgaggaggaggagcuggagggcgacgaggagggcgaggacgaggacgacgccgagaucaaccccaagguguaa

SEQ ID NO: 20321 - RNA, 549 nt, Artificial Sequence
  NAP1L5__Homo_sapiens__NP_715638
auggccgacagcgagaaccagggccccgccgagcccagccaggccgccgccgccgccgaggccgccgccgaggaggugauggccgagggcggcgcccagggcggcgacugcgacagcgccgccggcgaccccgacagcgccgccggccagauggccgaggagccccagacccccgccgagaacgcccccaagcccaagaacgacuucaucgagagccugcccaacagcgugaagugcagagugcuggcccugaagaagcugcagaagagaugcgacaagaucgaggccaaguucgacaaggaguuccaggcccuggagaagaaguacaacgacaucuacaagccccugcuggccaagauccaggagcugaccggcgagauggagggcugcgccuggacccuggagggcgaggaggaggaggaggaggaguacgaggacgacgaggaggagggcgaggacgaggaggaggaggaggccgccgccgaggccgccgccggcgccaagcacgacgacgcccacgccgagaugcccgacgacgccaagaaguaa

SEQ ID NO: 20322 - RNA, 888 nt, Artificial Sequence
  NAPA__Homo_sapiens__NP_003818
auggacaacagcggcaaggaggccgaggccauggcccugcuggccgaggccgagagaaaggugaagaacagccagagcuucuucagcggccuguucggcggcagcagcaagaucgaggaggccugcgagaucuacgccagagccgccaacauguucaagauggccaagaacuggagcgccgccggcaacgccuucugccaggccgcccagcugcaccugcagcugcagagcaagcacgacgccgccaccugcuucguggacgccggcaacgccuucaagaaggccgacccccaggaggccaucaacugccugaugagagccaucgagaucuacaccgacaugggcagauucaccaucgccgccaagcaccacaucagcaucgccgagaucuacgagaccgagcugguggacaucgagaaggccaucgcccacuacgagcagagcgccgacuacuacaagggcgaggagagcaacagcagcgccaacaagugccugcugaagguggccggcuacgccgcccugcuggagcaguaccagaaggccaucgacaucuacgagcaggugggcaccaacgccauggacagcccccugcugaaguacagcgccaaggacuacuucuucaaggccgcccugugccacuucugcaucgacaugcugaacgccaagcuggccgugcagaaguacgaggagcuguuccccgccuucagcgacagcagagagugcaagcugaugaagaagcugcuggaggcccacgaggagcagaacguggacagcuacaccgagagcgugaaggaguacgacagcaucagcagacuggaccaguggcugaccaccaugcugcugagaaucaagaagaccauccagggcgacgaggaggaccugagauaa

SEQ ID NO: 20323 - RNA, 1182 nt, Artificial Sequence
  NAPEPLD__Homo_sapiens__XP_006725119
auggacgagaacgagagcaaccagagccugaugaccagcagccaguaccccaaggaggccgugagaaagagacagaacagcgccagaaacagcggcgccagcgacagcagcagauucagcagaaagagcuucaagcuggacuacagacuggaggaggacgugaccaagagcaagaagggcaaggacggcagauucgugaaccccuggcccaccuggaagaaccccagcauccccaacgugcugagauggcugaucauggagaaggaccacagcagcgugcccagcagcaaggaggagcuggacaaggagcugcccgugcugaagcccuacuucaucaccaaccccgaggaggccggcgugagagaggccggccugagagugaccuggcugggccacgccaccgugaugguggagauggacgagcugaucuuccugaccgaccccaucuucagcagcagagccagccccagccaguacaugggccccaagagauucagaagaagccccugcaccaucagcgagcugccccccaucgacgccgugcugaucagccacaaccacuacgaccaccuggacuacaacagcgugaucgcccugaacgagagauucggcaacgagcugagaugguucgugccccugggccugcuggacuggaugcagaagugcggcugcgagaacgugaucgagcuggacuggugggaggagaacugcgugcccggccacgacaaggugaccuucguguucacccccagccagcacuggugcaagagaacccugauggacgacaacaaggugcuguggggcagcuggagcgugcugggccccuggaacagauucuucuucgccggcgacaccggcuacugccccgccuucgaggagaucggcaagagauucggccccuucgaccuggccgccauccccaucggcgccuacgagcccagaugguucaugaaguaccagcacguggaccccgaggaggccgugagaauccacaccgacgugcagaccaagaagagcauggccauccacuggggcaccuucgcccuggccaacgagcacuaccuggagccccccgugaagcugaacgaggcccuggagagauacggccugaacgccgaggacuucuucgugcugaagcacggcgagagcagauaccugaacaacgacgacgagaacuucuaa

SEQ ID NO: 20324 - RNA, 939 nt, Artificial Sequence
  NAPG__Homo_sapiens__NP_003817
auggccgcccagaagaucaacgagggccuggagcaccuggccaaggccgagaaguaccugaagaccggcuuccugaaguggaagcccgacuacgacagcgccgccagcgaguacggcaaggccgccguggccuucaagaacgccaagcaguucgagcaggccaaggacgccugccugagagaggccguggcccacgagaacaacagagcccuguuccacgccgccaaggccuacgagcaggccggcaugaugcugaaggagaugcagaagcugcccgaggccgugcagcugaucgagaaggccagcaugauguaccuggagaacggcacccccgacaccgccgccauggcccuggagagagccggcaagcugaucgagaacguggaccccgagaaggccgugcagcuguaccagcagaccgccaacguguucgagaacgaggagagacugagacaggccguggagcugcugggcaaggccagcagacugcuggugagaggcagaagauucgacgaggccgcccugagcauccagaaggagaagaacaucuacaaggagaucgagaacuaccccaccugcuacaagaagaccaucgcccaggugcuggugcaccugcacagaaacgacuacguggccgccgagagaugcgugagagagagcuacagcauccccggcuucaacggcagcgaggacugcgccgcccuggagcagcugcuggagggcuacgaccagcaggaccaggaccaggugagcgacgugugcaacagcccccuguucaaguacauggacaacgacuacgccaagcugggccugagccugguggugcccggcggcggcaucaagaagaagagccccgccaccccccaggccaagcccgacggcgugaccgccaccgccgccgacgaggaggaggacgaguacagcggcggccugugcuaa

SEQ ID NO: 20325 - RNA, 1578 nt, Artificial Sequence
  NAPRT__Homo_sapiens__NP_001273758
auggccgccgagcaggaccccgaggccagagccgccgccagaccccugcugaccgaccuguaccaggccaccauggcccugggcuacuggagagccggcagagccagagacgccgccgaguucgagcuguucuucagaagaugccccuucggcggcgccuucgcccuggccgccggccugagagacugcgugagauuccugagagccuucagacugagagacgccgacgugcaguuccuggccagcgugcugccccccgacaccgaccccgccuucuucgagcaccugagagcccuggacugcagcgaggugaccgugagagcccugcccgagggcagccuggccuuccccggcgugccccugcugcaggugagcggcccccugcugguggugcagcugcuggagaccccccugcugugccuggugagcuacgccagccugguggccaccaacgccgccagacugagacugaucgccggccccgagaagagacugcuggagaugggccugagaagagcccagggccccgacggcggccugaccgccagcaccuacagcuaccugggcggcuucgacagcagcagcaacgugcuggccggccagcugagaggcgugcccguggccggcacccuggcccacagcuucgugaccagcuucagcggcagcgaggugccccccgaccccaugcuggcccccgccgccggcgagggccccggcguggaccuggccgccaaggcccagguguggcuggagcaggugugcgcccaccugggccugggcgugcaggagccccaccccggcgagagagccgccuucguggccuacgcccuggccuuccccagagccuuccagggccugcuggacaccuacagcguguggagaagcggccugcccaacuuccuggccguggcccuggcccugggcgagcugggcuacagagccgugggcgugagacuggacagcggcgaccugcugcagcaggcccaggagaucagaaagguguucagagccgccgccgcccaguuccaggugcccuggcuggagagcgugcugaucguggugagcaacaacaucgacgaggaggcccuggccagacuggcccaggagggcagcgaggugaacgugaucggcaucggcaccagcguggugaccugcccccagcagcccagccugggcggcguguacaagcugguggccgugggcggccagcccagaaugaagcugaccgaggaccccgagaagcagacccugcccggcagcaaggccgccuucagacugcugggcagcgacggcagcccccugauggacaugcugcagcuggccgaggagcccgugccccaggccggccaggagcugagaguguggccccccggcgcccaggagcccugcaccgugagacccgcccagcugugcgagccccugcccagccuggccgagagcagagcccuggcccagcugagccugagcagacugagccccgagcacagaagacugagaagccccgcccaguaccagguggugcugagcgagagacugcaggcccuggugaacagccugugcgccggccagagccccuaa

SEQ ID NO: 20326 - RNA, 1263 nt, Artificial Sequence
  NAPSA__Homo_sapiens__XP_011525842
augagcccccccccccugcugcagccccugcugcugcugcugccccugcugaacguggagcccagcggcgccacccugaucagaaucccccugcacagagugcagcccggcagaagaauccugaaccugcugagaggcuggagagagcccgccgagcugcccaagcugggcgcccccagccccggcgacaagcccaucuucgugccccugagcaacuacagagacgugcaguacuucggcgagaucggccugggcacccccccccagaacuucaccguggccuucgacaccggcagcagcaaccugugggugcccagcagaagaugccacuucuucagcgugcccugcuggcugcaccacagauucgaccccaaggccagcagcagcuuccaggccaacggcaccaaguucgccauccaguacggcaccggcagaguggacggcauccugagcgaggacaagcugaccaucggcggcaucaagggcgccagcgugaucuucggcgaggcccugugggagcccagccugguguucgccuucgcccacuucgacggcauccugggccugggcuuccccauccugagcguggagggcgugagaccccccauggacgugcugguggagcagggccugcuggacaagcccguguucagcuucuaccugaacagagaccccgaggagcccgacggcggcgagcuggugcugggcggcagcgaccccgcccacuacauccccccccugaccuucgugcccgugaccgugcccgccuacuggcagauccacauggagagagugaaggugggccccggccugacccugugcgccaagggcugcgccgccauccuggacaccggcaccagccugaucaccggccccaccgaggagaucagagcccugcacgccgccaucggcggcaucccccugcuggccggcgaguacaucauccugugcagcgagauccccaagcugcccgccgugagcuuccugcugggcggcgugugguucaaccugaccgcccacgacuacgugauccagaccaccagaaacggcgugagacugugccugagcggcuuccaggcccuggacgugcccccccccgccggccccuucuggauccugggcgacguguuccugggcaccuacguggccguguucgacagaggcgacaugaagagcagcgccagagugggccuggccagagccagaaccagaggcgccgaccugggcuggggcgagaccgcccaggcccaguuccccggcuaa

SEQ ID NO: 20327 - RNA, 1125 nt, Artificial Sequence
  NARFL__Homo_sapiens__NP_001291728
auggccgcccccagccagcagagacuggugguggugagcgugagcccccagagcagagccagccuggccgccagauuccagcugaaccccaccgacaccgccagaaagcugaccagcuucuucaagaagaucggcgugcacuucguguucgacaccgccuucagcagacacuucagccugcuggagagccagagagaguucgugagaagauucagaggccaggccgacugcagacaggcccugccccugcuggccagcgccugccccggcuggaucugcuacgccgagaagacccacggcagcuucauccugccccacaucagcaccgccagaagcccccagcaggugaugggcagccuggugaaggacuucuucgcccagcagcagcaccugacccccgacaagaucuaccacgugaccgugaugcccugcuacgacaagaagcuggaggccagcagacccgacuucuucaaccaggagcaccagaccagagacguggacugcgugcugaccaccggcgagguguucagacugcuggaggaggagggcgugagccugcccgaccuggagcccgccccccuggacagccugugcagcggcgccagcgccgaggagcccaccagccacagaggcggcggcagcggcggcuaccuggagcacguguucagacacgccgccagagagcuguucggcauccacguggccgaggugaccuacaagccccugagaaacaaggacuuccaggaggugacccuggagaaggagggccaggugcugcugcacuucgccauggccuacggcuucagaaacauccagaaccuggugcagagacugaagagaggcagaugccccuaccacuacguggaggugauggccugccccagcggcugccugaacggcggcggccagcugcaggcccccgacagacccagcagagagcugcugcagcacguggagagacuguacggcauggugagagccgaggcccccgaggacgcccccggcgugcaggagcuguacacccacuggcugcagggcaccgacagcgagugcgccggcagacugcugcacacccaguaccacgccguggagaaggccagcaccggccugggcaucagaugguaa

SEQ ID NO: 20328 - RNA, 597 nt, Artificial Sequence
  NARR__Homo_sapiens__NP_001243210
auggugggccagccccagcccagagacgacgugggcagccccagacccagagugaucgugggcaccaucagacccagagugaucgugggcaccaucagacccagagugaucgugggcagcgccagagccagacccccccccgacggcacccccagaccccagcuggccgccgaggagagccccagacccagagugaucuucggcacccccagagccagagugauccugggcagccccagacccagagugaucgugagcagccccuggcccgccguggugguggccagccccagacccagaacccccgugggcagccccuggcccagagugguggugggcacccccagacccagagugaucgugggcagccccagagccagaguggccgacgccgaccccgccagcgcccccagccagggcgcccugcagggcagaagacaggacgagcacagcggcaccagagccgagggcagcagacccggcggcgccgcccccgugcccgaggagggcggcagauucgccagagcccagagacugcccccccccagacaccugagacugcccggcgcccccgacagacacagaggccagaucuaa

SEQ ID NO: 20329 - RNA, 1647 nt, Artificial Sequence
  NARS__Homo_sapiens__NP_004530
auggugcuggccgagcuguacgugagcgacagagagggcagcgacgccaccggcgacggcaccaaggagaagcccuucaagaccggccugaaggcccugaugaccgugggcaaggagcccuuccccaccaucuacguggacagccagaaggagaacgagagauggaacgugaucagcaagagccagcugaagaacaucaagaagauguggcacagagagcagaugaagagcgagagcagagagaagaaggaggccgaggacagccugagaagagagaagaaccuggaggaggccaagaagaucaccaucaagaacgaccccagccugcccgagcccaagugcgugaagaucggcgcccuggagggcuacagaggccagagagugaagguguucggcugggugcacagacugagaagacagggcaagaaccugauguuccuggugcugagagacggcaccggcuaccugcagugcgugcuggccgacgagcugugccagugcuacaacggcgugcugcugagcaccgagagcagcguggccguguacggcaugcugaaccugacccccaagggcaagcaggcccccggcggccacgagcugagcugcgacuucugggagcugaucggccuggcccccgccggcggcgccgacaaccugaucaacgaggagagcgacguggacgugcagcugaacaacagacacaugaugaucagaggcgagaacaugagcaagauccugaaggccagaagcauggugaccagaugcuucagagaccacuucuucgacagaggcuacuacgaggugaccccccccacccuggugcagacccagguggagggcggcgccacccuguucaagcuggacuacuucggcgaggaggccuuccugacccagagcagccagcuguaccuggagaccugccugcccgcccugggcgacguguucugcaucgcccagagcuacagagccgagcagagcagaaccagaagacaccuggccgaguacacccacguggaggccgagugccccuuccugaccuucgacgaccugcugaacagacuggaggaccuggugugcgacgugguggacagaauccugaagagccccgccggcagcaucgugcacgagcugaaccccaacuuccagccccccaagagacccuucaagagaaugaacuacagcgacgccaucguguggcugaaggagcacgacgugaagaaggaggacggcaccuucuacgaguucggcgaggacauccccgaggcccccgagagacugaugaccgacaccaucaacgagcccauccugcugugcagauuccccguggagaucaagagcuucuacaugcagagaugccccgaggacagcagacugaccgagagcguggacgugcugaugcccaacgugggcgagaucgugggcggcagcaugagaaucuucgacagcgaggagauccuggccggcuacaagagagagggcaucgaccccacccccuacuacugguacaccgaccagagaaaguacggcaccugcccccacggcggcuacggccugggccuggagagauuccugaccuggauccugaacagauaccacaucagagacgugugccuguaccccagauucgugcagagaugcacccccuaa

SEQ ID NO: 20330 - RNA, 3078 nt, Artificial Sequence
  NAT10__Homo_sapiens__XP_011518499
augcacagaaagaagguggacaacagaaucagaauccugaucgagaacggcguggccgagagacagagaagccuguucgugguggugggcgacagaggcaaggaccagguggugauccugcaccacaugcugagcaaggccaccgugaaggccagacccagcgugcuguggugcuacaagaaggagcugggcuucagcagccacagaaagaagagaaugagacagcugcagaagaagaucaagaacggcacccugaacaucaagcaggacgaccccuucgagcuguucaucgccgccaccaacaucagauacugcuacuacaacgagacccacaagauccugggcaacaccuucggcaugugcgugcugcaggacuucgaggcccugacccccaaccugcuggccagaaccguggagaccguggagggcggcggccugguggugauccugcugagaaccaugaacagccugaagcagcuguacaccgugaccauggacgugcacagcagauacagaaccgaggcccaccaggacguggugggcagauucaacgagagauucauccugagccuggccagcugcaagaagugccuggugaucgacgaccagcugaacauccugcccaucagcagccacguggccaccauggaggcccugcccccccagacccccgacgagagccugggccccagcgaccuggagcugagagagcugaaggagagccugcaggacacccagcccgugggcgugcugguggacugcugcaagacccuggaccaggccaaggccgugcugaaguucaucgagggcaucagcgagaagacccugagaagcaccguggcccugaccgccgccagaggcagaggcaagagcgccgcccugggccuggccaucgccggcgccguggccuucggcuacagcaacaucuucgugaccagccccagccccgacaaccugcacacccuguucgaguucguguucaagggcuucgacgcccugcaguaccaggagcaccuggacuacgagaucauccagagccugaaccccgaguucaacaaggccgugaucagagugaacguguucagagagcacagacagaccauccaguacauccaccccgccgacgccgugaagcugggccaggccgagcugguggugaucgacgaggccgccgccaucccccugccccuggugaagagccugcugggccccuaccugguguucauggccagcaccaucaacggcuacgagggcaccggcagaagccugagccugaagcugauccagcagcugagacagcagagcgcccagagccaggugagcaccaccgccgagaacaagaccaccaccaccgccagacuggccagcgccagaacccuguacgaggugagccugcaggagagcaucagauacgcccccggcgacgccguggagaaguggcugaacgaccugcugugccuggacugccugaacaucaccagaaucgugagcggcugcccccugcccgaggccugcgagcuguacuacgugaacagagacacccuguucugcuaccacaaggccagcgagguguuccugcagagacugauggcccuguacguggccagccacuacaagaacagccccaacgaccugcagaugcugagcgacgcccccgcccaccaccuguucugccugcugccccccgugccccccacccagaacgcccugcccgaggugcuggccgugauccaggugugccuggagggcgagaucagcagacagagcauccugaacagccugagcagaggcaagaaggccagcggcgaccugauccccuggaccgugagcgagcaguuccaggaccccgacuucggcggccugagcggcggcagaguggugagaaucgccgugcaccccgacuaccagggcaugggcuacggcagcagagcccugcagcugcugcagauguacuacgagggcagauuccccugccuggaggagaaggugcuggagaccccccaggagauccacaccgugagcagcgaggccgugagccugcuggaggaggugaucacccccagaaaggaccugcccccccugcugcugaagcugaacgagagacccgccgagagacuggacuaccugggcgugagcuacggccugacccccagacugcugaaguucuggaagagagccggcuucgugcccguguaccugagacagacccccaacgaccugaccggcgagcacagcugcaucaugcugaagacccugaccgacgaggacgaggccgaccagggcggcuggcuggccgccuucuggaaggacuucagaagaagauuccuggcccugcugagcuaccaguucagcaccuucagccccagccuggcccugaacaucauccagaacagaaacaugggcaagcccgcccagcccgcccugagcagagaggagcuggaggcccuguuccugcccuacgaccugaagagacuggagauguacagcagaaacaugguggacuaccaccugaucauggacaugauccccgccaucagcagaaucuacuuccugaaccagcugggcgaccuggcccugagcgccgcccagagcgcccugcugcugggcaucggccugcagcacaagagcguggaccagcuggagaaggagaucgagcugcccagcggccagcugaugggccuguucaacagaaucaucagaaagguggugaagcuguucaacgaggugcaggagaaggccaucgaggagcagaugguggccgccaaggacguggugauggagcccaccaugaagacccugagcgacgaccuggacgaggccgccaaggaguuccaggagaagcacaagaaggaggugggcaagcugaagagcauggaccugagcgaguacaucaucagaggcgacgacgaggaguggaacgaggugcugaacaaggccggccccaacgccagcaucaucagccugaagagcgacaagaagagaaagcuggaggccaagcaggagcccaagcagagcaagaagcugaagaacagagagaccaagaacaagaaggacaugaagcugaagagaaagaaguaa

SEQ ID NO: 20331 - RNA, 621 nt, Artificial Sequence
  NAT14__Homo_sapiens__NP_065111
auggcccccagccaccugagcgugagagagaugagagaggacgagaagccccuggugcuggagaugcugaaggccggcgugaaggacaccgagaacagaguggcccugcacgcccugaccagaccccccgcccugcugcugcuggccgccgccagcagcggccugagauucgugcuggccagcuucgcccuggcccugcugcugcccguguuccuggccguggccgccgugaagcugggccugagagccagauggggcagccugcccccccccggcggccugggcggccccuggguggccgugagaggcagcggcgacgugugcggcgugcuggcccuggcccccggcaccaacgccggcgacggcgccagagugaccagacugagcgugagcagauggcacagaagaagaggcgugggcagaagacugcuggccuucgccgaggccagagccagagccugggccggcggcaugggcgagcccagagccagacugguggugcccguggccguggccgccuggggcgugggcggcaugcuggagggcugcggcuaccaggccgagggcggcuggggcugccugggcuacacccuggugagagaguucagcaaggaccuguaa

SEQ ID NO: 20332 - RNA, 873 nt, Artificial Sequence
  NAT1__Homo_sapiens__NP_001153646
auggacaucgaggccuaccuggagagaaucggcuacaagaagagcagaaacaagcuggaccuggagacccugaccgacauccugcagcaccagaucagagccgugcccuucgagaaccugaacauccacugcggcgacgccauggaccugggccuggaggccaucuucgaccagguggugagaagaaacagaggcggcuggugccugcaggugaaccaccugcuguacugggcccugaccaccaucggcuucgagaccaccaugcugggcggcuacguguacagcacccccgccaagaaguacagcaccggcaugauccaccugcugcugcaggugaccaucgacggcagaaacuacaucguggacgccggcuucggcagaagcuaccagauguggcagccccuggagcugaucagcggcaaggaccagccccaggugcccugcguguucagacugaccgaggagaacggcuucugguaccuggaccagaucagaagagagcaguacauccccaacgaggaguuccugcacagcgaccugcuggaggacagcaaguacagaaagaucuacagcuucacccugaagcccagaaccaucgaggacuucgagagcaugaacaccuaccugcagaccagccccagcagcguguucaccagcaagagcuucugcagccugcagacccccgacggcgugcacugccuggugggcuucacccugacccacagaagauucaacuacaaggacaacaccgaccugaucgaguucaagacccugagcgaggaggagaucgagaaggugcugaagaacaucuucaacaucagccugcagagaaagcuggugcccaagcacggcgacagauucuucaccaucuaa

SEQ ID NO: 20333 - RNA, 873 nt, Artificial Sequence
  NAT2__Homo_sapiens__XP_011542660
auggacaucgaggccuacuucgagagaaucggcuacaagaacagcagaaacaagcuggaccuggagacccugaccgacauccuggagcaccagaucagagccgugcccuucgagaaccugaacaugcacugcggccaggccauggagcugggccuggaggccaucuucgaccacaucgugagaagaaacagaggcggcuggugccugcaggugaaccagcugcuguacugggcccugaccaccaucggcuuccagaccaccaugcugggcggcuacuucuacaucccccccgugaacaaguacagcaccggcauggugcaccugcugcugcaggugaccaucgacggcagaaacuacaucguggacgccggcagcggcagcagcagccagauguggcagccccuggagcugaucagcggcaaggaccagccccaggugcccugcaucuucugccugaccgaggagagaggcaucugguaccuggaccagaucagaagagagcaguacaucaccaacaaggaguuccugaacagccaccugcugcccaagaagaagcaccagaagaucuaccuguucacccuggagcccagaaccaucgaggacuucgagagcaugaacaccuaccugcagaccagccccaccagcagcuucaucaccaccagcuucugcagccugcagacccccgagggcguguacugccuggugggcuucauccugaccuacagaaaguucaacuacaaggacaacaccgaccugguggaguucaagacccugaccgaggaggagguggaggaggugcugagaaacaucuucaagaucagccugggcagaaaccuggugcccaagcccggcgacggcagccugaccaucuaa

SEQ ID NO: 20334 - RNA, 861 nt, Artificial Sequence
  NAT6__Homo_sapiens__NP_001186947
auggagcugauccugagcaccagccccgccgagcugacccuggaccccgccugccagcccaagcugccccuggacagcaccugccagcccgagaugaccuucaaccccggccccaccgagcugacccuggaccccgagcaccagcccgaggagacccccgcccccagccuggccgagcugacccuggagcccgugcacagaagacccgagcugcuggacgccugcgccgaccugaucaacgaccaguggcccagaagcagaaccagcagacugcacagccugggccagagcagcgacgccuucccccugugccugaugcugcugagcccccaccccacccuggaggccgcccccgugguggugggccacgccagacugagcagagugcugaaccagccccagagccugcugguggagaccguggugguggccagagcccugagaggcagaggcuucggcagaagacugauggagggccuggagguguucgccagagccagaggcuucagaaagcugcaccugaccacccacgaccaggugcacuucuacacccaccugggcuaccagcugggcgagcccgugcagggccugguguucaccagcagaagacugcccgccacccugcugaacgccuuccccaccgcccccagccccagaccccccagaaaggcccccaaccugaccgcccaggccgcccccagaggccccaagggccccccccugccccccccccccccccugcccgagugccugaccaucagcccccccgugcccagcggcccccccagcaagagccugcuggagacccaguaccagaacgugagaggcagacccaucuucuggauggagaaggacaucuaa

SEQ ID NO: 20335 - RNA, 684 nt, Artificial Sequence
  NAT8B__Homo_sapiens__NP_057431
auggcccccuaccacaucagaaaguaccaggagagcgacagaaagagcguggugggccugcugagcagaggcauggccgagcacgcccccgccaccuucagaagacugcugaagcugcccagaacccugauccugcugcugggcggcgcccuggcccugcugcuggugagcggcagcuggauccuggcccugguguucagccugagccugcugcccgcccugugguuccuggccaagaagcccuggaccagauacguggacaucgcccugagaaccgacaugagcgacaucaccaagagcuaccugagcgagugcggcagcugcuucugggugggcgagagcgaggagaagguggugggcaccgugggcgcccugcccguggacgaccccacccugagagagaagagacugcagcuguuccaccugagcguggacaacgagcacagaggccagggcaucgccaaggcccuggugagaaccgugcugcaguucgccagagaccagggcuacagcgagguggugcuggacaccagcaacauccagcugagcgccaugggccuguaccagagccugggcuucaagaagaccggccagagcuucuuccacgugugggccagacugguggaccugcacaccgugcacuucaucuaccaccugcccagcgcccaggccggcagacuguaa

SEQ ID NO: 20336 - RNA, 684 nt, Artificial Sequence
  NAT8__Homo_sapiens__NP_003951
auggcccccugccacaucagaaaguaccaggagagcgacagacaguggguggugggccugcugagcagaggcauggccgagcacgcccccgccaccuucagacagcugcugaagcugcccagaacccugauccugcugcugggcggcccccuggcccugcugcuggugagcggcagcuggcugcuggcccugguguucagcaucagccuguuccccgcccugugguuccuggccaagaagcccuggaccgaguacguggacaugacccugugcaccgacaugagcgacaucaccaagagcuaccugagcgagagaggcagcugcuucuggguggccgagagcgaggagaagguggugggcauggugggcgcccugcccguggacgaccccacccugagagagaagagacugcagcuguuccaccuguucguggacagcgagcacagaagacagggcaucgccaaggcccuggugagaaccgugcugcaguucgccagagaccagggcuacagcgaggugauccuggacaccggcaccauccagcugagcgccauggcccuguaccagagcaugggcuucaagaagaccggccagagcuucuucugcgugugggccagacugguggcccugcacaccgugcacuucaucuaccaccugcccagcagcaaggugggcagccuguaa

SEQ ID NO: 20337 - RNA, 909 nt, Artificial Sequence
  NAT8L__Homo_sapiens__NP_848652
augcacugcggcccccccgacauggugugcgagaccaagaucguggccgccgaggaccacgaggcccugcccggcgccaagaaggacgcccugcuggccgccgccggcgccauguggcccccccugcccgccgcccccggccccgccgccgccccccccgcccccccccccgcccccguggcccagccccacggcggcgccggcggcgccggcccccccggcggcagaggcgugugcaucagagaguucagagccgccgagcaggaggccgccagaagaaucuucuacgacggcaucauggagagaauccccaacaccgccuucagaggccugagacagcaccccagagcccagcugcuguacgcccugcuggccgcccugugcuucgccgugagcagaagccugcugcugaccugccuggugcccgccgcccugcugggccugagauacuacuacagcagaaaggugaucagagccuaccuggagugcgcccugcacaccgacauggccgacaucgagcaguacuacaugaagccccccggcagcugcuucuggguggccgugcuggacggcaacguggugggcaucguggccgccagagcccacgaggaggacaacaccguggagcugcugagaaugagcguggacagcagauucagaggcaagggcaucgccaaggcccugggcagaaaggugcuggaguucgccguggugcacaacuacagcgccguggugcugggcaccaccgccgugaagguggccgcccacaagcuguacgagagccugggcuucagacacaugggcgccagcgaccacuacgugcugcccggcaugacccugagccuggccgagagacuguucuuccaggugagauaccacagauacagacugcagcugagagaggaguaa

SEQ ID NO: 20338 - RNA, 4452 nt, Artificial Sequence
  NAV1__Homo_sapiens__NP_001161210
augcugcaccugccccugcccagaagcggcagaaccgugaacuuccccagaagcugggacgagagcagcagcaucagcagcggccugagcgacgccagcgacaaccugagcagcgaggaguucaacgccagcagcagccugaacagccugcccagcacccccaccgccagcagaagaaacagcaccaucgugcugagaaccgacagcgagaagagaagccuggccgagagcggccugagcugguucagcgagagcgaggagaaggcccccaagaagcuggaguacgacagcggcagccugaagauggagcccggcaccagcaaguggagaagagagagacccgagagcugcgacgacagcagcaagggcggcgagcugaagaagcccaucagccugggccaccccggcagccugaagaagggcaagaccccccccguggccgugaccagccccaucacccacaccgcccagagcgcccugaagguggccggcaagcccgagggcaaggccaccgacaagggcaagcuggccgugaagaacaccggccugcagagaagcagcagcgacgccggcagagacagacugagcgacgccaagaagccccccagcggcaucgccagacccagcaccagcggcagcuucggcuacaagaagcccccccccgccaccggcaccgccaccgugaugcagaccggcggcagcgccacccugagcaagauccagaagagcagcggcauccccgugaagcccgugaacggcagaaagaccagccuggacgugagcaacagcgccgagcccggcuuccuggcccccggcgccagaagcaacauccaguacagaagccugcccagacccgccaagagcagcagcaugagcgugaccggcggcagaggcggccccagacccgugagcagcagcaucgaccccagccugcugagcaccaagcagggcggccugacccccagcagacugaaggagcccaccaagguggccagcggcagaaccacccccgcccccgugaaccagaccgacagagagaaggagaaggccaaggccaaggccguggcccuggacagcgacaacaucagccugaagagcaucggcagccccgagagcacccccaagaaccaggccagccaccccaccgccaccaagcuggccgagcugccccccaccccccugagagccaccgccaagagcuucgugaagccccccagccuggccaaccuggacaaggugaacagcaacagccuggaccugcccagcagcagcgacaccacccacgccagcaaggugcccgaccugcacgccaccagcagcgccagcggcggcccccugcccagcugcuucacccccagccccgcccccauccugaacaucaacagcgccagcuucagccagggccuggagcugaugagcggcuucagcgugcccaaggagaccagaauguaccccaagcugagcggccugcacagaagcauggagagccugcagaugcccaugagccugcccagcgccuuccccagcagcacccccgugcccaccccccccgccccccccgccgcccccaccgaggaggagaccgaggagcugaccuggagcggcagccccagagccggccagcuggacagcaaccagagagacagaaacacccugcccaagaagggccugagauaccagcugcagagccaggaggagaccaaggagagaagacacagccacaccaucggcggccugcccgagagcgacgaccagagcgagcugcccagcccccccgcccugcccaugagccugagcgccaagggccagcugaccaacaucgugagccccaccgccgccaccacccccagaaucaccagaagcaacagcauccccacccacgaggccgccuucgagcuguacagcggcagccagaugggcagcacccugagccuggccgagagacccaagggcaugaucagaagcggcagcuucagagaccccaccgacgacgugcacggcagcgugcugagccuggccagcagcgccagcagcaccuacagcagcgccgaggagagaaugcagagcgagcagaucagaaagcugagaagagagcuggagagcagccaggagaagguggccacccugaccagccagcugagcgccaacgccaaccugguggccgccuucgagcagagccuggugaacaugaccagcagacugagacaccuggccgagaccgccgaggagaaggacaccgagcugcuggaccugagagagaccaucgacuuccugaagaagaagaacagcgaggcccaggccgugauccagggcgcccugaacgccagcgagaccacccccaaggagcugagaaucaagagacagaacagcagcgacagcaucagcagccugaacagcaucaccagccacagcagcaucggcagcagcaaggacgccgacgccaagaagaagaagaagaagagcuggcugagaagcagcuucaacaaggccuucagcaucaagaagggccccaagagcgccagcagcuacagcgacaucgaggagaucgccacccccgacagcagcgcccccagcagccccaagcugcagcacggcagcaccgagaccgccagccccagcaucaagagcagcaccagcagcagcgugggcaccgacgugaccgagggccccgcccaccccgccccccacaccagacuguuccacgccaacgaggaggaggagcccgagaagaaggaggugagcgagcugagaagcgagcugugggagaaggagaugaagcugaccgacaucagacuggaggcccugaacagcgcccaccagcuggaccagcugagagagaccaugcacaacaugcagcuggagguggaccugcugaaggccgagaacgacagacugaagguggcccccggccccagcagcggcagcacccccggccaggugcccggcagcagcgcccugagcagccccagaagaagccugggccuggcccugacccacagcuucggccccagccuggccgacaccgaccugagccccauggacggcaucagcaccugcggccccaaggaggaggugacccugagagugguggugagaaugcccccccagcacaucaucaagggcgaccugaagcagcaggaguucuuccugggcugcagcaaggugagcggcaagguggacuggaagaugcuggacgaggccguguuccagguguucaaggacuacaucagcaagauggaccccgccagcacccugggccugagcaccgagagcauccacggcuacagcaucagccacgugaagagagugcuggacgccgagccccccgagaugccccccugcagaagaggcgugaacaacaucagcgugagccugaagggccugaaggagaagugcguggacagccugguguucgagacccugauccccaagcccaugaugcagcacuacaucagccugcugcugaagcacagaagacuggugcugagcggccccagcggcaccggcaagaccuaccugaccaacagacuggccgaguaccugguggagagaagcggcagagaggugaccgagggcaucgugagcaccuucaacaugcaccagcagagcugcaaggaccugcagcuguaccugagcaaccuggccaaccagaucgacagagagaccggcaucggcgacgugccccuggugauccugcuggacgaccugagcgaggccggcagcaucagcgagcuggugaacggcgcccugaccugcaaguaccacaagugccccuacaucaucggcaccaccaaccagcccgugaagaugacccccaaccacggccugcaccugagcuucagaaugcugaccuucagcaacaacguggagcccgccaacggcuuccuggugagauaccugagaagaaagcugguggagagcgacagcgacaucaacgccaacaaggaggagcugcugagagugcuggacugggugcccaagcugugguaccaccugcacaccuuccuggagaagcacagcaccagcgacuuccugaucggccccugcuucuuccugagcugccccaucggcaucgaggacuucagaaccugguucaucgaccuguggaacaacagcaucauccccuaccugcaggagggcgccaaggacggcaucaaggugcacggccagaaggccgccugggaggaccccguggagugggugagagacacccugcccuggcccagcgcccagcaggaccagagcaagcuguaccaccugcccccccccaccgugggcccccacagcaucgccagcccccccgaggacagaaccgugaaggacagcacccccagcagccuggacagcgacccccugauggccaugcugcugaagcugcaggaggccgccaacuacaucgagagccccgacagagagaccauccuggaccccaaccugcaggccacccuguaa

SEQ ID NO: 20339 - RNA, 7098 nt, Artificial Sequence
  NAV2__Homo_sapiens__NP_001104488
auggagagcgugagcgagagcagccagcagcagaagagaaagcccgugauccacggccuggaggaccagaagagaaucuacaccgacugggccaaccacuaccuggccaagagcggccacaagagacugaucagagaccugcagcaggacgugaccgacggcgugcugcuggcccagaucauccaggugguggccaacgagaagaucgaggacaucaacggcugccccaagaacagaagccagaugaucgagaacaucgacgccugccugaacuuccuggccgccaagggcaucaacauccagggccugagcgccgaggagaucagaaacggcaaccugaaggccauccugggccuguucuucagccugagcagauacaagcagcagcagcagcagccccagaagcagcaccugagcagcccccugccccccgccgugagccagguggccggcgcccccagccagugccaggccggcaccccccagcagcaggugcccgugaccccccaggcccccugccagccccaccagcccgccccccaccagcagagcaaggcccaggccgagaugcagagcagacugcccggccccaccgccagagugagcgccgccggcagcgaggccaagaccagaggcggcagcaccaccgccaacaacagaagaagccagagcuucaacaacuacgacaagagcaagcccgugaccagccccccccccccccccagcagccacgagaaggagccccuggccagcagcgccagcagccaccccggcaugagcgacaacgcccccgccagccuggagagcggcagcagcagcacccccaccaacugcagcaccagcagcgccaucccccagcccggcgccgccaccaagcccuggagaagcaagagccugagcgugaagcacagcgccaccgugagcaugcugagcgugaagccccccggccccgaggcccccagacccacccccgaggccaugaagcccgcccccaacaaccagaagagcaugcuggagaagcugaagcuguucaacagcaagggcggcagcaaggccggcgagggccccggcagcagagacaccagcugcgagagacuggagacccugcccagcuucgaggagagcgaggagcuggaggccgccagcagaaugcugaccaccgugggccccgccagcagcagccccaagaucgcccugaagggcaucgcccagagaaccuucagcagagcccugaccaacaagaagagcagccugaagggcaacgagaaggagaaggagaagcagcagagagagaaggacaaggagaagagcaaggaccuggccaagagagccagcgugaccgagagacuggaccugaaggaggagcccaaggaggaccccagcggcgccgccgugcccgagaugcccaagaagagcagcaagaucgccagcuucauccccaagggcggcaagcugaacagcgccaagaaggagcccauggcccccagccacagcggcauccccaagcccggcaugaagagcaugcccggcaagagccccagcgcccccgcccccagcaaggagggcgagagaagcagaagcggcaagcugagcagcggccugccccagcagaagccccagcuggacggcagacacagcagcagcagcagcagccuggccagcagcgagggcaagggccccggcggcaccacccugaaccacagcaucagcagccagaccgugagcggcagcgugggcaccacccagaccaccggcagcaacaccgugagcgugcagcugccccagccccagcagcaguacaaccaccccaacaccgccaccguggcccccuuccuguacagaagccagaccgacaccgagggcaacgugaccgccgagagcagcagcaccggcgugagcguggagcccagccacuucaccaagaccggccagcccgcccuggaggagcugaccggcgaggaccccgaggccagaagacugagaaccgugaagaacaucgccgaccugagacagaaccuggaggagaccaugagcagccugagaggcacccaggugacccacagcacccuggagaccaccuucgacaccaacgugaccaccgagaugagcggcagaagcauccugagccugaccggcagacccaccccccugagcuggagacugggccagagcagccccagacugcaggccggcgacgcccccagcaugggcaacggcuacccccccagagccaacgccagcagauucaucaacaccgagagcggcagauacguguacagcgccccccugagaagacagcuggccagcagaggcagcagcgugugccacguggacgugagcgacaaggccggcgacgagauggaccuggagggcaucagcauggacgcccccggcuacaugagcgacggcgacgugcugagcaagaacaucagaaccgacgacaucaccagcggcuacaugaccgacggcggccugggccuguacaccagaagacugaacagacugcccgacggcauggccguggugagagagacccugcagagaaacaccagccugggccugggcgacgccgacagcugggacgacagcagcagcgugagcagcggcaucagcgacaccaucgacaaccugagcaccgacgacaucaacaccagcagcagcaucagcagcuacgccaacacccccgccagcagcagaaagaaccuggacgugcagaccgacgccgagaagcacagccagguggagagaaacagccuguggagcggcgacgacgugaagaagagcgacggcggcagcgacagcggcaucaagauggagcccggcagcaaguggagaagaaaccccagcgacgugagcgacgagagcgacaagagcaccagcggcaagaagaaccccgugaucagccagaccggcagcuggagaagaggcaugaccgcccaggugggcaucaccaugcccagaaccaagcccagcgcccccgccggcgcccugaagacccccggcaccggcaagaccgacgacgccaaggugagcgagaagggcagacugagccccaaggccagccaggugaagagaagccccagcgacgccggcagaagcagcggcgacgagagcaagaagccccugcccagcagcagcagaacccccaccgccaacgccaacagcuucggcuucaagaagcagagcggcagcgccgccggccuggccaugaucaccgccagcggcgugaccgugaccagcagaagcgccacccugggcaagauccccaagagcagcgcccuggugagcagaagcgccggcagaaagagcagcauggacggcgcccagaaccaggacgacggcuaccuggcccugagcagcagaaccaaccugcaguacagaagccugcccagacccagcaagagcaacagcagaaacggcgccggcaacagaagcagcaccagcagcaucgacagcaacaucagcagcaagagcgccggccugcccgugcccaagcugagagagcccagcaagaccgcccugggcagcagccugcccggccuggugaaccagaccgacaaggagaagggcaucagcagcgacaacgagagcguggccagcugcaacagcgugaaggugaaccccgccgcccagcccgugagcagccccgcccagaccagccugcagcccggcgccaaguaccccgacguggccagccccacccugagaagacuguucggcggcaagcccaccaagcaggugcccaucgccaccgccgagaacaugaagaacagcguggugaucagcaacccccacgccaccaugacccagcagggcaaccuggacagccccagcggcagcggcgugcugagcagcggcagcagcagcccccuguacagcaagaacguggaccugaaccagagcccccuggccagcagccccagcagcgcccacagcgcccccagcaacagccugaccuggggcaccaacgccagcagcagcagcgccgugagcaaggacggccugggcuuccagagcgugagcagccugcacaccagcugcgagagcaucgacaucagccugagcagcggcggcgugcccagccacaacagcagcaccggccugaucgccagcagcaaggacgacagccugacccccuucgugagaaccaacagcgugaagaccacccugagcgagagcccccugagcagccccgccgccagccccaaguucugcagaagcacccugcccagaaagcaggacagcgacccccaccuggacagaaacacccugcccaagaagggccugagauacacccccaccagccagcugagaacccaggaggacgccaaggaguggcugagaagccacagcgccggcggccugcaggacaccgccgccaacagccccuucagcagcggcagcagcgugaccagccccagcggcaccagauucaacuucagccagcuggccagccccaccaccgugacccagaugagccugagcaaccccaccaugcugagaacccacagccugagcaacgccgacggccaguacgaccccuacaccgacagcagauucagaaacagcagcaugagccuggacgagaagagcagaaccaugagcagaagcggcagcuucagagacggcuucgaggaggugcacggcagcagccugagccuggugagcagcaccagcagcguguacagcacccccgaggagaagugccagagcgagaucagaaagcugagaagagagcuggacgccagccaggagaaggugagcgcccugaccacccagcugaccgccaacgcccaccugguggccgccuucgagcagagccugggcaacaugaccaucagacugcagagccugaccaugaccgccgagcagaaggacagcgagcugaacgagcugagaaagaccaucgagcugcugaagaagcagaacgccgccgcccaggccgccaucaacggcgugaucaacacccccgagcugaacugcaagggcaacggcaccgcccagagcgccgaccugagaaucagaagacagcacagcagcgacagcgugagcagcaucaacagcgccaccagccacagcagcgugggcagcaacaucgagagcgacagcaagaagaagaagagaaagaacuggcugagaagcagcuucaagcaggccuucggcaagaagaagagccccaagagcgccagcagccacagcgacaucgaggagaugaccgacagcagccugcccagcagccccaagcugccccacaacggcagcaccggcagcaccccccugcugagaaacagccacagcaacagccugaucagcgagugcauggacagcgaggccgagaccgugaugcagcugagaaacgagcugagagacaaggagaugaagcugaccgacaucagacuggaggcccugagcagcgcccaccagcuggaccagcugagagaggccaugaacagaaugcagagcgagaucgagaagcugaaggccgagaacgacagacugaagagcgagagccagggcagcggcugcagcagagcccccagccaggugagcaucagcgccagccccagacagagcaugggccugagccagcacagccugaaccugaccgagagcaccagccuggacaugcugcuggacgacaccggcgagugcagcgccagaaaggagggcggcagacacgugaagaucguggugagcuuccaggaggagaugaaguggaaggaggacagcagaccccaccuguuccugaucggcugcaucggcgugagcggcaagaccaagugggacgugcuggacggcguggugagaagacuguucaaggaguacaucauccacguggaccccgugagccagcugggccugaacagcgacagcgugcugggcuacagcaucggcgagaucaagagaagcaacaccagcgagacccccgagcugcugcccugcggcuaccuggugggcgagaacaccaccaucagcgugaccgugaagggccuggccgagaacagccuggacagccugguguucgagagccugauccccaagcccauccugcagagauacgugagccugcugaucgagcacagaagaaucauccugagcggccccagcggcaccggcaagaccuaccuggccaacagacugagcgaguacaucgugcugagagagggcagagagcugaccgacggcgugaucgccaccuucaacguggaccacaagagcagcaaggagcugagacaguaccugagcaaccuggccgaccagugcaacagcgagaacaacgccguggacaugccccuggugaucauccuggacaaccugcaccacgugagcagccugggcgagaucuucaacggccugcugaacugcaaguaccacaagugccccuacaucaucggcaccaugaaccaggccaccagcagcacccccaaccugcagcugcaccacaacuucagaugggugcugugcgccaaccacaccgagcccgugaagggcuuccugggcagauuccugagaagaaagcugauggagaccgagaucagcggcagagugagaaacauggagcuggugaagaucaucgacuggauccccaagguguggcaccaccugaacagauuccuggaggcccacagcagcagcgacgugaccaucggccccagacuguuccugagcugccccaucgacguggacggcagcagagugugguucaccgaccuguggaacuacagcaucauccccuaccugcuggaggccgugagagagggccugcagcuguacggcagaagagcccccugggaggaccccgccaagugggugauggacaccuaccccugggccgccagcccccagcagcacgaguggcccccccugcugcagcugagacccgaggacgugggcuucgacggcuacagcaugcccagagagggcagcaccagcaagcagaugccccccagcgacgccgagggcgacccccugaugaacaugcugaugagacugcaggaggccgccaacuacagcagcccccagagcuacgacagcgacagcaacagcaacagccaccacgacgacauccuggacagcagccuggagagcacccuguaa

SEQ ID NO: 20340 - RNA, 7158 nt, Artificial Sequence
  NAV3__Homo_sapiens__NP_001019554
augcccgugcugggcguggccagcaagcugagacagcccgccgugggcagcaagcccgugcacaccgcccugcccauccccaaccugggcaccaccggcagccagcacugcagcagcagaccccuggagcugaccgagaccgagagcagcaugcugagcugccagcuggcccugaagagcaccugcgaguucggcgagaagaagccccugcagggcaaggccaaggagaaggaggacagcaagaucuacaccgacugggccaaccacuaccuggccaagagcggccacaagagacugaucaaggaccugcagcaggacaucgccgacggcgugcugcuggccgagaucauccagaucaucgccaacgagaagguggaggacaucaacggcugccccagaagccagagccagaugaucgagaacguggacgugugccugagcuuccuggccgccagaggcgugaacgugcagggccugagcgccgaggagaucagaaacggcaaccugaaggccauccugggccuguucuucagccugagcagauacaagcagcagcagcaccaccagcagcaguacuaccagagccugguggagcugcagcagagagugacccacgccagcccccccagcgaggccagccaggccaagacccagcaggacaugcagagcagccuggccgccagauacgccacccagagcaaccacagcggcaucgccaccagccagaagaagcccaccagacugcccggccccagcagagugcccgccgccggcagcagcagcaaggugcagggcgccagcaaccugaacagaagaagccagagcuucaacagcaucgacaagaacaagccccccaacuacgccaacggcaacgagaaggacagcagcaagggcccccagagcagcagcggcgugaacggcaacgugcagccccccagcaccgccggccagccccccgccagcgccauccccagccccagcgccagcaagcccuggagaagcaagagcaugaacgugaagcacagcgccaccagcaccaugcugaccgugaagcagagcagcaccgccaccagccccacccccagcagcgacagacugaagccccccgugagcgagggcgugaagaccgcccccagcggccagaagagcaugcuggagaaguucaagcuggugaacgccagaaccgcccugagacccccccagccccccagcagcggccccagcgacggcggcaaggacgacgacgccuucagcgagagcggcgagauggagggcuucaacagcggccugaacagcggcggcagcaccaacagcagccccaaggugagccccaagcuggccccccccaaggccggcagcaagaaccugagcaacaagaagagccugcugcagcccaaggagaaggaggagaagaacagagacaagaacaaggugugcaccgagaagcccgugaaggaggagaaggaccaggugaccgagauggcccccaagaagaccagcaagaucgccagccugauccccaagggcagcaagaccaccgccgccaagaaggagagccugauccccagcagcagcggcauccccaagcccggcagcaaggugcccaccgugaagcagaccaucagccccggcagcaccgccagcaaggagagcgagaaguucagaaccaccaagggcagccccagccagagccugagcaagcccaucaccauggagaaggccagcgccagcagcugccccgccccccuggagggcagagaggccggccaggccagccccagcggcagcugcaccaugaccguggcccagagcagcggccagagcaccggcaacggcgccgugcagcugccccagcagcagcagcacagccaccccaacaccgccaccguggcccccuucaucuacagagcccacagcgagaacgagggcaccgcccugcccagcgccgacagcugcaccagccccaccaagauggaccugagcuacagcaagaccgccaagcagugccuggaggagaucagcggcgaggaccccgagaccagaagaaugagaaccgugaagaacaucgccgaccugagacagaaccuggaggagaccaugagcagccugagaggcacccagaucagccacagcacccuggagaccaccuucgacagcaccgugaccaccgaggugaacggcagaaccauccccaaccugaccagcagacccacccccaugaccuggagacugggccaggccugccccagacugcaggccggcgacgcccccagccugggcgccggcuaccccagaagcggcaccagcagauucauccacaccgaccccagcagauucauguacaccaccccccugagaagagccgccgugagcagacugggcaacaugagccagaucgacaugagcgagaaggccagcagcgaccuggacaugagcagcgagguggacgugggcggcuacaugagcgacggcgacauccugggcaagagccugagaaccgacgacaucaacagcggcuacaugaccgacggcggccugaaccuguacaccagaagccugaacagaauccccgacaccgccaccagcagagacaucauccagagaggcgugcacgacgugaccguggacgccgacagcugggacgacagcagcagcgugagcagcggccugagcgacacccuggacaacaucagcaccgacgaccugaacaccaccagcagcgugagcagcuacagcaacaucaccgugcccagcagaaagaacacccagcugagaaccgacagcgagaagagaagcaccaccgacgagaccugggacagccccgaggagcugaagaagcccgaggaggacuucgacagccacggcgacgccggcggcaaguggaagaccgugagcagcggccugcccgaggaccccgagaaggccggccagaaggccagccugagcgugagccagaccggcagcuggagaagaggcaugagcgcccagggcggcgcccccagcagacagaaggccggcaccagcgcccugaagacccccggcaagaccgacgacgccaaggccagcgagaagggcaaggccccccugaagggcagcagccugcagagaagccccagcgacgccggcaagagcagcggcgacgagggcaagaagccccccagcggcaucggcagaagcaccgccaccagcagcuucggcuucaagaagcccagcggcgugggcagcagcgccaugaucaccagcagcggcgccaccaucaccagcggcagcgccacccugggcaagauccccaagagcgccgccaucggcggcaagagcaacgccggcagaaagaccagccuggacggcagccagaaccaggacgacguggugcugcacgugagcagcaagaccacccugcaguacagaagccugcccagacccagcaagagcagcaccagcggcauccccggcagaggcggccacagaagcagcaccagcagcaucgacagcaacgugagcagcaagagcgccggcgccaccaccagcaagcugagagagcccaccaagaucggcagcggcagaagcagccccgugaccgugaaccagaccgacaaggagaaggagaagguggccgugagcgacagcgagagcgugagccugagcggcagccccaagagcagccccaccagcgccagcgccugcggcgcccagggccugagacagcccggcagcaaguaccccgacaucgccagccccaccuucagaagacuguucggcgccaaggccggcggcaagagcgccagcgcccccaacaccgagggcgugaagagcagcagcgugaugcccagccccagcaccacccuggccagacagggcagccuggagagccccagcagcggcaccggcagcaugggcagcgccggcggccugagcggcagcagcagcccccuguucaacaagcccagcgaccugaccaccgacgugaucagccugagccacagccuggccagcagccccgccagcgugcacagcuucaccagcggcggccuggugugggccgccaacaugagcagcagcagcgccggcagcaaggacacccccagcuaccagagcaugaccagccugcacaccagcagcgagagcaucgaccugccccugagccaccacggcagccugagcggccugaccaccggcacccacgaggugcagagccugcugaugagaaccggcagcgugagaagcacccugagcgagagcaugcagcuggacagaaacacccugcccaagaagggccugagauacacccccagcagcagacaggccaaccaggaggagggcaaggaguggcugagaagccacagcaccggcggccugcaggacaccggcaaccagagcccccuggugagccccagcgccaugagcagcagcgccgccggcaaguaccacuucagcaaccuggugagccccaccaaccugagccaguucaaccugcccggccccagcaugaugagaagcaacagcauccccgcccaggacagcagcuucgaccuguacgacgacagccagcugugcggcagcgccaccagccuggaggagagacccagagccaucagccacagcggcagcuucagagacagcauggaggaggugcacggcagcagccugagccuggugagcagcaccagcagccuguacagcaccgccgaggagaaggcccacagcgagcagauccacaagcugagaagagagcugguggccagccaggagaagguggccacccugaccagccagcugagcgccaacgcccaccugguggccgccuucgagaagagccugggcaacaugaccggcagacugcagagccugaccaugaccgccgagcagaaggagagcgagcugaucgagcugagagagaccaucgagaugcugaaggcccagaacagcgccgcccaggccgccauccagggcgcccugaacggccccgaccacccccccaaggaccugagaaucagaagacagcacagcagcgagagcgugagcagcaucaacagcgccaccagccacagcagcaucggcagcggcaacgacgccgacagcaagaagaagaagaagaagaacugggugaacagcagaggcagcgagcugagaagcagcuucaagcaggccuucggcaagaagaagagcaccaagccccccagcagccacagcgacaucgaggagcugaccgacagcagccugcccgccagccccaagcugccccacaacgccggcgacugcggcagcgccagcaugaagcccagccagagcgccagcgccagcccccugguguggccccccaagaagagacagaacggccccgugaucuacaagcacagaagcagaaucugcgagugcaccgaggccgaggccgagaucauccugcagcugaagagcgagcugagagagaaggagcugaagcugaccgacaucagacuggaggcccugagcagcgcccaccaccuggaccagaucagagaggccaugaacagaaugcagaacgagaucgagauccugaaggccgagaacgacagacugaaggccgagaccggcaacaccgccaagcccaccagaccccccagcgagagcagcagcagcaccagcagcagcagcagcagacagagccugggccugagccugaacaaccugaacaucaccgaggccgugagcagcgacauccugcuggacgacgccggcgacgccaccggccacaaggacggcagaagcgugaagaucaucgugagcaucagcaagggcuacggcagagccaaggaccagaagagccaggccuaccugaucggcagcaucggcgugagcggcaagaccaagugggacgugcuggacggcgugaucagaagacuguucaaggaguacguguucagaaucgacaccagcaccagccugggccugagcagcgacugcaucgccagcuacugcaucggcgaccugaucagaagccacaaccuggaggugcccgagcugcugcccugcggcuaccuggugggcgacaacaacaucaucaccgugaaccugaagggcguggaggagaacagccuggacagcuucguguucgacacccugauccccaagcccaucacccagagauacuucaaccugcugauggagcaccacagaaucauccugagcggccccagcggcaccggcaagaccuaccuggccaacaagcuggccgaguacgugaucaccaagagcggcagaaagaagaccgaggacgccaucgccaccuucaacguggaccacaagagcagcaaggagcugcagcaguaccuggccaaccuggccgagcagugcagcgccgacaacaacggcguggagcugcccguggugaucauccuggacaaccugcaccacgugggcagccugagcgacaucuucaacggcuuccugaacugcaaguacaacaagugccccuacaucaucggcaccaugaaccagggcgugagcagcagccccaaccuggagcugcaccacaacuucagaugggugcugugcgccaaccacaccgagcccgugaagggcuuccugggcagauaccugagaagaaagcugaucgagaucgagaucgagagaaacaucagaaacaacgaccuggugaagaucaucgacuggauccccaagaccuggcaccaccugaacagcuuccuggagacccacagcagcagcgacgugaccaucggccccagacuguuccugcccugccccauggacguggagggcagcagagugugguucauggaccuguggaacuacagccuggugcccuacauccuggaggccgugagagagggccugcagauguacggcaagagaacccccugggaggaccccagcaagugggugcuggacaccuaccccuggagcagcgccacccugccccaggagagccccgcccugcugcagcugagacccgaggacgugggcuacgagagcugcaccagcaccaaggaggccaccaccagcaagcacaucccccagaccgacaccgagggcgacccccugaugaacaugcugaugaagcugcaggaggccgccaacuacagcagcacccagagcugcgacagcgagagcaccagccaccacgaggacauccuggacagcagccuggagagcacccuguaa

SEQ ID NO: 20341 - RNA, 7116 nt, Artificial Sequence
  NBAS__Homo_sapiens__NP_056993
auggccgcccccgagagcggccccgcccugagccccggcaccgccgagggcgaggaggagaccauccuguacgaccugcuggugaacaccgaguggccccccgagaccgaggugcagcccagaggcaaccagaagcacggcgccagcuucaucaucaccaaggccaucagagacagacugcuguuccugagacaguacaucugguacagccccgcccccuuccugcugcccgacggccuggugagacuggugaacaagcagaucaacuggcaccuggugcuggccagcaacggcaagcugcuggccgccgugcaggaccagugcguggagaucagaagcgccaaggacgacuucaccagcaucaucggcaagugccaggugcccaaggaccccaagccccaguggagaagaguggccuggagcuacgacugcacccugcuggccuacgccgagagcaccggcaccgugagaguguucgaccugaugggcagcgagcuguucgugaucagccccgccagcagcuucaucggcgaccugagcuacgccaucgccggccugaucuuccuggaguacaaggccagcgcccaguggagcgccgagcugcuggugaucaacuacagaggcgagcugagaagcuaccuggugagcgugggcaccaaccagagcuaccaggagagccacugcuucagcuucagcagccacuacccccacggcaucaacaccgccaucuaccaccccggccacagacugcugcuggugggcggcugcgagaccgccgaggugggcaugagcaaggccagcagcugcggccugagcgccuggagagugcugagcggcagccccuacuacaagcaggugaccaacggcggcgacggcgugaccgccgugcccaagacccugggccugcugagaaugcugagcgugaaguucuacagcagacagggccaggagcaggacggcaucuucaagaugagccugagccccgacggcaugcugcuggccgccauccacuucagcggcaagcugagcaucugggccauccccagccugaagcagcagggcgaguggggccagaacgagcagcccggcuacgacgaccugaaccccgacuggagacugagcaccgagaagagaaagaagaucaaggacaaggagagcuucuacccccugaucgacgugaacuggugggccgacagcgccgugacccuggccagaugcagcggcgcccugaccgugagcagcgugaagacccugaagaaccugcugggcaagagcugcgagugguucgagcccagcccccaggugaccgccacccacgacggcggcuuccugagccuggagugcgagaucaagcuggcccccaagagaagcagacuggagaccagagccggcgaggaggacgagggcgaggaggacagcgacagcgacuacgagaucagcgccaaggccagauacuucggcuacaucaagcagggccuguaccuggugaccgagauggagagauucgccccccccagaaagagacccagaaccaucaccaagaacuacagacuggugagccugagaagcaccacccccgaggagcuguaccagagaaagaucgagagcgaggaguacgaggaggcccugagccuggcccacaccuacggccuggacaccgaccugguguaccagagacaguggagaaagagcgccgugaacguggccagcauccagaacuaccugagcaagaucaagaagagaagcugggugcugcacgagugccuggagagagugcccgagaacguggacgccgccaaggagcugcugcaguacggccugaagggcaccgaccuggaggcccugcuggccaucggcaagggcgccgacgacggcagauucacccugcccggcgagaucgacaucgacagcaucagcuacgaggagcugagcccccccgacgaggagcccgccaagaacaagaaggagaaggagcugaagaagagacaggagcugcugaagcuggugaacuucagcaagcugacccuggagcagaaggagcugugcagaugcagaagaaagcugcugaccuaccuggacagacuggccaccuacgaggagauccugggcgugccccacgccagcgagcagagauacgacgccgaguucuucaagaaguucagaaaccagaacaucgugcugagcgccagaaccuacgcccaggagagcaacgugcaggcccuggagauccuguucaccuaccacggcagcgaccugcugccccacagacuggccauccugagcaacuuccccgagaccaccagcccccacgaguacagcgugcugcugcccgaggccugcuucaacggcgacagccugaugaucauccccuggcacgagcacaagcacagagccaaggacuggugcgaggagcuggccugcagaauggugguggagcccaaccugcaggacgagagcgaguuccuguacgccgcccagcccgagcugcugagauucagaaugacccagcugaccguggagaaggugauggacugguaccagaccagagccgaggagaucgagcacuacgccagacagguggacugcgcccugagccugaucagacugggcauggagagaaacauccccggccugcuggugcugugcgacaaccuggugacccuggagacccugguguacgaggccagaugcgacgugacccugacccugaaggagcugcagcagaugaaggacaucgagaagcugagacugcugaugaacagcugcagcgaggacaaguacgugaccagcgccuaccaguggauggugcccuuccugcacagaugcgagaagcagagccccggcguggccaacgagcugcugaaggaguaccuggugacccuggccaagggcgaccugaaguucccccugaagaucuuccagcacagcaagcccgaccugcagcagaagaucauccccgaccaggaccagcugauggccaucgcccuggagugcaucuacaccugcgagagaaacgaccagcugugccugugcuacgaccugcuggagugccugcccgagagaggcuacggcgacaagaccgaggccaccaccaagcugcacgacaugguggaccagcuggagcagauccugagcgugagcgagcugcuggagaagcacggccuggagaagcccaucagcuucgugaagaacacccagagcagcagcgaggaggccagaaagcugauggugagacugaccagacacaccggcagaaagcagccccccgugagcgagagccacuggagaacccugcugcaggacaugcugaccaugcagcagaacguguacaccugccuggacagcgacgccugcuacgagaucuucaccgagagccugcugugcagcagcagacuggagaacauccaccuggccggccagaugaugcacugcagcgccugcagcgagaacccccccgccggcaucgcccacaagggcaagccccacuacagagugagcuacgagaagagcaucgaccuggugcuggccgccagcagagaguacuucaacagcagcaccaaccugaccgacagcugcauggaccuggccagaugcugccugcagcugaucaccgacagaccccccgccauccaggaggagcuggaccugauccaggccgugggcugccuggaggaguucggcgugaagauccugccccugcaggugagacugugccccgacagaaucagccugaucaaggagugcaucagccagagccccaccugcuacaagcagagcaccaagcugcugggccuggccgagcugcugagaguggccggcgagaaccccgaggagagaagaggccaggugcugauccugcugguggagcaggcccugagauuccacgacuacaaggccgccagcaugcacugccaggagcugauggccaccggcuaccccaagagcugggacgugugcagccagcugggccagagcgagggcuaccaggaccuggccaccagacaggagcugauggccuucgcccugacccacugcccccccagcagcaucgagcugcugcuggccgccagcagcagccugcagaccgagauccuguaccagagagugaacuuccagauccaccacgagggcggcgagaacaucagcgccagcccccugaccagcaaggccgugcaggaggacgaggugggcgugcccggcagcaacagcgccgaccugcugagauggaccaccgccaccaccaugaaggugcugagcaacaccaccaccaccaccaaggccgugcugcaggccgugagcgacggccagugguggaagaagagccugaccuaccugagaccccugcagggccagaagugcggcggcgccuaccagaucggcaccaccgccaacgaggaccuggagaagcagggcugccaccccuucuacgagagcgugaucagcaaccccuucguggccgagagcgagggcaccuacgacaccuaccagcacgugcccguggagagcuucgccgaggugcugcugagaaccggcaagcuggccgaggccaagaacaagggcgagguguuccccaccaccgaggugcugcugcagcuggccagcgaggcccugcccaacgacaugacccuggcccuggccuaccugcuggcccugccccaggugcuggacgccaacagaugcuucgagaagcagagccccagcgcccugagccugcagcuggccgccuacuacuacagccugcagaucuacgccagacuggcccccugcuucagagacaagugccacccccuguacagagccgaccccaaggagcugaucaagauggugaccagacacgugaccagacacgagcacgaggccuggcccgaggaccugaucagccugaccaagcagcugcacugcuacaacgagagacugcuggacuucacccaggcccagauccugcagggccugagaaagggcguggacgugcagagauucaccgccgacgaccaguacaagagagagaccauccugggccuggccgagacccuggaggagagcguguacagcaucgccaucagccuggcccagagauacagcgugagcagaugggagguguucaugacccaccuggaguuccuguucaccgacagcggccugagcacccuggagaucgagaacagagcccaggaccugcaccuguucgagacccugaagaccgaccccgaggccuuccaccagcacauggugaaguacaucuaccccaccaucggcggcuucgaccacgagagacugcaguacuacuucacccugcuggagaacugcggcugcgccgaccugggcaacugcgccaucaagcccgagacccacaucagacugcugaagaaguucaaggugguggccagcggccugaacuacaagaagcugaccgacgagaacaugagcccccuggaggcccuggagcccgugcugagcagccagaacauccugagcaucagcaagcuggugcccaagauccccgagaaggacggccagaugcugagccccagcagccuguacaccaucuggcugcagaagcuguucuggaccggcgacccccaccugaucaagcaggugcccggcagcagccccgaguggcugcacgccuacgacgugugcaugaaguacuucgacagacugcaccccggcgaccugaucaccgugguggacgccgugaccuucagccccaaggccgugaccaagcugagcguggaggccagaaaggagaugaccagaaaggccaucaagaccgugaagcacuucaucgagaagcccagaaagagaaacagcgaggacgaggcccaggaggccaaggacagcaaggugaccuacgccgacacccugaaccaccuggagaagagccuggcccaccuggagacccugagccacagcuucauccugagccugaagaacagcgagcaggagacccugcagaaguacagccaccuguacgaccugagcagaagcgagaaggagaagcugcacgacgaggccguggccaucugccuggacggccagccccuggccaugauccagcagcugcuggagguggccgugggcccccuggacaucagccccaaggacaucgugcagagcgccaucaugaagaucaucagcgcccugagcggcggcagcgccgaccugggcggccccagagacccccugaaggugcuggagggcgugguggccgccgugcacgccagcguggacaagggcgaggagcuggugagccccgaggaccugcuggaguggcugagacccuucugcgccgacgacgccuggcccgugagacccagaauccacgugcugcagauccugggccagagcuuccaccugaccgaggaggacagcaagcugcugguguucuucagaaccgaggccauccugaaggccagcuggccccagagacagguggacaucgccgacaucgagaacgaggagaacagauacugccuguucauggagcugcuggagagcagccaccacgaggccgaguuccagcaccuggugcugcugcugcaggccuggccccccaugaagagcgaguacgugaucaccaacaaccccugggugagacuggccaccgugaugcugaccagaugcaccauggagaacaaggagggccugggcaacgaggugcugaagaugugcagaagccuguacaacaccaagcagaugcugcccgccgagggcgugaaggagcugugccugcugcugcugaaccagagccugcugcugcccagccugaagcugcugcuggagagcagagacgagcaccugcacgagauggcccuggagcagaucaccgccgugaccaccgugaacgacagcaacugcgaccaggagcugcugagccugcugcuggacgccaagcugcuggugaagugcgugagcacccccuucuaccccagaaucguggaccaccugcuggccagccugcagcagggcagaugggacgccgaggagcugggcagacaccugagagaggccggccacgaggccgaggccggcagccugcugcuggccgugagaggcacccaccaggccuucagaaccuucagcaccgcccugagagccgcccagcacuggguguaa

SEQ ID NO: 20342 - RNA, 2220 nt, Artificial Sequence
  NBEA__Homo_sapiens__NP_001191126
auguucagcgagaucagagccguguucagcagaagauaccugcugcagaacaccgcccuggagguguucauggccaacagaaccagcgugauguucaacuuccccgaccaggccaccgugaagaaggugguguacagccugcccagagugggcgugggcaccagcuacggccugccccaggccagaagaaucagccuggccacccccagacagcuguacaagagcagcaacaugacccagagauggcagagaagagagaucagcaacuucgaguaccugauguuccugaacaccaucgccggcagaaccuacaacgaccugaaccaguaccccguguuccccugggugcugaccaacuacgagagcgaggagcuggaccugacccugcccggcaacuucagagaccugagcaagcccaucggcgcccugaaccccaagagagccguguucuacgccgagagauacgagaccugggaggacgaccagagcccccccuaccacuacaacacccacuacagcaccgccaccagcacccugagcuggcuggugagaaucgagcccuucaccaccuucuuccugaacgccaacgacggcaaguucgaccaccccgacagaaccuucagcagcguggccagaagcuggagaaccagccagagagacaccagcgacgugaaggagcugauccccgaguucuacuaccugcccgagauguucgugaacagcaacggcuacaaccugggcgugagagaggacgaggugguggugaacgacguggaccugccccccugggccaagaagcccgaggacuucgugagaaucaacagaauggcccuggagagcgaguucgugagcugccagcugcaccaguggaucgaccugaucuucggcuacaagcagagaggccccgaggccgugagagcccugaacguguuccacuaccugaccuacgagggcagcgugaaccuggacagcaucaccgaccccgugcugagagaggccauggaggcccagauccagaacuucggccagacccccagccagcugcugaucgagccccacccccccagaagcagcgccaugcaccugugcuuccugccccagagcccccugauguucaaggaccagaugcagcaggacgugaucauggugcugaaguuccccagcaacagccccgugacccacguggccgccaacacccugccccaccugaccauccccgccguggugaccgugaccugcagcagacuguucgccgugaacagauggcacaacaccgugggccugagaggcgcccccggcuacagccuggaccaggcccaccaccugcccaucgagauggacccccugaucgccaacaacagcggcgugaacaagagacagaucaccgaccugguggaccagagcauccagaucaacgcccacugcuucguggugaccgccgacaacagauacauccugaucugcggcuucugggacaagagcuucagaguguacagcaccgagaccggcaagcugacccagaucguguucggccacugggacguggugaccugccuggccagaagcgagagcuacaucggcggcgacugcuacaucgugagcggcagcagagacgccacccugcugcugugguacuggagcggcagacaccacaucaucggcgacaaccccaacagcagcgacuaccccgcccccagagccgugcugaccggccacgaccacgagguggugugcgugagcgugugcgccgagcugggccuggugaucagcggcgccaaggagggccccugccuggugcacaccaucaccggcgaccugcugagagcccuggagggccccgagaacugccuguuccccagacugaucagcgugagcagcgagggccacugcaucaucuacuacgagagaggcagauucagcaacuucagcaucaacggcaagcugcuggcccagauggagaucaacgacagcaccagagccauccugcugagcagcgacggccagaaccuggugaccggcggcgacaacggcgugguggagguguggcaggccugcgacuucaagcagcuguacaucuaccccggcugcgacgccggcaucagagccauggaccugagccacgaccagagaacccugaucaccggcauggccagcggcagcaucguggccuucaacaucgacuucaacagauggcacuacgagcaccagaacagauacuaa

SEQ ID NO: 20343 - RNA, 8085 nt, Artificial Sequence
  NBEAL1__Homo_sapiens__NP_001107604
auggccagcagagagagacuguucgagcuguggaugcuguacugcaccaagaaggaccccgacuaccugaagcuguggcuggacaccuucgugagcagcuacgagcaguuccuggacguggacuucgagaagcugcccaccagaguggacgacaugccccccggcaucagccugcugcccgacaacauccugcaggugcugagaauccagcugcugcagugcgugcagaagauggccgacggccuggaggagcagcagcaggcccugagcauccugcuggugaaguucuucaucauccugugcagaaaccugagcaacguggaggagaucggcaccugcagcuacaucaacuacgugaucaccaugaccacccuguacauccagcagcugaagagcaagaagaaggagaaggagauggccgaccagaccugcaucgaggaguucgugauccacgcccuggccuucugcgagagccuguacgaccccuacagaaacuggagacacagaaucagcggcagaauccugagcaccguggagaagagcagacagaaguacaagcccgccagccugaccguggaguucgugcccuucuucuaccagugcuuccaggagagcgagcaccugaaggagagccugaagugcugccugcugcaccuguucggcgccaucguggccggcggccagagaaacgcccugcaggccaucagccccgccaccauggaggugcugaugagagugcuggccgacugcgacagcugggaggacggcgaccccgaggaggugggcagaaaggccgagcugacccugaagugccugaccgagguggugcacauccugcugagcagcaacagcgaccagagacagguggagaccagcaccauccuggagaacuacuucaagcugcugaacagcgaccacagcgcccugcccaaccagagaagaagcagacagugggagaacagauucaucgcccugcagaucaagaugcugaacaccaucaccgccaugcuggacugcaccgacagacccgugcugcaggccaucuuccugaacagcaacugcuucgagcaccugaucagacugcugcagaacugcaagguguuccagggccagcuggacugccuggccaucagcaccauccaggcccugaccgccgugaugaacaagagccccgccgccaaggagguguucaaggagagaaucggcuacacccacaugcuggaggugcugaagagccugggccagcccccccuggagcugcugaaggagcugaugaacauggccguggagggcgaccacaccagcgugggcauccugggcaucagcaacgugcagccccugcugcugcugauccaguggcugcccgagcugcagagccacgaccugcagaucuucaucagcgacuggcugaagagaaucugcugcaucaacagacagagcagaaccaccugcgugaacgccaacaugggcaucagaaucaucgagacccuggaccugcacagcagccugcaccagaccugcgccgagaaccugaucgccauccacggcagccugggcagccagagcgugagcagcgaggagaucagaagacugcugagacugcugagaguggacgagagcgagagcgugcaccccuacgugacccccgugaccagagccauccugaccauggccagaaagcugagccuggagagcgcccugcaguacuucaaccugagccacagcauggccggcaucagcgugccccccauccagaaguggcccggcagcgccuucagcuucagcgccugguucugccuggaccaggaccagcugacccugggcaucgccaacaagggcggcaagagaaagcagcuguacagcuucuucaccggcagcggcaugggcuucgaggccuucaucacccacagcggcaugcuggugguggccgugugcaccaagagagaguacgccaccgugaugcugcccgaccacagcuucugcgacagccuguggcacaacaucaccguggugcacaugcccggcaagagacccuucggccagagcuucguguacaucuacgacaacggccagcagaaggugagcgccccccugagauuccccgccaugaacgagcccuucaccagcugcugcaucggcagcgccggccagagaaccaccacccccccccccagccagauccccgacccccccuucagcagccccaucaccccccacagaaccagcuucggcggcauccugagcagcgccagcuggggcggcaccaucgagaagagcaagcugaucaccaagcugaucagcgccggcacccaggacagcgaguggggcugccccaccagccuggagggccagcugggcagcgugaucaucuucuacgagccccugcagcccccccaggugaaggcccuguaccuggccggccccaacugccugagccccuggaagugccaggagagcgacauggccgaccugcccggcaacauccugcuguacuacaccgccaaggccugcaagaacagcaucugccuggaccugagcaccaacugccugcacggcagacugaccggcaacaagguggugaacugggacaucaaggacaucaucaacugcaucggcggccugaacgugcuguucccccugcuggagcagaucagccacuucagcgagggccagauccccgaggagaagaacgagagcaccgugcccgagagcgugacccccguggagggcgacuggcugguguggaccagcaccaaggccagcgagagcagacuggagagaaaccugguggccaccuucauccugaucgugaagcacuucauccagagacaccccaucaaccagggcaaccugauccacagccacggcguggccacccugggcgcccugcugcagaaggugcccagcacccugauggacgugaacgugcugauggccgugcagcugcugaucgagcaggugagccuggagaagaacaugcagcugcugcagcagauguaccaguaccugcuguucgacuucagaaucuggaacagaggcgacuuccccuucagaaucggccacauccaguaccugagcaccaucaucaaggacagcagaagaguguucagaaagaaguacggcgugcaguuccugcuggacacccugagaaucuacuacggcaacggcugcaaguacaacgagcugagccuggacgacaucagaaccaucagaaccagccuguacggccugaucaaguacuuccugugcaagggcggcagccacgaggagauccagagcaucaugggcuacaucgccgccaccaacgaggaggagcagcuguucggcauccuggacgugcuguucagccugcugagaaccagccccaccagaggccagcuguuccugcugcuguucgagcccggcaacgccgacauccuguacgcccugcugcugaaccagaaguacagcgacagacugagagagaucaucuucaagaucauggagcagaugcugaagugcaccaacguguacgagagaagcaagcagcacaucagacugagagaggugggcuacagcggccugggccugcugcugaacgaggcccuggugaacaccagccugaucaagaaccugacccaccagaucaucaacaccgaccccgugaucaacuucaaggaccugcugagcgugguguacaucagccacagagcccacaucaacgugagaguggccaucugcagaaaggugcugcagauccugcaguuccagcccgacgccgcccaccagaucagccagcaggugggcuggcaggacacccuggugagacuguuccugaaggccaaguucgagaacggcaacacccugcacaagcacagcagagccgugcugaugaaggacaacgacaagaacaugagcaccgaggacaccaagaagaacagcgacgagaagaccgacgaggagaagaucaccagcuucgccagcgccaacgugagcagcgaccaguggagccuggaggacagacacagccuggacagcaacaccccccuguuccccgaggacagcagcgugggcgagcugagcuucaagagcgagaaccaggaggaguucuggcacagcaaccccagccaccugagccuggaccugagcggcaucgacagcugcgagaugagcgacagcggcagccaggugcccgacagccugcccagcacccccagccccguggagagcaccaagagcuucagcgugcacagcgacagagagagcagcaucaccaacgacaugggcuucagcgacgacuucagccugcuggagagccaggagagaugcgaggaggagcugcugcagcugcugacccacauccugaacuacgugaugugcaagggccuggagaagagcgacgacgacaccuggaucgagagaggccagguguucagcgcccugagcaagcccggcaucagcagcgagcugcugagacccagcgacgagaucaagcugacccugcugcagaagaugcuggagugggccaucagcgagaacagagaggccaagaccaaccccgugaccgccgagaacgccuucagacuggugcugaucauccaggacuuccugcagagcgagggccuggugaacagcaacauguggaccgagaagcugcuggaggacaugaugcugcuguucgacugccugagcgugugcuacagcgagagccccgugugggugaagcugagccagauccagauccagcugcugcugggcuucaucggcagaggcaaccugcaggugugcgccauggccagcgccaagcugaacacccugcugcagaccaaggugaucgagaaccaggacgaggccugcuacauccugggcaagcuggagcacgugcugagccagagcaucaaggagcagaccgagaucuacagcuuccugaucccccuggugagaacccuggugagcaagaucuacgagcugcuguucaugaaccugcaccugcccagccugcccuucaccaacggcagcagcagcuucuucgaggacuuccaggaguacugcaacagcaacgaguggcagguguacaucgagaaguacaucgugcccuacaugaagcaguacgaggcccacaccuucuacgacggccacgagaacauggcccuguacuggaaggacugcuacgaggcccugauggugaacaugcacaagagagacagagagggcggcgagagcaagcugaaguuccaggagcuguucguggagcccuucaacagaaaggccagacaggagaaccugagauacaacaacaugcugaagcagcugagcagccagcagcuggccacccugagaagauggaaggccauccagcuguaccugaccugcgagagaggccccugggccaagagaaagcagaaccccauccacuggaagcuggccaacguggagaacuacagcagaaugagacugaagcuggugcccaacuacaacuucaagacccacgaggaggccagcgcccugagagacaaccugggcauccagcacagccagcccagcagcgacacccugcugcuggagguggugaagcaggugaaggugagcgacaugguggaggacaagcuggaccugcccgaggaggacaucaccgccagagugaacguggacgagaaggaggagcaggaccagaaggagaagcuggugcugauggaggacugcgagcugaucaccaucaucgacgugauccccggcagacuggagaucaccacccagcacaucuacuucuacgacggcagcaucgagaaggaggacggcgugggcuucgacuucaaguggccccacagccagaucagagagauccaccugagaagauacaaccugagaagaagcgcccuggagaucuuccacguggaccagagcaacuacuuccugaacuucaagaaggaggugagaaacaagaucuacagcagacugcugagccugcacagccccaacagcuacuacggcagcagaagcccccaggagcuguucaaggccagcggccugacccagaagugggugaacagagagaucagcaacuucgacuaccugauccagaucaacaccauggccggcagaaccuacaacgaccuggcccaguaccccguguuccccuggauccugcaggacuacaccagcgaggagcuggaccugaacaaccccgccguguucagagaccugagcaagcccaucggcguggugaacgagaagaacgccaaggccaugagagagaaguacgagaacuucgaggaccccaugggcaccaucgacaaguuccacuacggcacccacuacagcaacagcgccggcgugaugcacuaccugaucagaguggagcccuucaccacccugcacauccagcugcagagcggcagauucgacugcgccgacagacaguuccacagcauccccgccaccuggcaggcccugauggacaaccccuacgacgugaaggagcugauccccgaguucuucuacuuccccgaguuccuggagaaccagaaccaguucaaccugggcagacugcagaucagcaaggagcuggugaacgacgugauccugcccaagugggccaagagcgccgaggacuucaucuacaagcacagaaaggcccuggagagcgaguacgugagcgcccaccugcacgaguggaucgaccugaucuucggcuacaagcagagaggccccgccgccguggaggcccugaacguguucuacuacugcagcuacgagggcgccguggaccuggacgcccugaccgacgagaaggagagaaaggcccuggagggcaugaucaacaacuucggccagacccccugccagcugcugaaggagccccacccccccagacugagcgccgaggaggccgugcagaagcccaccaagaucgacaccagcacccugaaccuguuccagcaccugcccgagcugaagagcuucuucaucgagggcaucagcgacggcaucccccugcugaaggccaccauccccaagaaccaguacagaagcuucaugagccagggcagccccgagcugcugaucaccaucagcaugaacuacgugaucggcacccacggcuggcugcccuacgacagaaacaucagcaacuacuucaccuucaucaaggaccagaccgugaccaaccccaagacccagagaagcaucaacggcagcuucgcccccggccuggagaucaccagcaagcuguucguggugagccacgacgccaagcugcuguucagcgccggcuacugggacaacagcauccaggugaugagccugaccaagggcaagaucaucagccacaucaucagacacauggacaucgugaccugccuggccaccgacuacugcggcauccaccugaucagcggcagcagagacaccaccugcaugaucuggcagaucacccagcagggcggcgugcccgugggccuggccagcaagcccuuccagauccuguacggccacaccaacgaggugcugagcgugggcaucagcaccgagcuggacauggccgugagcggcagcagagacggcaccgugaucauccacaccauccagaagggccaguacaugagaacccugagaccccccugcgagagcagccuguuccugaccauccccaaccuggccaucagcugggagggccacaucgugguguacagcagcaccgaggagaagaccacccugaaggacaagaacgcccugcaccuguucagcaucaacggcaaguaccugggcagccagauccugaaggagcaggugagcgacaucugcaucaucggcgagcacaucgugaccggcagcauccagggcuuccugagcaucagagaccugcacagccugaaccugagcaucaacccccuggccaugagacugcccauccacugcgugugcgugaccaaggaguacagccacauccuggugggccuggaggacggcaagcugaucguggugggcgugggcaagcccgccgagaugagaagcggccagcugagcagaaaguucuggggcagcagcaagagacugagccagaucagcgccggcgagaccgaguacaacacccaggacagcaaguaa

SEQ ID NO: 20344 - RNA, 8265 nt, Artificial Sequence
  NBEAL2__Homo_sapiens__NP_055990
auggccgccagcgagagacuguacgagcuguggcugcuguacuacgcccagaaggaccugggcuaccugcagcaguggcugaaggccuucgugggcgccuucaagaagagcaucagccugagcagccuggagcccagaagacccgaggaggccggcgccgaggugccccugcugccccuggacgagcugcacgugcuggccgagcagcugcaccaggccgaccuggagcaggcccugcugcugcugaagcuguucaucauccugugcagaaaccuggagaacaucgaggccggcagaggccaggugcuggugcccagagugcuggcccugcugaccaagcugguggccgagcugaagggcugcccccccccccagggcagaggcacccagcuggagaacguggcccugcacgcccugcugcugugcgagggccuguucgaccccuaccagaccuggagaagacagagaagcggcgaggugaucagcagcaaggagaagagcaaguacaaguucccccccgccgcccugccccaggaguucagcgccuucuuccaggagagccugcagaacgccgaccaccugccccccauccugcugcugagacugauccaccuguucugcgccgugcuggccggcggcaaggagaacggccagauggccgugagcgacggcagcgugaagggccugcugagcguggugagaggcuggagcagaggccccgcccccgaccccugccuggugccccuggcccuggaggcccuggugggcgccgugcacgugcugcacgccagcagagccccccccagaggccccgagcugagagcccugcuggagagcuacuuccacgugcugaacgccgacuggcccgccggccugagcagcggccccgaggaggcccuggugacccugagagugagcaugcuggacgccauccccaugaugcuggccugcgaggacagacccgugcugcaggccaccuuccugagcaacaacugcuucgagcaccugaccagacugauccagaacagcaagcuguaccugcagagcagagccccccccgagggcgacagcgaccuggccaccagacugcugaccgagcccgacgugcagaaggugcuggaccaggacaccgacgccaucgccgugcacguggugagagugcugaccugcaucaugagcgacagccccagcgccaaggagguguucaaggagagaaucggcuacccccaccugcaggaggugcugcagagccacggcccccccacccacagacugcugcaggagcugcugaacauggccguggagggcgaccacagcaugugcccccccccccccaucagaaacgagcagcccgugcuggugcuggcccaguggcugcccagccugcccaccgccgagcugagacuguuccuggcccagagacugagauggcugugcgacagcugccccgccagcagagccaccugcgugcaggccggccuggugggcugccugcuggagacccugagcaccggccuggcccuggaggccagaugccaggagcagcugcuggcccugcugcaggcccugggcagagugagcaucagacccauggagcugagacaccugcugagacccagacccggccuggacagcgagcccggcggcgccgaggccggcaaggccagacacgccggcgccgugaucagaacccugagcggcauggccagacaccagggccccgccagagcccugagauacuucgaccugacccccagcauggccggcaucauggugccccccgugcagagauggcccggccccggcuucaccuuccacgccuggcugugccugcaccccauggacaccgcccccacccccgcccccaccagaccccugcagagaaagcagcuguacagcuucuucaccagcagcggcagcggcuucgaggccuucuucaccgccgccggcacccuggugguggccgugugcaccagaaaggaguaccugaccaugagccugcccgaggugagcuucgccgacagcgccuggcacugcguggccaucgugcacgugcccggcagaagacccuucagccagaaccuggugcacguguacaaggacggccaccuggugaagaccgccccccugagaugccccagccugagcgagcccuucagcagcugcugcaucggcagcgccggcuacagaaccaccaccaccaccaccggccugcccaccccccccgugcccgccacccuggccuacacccaccccgcccugaccagaagccagagcgugcccgccagcaccggccugggcuggggcagcggccugguggccccccugcaggagggcagcaucgacagcacccuggccggcacccaggacaccagauggggcagccccaccagccuggagggcgagcugggcgccguggccaucuuccacgaggcccugcaggccaccgcccugagaacccugugcacccugggccccaacgagaccgcccccuucaagcccgagggcgagcugcacgagcugagcaccagacugcugcugcacuacagcccccaggccugcaagaacaacaucugccuggaccugagccccagccacggccuggacggcagacugaccggccacagaguggagaccugggacgugaaggacguggugaacugcgugggcggcaugggcgcccugcugccccugcuggagagaguggccgcccagcccaaggaggccgaggccggccccgccgagacccacgaccuggugggccccgagcugaccagcggccacaacacccagggccuggugcugccccugggcaagagcagcgaggagagaauggagagaaacgccguggccgccuuccugcugaugcugagaaacuuccugcagggccacauggugaaccaggagagccuggugcagugccagggccccgccaucaucggcgcccugcugagaaaggugcccagcugggccauggacaugaacgugcugaugagcgcccagcugcugauggagcagguggccgccgagggcagcggcccccugcuguaccugcuguaccagcaccugcuguucaacuuccaccuguggacccugagcgacuucgccgugagacugggccacauccaguacaugagcagcaucgugagagagcacagacagaagcugagaaagaaguacggcgugcaguucauccuggacgcccugagaacccacuacagcccccagagagagagaccccuggccgccgacgaccugagaaccgugcagaccagccugcugggccuggccagagaguuccuggugagaagccugagcgccgacgacgugcaggugacccagaccaugcugagcuuccuggccgccaccggcgacgacggccaggccgugggcgcccuggaccugcugcuggcccugcugcacggcagccuggugcaggagagccuggccguguuccugcuggagcccggcaaccuggaggugcugcuggcccugcuggugagacccggcagccugccccugcugcccgacagagugugcaagauccugagaagacugcagcagaacgagagacugcccgagagaagcagacagagacugagacugagagagugcggccugcagggccugguggccugccugcccgagggcaccgugagcccccagcugugccagggccuguacaagcuguuccugggcgccgacugccugaaccugagcgaccugcuggccguggugcagcugagccugcaggccgaccugagcgugagacuggacaucugcagacagcuguuccaccugaucuacggccagcccgacguggugagacugcuggccagacaggccggcuggcaggacgugcugaccagacuguacgugcuggaggccgccaccgccggcagccccccccccagcagccccgagagccccaccagccccaagcccgccccccccaagccccccaccgagagccccgccgagcccagcgacguguuccugcccagcgaggcccccugccccgaccccgacggcuucuaccacgcccugagccccuucugcacccccuucgaccugggccuggagagaagcagcgugggcagcggcaacaccgccggcggcggcggcagcagcggcacccugacccccgccagccagcccggcacccccagcccccuggacggccccagacccuuccccgccgcccccggcagacacagcagcagccugagcaacgugcuggaggacggcagccugcccgagcccaccaucagcggcgacgacaccagcaacaccagcaacccccagcagaccagcgaggaggagcugugcaaccugcugaccaacgugcuguucagcgugaccuggagaggcguggagggcagcgacgaggccgccuggagagagagaggccagguguucagcgugcugacccagcugggcgccagcgccacccuggugagaccccccgacugcaucaagagaagccugcuggagaugaugcuggagagcgcccugaccgacaucaaggaggcccccgugggcgugcuggccagccugacccagcaggcccuguggcugcugagacugcugcaggacuuccugugcgccgagggccacggcaaccaggagcuguggagcgagaagcuguucgagggcgugugcagccugcuggacagacugggcgccuggccccaccuggccaacggcaccgccgaccugagagagauggcccagaucggccugagacuggugcugggcuacauccugcuggaggacccccagcugcacgcccaggccuacgugagacugcacaugcugcugcagaccgccgugcccgccagaagagaggaggccugcuacgugcugagcaagcuggaggccgcccugggcagagugcugaacaccagcagccuggagagcgccaccgacgaggccggcagcccccuggccgccgccgccgccgccgccgccgccgagagaugcagcuggcuggugccccuggugagaacccugcuggacagagccuacgagccccugggccugcaguggggccugcccagccugccccccaccaacggcagccccaccuucuucgaggacuuccaggccuucugcgccacccccgaguggagacacuucaucgacaagcaggugcagcccaccaugagccaguucgagauggacaccuacgccaagagccacgaccugaugagcggcuucuggaacgccugcuacgacaugcugaugagcagcggccagagaagacagugggagagagcccagagcagaagagccuuccaggagcuggugcuggagcccgcccagagaagagccagacuggagggccugagauacaccgccgugcugaagcagcaggccacccagcacagcauggcccugcugcacuggggcgcccuguggagacagcuggccagccccugcggcgccugggcccugagagacacccccauccccagauggaagcugagcagcgccgagaccuacagcagaaugagacugaagcuggugcccaaccaccacuucgacccccaccuggaggccagcgcccugagagacaaccugggcgaggugccccugacccccaccgaggaggccagccugccccuggccgugaccaaggaggccaaggugagcaccccccccgagcugcugcaggaggaccagcugggcgaggacgagcuggccgagcuggagacccccauggaggccgccgagcuggacgagcagagagagaagcuggugcugagcgccgagugccagcuggugaccgugguggccguggugcccggccugcuggaggugaccacccagaacguguacuucuacgacggcagcaccgagagaguggagaccgaggagggcaucggcuacgacuucagaagaccccuggcccagcugagagaggugcaccugagaagauucaaccugagaagaagcgcccuggagcuguucuucaucgaccaggccaacuacuuccugaacuuccccugcaaggugggcaccacccccgugagcagccccagccagacccccagaccccagcccggccccauccccccccacacccaggugagaaaccagguguacagcuggcugcugagacugagaccccccagccagggcuaccugagcagcagaagcccccaggagaugcugagagccagcggccugacccagaagugggugcagagagagaucagcaacuucgaguaccugaugcagcugaacaccaucgccggcagaaccuacaacgaccugagccaguaccccguguuccccugggugcugcaggacuacgugagccccacccuggaccugagcaaccccgccguguucagagaccugagcaagcccaucggcguggugaaccccaagcacgcccagcuggugagagagaaguacgagagcuucgaggaccccgccggcaccaucgacaaguuccacuacggcacccacuacagcaacgccgccggcgugaugcacuaccugaucagaguggagcccuucaccagccugcacgugcagcugcagagcggcagauucgacugcagcgacagacaguuccacagcguggccgccgccuggcaggccagacuggagagccccgccgacgugaaggagcugauccccgaguucuucuacuuccccgacuuccuggagaaccagaacggcuucgaccugggcugccugcagcugaccaacgagaaggugggcgacguggugcugccccccugggccagcagccccgaggacuucauccagcagcacagacaggcccuggagagcgaguacgugagcgcccaccugcacgaguggaucgaccugaucuucggcuacaagcagagaggccccgccgccgaggaggcccugaacguguucuacuacugcaccuacgagggcgccguggaccuggaccacgugaccgacgagagagagagaaaggcccuggagggcaucaucagcaacuucggccagacccccugccagcugcugaaggagccccaccccaccagacugagcgccgaggaggccgcccacagacuggccagacuggacaccaacagccccagcaucuuccagcaccuggacgagcugaaggccuucuucgccgagguggugagcgacggcgugccccuggugcuggcccuggugccccacagacagccccacagcuucaucacccagggcagccccgaccugcuggugaccgugagcgccagcggccugcugggcacccacagcuggcugcccuacgacagaaacaucagcaacuacuucagcuucagcaaggaccccaccaugggcagccacaagacccagagacugcugagcggccccugggugcccggcagcggcgugagcggccaggcccuggccguggcccccgacggcaagcugcuguucagcggcggccacugggacggcagccugagagugaccgcccugcccagaggcaagcugcugagccagcugagcugccaccuggacguggugaccugccuggcccuggacaccugcggcaucuaccugaucagcggcagcagagacaccaccugcaugguguggagacugcugcaccagggcggccugagcgugggccuggcccccaagcccgugcaggugcuguacggccacggcgccgccgugagcugcguggccaucagcaccgagcuggacauggccgugagcggcagcgaggacggcaccgugaucauccacaccgugagaagaggccaguucguggccgcccugagaccccugggcgccaccuuccccggccccaucuuccaccuggcccugggcagcgagggccagaucguggugcagagcagcgccugggagagacccggcgcccaggugaccuacagccugcaccuguacagcgugaacggcaagcugagagccagccugccccuggccgagcagcccaccgcccugaccgugaccgaggacuucgugcugcugggcaccgcccagugcgcccugcacauccugcagcugaacacccugcugcccgccgcccccccccugcccaugaagguggccaucagaagcguggccgugaccaaggagagaagccacgugcuggugggccuggaggacggcaagcugaucguggugguggccggccagcccagcgaggugagaagcagccaguucgccagaaagcuguggagaagcagcagaagaaucagccaggugagcagcggcgagaccgaguacaaccccaccgaggccagauaa

SEQ ID NO: 20345 - RNA, 2265 nt, Artificial Sequence
  NBN__Homo_sapiens__NP_002476
auguggaagcugcugcccgccgccggccccgccggcggcgagcccuacagacugcugaccggcguggaguacguggugggcagaaagaacugcgccauccugaucgagaacgaccagagcaucagcagaaaccacgccgugcugaccgccaacuucagcgugaccaaccugagccagaccgacgagauccccgugcugacccugaaggacaacagcaaguacggcaccuucgugaacgaggagaagaugcagaacggcuucagcagaacccugaagagcggcgacggcaucaccuucggcguguucggcagcaaguucagaaucgaguacgagccccugguggccugcagcagcugccuggacgugagcggcaagaccgcccugaaccaggccauccugcagcugggcggcuucaccgugaacaacuggaccgaggagugcacccaccuggugauggugagcgugaaggugaccaucaagaccaucugcgcccugaucugcggcagacccaucgugaagcccgaguacuucaccgaguuccugaaggccguggagagcaagaagcagcccccccagaucgagagcuucuaccccccccuggacgagcccagcaucggcagcaagaacguggaccugagcggcagacaggagagaaagcagaucuucaagggcaagaccuucaucuuccugaacgccaagcagcacaagaagcugagcagcgccgugguguucggcggcggcgaggccagacugaucaccgaggagaacgaggaggagcacaacuucuuccuggcccccggcaccugcgugguggacaccggcaucaccaacagccagacccugauccccgacugccagaagaaguggauccagagcaucauggacaugcugcagagacagggccugagacccauccccgaggccgagaucggccuggccgugaucuucaugaccaccaagaacuacugcgacccccagggccaccccagcaccggccugaagaccaccacccccggccccagccugagccagggcgugagcguggacgagaagcugaugcccagcgcccccgugaacaccaccaccuacguggccgacaccgagagcgagcaggccgacaccugggaccugagcgagagacccaaggagaucaaggugagcaagauggagcagaaguucagaaugcugagccaggacgcccccaccgugaaggagagcugcaagaccagcagcaacaacaacagcauggugagcaacacccuggccaagaugagaauccccaacuaccagcugagccccaccaagcugcccagcaucaacaagagcaaggacagagccagccagcagcagcagaccaacagcaucagaaacuacuuccagcccagcaccaagaagagagagagagacgaggagaaccaggagaugagcagcugcaagagcgccagaaucgagaccagcugcagccugcuggagcagacccagcccgccacccccagccuguggaagaacaaggagcagcaccugagcgagaacgagcccguggacaccaacagcgacaacaaccuguucaccgacaccgaccugaagagcaucgugaagaacagcgccagcaagagccacgccgccgagaagcugagaagcaacaagaagagagagauggacgacguggccaucgaggacgaggugcuggagcagcuguucaaggacaccaagcccgagcuggagaucgacgugaaggugcagaagcaggaggaggacgugaacgugagaaagagacccagaauggacaucgagaccaacgacaccuucagcgacgaggccgugcccgagagcagcaagaucagccaggagaacgagaucggcaagaagagagagcugaaggaggacagccuguggagcgccaaggagaucagcaacaacgacaagcugcaggacgacagcgagaugcugcccaagaagcugcugcugaccgaguucagaagccuggugaucaagaacagcaccagcagaaaccccagcggcaucaacgacgacuacggccagcugaagaacuucaagaaguucaagaaggugaccuaccccggcgccggcaagcugccccacaucaucggcggcagcgaccugaucgcccaccacgccagaaagaacaccgagcuggaggaguggcugagacaggagauggaggugcagaaccagcacgccaaggaggagagccuggccgacgaccuguucagauacaaccccuaccugaagagaagaagauaa

SEQ ID NO: 20346 - RNA, 1734 nt, Artificial Sequence
  NBPF3__Homo_sapiens__XP_011540583
augguggugagcgccggccccuggagcggcgagaaggccgagaugaacauccuggagaucaacaagaagagcagaccccagcuggccgagaacaagcagcaguucagaaaccugaagcagaagugccuggugacccagguggccuacuuccuggccaacagacagaacaacuacgacuacgaggacugcaaggaccugaucaagagcaugcugagagacgagagacugcugaccgaggagaagcuggccgaggagcugggccaggccgaggagcugagacaguacaaggugcuggugcacagccaggagagagagcugacccagcugagagagaagcugcaggagggcagagacgccagcagaagccugaaccagcaccugcaggcccugcugacccccgacgagcccgacaacagccagggcagagaccugagagagcagcuggccgagggcugcagacuggcccagcaccuggugcagaagcugagccccgagaacgacgacgacgaggacgaggacgugaagguggaggaggccgagaaggugcaggagcuguacgcccccagagaggugcagaaggccgaggagaaggaggugcccgaggacagccuggaggagugcgccaucaccugcagcaacagccaccaccccugcgagagcaaccagcccuacggcaacaccagaaucaccuucgaggaggaccagguggacagcacccugaucgacagcagcagccacgacgaguggcuggacgccgugugcaucauccccgagaacgagagcgaccacgagcaggaggaggagaagggccccgugagccccagaaaccugcaggagagcgaggaggaggaggccccccaggagagcugggacgagggcgacuggacccugagcaucccccccgacaugagcgccagcuaccagagcgacagaagcaccuuccacagcguggaggagcagcaggugggccuggcccuggacaucggcagacacuggugcgaccaggugaagaaggaggaccaggaggccaccagccccagacugagcagagagcugcuggacgagaaggagcccgaggugcugcaggacagccuggacagauucuacagcacccccuucgaguaccuggagcugcccgaccugugccagcccuacagaagcgacuucuacagccugcaggagcagcaccugggccuggcccuggaccuggacagaaugaagaaggaccaggaggaggaggaggaccagggcccccccugccccagacugagcagagagcugcccgaggugguggagcccgaggaccugcaggacagccuggacagaugguacagcacccccuucagcuaccccgagcugcccgacagcugccagcccuacggcagcugcuucuacagccuggaggaggagcacgugggcuucagccuggacguggacgagaucgagaaguaccaggagggcgaggaggaccagaagccccccugccccagacugaacgaggugcugauggaggccgaggagcccgaggugcugcaggacagccuggacagaugcuacagcaccaccagcaccuacuuccagcugcacgccagcuuccagcaguacagaagcgccuucuacagcuucgaggagcaggacgugagccuggcccuggacguggacaacagauucuucacccugaccgugaucagacaccaccuggccuuccagaugggcgugaucuucccccacuaa

SEQ ID NO: 20347 - RNA, 2814 nt, Artificial Sequence
  NBR1__Homo_sapiens__NP_001278500
auggagccccaggugacccugaacgugaccuucaagaacgagauccagagcuuccuggugagcgaccccgagaacaccaccugggccgacaucgaggccauggugaaggugagcuucgaccugaacaccauccagaucaaguaccuggacgaggagaacgaggaggugagcaucaacagccagggcgaguacgaggaggcccugaagauggccgugaagcagggcaaccagcugcagaugcaggugcacgagggccaccacgugguggacgaggcccccccccccguggugggcgccaagagacuggccgccagagccggcaagaagccccuggcccacuacagcagccuggugagagugcugggcagcgacaugaagacccccgaggaccccgccgugcagagcuucccccuggugcccugcgacaccgaccagccccaggacaagccccccgacugguucaccagcuaccuggagaccuucagagagcagguggugaacgagaccguggagaagcuggagcagaagcugcacgagaagcuggugcugcagaaccccagccugggcagcugccccagcgaggugagcaugcccaccagcgaggagacccuguuccugcccgagaaccaguucagcuggcacaucgccugcaacaacugccagagaagaaucgugggcgugagauaccagugcagccugugccccagcuacaacaucugcgaggacugcgaggccggccccuacggccacgacaccaaccacgugcugcugaagcugagaagacccguggugggcagcagcgagcccuucugccacagcaaguacagcacccccagacugcccgccgcccuggagcaggugagacugcagaagcagguggacaagaacuuccugaaggccgagaagcagagacugagagccgagaagaagcagagaaaggccgaggugaaggagcugaagaagcagcugaagcugcacagaaagauccaccuguggaacagcauccacggccugcagagccccaagagcccccugggcagacccgagagccugcugcagagcaacacccugaugcugccccugcagcccugcaccagcgugaugcccaugcugagcgccgccuucguggacgagaaccugcccgacggcacccaccugcagcccggcaccaaguucaucaagcacuggagaaugaagaacaccggcaacgugaaguggagcgccgacaccaagcugaaguucauguggggcaaccugacccuggccagcaccgagaagaaggacgugcuggugcccugccugaaggccggccacgugggcguggugagcguggaguucaucgcccccgcccuggagggcaccuacaccagccacuggagacugagccacaagggccagcaguucggccccagaguguggugcagcaucaucguggaccccuuccccagcgaggagagccccgacaacaucgagaagggcaugaucagcagcagcaagaccgacgaccugaccugccagcaggaggagaccuuccugcuggccaaggaggagagacagcugggcgaggugaccgagcagaccgagggcaccgccgccugcaucccccagaaggccaagaacguggccagcgagagagagcuguacauccccagcguggaccugcugaccgcccaggaccugcugagcuucgagcugcuggacaucaacaucgugcaggagcuggagagagugccccacaacacccccguggacgugacccccugcaugagcccccugccccacgacagcccccugaucgagaagcccggccugggccagaucgaggaggagaacgagggcgccggcuucaaggcccugcccgacagcauggugagcgugaagagaaaggccgagaacaucgccagcguggaggaggccgaggaggaccugagcggcacccaguucgugugcgagaccgugaucagaagccugacccuggacgccgcccccgaccacaacccccccugcagacagaagagccugcagaugaccuucgcccugcccgagggcccccugggcaacgagaaggaggagaucauccacaucgccgaggaggaggccgugauggaggaggaggaggacgaggaggacgaggaggaggaggacgagcugaaggacgaggugcagagccagagcagcgccagcagcgaggacuacaucaucauccugcccgagugcuucgacaccagcagaccccugggcgacagcauguacagcagcgcccugagccagcccggccuggagagaggcgccgagggcaagcccggcguggaggccggccaggagcccgccgaggccggcgagagacugcccggcggcgagaaccagccccaggagcacagcaucagcgacauccugaccaccagccagacccuggagaccgugccccugauccccgaggugguggagcugccccccagccugcccagaagcagccccugcgugcaccaccacggcagccccggcguggaccugcccgugaccauccccgaggugagcagcgugcccgaccagaucagaggcgagcccagaggcagcagcggccuggugaacagcagacagaagagcuacgaccacagcagacaccaccacggcagcagcaucgccggcggccuggugaagggcgcccugagcguggccgccagcgccuacaaggcccuguucgccggcccccccgugaccgcccagggccuguggggccugcugagcuuccugcaccuggccaagaagugcuucuuccugaaggcccccagcgaggccuucagcugguucuaa

SEQ ID NO: 20348 - RNA, 582 nt, Artificial Sequence
  NCALD__Homo_sapiens__XP_011515637
augggcaagcagaacagcaagcugagacccgaggugaugcaggaccugcuggagagcaccgacuucaccgagcacgagauccaggagugguacaagggcuuccugagagacugccccagcggccaccugagcauggaggaguucaagaagaucuacggcaacuucuuccccuacggcgacgccagcaaguucgccgagcacguguucagaaccuucgacgccaacggcgacggcaccaucgacuucagagaguucaucaucgcccugagcgugaccagcagaggcaagcuggagcagaagcugaagugggccuucagcauguacgaccuggacggcaacggcuacaucagcaaggccgagaugcuggagaucgugcaggccaucuacaagauggugagcagcgugaugaagaugcccgaggacgagagcacccccgagaagagaaccgagaagaucuucagacagauggacaccaacagagacggcaagcugagccuggaggaguucaucagaggcgccaagagcgaccccagcaucgugagacugcugcagugcgaccccagcagcgccggccaguucuaa

SEQ ID NO: 20349 - RNA, 2547 nt, Artificial Sequence
  NCAM1__Homo_sapiens__NP_000606
augcugcagaccaaggaccugaucuggacccuguucuuccugggcaccgccgugagccugcagguggacaucgugcccagccagggcgagaucagcgugggcgagagcaaguucuuccugugccagguggccggcgacgccaaggacaaggacaucagcugguucagccccaacggcgagaagcugacccccaaccagcagagaaucagcgugguguggaacgacgacagcagcagcacccugaccaucuacaacgccaacaucgacgacgccggcaucuacaagugcguggugaccggcgaggacggcagcgagagcgaggccaccgugaacgugaagaucuuccagaagcugauguucaagaacgcccccaccccccaggaguucagagagggcgaggacgccgugaucgugugcgacguggugagcagccugccccccaccaucaucuggaagcacaagggcagagacgugauccugaagaaggacgugagauucaucgugcugagcaacaacuaccugcagaucagaggcaucaagaagaccgacgagggcaccuacagaugcgagggcagaauccuggccagaggcgagaucaacuucaaggacauccaggugaucgugaacgugccccccaccauccaggccagacagaacaucgugaacgccaccgccaaccugggccagagcgugacccuggugugcgacgccgagggcuuccccgagcccaccaugagcuggaccaaggacggcgagcagaucgagcaggaggaggacgacgagaaguacaucuucagcgacgacagcagccagcugaccaucaagaagguggacaagaacgacgaggccgaguacaucugcaucgccgagaacaaggccggcgagcaggacgccaccauccaccugaagguguucgccaagcccaagaucaccuacguggagaaccagaccgccauggagcuggaggagcaggugacccugaccugcgaggccagcggcgaccccauccccagcaucaccuggagaaccagcaccagaaacaucagcagcgaggagaagacccuggacggccacaugguggugagaagccacgccagagugagcagccugacccugaagagcauccaguacaccgacgccggcgaguacaucugcaccgccagcaacaccaucggccaggacagccagagcauguaccuggaggugcaguacgcccccaagcugcagggccccguggccguguacaccugggagggcaaccaggugaacaucaccugcgagguguucgccuaccccagcgccaccaucagcugguucagagacggccagcugcugcccagcagcaacuacagcaacaucaagaucuacaacacccccagcgccagcuaccuggaggugacccccgacagcgagaacgacuucggcaacuacaacugcaccgccgugaacagaaucggccaggagagccuggaguucauccuggugcaggccgacacccccagcagccccagcaucgaccagguggagcccuacagcagcaccgcccaggugcaguucgacgagcccgaggccaccggcggcgugcccauccugaaguacaaggccgaguggagagccgugggcgaggagguguggcacagcaagugguacgacgccaaggaggccagcauggagggcaucgugaccaucgugggccugaagcccgagaccaccuacgccgugagacuggccgcccugaacggcaagggccugggcgagaucagcgccgccagcgaguucaagacccagcccgugcagggcgagcccagcgcccccaagcuggagggccagaugggcgaggacggcaacagcaucaaggugaaccugaucaagcaggacgacggcggcagccccaucagacacuaccuggugagauacagagcccugagcagcgaguggaagcccgagaucagacugcccagcggcagcgaccacgugaugcugaagagccuggacuggaacgccgaguacgagguguacgugguggccgagaaccagcagggcaagagcaaggccgcccacuucguguucagaaccagcgcccagcccaccgccauccccgccaacggcagccccaccagcggccugagcaccggcgccaucgugggcauccugaucgugaucuucgugcugcugcugguggugguggacaucaccugcuacuuccugaacaagugcggccuguucaugugcaucgccgugaaccugugcggcaaggccggccccggcgccaagggcaaggacauggaggagggcaaggccgccuucagcaaggacgagagcaaggagcccaucguggaggugagaaccgaggaggagagaacccccaaccacgacggcggcaagcacaccgagcccaacgagaccaccccccugaccgagcccgagaagggccccguggaggccaagcccgagugccaggagaccgagaccaagcccgcccccgccgaggugaagaccgugcccaacgacgccacccagaccaaggagaacgagagcaaggccuaa

SEQ ID NO: 20350 - RNA, 2514 nt, Artificial Sequence
  NCAM2__Homo_sapiens__NP_004531
augagccugcugcugagcuucuaccugcugggccugcuggugagcagcggccaggcccugcugcaggugaccaucagccugagcaagguggagcugagcgugggcgagagcaaguucuucaccugcaccgccaucggcgagcccgagagcaucgacugguacaacccccagggcgagaagaucaucagcacccagagagugguggugcagaaggagggcgugagaagcagacugaccaucuacaacgccaacaucgaggacgccggcaucuacagaugccaggccaccgacgccaagggccagacccaggaggccaccguggugcuggagaucuaccagaagcugaccuucagagagguggugagcccccaggaguucaagcagggcgaggacgccgagguggugugcagagugagcagcagccccgcccccgccgugagcuggcuguaccacaacgaggaggugaccaccaucagcgacaacagauucgccaugcuggccaacaacaaccugcagauccugaacaucaacaagagcgacgagggcaucuacagaugcgagggcagaguggaggccagaggcgagaucgacuucagagacaucaucgugaucgugaacgugccccccgccaucagcaugccccagaagagcuucaacgccaccgccgagagaggcgaggagaugaccuucagcugcagagccagcggcagccccgagcccgccaucagcugguucagaaacggcaagcugaucgaggagaacgagaaguacauccugaagggcagcaacaccgagcugaccgugagaaacaucaucaacagcgacggcggccccuacgugugcagagccaccaacaaggccggcgaggacgagaagcaggccuuccugcagguguucgugcagccccacaucauccagcugaagaacgagaccaccuacgagaacggccaggugacccuggugugcgacgccgagggcgagcccauccccgagaucaccuggaagagagccguggacggcuucaccuucaccgagggcgacaagagccuggacggcagaaucgaggugaagggccagcacggcagcagcagccugcacaucaaggacgugaagcugagcgacagcggcagauacgacugcgaggccgccagcagaaucggcggccaccagaagagcauguaccuggacaucgaguacgcccccaaguucaucagcaaccagaccaucuacuacagcugggagggcaaccccaucaacaucagcugcgacgugaagagcaacccccccgccagcauccacuggagaagagacaagcuggugcugcccgccaagaacaccaccaaccugaagaccuacagcaccggcagaaagaugauccuggagaucgcccccaccagcgacaacgacuucggcagauacaacugcaccgccaccaaccacaucggcaccagauuccaggaguacauccuggcccuggccgacgugcccagcagccccuacggcgugaagaucaucgagcugagccagaccaccgccaaggugagcuucaacaagcccgacagccacggcggcgugcccauccaccacuaccagguggacgugaaggagguggccagcgagaucuggaagaucgugagaagccacggcgugcagaccaugguggugcugaacaaccuggagcccaacaccaccuacgagaucagaguggccgccgugaacggcaagggccagggcgacuacagcaagaucgagaucuuccagacccugcccgugagagagcccagcccccccagcauccacggccagcccagcagcggcaagagcuucaagcugagcaucaccaagcaggacgacggcggcgcccccauccuggaguacaucgugaaguacagaagcaaggacaaggaggaccaguggcuggagaagaaggugcagggcaacaaggaccacaucauccuggagcaccugcaguggaccaugggcuacgaggugcagaucaccgccgccaacagacugggcuacagcgagcccaccguguacgaguucagcaugccccccaagcccaacaucaucaaggacacccuguucaacggccugggccugggcgccgugaucggccugggcguggccgcccugcugcugauccugguggugaccgacgugagcugcuucuucaucagacagugcggccugcugaugugcaucaccagaagaaugugcggcaagaagagcggcagcagcggcaagagcaaggagcuggaggagggcaaggccgccuaccugaaggacggcagcaaggagcccaucguggagaugagaaccgaggacgagagagugaccaaccacgaggacggcagccccgugaacgagcccaacgagaccaccccccugaccgagcccgagaagcugccccugaaggaggaggacggcaaggaggcccugaaccccgagaccaucgagaucaaggugagcaacgacaucauccagagcaaggaggacgacagcaaggccuaa

SEQ ID NO: 20351 - RNA, 3966 nt, Artificial Sequence
  NCAN__Homo_sapiens__NP_004377
augggcgcccccuucgugugggcccugggccugcugaugcugcagaugcugcuguucguggccggcgagcagggcacccaggacaucaccgacgccagcgagagaggccugcacaugcagaagcugggcagcggcagcgugcaggccgcccuggccgagcugguggcccugcccugccuguucacccugcagcccagacccagcgccgccagagacgcccccagaaucaaguggaccaaggugagaaccgccagcggccagagacaggaccugcccauccugguggccaaggacaacguggugagaguggccaagagcuggcagggcagagugagccugcccagcuaccccagaagaagagccaacgccacccugcugcugggcccccugagagccagcgacagcggccuguacagaugccagguggugagaggcaucgaggacgagcaggaccuggugccccuggaggugaccggcgugguguuccacuacagaagcgccagagacagauacgcccugaccuucgccgaggcccaggaggccugcagacugagcagcgccaucaucgccgcccccagacaccugcaggccgccuucgaggacggcuucgacaacugcgacgccggcuggcugagcgacagaaccgugagauaccccaucacccagagcagacccggcugcuacggcgacagaagcagccugcccggcgugagaagcuacggcagaagaaacccccaggagcuguacgacguguacugcuucgccagagagcugggcggcgagguguucuacgugggccccgccagaagacugacccuggccggcgccagagcccagugcagaagacagggcgccgcccuggccagcgugggccagcugcaccuggccuggcacgagggccuggaccagugcgaccccggcuggcuggccgacggcagcgugagauaccccauccagacccccagaagaagaugcggcggccccgcccccggcgugagaaccguguacagauucgccaacagaaccggcuuccccagccccgccgagagauucgacgccuacugcuucagagcccaccaccccaccagccagcacggcgaccuggagacccccagcagcggcgacgagggcgagauccugagcgccgagggcccccccgugagagagcuggagcccacccuggaggaggaggagguggugacccccgacuuccaggagccccuggugagcagcggcgaggaggagacccugauccuggaggagaagcaggagagccagcagacccugagccccacccccggcgaccccaugcuggccagcuggcccaccggcgagguguggcugagcaccguggcccccagccccagcgacaugggcgccggcaccgccgccagcagccacaccgagguggcccccaccgaccccaugcccagaagaagaggcagauucaagggccugaacggcagauacuuccagcagcaggagcccgagcccggccugcagggcggcauggaggccagcgcccagccccccaccagcgaggccgccgugaaccagauggagcccccccuggccauggccgugaccgagaugcugggcagcggccagagcagaagccccugggccgaccugaccaacgagguggacaugcccggcgccggcagcgccggcggcaagagcagccccgagcccuggcuguggccccccaccauggugccccccagcaucagcggccacagcagagcccccgugcuggagcuggagaaggccgagggccccagcgccagacccgccacccccgaccuguucuggagcccccuggaggccaccgugagcgcccccagccccgcccccugggaggccuuccccguggccaccagccccgaccugcccaugauggccaugcugagaggccccaaggaguggaugcugccccaccccacccccaucagcaccgaggccaacagaguggaggcccacggcgaggccaccgccaccgccccccccagccccgccgccgagaccaagguguacagccugccccugagccugacccccaccggccagggcggcgaggccaugcccaccacccccgagagccccagagccgacuucagagagaccggcgagaccagccccgcccaggugaacaaggccgagcacagcagcagcagccccuggcccagcgugaacagaaacguggccgugggcuucgugcccaccgagaccgccaccgagcccaccggccugagaggcauccccggcagcgagagcggcguguucgacaccgccgagagccccaccagcggccugcaggccaccguggacgaggugcaggaccccuggcccagcguguacagcaagggccuggacgccagcagccccagcgccccccugggcagccccggcguguuccuggugcccaaggugacccccaaccuggagcccuggguggccaccgacgagggccccaccgugaaccccauggacagcaccgugacccccgcccccagcgacgccagcggcaucugggagcccggcagccagguguucgaggaggccgagagcaccacccugagcccccagguggcccuggacaccagcaucgugaccccccugaccacccuggagcagggcgacaaggugggcgugcccgccaugagcacccugggcagcagcagcagccagccccaccccgagcccgaggaccagguggagacccagggcaccagcggcgccagcgugcccccccaccagagcagcccccugggcaagcccgccgugccccccggcacccccaccgccgccagcgugggcgagagcgccagcgugagcagcggcgagcccaccgugcccugggaccccagcagcacccugcugcccgugacccugggcaucgaggacuucgagcuggaggugcuggccggcagccccggcguggagagcuucugggaggagguggccagcggcgaggagcccgcccugcccggcacccccaugaacgccggcgccgaggaggugcacagcgaccccugcgagaacaaccccugccugcacggcggcaccugcaacgccaacggcaccauguacggcugcagcugcgaccagggcuucgccggcgagaacugcgagaucgacaucgacgacugccugugcagccccugcgagaacggcggcaccugcaucgacgaggugaacggcuucgugugccugugccugcccagcuacggcggcagcuucugcgagaaggacaccgagggcugcgacagaggcuggcacaaguuccagggccacugcuacagauacuucgcccacagaagagccugggaggacgccgagaaggacugcagaagaagaagcggccaccugaccagcgugcacagccccgaggagcacagcuucaucaacagcuucggccacgagaacaccuggaucggccugaacgacagaaucguggagagagacuuccaguggaccgacaacaccggccugcaguucgagaacuggagagagaaccagcccgacaacuucuucgccggcggcgaggacugcguggugaugguggcccacgagagcggcagauggaacgacgugcccugcaacuacaaccugcccuacgugugcaagaagggcaccgugcugugcggccccccccccgccguggagaacgccagccugaucggcgccagaaaggccaaguacaacgugcacgccaccgugagauaccagugcaacgagggcuucgcccagcaccacguggccaccaucagaugcagaagcaacggcaagugggacagaccccagaucgugugcaccaagcccagaagaagccacagaaugagaagacaccaccaccaccaccagcaccaccaccagcaccaccaccacaagagcagaaaggagagaagaaagcacaagaagcaccccaccgaggacugggagaaggacgagggcaacuucugcuaa

SEQ ID NO: 20352 - RNA, 4206 nt, Artificial Sequence
  NCAPD2__Homo_sapiens__NP_055680
auggccccccagauguacgaguuccaccugccccugagccccgaggagcugcugaagagcggcggcgugaaccaguacguggugcaggaggugcugagcaucaagcaccugcccccccagcugagagccuuccaggccgccuucagagcccagggcccccuggccaugcugcagcacuucgacaccaucuacagcauccugcaccacuucagaagcaucgaccccggccugaaggaggacacccugcaguuccugaucaagguggugagcagacacagccaggagcugcccgccauccuggacgacaccacccugagcggcagcgacagaaacgcccaccugaacgcccugaagaugaacugcuacgcccugaucagacugcuggagagcuucgagaccauggccagccagaccaaccugguggaccuggaccugggcggcaagggcaagaaggccagaaccaaggccgcccacggcuucgacugggaggaggagagacagcccauccugcagcugcugacccagcugcugcagcuggacaucagacaccuguggaaccacagcaucaucgaggaggaguucgugagccuggugaccggcugcugcuacagacugcuggagaaccccaccaucaaccaccagaagaacagacccaccagagaggccaucacccaccugcugggcguggcccugaccagauacaaccacaugcugagcgccaccgugaagaucauccagaugcugcagcacuucgagcaccuggcccccgugcugguggccgccgugagccugugggccaccgacuacggcaugaagagcaucgugggcgagaucgugagagagaucggccagaagugcccccaggagcugagcagagaccccagcggcaccaagggcuucgccgccuuccugaccgagcuggccgagagagugcccgccauccugaugagcagcaugugcauccugcuggaccaccuggacggcgagaacuacaugaugagaaacgccgugcuggccgccauggccgagauggugcugcaggugcugagcggcgaccagcuggaggccgccgccagagacaccagagaccaguuccuggacacccugcaggcccacggccacgacgugaacagcuucgugagaagcagagugcugcagcuguucaccagaaucgugcagcagaaggcccugccccugaccagauuccaggccgugguggcccuggccgugggcagacuggccgacaagagcgugcuggugugcaagaacgccauccagcugcuggccagcuuccuggccaacaaccccuucagcugcaagcugagcgacgccgaccuggccggcccccugcagaaggagacccagaagcugcaggagaugagagcccagagaagaaccgccgccgccagcgccgugcuggaccccgaggaggagugggaggccaugcugcccgagcugaagagcacccugcagcagcugcugcagcugccccagggcgaggaggagauccccgagcagaucgccaacaccgagaccaccgaggacgugaagggcagaaucuaccagcugcuggccaaggccagcuacaagaaggccaucauccugaccagagaggccaccggccacuuccaggagagcgagcccuucagccacaucgaccccgaggagagcgaggagaccagacugcugaacauccugggccugaucuucaagggccccgccgccagcacccaggagaagaaccccagagagagcaccggcaacauggugaccggccagaccgugugcaagaacaagcccaacaugagcgaccccgaggagagcagaggcaacgacgagcuggugaagcaggagaugcuggugcaguaccugcaggacgccuacagcuucagcagaaagaucaccgaggccaucggcaucaucagcaagaugauguacgagaacaccaccaccguggugcaggaggugaucgaguucuucgugaugguguuccaguucggcgugccccaggcccuguucggcgugagaagaaugcugccccugaucuggagcaaggagcccggcgugagagaggccgugcugaacgccuacagacagcuguaccugaaccccaagggcgacagcgccagagccaaggcccaggcccugauccagaaccugagccugcugcugguggacgccagcgugggcaccauccagugccuggaggagauccugugcgaguucgugcagaaggacgagcugaagcccgccgugacccagcugcugugggagagagccaccgagaagguggccugcugcccccuggagagaugcagcagcgugaugcugcugggcaugauggccagaggcaagcccgagaucgugggcagcaaccuggacacccuggugagcaucggccuggacgagaaguucccccaggacuacagacuggcccagcaggugugccacgccaucgccaacaucagcgacagaagaaagcccagccugggcaagagacacccccccuucagacugccccaggagcacagacuguucgagagacugagagagaccgugaccaagggcuucgugcaccccgacccccuguggauccccuucaaggagguggccgugacccugaucuaccagcuggccgagggccccgaggugaucugcgcccagauccugcagggcugcgccaagcaggcccuggagaagcuggaggagaagagaaccagccaggaggaccccaaggagagccccgccaugcugcccaccuuccugcugaugaaccugcugagccuggccggcgacguggcccugcagcagcuggugcaccuggagcaggccgugagcggcgagcugugcagaagaagagugcugagagaggagcaggagcacaagaccaaggaccccaaggagaagaacaccagcagcgagaccaccauggaggaggagcugggccuggugggcgccaccgccgacgacaccgaggccgagcugaucagaggcaucugcgagauggagcugcuggacggcaagcagacccuggccgccuucgugccccugcugcugaaggugugcaacaaccccggccuguacagcaaccccgaccugagcgccgccgccagccuggcccugggcaaguucugcaugaucagcgccaccuucugcgacagccagcugagacugcuguucaccaugcuggagaagagcccccugcccaucgugagaagcaaccugaugguggccaccggcgaccuggccaucagauuccccaaccugguggaccccuggaccccccaccuguacgccagacugagagaccccgcccagcaggugagaaagaccgccggccuggugaugacccaccugauccugaaggacauggugaaggugaagggccaggugagcgagauggccgugcugcugaucgaccccgagccccagaucgccgcccuggccaagaacuucuucaacgagcugagccacaagggcaacgccaucuacaaccugcugcccgacaucaucagcagacugagcgaccccgagcugggcguggaggaggagcccuuccacaccaucaugaagcagcugcugagcuacaucaccaaggacaagcagaccgagagccugguggagaagcugugccagagauucagaaccagcagaaccgagagacagcagagagaccuggccuacugcgugagccagcugccccugaccgagagaggccugagaaagaugcuggacaacuucgacugcuucggcgacaagcugagcgacgagagcaucuucagcgccuuccugagcguggugggcaagcugagaagaggcgccaagcccgagggcaaggccaucaucgacgaguucgagcagaagcugagagccugccacaccagaggccuggacggcaucaaggagcuggagaucggccaggccggcagccagagagcccccagcgccaagaagcccagcaccggcagcagauaccagccccuggccagcaccgccagcgacaacgacuucgugacccccgagcccagaagaaccaccagaagacaccccaacacccagcagagagccagcaagaagaagcccaaggugguguucagcagcgacgagagcagcgaggaggaccugagcgccgagaugaccgaggacgagacccccaagaagaccacccccauccugagagccagcgccagaagacacagaagcuaa

SEQ ID NO: 20353 - RNA, 4497 nt, Artificial Sequence
  NCAPD3__Homo_sapiens__NP_056076
augguggcccugagaggccugggcagcggccugcagcccuggugcccccuggaccugagacuggaguggguggacaccgugugggagcuggacuucaccgagaccgagccccuggaccccagcaucgaggccgagaucaucgagaccggccuggccgccuucaccaagcuguacgagagccugcugcccuucgccaccggcgagcacggcagcauggagagcaucuggaccuucuucaucgagaacaacgugagccacagcacccugguggcccuguucuaccacuucgugcagaucgugcacaagaagaacgugagcgugcaguacagagaguacggccugcacgccgccggccuguacuuccugcugcuggaggugcccggcagcguggccaaccagguguuccaccccgugauguucgacaagugcauccagacccugaagaagagcuggccccaggagagcaaccugaacagaaagagaaagaaggagcagcccaagagcagccaggccaaccccggcagacacagaaagagaggcaagccccccagaagagaggacaucgagauggacgagaucaucgaggagcaggaggacgagaacaucugcuucagcgccagagaccugagccagaucagaaacgccaucuuccaccugcugaagaacuuccugagacugcugcccaaguucagccugaaggagaagccccagugcgugcagaacugcaucgagguguucgugagccugaccaacuucgagcccgugcugcacgagugccacgugacccaggccagagcccugaaccaggccaaguacauccccgagcuggccuacuacggccuguaccugcugugcagccccauccacggcgagggcgacaaggugaucagcugcguguuccaccagaugcugagcgugauccugaugcuggaggugggcgagggcagccacagagccccccuggccgugaccagccaggugaucaacugcagaaaccaggccgugcaguucaucagcgcccugguggacgagcugaaggagagcaucuuccccguggugagaauccugcugcagcacaucugcgccaaggugguggacaagagcgaguacagaaccuucgccgcccagagccuggugcagcugcugagcaagcugcccugcggcgaguacgccauguucaucgccuggcuguacaaguacagcagaagcagcaagaucccccacagaguguucacccuggacguggugcuggcccugcuggagcugcccgagagagagguggacaacacccugagccuggagcaccagaaguuccugaagcacaaguuccuggugcaggagaucauguucgacagaugccuggacaaggcccccaccgugagaagcaaggcccugagcagcuucgcccacugccuggagcugaccgugaccagcgccagcgagagcauccuggagcugcugaucaacagccccaccuucagcgugaucgagagccaccccggcacccugcugagaaacagcagcgccuucagcuaccagagacagaccagcaacagaagcgagcccagcggcgagaucaacaucgacagcagcggcgagaccgugggcagcggcgagagaugcgugauggccaugcugagaagaagaaucagagacgagaagaccaacgugagaaagagcgcccugcaggugcuggugagcauccugaagcacugcgacgugagcggcaugaaggaggaccuguggauccugcaggaccagugcagagaccccgccgugagcgugagaaagcaggcccugcagagccugaccgagcugcugauggcccagcccagaugcgugcagauccagaaggccuggcugagaggcguggugcccguggugauggacugcgagagcaccgugcaggagaaggcccuggaguuccuggaccagcugcugcugcagaacaucagacaccacagccacuuccacagcggcgacgacagccaggugcuggccugggcccugcugacccugcugaccaccgagagccaggagcugagcagauaccugaacaaggccuuccacaucuggagcaagaaggagaaguucagccccaccuucaucaacaacgugaucagccacaccggcaccgagcacagcgcccccgccuggaugcugcugagcaagaucgccggcagcagccccagacuggacuacagcagaaucauccagagcugggagaagaucagcagccagcagaaccccaacagcaacacccugggccacauccugugcgugaucggccacaucgccaagcaccugcccaagagcaccagagacaaggugaccgacgccgugaagugcaagcugaacggcuuccaguggagccuggaggugaucagcagcgccguggacgcccugcagagacugugcagagccagcgccgagacccccgccgaggagcaggagcugcugacccaggugugcggcgacgugcugagcaccugcgagcacagacugagcaacaucgugcugaaggagaacggcaccggcaacauggacgaggaccugcuggugaaguacaucuucacccugggcgacaucgcccagcugugccccgccagaguggagaagagaaucuuccugcugauccagagcgugcuggccagcagcgccgacgccgaccacagccccagcagccagggcagcagcgaggcccccgccagccagccccccccccaggugagaggcagcgugaugcccagcgugaucagagcccacgccaucaucacccugggcaagcugugccugcagcacgaggaccuggccaagaagagcauccccgcccuggugagagagcuggaggugugcgaggacguggccgugagaaacaacgugaucaucgugaugugcgaccugugcaucagauacaccaucaugguggacaaguacauccccaacaucagcaugugccugaaggacagcgaccccuucaucagaaagcagacccugauccugcugaccaaccugcugcaggaggaguucgugaaguggaagggcagccuguucuucagauucgugagcacccugaucgacagccaccccgacaucgccagcuucggcgaguucugccuggcccaccugcugcugaagagaaaccccgugauguucuuccagcacuucaucgagugcaucuuccacuucaacaacuacgagaagcacgagaaguacaacaaguucccccagagcgagagagagaagagacuguucagccugaagggcaagagcaacaaggagagaagaaugaagaucuacaaguuccugcuggagcacuucaccgacgagcagagauucaacaucaccagcaagaucugccugagcauccuggccugcuucgccgacggcauccugccccuggaccuggacgccagcgagcugcugagcgacaccuucgaggugcugagcagcaaggagaucaagcugcuggccaugagaagcaagcccgacaaggaccugcugauggaggaggacgacauggcccuggccaacguggugaugcaggaggcccagaagaagcugaucagccaggugcagaagagaaacuucaucgagaacaucauccccaucaucaucagccugaagaccgugcuggagaagaacaagauccccgcccugagagagcugaugcacuaccugagagaggugaugcaggacuacagagacgagcugaaggacuucuucgccguggacaagcagcuggccagcgagcuggaguacgacaugaagaaguaccaggagcagcuggugcaggagcaggagcuggccaagcacgccgacguggccggcaccgccggcggcgccgagguggcccccguggcccagguggcccugugccuggagaccgugcccgugcccgccggccaggagaaccccgccaugagccccgccgugagccagcccugcacccccagagccagcgccggccacguggccgugagcagccccacccccgagaccggcccccugcagagacugcugcccaaggccagacccaugagccugagcaccaucgccauccugaacagcgugaagaaggccguggagagcaagagcagacacagaagcagaagccugggcgugcugcccuucacccugaacagcggcagccccgagaagaccugcagccaggugagcagcuacagccuggagcaggagagcaacggcgagaucgagcacgugaccaagagagccaucagcacccccgagaagagcaucagcgacgugaccuucggcgccggcgugagcuacaucggcacccccagaacccccagcagcgccaaggagaagaucgagggcagaagccagggcaacgacauccugugccugagccugcccgacaagccccccccccagccccagcaguggaacgugagaagccccgccagaaacaaggacacccccgccugcagcagaagaagccugagaaagaccccccugaagaccgccaacuaa

SEQ ID NO: 20354 - RNA, 3432 nt, Artificial Sequence
  NCAPG2__Homo_sapiens__NP_001268861
auggagaagagagagaccuucgugcaggccgugagcaaggagcuggugggcgaguuccugcaguucgugcagcuggacaaggaggccagcgaccccuucagccugaacgagcugcuggacgagcugagcagaaagcagaaggaggagcuguggcagagacugaagaaccugcugaccgacgugcugcuggagagccccguggacggcuggcaggugguggaggcccagggcgaggacaacauggagaccgagcacggcagcaagaugagaaagagcaucgagaucaucuacgccaucaccagcgugauccuggccagcgugagcgugaucaacgagagcgagaacuacgaggcccugcuggagugcgugaucauccugaacggcauccuguacgcccugcccgagagcgagagaaagcugcagagcagcauccaggaccugugcgugaccuggugggagaagggccugcccgccaaggaggacaccggcaagaccgccuucgugaugcugcugagaagaagccuggagaccaagaccggcgccgacgugugcagacuguggagaauccaccaggcccuguacugcuucgacuacgaccuggaggagagcggcgagaucaaggacaugcugcuggagugcuucaucaacaucaacuacaucaagaaggaggagggcagaagauuccugagcugccuguucaacuggaacaucaacuucaucaagaugauccacggcaccaucaagaaccagcugcagggccugcagaagagccugaugguguacaucgccgagaucuacuucagagccuggaagaaggccagcggcaagauccuggaggccaucgagaacgacugcauccaggacuucauguuccacggcauccaccugcccagaagaagccccgugcacagcaaggugagagaggugcugagcuacuuccaccaccagaagaaggugagacagggcguggaggagaugcuguacagacuguacaagcccauccuguggagaggccugaaggccagaaacagcgaggugagaagcaacgccgcccugcuguucguggaggccuuccccaucagagaccccaaccugcacgccaucgagauggacagcgagauccagaagcaguucgaggagcuguacagccugcuggaggaccccuaccccauggugagaagcaccggcauccugggcgugugcaagaucaccagcaaguacugggagaugaugccccccaccauccugaucgaccugcugaagaaggugaccggcgagcuggccuucgacaccagcagcgccgacgugagaugcagcguguucaagugccugcccaugauccuggacaacaagcugagccacccccugcuggagcagcugcugcccgcccugagauacagccugcacgacaacagcgagaaggugagaguggccuucguggacaugcugcugaagaucaaggccgugagagccgccaaguucuggaagaucugccccauggagcacauccuggugagacuggagaccgacagcagacccgugagcagaagacuggugagccugaucuucaacagcuuccugcccgugaaccagcccgaggagguguggugcgagagaugcgugacccuggugcagaugaaccacgccgccgccagaagauucuaccaguacgcccacgagcacaccgccugcaccaacaucgccaagcugauccacgugaucagacacugccugaacgccugcauccagagagccgugagagagccccccgaggacgaggaggaggaggacggcagagagaaggagaacgugaccgugcuggacaagacccugagcgugaacgacguggccugcauggccggccugcuggagaucaucgugauccuguggaagagcaucgacagaagcauggagaacaacaaggaggccaagcuguacaccaucaacaaguucgccagcgugcugcccgaguaccugaagguguucaaggacgacagaugcaagaucccccuguucaugcugaugagcuucaugcccgccagcgccgugccccccuucagcugcggcgugaucagcacccugagaagcagagaggagggcgccguggacaagagcuacugcacccugcuggacugccugugcagcuggggccaggugggccacauccuggagcugguggacaacuggcugcccaccgagcacgcccaggccaagagcaacaccgccagcaagggcagagugcagauccacgacaccagacccgugaagcccgagcuggcccugguguacaucgaguaccugcugacccaccccaagaacagagagugccugcugagcgcccccagaaagaagcugaaccaccugcugaaggcccuggagaccagcaaggccgaccuggagagccugcugcagacccccggcggcaagcccagaggcuucagcgaggccgccgcccccagagccuucggccugcacugcagacugagcauccaccugcagcacaaguucugcagcgagggcaagguguaccugagcaugcuggaggacaccggcuucuggcuggagagcaagauccugagcuucauccaggaccaggaggaggacuaccugaagcugcacagagugaucuaccagcagaucauccagaccuaccugaccgugugcaaggacguggugauggugggccugggcgaccaccaguuccagaugcagcugcugcagagaagccugggcaucaugcagaccgugaagggcuucuucuacgugagccugcugcuggacauccugaaggagaucaccggcagcagccugauccagaagaccgacagcgacgaggagguggccaugcugcuggacaccgugcagaagguguuccagaagaugcuggagugcaucgccagaagcuucagaaagcagcccgaggagggccugagacugcuguacagcgugcagagaccccugcacgaguucaucaccgccgugcagagcagacacaccgacacccccgugcacagaggcgugcugagcacccugaucgccggccccgugguggagaucagccaccagcugagaaaggugagcgacguggaggagcugaccccccccgagcaccugagcgaccugccccccuucagcagaugccugaucggcaucaucaucaagagcagcaacguggugagaagcuuccuggacgagcugaaggccugcguggccagcaacgacaucgagggcaucgugugccugaccgccgccgugcacaucauccuggugaucaacgccggcaagcacaagagcagcaaggugagagagguggccgccaccgugcacagaaagcugaagaccuucauggagaucacccuggaggaggacagcaucgagagauuccuguacgagagcagcagcagaacccugggcgagcugcugaacagcuaa

SEQ ID NO: 20355 - RNA, 3048 nt, Artificial Sequence
  NCAPG__Homo_sapiens__NP_071741
augggcgccgagagaagacugcugagcaucaaggaggccuucagacuggcccagcagccccaccagaaccaggccaagcuggugguggcccugagcagaaccuacagaaccauggacgacaagaccguguuccacgaggaguucauccacuaccugaaguacgugauggugguguacaagagagagcccgccguggagagagugaucgaguucgccgccaaguucgugaccagcuuccaccagagcgacauggaggacgacgaggaggaggaggacggcggccugcugaacuaccuguucaccuuccugcugaagagccacgaggccaacagcaacgccgugagauucagagugugccugcugaucaacaagcugcugggcagcaugcccgagaacgcccagaucgacgacgacguguucgacaagaucaacaaggccaugcugaucagacugaaggacaagauccccaacgugagaauccaggccgugcuggcccugagcagacugcaggaccccaaggacgacgagugccccguggugaacgccuacgccacccugaucgagaacgacagcaaccccgaggugagaagagccgugcugagcugcaucgcccccagcgccaagacccugcccaagaucgugggcagaaccaaggacgugaaggaggccgugagaaagcuggccuaccaggugcuggccgagaaggugcacaugagagccaugagcaucgcccagagagugaugcugcugcagcagggccugaacgacagaagcgacgccgugaagcaggccaugcagaagcaccugcugcagggcuggcugagauucagcgagggcaacauccuggagcugcugcacagacuggacguggagaacagcagcgagguggccgugagcgugcugaacgcccuguucagcaucaccccccugagcgagcuggugggccugugcaagaacaacgacggcagaaagcugauccccguggagacccugacccccgagaucgcccuguacuggugcgcccugugcgaguaccugaagagcaagggcgacgagggcgaggaguuccuggagcagauccugcccgagcccgugguguacgccgacuaccugcugagcuacauccagagcauccccguggugaacgaggagcacagaggcgacuucagcuacaucggcaaccugaugaccaaggaguucaucggccagcagcugauccugaucaucaagagccuggacaccagcgaggagggcggcagaaagaagcugcuggccgugcugcaggagauccugauccugcccaccauccccaucagccuggugagcuuccugguggagagacugcugcacaucaucaucgacgacaacaagagaacccagaucgugaccgagaucaucagcgagaucagagcccccaucgugaccgugggcgugaacaacgaccccgccgacgugagaaagaaggagcugaagauggccgagaucaaggugaagcugaucgaggccaaggaggcccuggagaacugcaucacccugcaggacuucaacagagccagcgagcugaaggaggagaucaaggcccuggaggacgccagaaucaaccugcugaaggagaccgagcagcuggagaucaaggaggugcacaucgagaagaacgacgccgagacccugcagaagugccugauccugugcuacgagcugcugaagcagaugagcaucagcaccggccugagcgccaccaugaacggcaucaucgagagccugauccugcccggcaucaucagcauccaccccguggugagaaaccuggccgugcugugccugggcugcugcggccugcagaaccaggacuucgccagaaagcacuucgugcugcugcugcaggugcugcagaucgacgacgugaccaucaagaucagcgcccugaaggccaucuucgaccagcugaugaccuucggcaucgagcccuucaagaccaagaagaucaagacccugcacugcgagggcaccgagaucaacagcgacgacgagcaggagagcaaggagguggaggagaccgccaccgccaagaacgugcugaagcugcugagcgacuuccuggacagcgaggugagcgagcugagaaccggcgccgccgagggccuggccaagcugauguucagcggccugcuggugagcagcagaauccugagcagacugauccugcugugguacaaccccgugaccgaggaggacgugcagcugagacacugccugggcguguucuuccccguguucgccuacgccagcagaaccaaccaggagugcuucgaggaggccuuccugcccacccugcagacccuggccaacgcccccgccagcagcccccuggccgagaucgacaucaccaacguggccgagcugcugguggaccugaccagacccagcggccugaacccccaggccaagaccagccaggacuaccaggcccugaccgugcacgacaaccuggccaugaagaucugcaacgagauccugaccagccccugcagccccgagaucagaguguacaccaaggcccugagcagccuggagcugagcagccaccuggccaaggaccugcuggugcugcugaacgagauccuggagcaggugaaggacagaaccugccugagagcccuggagaagaucaagauccagcuggagaagggcaacaaggaguucggcgaccaggccgaggccgcccaggacgccacccugaccaccaccaccuuccagaacgaggacgagaagaacaaggagguguacaugaccccccugagaggcgugaaggccacccaggccagcaagagcacccagcugaagaccaacagaggccagagaaaggugaccgugagcgccagaaccaacagaagaugccagaccgccgaggccgacagcgagagcgaccacgaggugcccgagcccgagagcgagaugaagaugagacugcccagaagagccaagaccgccgcccuggagaagagcaagcugaaccuggcccaguuccugaacgaggaccugagcuaa

SEQ ID NO: 20356 - RNA, 312 nt, Artificial Sequence
  NCBP2__Homo_sapiens__NP_001036005
augagcggcggccugcugaaggcccugagaagcgacagcuacguggagcugagccaguacagagaccagcacuucagaggcgacaacgaggagcaggagaagcugcugaagaagagcuacgccgagaacgccaugagauacaucaacggcaccagacuggacgacagaaucaucagaaccgacugggacgccggcuucaaggagggcagacaguacggcagaggcagaagcggcggccaggugagagacgaguacagacaggacuacgacgccggcagaggcggcuacggcaagcuggcccagaaccaguaa

SEQ ID NO: 20357 - RNA, 1347 nt, Artificial Sequence
  NCEH1__Homo_sapiens__NP_001139748
augagcagcugcagaggccagaagguggccggcggccugagaguggugagccccuucccccugugccagcccgccggcgagcccagccagggcaagaugagaagcagcugcgugcugcugaccgcccugguggcccuggccgccuacuacguguacaucccccugcccggcagcgugagcgaccccuggaagcugaugcugcuggacgccaccuucagaggcgcccagcaggugagcaaccugauccacuaccugggccugagccaccaccugcuggcccugaacuucaucaucgugagcuucggcaagaagagcgccuggagcagcgcccaggugaaggugaccgacaccgacuucgacggcguggaggugagaguguucgagggcccccccaagcccgaggagccccugaagagaagcgugguguacauccacggcggcggcugggcccuggccagcgccagcgccagcuggagccccagcgacgagaucagauacuacgacgagcugugcaccgccauggccgaggagcugaacgccgugaucgugagcaucgaguacagacuggugcccaagguguacuuccccgagcagauccacgacguggugagagccaccaaguacuuccugaagcccgaggugcugcagaaguacaugguggaccccggcagaaucugcaucagcggcgacagcgccggcggcaaccuggccgccgcccugggccagcaguucacccaggacgccagccugaagaacaagcugaagcugcaggcccugaucuaccccgugcugcaggcccuggacuucaacacccccagcuaccagcagaacgugaacacccccauccugcccagauacgugauggugaaguacuggguggacuacuucaagggcaacuacgacuucgugcaggccaugaucgugaacaaccacaccagccuggacguggaggaggccgccgccgugagagccagacugaacuggaccagccugcugcccgccagcuucaccaagaacuacaagcccguggugcagaccaccggcaacgccagaaucgugcaggagcugccccagcugcuggacgccagaagcgccccccugaucgccgaccaggccgugcugcagcugcugcccaagaccuacauccugaccugcgagcacgacgugcugagagacgacggcaucauguacgccaagagacuggagagcgccggcguggaggugacccuggaccacuucgaggacggcuuccacggcugcaugaucuucaccagcuggcccaccaacuucagcgugggcaucagaaccagaaacagcuacaucaaguggcuggaccagaaccuguaa

SEQ ID NO: 20358 - RNA, 1173 nt, Artificial Sequence
  NCF1__Homo_sapiens__NP_000256
augggcgacaccuucaucagacacaucgcccugcugggcuucgagaagagauucgugcccagccagcacuacguguacauguuccuggugaaguggcaggaccugagcgagaaggugguguacagaagauucaccgagaucuacgaguuccacaagacccugaaggagauguuccccaucgaggccggcgccaucaaccccgagaacagaaucaucccccaccugcccgcccccaagugguucgacggccagagagccgccgagaacagacagggcacccugaccgaguacugcagcacccugaugagccugcccaccaagaucagcagaugcccccaccugcuggacuucuucaaggugagacccgacgaccugaagcugcccaccgacaaccagaccaagaagcccgagaccuaccugaugcccaaggacggcaagagcaccgccaccgacaucaccggccccaucauccugcagaccuacagagccaucgccaacuacgagaagaccagcggcagcgagauggcccugagcaccggcgacgugguggaggugguggagaagagcgagagcggcuggugguucugccagaugaaggccaagagaggcuggauccccgccagcuuccuggagccccuggacagccccgacgagaccgaggaccccgagcccaacuacgccggcgagcccuacguggccaucaaggccuacaccgccguggagggcgacgaggugagccugcuggagggcgaggccguggaggugauccacaagcugcuggacggcuggugggugaucagaaaggacgacgugaccggcuacuuccccagcauguaccugcagaagagcggccaggacgugagccaggcccagagacagaucaagagaggcgccccccccagaagaagcagcaucagaaacgcccacagcauccaccagagaagcagaaagagacugagccaggacgccuacagaagaaacagcgugagauuccugcagcagagaagaagacaggccagacccggcccccagagccccggcagcccccuggaggaggagagacagacccagagaagcaagccccagcccgccgugccccccagacccagcgccgaccugauccugaacagaugcagcgagagcaccaagagaaagcuggccagcgccguguaa

SEQ ID NO: 20359 - RNA, 1338 nt, Artificial Sequence
  NCF2__Homo_sapiens__NP_001177718
augagccugguggaggccaucagccuguggaacgagggcgugcuggccgccgacaagaaggacuggaagggcgcccuggacgccuucagcgccgugcaggacccccacagcagaaucugcuucaacaucggcugcauguacaccauccugaagaacaugaccgaggccgagaaggccuucaccagaagcaucaacagagacaagcaccuggccguggccuacuuccagagaggcaugcuguacuaccagaccgagaaguacgaccuggccaucaaggaccugaaggaggcccugauccagcugagaggcaaccagcugaucgacuacaagauccugggccugcaguucaagcuguucgccugcgaggugguggccagcgugguggaccaggacagcuucagcggcuucgccccccugcagccccaggccgccgagcccccccccagacccaagacccccgagaucuucagagcccuggagggcgaggcccacagagugcuguucggcuucgugcccgagaccaaggaggagcugcaggugaugcccggcaacaucguguucgugcugaagaagggcaacgacaacugggccaccgugauguucaacggccagaagggccuggugcccugcaacuaccuggagcccguggagcugagaauccacccccagcagcagccccaggaggagagcagcccccagagcgacauccccgccccccccagcagcaaggcccccggcagaccccagcugagccccggccagaagcagaaggaggagcccaaggaggugaagcugagcgugcccaugcccuacacccugaaggugcacuacaaguacaccguggugaugaagacccagcccggccugcccuacagccaggugagagacauggugagcaagaagcuggagcugagacuggagcacaccaagcugagcuacagacccagagacagcaacgagcuggugccccugagcgaggacagcaugaaggacgccuggggccaggugaagaacuacugccugacccuguggugcgagaacaccgugggcgaccagggcuuccccgacgagcccaaggagagcgagaaggccgacgccaacaaccagaccaccgagccccagcugaagaagggcagccagguggaggcccuguucagcuacgaggccacccagcccgaggaccuggaguuccaggagggcgacaucauccuggugcugagcaaggugaacgaggaguggcuggagggcgagugcaagggcaaggugggcaucuuccccaagguguucguggaggacugcgccaccaccgaccuggagagcaccagaagagagguguaa

SEQ ID NO: 20360 - RNA, 1020 nt, Artificial Sequence
  NCF4__Homo_sapiens__NP_000622
auggccguggcccagcagcugagagccgagagcgacuucgagcagcugcccgacgacguggccaucagcgccaacaucgccgacaucgaggagaagagaggcuucaccagccacuucguguucgugaucgaggugaagaccaagggcggcagcaaguaccugaucuacagaagauacagacaguuccacgcccugcagagcaagcuggaggagagauucggccccgacagcaagagcagcgcccuggccugcacccugcccacccugcccgccaagguguacgugggcgugaagcaggagaucgccgagaugagaauccccgcccugaacgccuacaugaagagccugcugagccugcccgugugggugcugauggacgaggacgugagaaucuucuucuaccagagccccuacgacagcgagcaggugccccaggcccugagaagacugagacccagaaccagaaaggugaagagcgugagcccccagggcaacagcguggacagaauggccgcccccagagccgaggcccuguucgacuucaccggcaacagcaagcuggagcugaacuucaaggccggcgacgugaucuuccugcugagcagaaucaacaaggacuggcuggagggcaccgugagaggcgccaccggcaucuucccccugagcuucgugaagauccugaaggacuuccccgaggaggacgaccccaccaacuggcugagaugcuacuacuacgaggacaccaucagcaccaucaaggacaucgccguggaggaggaccugagcagcaccccccugcugaaggaccugcuggagcugaccagaagagaguuccagagagaggacaucgcccugaacuacagagacgccgagggcgaccuggugagacugcugagcgacgaggacguggcccugauggugagacaggccagaggccugcccagccagaagagacuguuccccuggaagcugcacaucacccagaaggacaacuacagaguguacaacaccaugcccuaa

SEQ ID NO: 20361 - RNA, 942 nt, Artificial Sequence
  NCK1__Homo_sapiens__NP_001177725
auggacuggcugaacguguucaaggacuucuucagcaucggcaaggugaagagaaagcccagcgugcccgacagcgccagccccgccgacgacagcuucguggaccccggcgagagacuguacgaccugaacaugcccgccuacgugaaguucaacuacauggccgagagagaggacgagcugagccugaucaagggcaccaaggugaucgugauggagaagugcagcgacggcugguggagaggcagcuacaacggccaggugggcugguuccccagcaacuacgugaccgaggagggcgacagcccccugggcgaccacgugggcagccugagcgagaagcuggccgccguggugaacaaccugaacaccggccaggugcugcacguggugcaggcccuguaccccuucagcagcagcaacgacgaggagcugaacuucgagaagggcgacgugauggacgugaucgagaagcccgagaacgaccccgagugguggaagugcagaaagaucaacggcauggugggccuggugcccaagaacuacgugaccgugaugcagaacaacccccugaccagcggccuggagcccagccccccccagugcgacuacaucagacccagccugaccggcaaguucgccggcaaccccugguacuacggcaaggugaccagacaccaggccgagauggcccugaacgagagaggccacgagggcgacuuccugaucagagacagcgagagcagccccaacgacuucagcgugagccugaaggcccagggcaagaacaagcacuucaaggugcagcugaaggagaccguguacugcaucggccagagaaaguucagcaccauggaggagcugguggagcacuacaagaaggcccccaucuucaccagcgagcagggcgagaagcuguaccuggugaagcaccugagcuaa

SEQ ID NO: 20362 - RNA, 252 nt, Artificial Sequence
  NCK2__Homo_sapiens__NP_001004722
augaccgaggaggugaucgugaucgccaagugggacuacaccgcccagcaggaccaggagcuggacaucaagaagaacgagagacuguggcugcuggacgacagcaagaccugguggagagugagaaacgccgccaacagaaccggcuacgugcccagcaacuacguggagagaaagaacagccugaagaagggcagccuggugaagaaccugaaggacacccuggcccagagacugcugagagugcccuaa

SEQ ID NO: 20363 - RNA, 3387 nt, Artificial Sequence
  NCKAP1__Homo_sapiens__NP_038464
augagcagaagcgugcugcagcccagccagcagaagcuggccgagaagcugaccauccugaacgacagaggcgugggcaugcugaccagacuguacaacaucaagaaggccugcggcgaccccaaggccaagcccagcuaccugaucgacaagaaccuggagagcgccgugaaguucaucgugagaaaguuccccgccguggagaccagaaacaacaaccagcagcuggcccagcugcagaaggagaagagcgagauccugaagaaccuggcccuguacuacuucaccuucguggacgugauggaguucaaggaccacgugugcgagcugcugaacaccaucgacgugugccagguguucuucgacaucaccgugaacuucgaccugaccaagaacuaccuggaccugaucaucaccuacaccacccugaugauccugcugagcagaaucgaggagagaaaggccaucaucggccuguacaacuacgcccacgagaugacccacggcgccagcgacagagaguaccccagacugggccagaugaucguggacuacgagaacccccugaagaagaugauggaggaguucgugccccacagcaagagccugagcgacgcccugaucagccugcagaugguguaccccagaagaaaccugagcgccgaccaguggagaaacgcccagcugcugagccugaucagcgcccccagcaccaugcugaaccccgcccagagcgacaccaugcccugcgaguaccugagccuggacgccauggagaaguggaucaucuucggcuucauccugugccacggcauccugaacaccgacgccaccgcccugaaccuguggaagcuggcccugcagagcagcagcugccugagccuguucagagacgagguguuccacauccacaaggccgccgaggaccuguucgugaacaucagaggcuacaacaagagaaucaacgacaucagagagugcaaggaggccgccgugagccacgccggcagcaugcacagagagagaagaaaguuccugagaagcgcccugaaggagcuggccaccgugcugagcgaccagcccggccugcugggccccaaggcccuguucguguucauggcccugagcuucgccagagacgagaucaucuggcugcugagacacgccgacaacaugcccaagaagagcgccgacgacuucaucgacaagcacaucgccgagcugaucuucuacauggaggagcugagagcccacgugagaaaguacggccccgugaugcagagauacuacgugcaguaccugagcggcuucgacgccguggugcugaacgagcuggugcagaaccugagcgugugccccgaggacgagagcaucaucaugagcagcuucgugaacaccaugaccagccugagcgugaagcagguggaggacggcgagguguucgacuucagaggcaugagacuggacugguucagacugcaggccuacaccagcgugagcaaggccagccugggccuggccgaccacagagagcugggcaagaugaugaacaccaucaucuuccacaccaagaugguggacagccugguggagaugcugguggagaccagcgaccugagcaucuucugcuucuacagcagagccuucgagaagauguuccagcagugccuggagcugcccagccagagcagauacagcaucgccuucccccugcugugcacccacuucaugagcugcacccacgagcugugccccgaggagagacaccacaucggcgacagaagccugagccugugcaacauguuccuggacgagauggccaagcaggccagaaaccugaucaccgacaucugcaccgagcagugcacccugagcgaccagcugcugcccaagcacugcgccaagaccaucagccaggccgugaacaagaagagcaagaagcagaccggcaagaagggcgagcccgagagagagaagcccggcguggagagcaugagaaagaacagacugguggugaccaaccuggacaagcugcacaccgcccugagcgagcugugcuucagcaucaacuacgugcccaacaugguggugugggagcacaccuucacccccagagaguaccugaccagccaccuggagaucagauucaccaagagcaucgugggcaugaccauguacaaccaggccacccaggagaucgccaagcccagcgagcugcugaccagcgugagagccuacaugaccgugcugcagagcaucgagaacuacgugcagaucgacaucaccagaguguucaacaacgugcugcugcagcagacccagcaccuggacagccacggcgagcccaccaucaccagccuguacaccaacugguaccuggagacccugcugagacaggugagcaacggccacaucgccuacuuccccgccaugaaggccuucgugaaccugcccaccgagaacgagcugaccuucaacgccgaggaguacagcgacaucagcgagaugagaagccugagcgagcugcugggccccuacggcaugaaguuccugagcgagagccugauguggcacaucagcagccagguggccgagcugaagaagcuggugguggagaacguggacgugcugacccagaugagaaccagcuucgacaagcccgaccagauggccgcccuguucaagagacugagcagcguggacagcgugcugaagagaaugaccaucaucggcgugauccugagcuucagaagccuggcccaggaggcccugagagacgugcugagcuaccacauccccuuccuggugagcagcaucgaggacuucaaggaccacauccccagagagaccgacaugaagguggccaugaacguguacgagcugagcagcgccgccggccugcccugcgagaucgaccccgcccuggugguggcccugagcagccagaagagcgagaacaucagccccgaggaggaguacaagaucgccugccugcugaugguguucguggccgugagccugcccacccuggccagcaacgugaugagccaguacagccccgccaucgagggccacugcaacaacauccacugccuggccaaggccaucaaccagaucgccgccgcccuguucaccauccacaagggcagcaucgaggacagacugaaggaguuccuggcccuggccagcagcagccugcugaagaucggccaggagaccgacaagaccaccaccagaaacagagagagcguguaccugcugcuggacaugaucgugcaggagagccccuuccugaccauggaccugcuggagagcugcuuccccuacgugcugcugagaaacgccuaccacgccguguacaagcagagcgugaccagcagcgccuaa

SEQ ID NO: 20364 - RNA, 3234 nt, Artificial Sequence
  NCKAP1L__Homo_sapiens__NP_001171905
auggagcccagccugaaguacaucaacaagaaguuccccaacaucgacgugagaaacagcacccagcaccugggccccgugcacagagagaaggccgagaucaucagauuccugaccaacuacuaccagagcuucguggacgugauggaguucagagaccacguguacgagcugcugaacaccaucgacgccugccagugccacuucgacaucaaccugaacuucgacuucaccagaagcuaccuggaccugaucgugaccuacaccagcgugauccugcugcugagcagaaucgaggacagaagaauccugaucggcauguacaacugcgcccacgagaugcugcacggccacggcgaccccagcuucgccagacugggccagauggugcuggaguacgaccacccccugaagaagcugaccgaggaguucggcccccacaccaaggccgugagcggcgcccugcugagccugcacuuccuguucgugagaagaaaccagggcgccgagcaguggagaagcgcccagcugcugagccugaucagcaacccccccgccaugaucaaccccgccaacagcgacaccauggccugcgaguaccugagcguggaggugauggagagauggaucaucaucggcuuccugcugugccacggcugccugaacagcaacagccagugccagaagcuguggaagcugugccugcagggcagccuguacaucacccugaucagagaggacgugcugcaggugcacaaggugaccgaggaccuguucagcagccugaagggcuacggcaagagaguggccgacaucaaggagagcaaggagcacgugaucgccaacagcggccaguuccacugccagagaagacaguuccugagaauggccgugaaggagcuggagaccgugcuggccgacgagcccggccugcugggccccaaggcccuguucgccuucauggcccugagcuucaucagagacgaggugaccuggcuggugagacacaccgagaacgugaccaagaccaagacccccgaggacuacgccgacagcagcaucgccgagcugcuguuccugcuggagggcaucagaagccuggugagaagacacaucaaggugauccagcaguaccaccugcaguaccuggccagauucgacgcccuggugcugagcgacaucauccagaaccugagcgugugccccgaggaggagagcaucaucaugagcagcuucgugagcauccugagcagccugaaccugaagcagguggacaacggcgagaaguucgaguucagcggccugagacuggacugguucagacugcaggccuacaccagcguggccaaggccccccugcaccugcacgagaaccccgaccuggccaaggugaugaaccugaucguguuccacagcagaaugcuggacagcguggagaagcugcugguggagaccagcgaccugagcaccuucugcuuccaccugagaaucuucgagaagauguucgccaugacccuggaggagagcgccaugcugagauacgccaucgccuucccccugaucugcgcccacuucgugcacugcacccacgagaugugccccgaggaguacccccaccugaagaaccacggccugcaccacugcaacagcuuccuggaggagcuggccaagcagaccagcaacugcgugcuggagaucugcgccgagcagagaaaccugagcgagcagcugcugcccaagcacugcgccaccaccaucagcaaggccaagaacaagaagaccagaaagcagagacagacccccagaaagggcgagcccgagagagacaagcccggcgccgagagccacagaaagaacagaagcaucgugaccaacauggacaagcugcaccugaaccugaccgagcuggcccugaccaugaaccacguguacagcuucagcguguucgagcacaccaucuuccccagcgaguaccugagcagccaccuggaggccagacugaacagagccaucguguggcuggccggcuacaacgccaccacccaggagaucgugagacccagcgagcugcuggccggcgugaaggccuacaucggcuucauccagagccuggcccaguuccugggcgccgacgccagcagagugaucagaaacgcccugcugcagcagacccagccccuggacagcugcggcgagcagaccaucaccacccuguacaccaacugguaccuggagagccugcugagacaggccagcagcggcaccaucauccugagccccgccaugcaggccuucgugagccugcccagagagggcgagcagaacuucagcgccgaggaguucagcgacaucagcgagaugagagcccuggccgagcugcugggccccuacggcaugaaguuccugagcgagaaccugauguggcacgugaccagccagaucguggagcugaagaagcuggugguggagaacauggacauccuggugcagaucagaagcaacuucagcaagcccgaccugauggccagccugcugccccagcugaccggcgccgagaacgugcugaagagaaugaccaucaucggcgugauccugagcuucagagccauggcccaggagggccugagagagguguucagcagccacugccccuuccugaugggccccaucgagugccugaaggaguucgugacccccgacaccgacaucaaggugacccugagcaucuucgagcuggccagcgccgccggcgugggcugcgacaucgaccccgcccugguggccgccaucgccaaccugaaggccgacaccagcagccccgaggaggaguacaagguggccugccugcugcugaucuuccuggccgugagccugccccugcuggccaccgaccccagcagcuucuacagcaucgagaaggacggcuacaacaacaacauccacugccugaccaaggccaucauccaggugagcgccgcccuguucacccuguacaacaagaacaucgagacccaccugaaggaguuccuggugguggccagcgugagccugcugcagcugggccaggagaccgacaagcugaagaccagaaacagagagagcaucagccugcugaugagacuggugguggaggagagcagcuuccugacccuggacaugcuggagagcugcuuccccuacgugcugcugagaaacgccuacagagaggugagcagagccuuccaccugaacuaa

SEQ ID NO: 20365 - RNA, 5730 nt, Artificial Sequence
  NCKAP5__Homo_sapiens__NP_997246
auggagggcaagagacagcuggagaagagagacuucggcaagagacugagccuggacagcagccugguggaguacauggacagcaacaaguacaucgagcaccugcugacccagcuggaggagcagcacagaagccuguggagagagaagcuggccguggccagacugcagagagagguggcccagagaaccagcgagggcgccaugcacgagaagcugauccacgagcuggaggaggagagacaccugagacugcagagcgagaagagacugcaggaggugacccuggagagcgagagaaacagaauccagaugagaagccugcagcagcaguucagcagaauggaggagaccgugagaaaccugcugcagagccagggcagccccgagcagaagaaggaggagaccgugaacaucaugguguaccaggagaagcugagcgaggaggagagaaagcacaaggaggcccuggaggaccugcacauggugguggacgaggacagcagaagcgagagcagcagcaccgacgagggcaaggagaagaccaagcugcugcuggagagacugaaggcccuggaggccgagaacagcgcccuggcccuggagaacgagaaccagagagagcaguacgagagaugccuggacgagguggccaaccagguggugcaggcccugcugacccagaaggaccugagagaggagugcgugaagcugaagaccagaguguucgaccuggagcagcagaacagaacccugagcauccuguuccagcagagagugagacccaccagcgaccugcugcugcagaagcugcacagcagacugcuggaccugagcagcggcgaccugcugagcgagguggagagaaacagaagccugacccagagcagaaccgacgccgaggugcacgagcaccagcugaacaccaagagcgcccugaagugccccggccugggcgccgugauccccggccaccugugccccagaaacagcuacagcagcagcagcgagcugagccugagcagcaccugcagcgaguacagcagcggcagcagcuacaccuggcacgacggcaagaaccugagaaagagacagagcagccagaacugggacaagagacugagcaucgacagcagccugcccagcggcuucgccagccccaccaacgagcugccccccaccagaaucaaggagagccacauccuggagggccugagaaagcugcagaagagaaaggugcugcuggagccccccagcgugaucaccaaguggggcuacaaggacugcaugaacagcaacgagggcaucuacagccccggcaucaagagcagcagccugaaggaguacccccccugcaagaccgccgaccugggcagccccugcaaggagccccacaagaccuucguguacgaccuggacagccacguggacgccgacgacgaccccagcacccuggcccugcugcaggccgugcccaaccagagcugcagaccccacggcagcaagcugacccacagcgugagcgacagccuguucggcugggagaccaacagaaagcacuuccuggagggcaccagcagcguguaccccaaggagagacccgagaagcugaccagcugcgccagcagcugcccccuggagaugaagcugugccccagcgugcagaccccccaggugcagagagagagaggcccccagggccagggccacggcagaauggcccugaaccugcagcugagcgacaccgacgacaacgagaccuucgacgagcugcacaucgagagcagcgacgagaagagccccagcgacgugagccuggccgccgacaccgacaagagcguggagaaccuggacgugcuggugggcuucggcaagagccugugcggcagccccgaggaggaggagaagcaggugcccauccccagcgagaccagacccaagaccuucagcuucaucaagcagcagagaguggugaagagaaccagcagcgaggagugcgugaccgugaucuucgacgccgaggacggcgagcccaucgaguucagcagccaccagaccggcguggugaccgugaccagaaacgagaucagcaucaacagcacccccgccggccccaaggccgagcacaccgagcugcugccccagggcaucgccugccugcagcccagagccgccgccagagacuacaccuucuucaagagaagcgaggaggacaccgagaagaacauccccaaggacaacguggacaacgugcccagagugagcaccgagagcuucagcagcagaaccgugacccagaacccccagcagcagaagcuggugaagcccacccacaacaucagcugccagagcaacagcagaagcagcgcccccaugggcaucuaccagaagcagaaccugaccaagaucccccccagaggcaagagcagcccccagaagagcaagcugauggagcccgaggccaccacccugcugcccagcagcggccuggugacccuggagaagagccccgcccuggcccccggcaagcugagcagauucaugaagaccgagagcagcggcccccuguucgagcugagaagcgacccccacauccccaagcacagcgcccagcugccccacagcagcagaaugcccagcagaagagacugggugcagugccccaagagccagacccccggcagcagaagcagacccgccaucgagagcagcgacagcggcgagccccccaccagagacgagcacugcggcagcggccccgaggccggcgugaagagccccagccccccccccccccccggcagaagcgugagccugcuggccagacccagcuacgacuacagccccgcccccagcagcaccaagagcgagaccagagugcccagcgagaccgccagaacccccuucaagagcccccugcugaagggcaucagcgcccccgugaucagcagcaaccccgccaccaccgaggugcagagaaagaagcccagcguggccuucaagaagcccaucuucacccaccccaugcccagccccgaggccgugauccagaccagaugccccgcccacgcccccagcagcagcuucaccgugauggcccugggcccccccaaggugagccccaagagaggcgugcccaagaccagccccagacagacccugggcaccccccagagagacaucggccugcagacccccagaaucagccccagcacccacgagccccuggagaugaccagcagcaagagcgugagccccggcagaaagggccagcugaacgacagcgccagcaccccccccaagcccagcuuccugggcgugaacgagagccccagcagccaggugagcagcagcagcagcagcagcagccccgccaagagccacaacagcccccacggcugccagagcgcccacgagaagggccugaagaccagacugcccgugggccugaaggugcugaugaagagcccccagcugcugagaaagagcagcaccgugcccggcaagcacgagaaggacagccugaacgaggccagcaagagcagcguggccgugaacaagagcaagcccgaggacagcaagaaccccgccagcauggagaucaccgccggcgagagaaacgugacccugcccgacagccaggcccagggcagccuggccgacggccugccccuggagaccgcccugcaggagccccuggagagcagcauccccggcagcgacggcagagacggcguggacaacagaagcaugagaagaagccugagcagcagcaagccccaccugaagcccgcccugggcaugaacggcgccaaggccagaagccacagcuucagcacccacagcggcgacaagcccagcaccccccccaucgagggcagcggcaaggugagaacccagaucaucaccaacaccgccgagagaggcaacagccugaccagacagaacagcagcaccgagagcagccccaacaaggcccccagcgcccccaugcuggagagccugcccagcgugggcagacccagcggccaccccagcagcggcaagggcagccugggcagcagcggcagcuucagcagccagcacggcagccccagcaagcugccccugagaaucccccccaagagcgagggccugcugaucccccccggcaaggaggaccagcaggccuucacccagggcgagugccccagcgccaacguggccgugcugggcgagcccggcagcgacagaagaagcugcccccccacccccaccgacugccccgaggcccugcagagccccggcagaacccagcaccccagcaccuucgagaccagcagcaccagcaagcuggagaccagcggcagacaccccgacgccagcgccaccgccaccgacgccgugagcagcgaggccccccugagccccaccaucgaggagaaggugaugcugugcauccaggagaacguggagaagggccaggugcagaccaagcccaccagcguggaggccaagcagaagcccggccccagcuucgccagcugguucggcuucagaaagagcagacugcccgcccugagcagcagaaagauggacaucagcaagaccaagguggagaagaaggacgccaaggugcugggcuucggcaacagacagcugaagagcgagagaaagaaggagaagaagaagcccgagcugcagugcgagaccgagaacgagcugaucaaggacaccaagagcgccgacaaccccgacggcggccugcagagcaagaacaacagaagaaccccccaggacaucuacaaccagcugaagaucgagcccagaaacagacacagccccguggccugcagcaccaaggacaccuucaugaccgagcugcugaacagaguggacaagaaggccgccccccagaccgagagcggcagcagcaacgccagcugcagaaacgugcugaagggcagcagccagggcagcugccugaucggcagcagcaucagcacccagggcaaccacaagaagaacaugaagaucaaggccgacauggaggugcccaaggacagccuggugaaggaggccaacgagaaccugcaggaggacgaggacgacgccguggccgacagcguguuccagagccacaucaucgagagcaacugccagaugagaacccuggacagcggcaucggcaccuucccccugcccgacagcggcaacagaagcaccggcagauaccugugccagcccgacagccccgaggacgccgagccccugcugccccugcagagcgcccugagcgccgugagcagcaugagagcccagacccuggagagagaggugcccagcagcaccgacggccagagacccgccgacagcgccaucgugcacagcaccagcgaccccaucaugaccgccagaggcaugagaccccugcagagcagacugcccaagcccgccagcagcggcaaggugagcagccagaagcagaacgaggccgagcccagaccccagaccugcagcagcuucggcuacgccgaggaccccauggccagccagccccugcccgacuggggcagcgagguggccgccaccggcacccaggacaaggcccccagaaugugcaccuacagcgccagcggcggcagcaacagcgacagcgaccuggacuacggcgacaacggcuucggcgccggcagaggccagcuggugaaggcccugaagagcgccgcccccgagaucgagaccaccuaa

SEQ ID NO: 20366 - RNA, 2169 nt, Artificial Sequence
  NCKIPSD__Homo_sapiens__NP_057537
auguacagagcccuguacgccuucagaagcgccgagcccaacgcccuggccuucgccgccggcgagaccuuccuggugcuggagagaagcagcgcccacugguggcuggccgccagagccagaagcggcgagaccggcuacgugccccccgccuaccugagaagacugcagggccuggagcaggacgugcugcaggccaucgacagagccaucgaggccgugcacaacaccgccaugagagacggcggcaaguacagccuggagcagagaggcgugcugcagaagcugauccaccacagaaaggagacccugagcagaagaggccccagcgccagcagcguggccgugaugaccagcagcaccagcgaccaccaccuggacgccgccgccgccagacagcccaacggcgugugcagagccggcuucgagagacagcacagccugcccagcagcgagcaccugggcgccgacggcggccuguaccagaucccccugcccagcagccagauccccccccagcccagaagagccgcccccaccaccccccccccccccgugaagagaagagacagagaggcccugauggccagcggcagcggcggccacaacaccaugcccagcggcggcaacagcgugagcagcggcagcagcgugagcagcaccagccuggacacccuguacaccagcagcagccccagcgagcccggcagcagcugcagccccacccccccccccgugcccagaagaggcacccacaccaccgugagccaggugcagcccccccccagcaaggccagcgcccccgagccccccgccgaggaggagguggccaccggcaccaccagcgccagcgacgaccuggaggcccugggcacccugagccugggcaccaccgaggagaaggccgccgccgaggccgccgugcccagaaccaucggcgccgagcugauggagcuggugagaagaaacaccggccugagccacgagcugugcagaguggccaucggcaucaucgugggccacauccaggccagcgugcccgccagcagccccgugauggagcaggugcugcugagccugguggagggcaaggaccugagcauggcccugcccagcggccaggugugccacgaccagcagagacuggaggugaucuucgccgaccuggccagaagaaaggacgacgcccagcagagaagcugggcccuguacgaggacgagggcgugaucagaugcuaccuggaggagcugcugcacauccugaccgacgccgaccccgaggugugcaagaagaugugcaagagaaacgaguucgagagcgugcuggcccugguggccuacuaccagauggagcacagagccagccugagacugcugcugcugaagugcuucggcgccaugugcagccuggacgccgccaucaucagcacccuggugagcagcgugcugcccguggagcuggccagagacaugcagaccgacacccaggaccaccagaagcugugcuacagcgcccugauccuggccaugguguucagcaugggcgaggccgugcccuacgcccacuacgagcaccugggcacccccuucgcccaguuccugcugaacaucguggaggacggccugccccuggacaccaccgagcagcugcccgaccugugcgugaaccugcugcuggcccugaaccugcaccugcccgccgccgaccagaacgugaucauggccgcccugagcaagcacgccaacgugaagaucuucagcgagaagcugcugcugcugcugaacagaggcgacgaccccgugagaaucuucaagcacgagccccagcccccccacagcgugcugaaguuccugcaggacguguucggcagccccgccaccgccgccaucuucuaccacaccgacaugauggcccugaucgacaucaccgugagacacaucgccgaccugagccccggcgacaagcugagaauggaguaccugagccugaugcacgccaucgugagaaccacccccuaccugcagcacagacacagacugcccgaccugcaggccauccugagaagaauccugaacgaggaggagaccagcccccagugccagauggacagaaugaucgugagagagaugugcaaggaguuccuggugcugggcgaggcccccagcuaa

SEQ ID NO: 20367 - RNA, 2133 nt, Artificial Sequence
  NCL__Homo_sapiens__NP_005372
auggugaagcuggccaaggccggcaagaaccagggcgaccccaagaagauggcccccccccccaaggagguggaggaggacagcgaggacgaggagaugagcgaggacgaggaggacgacagcagcggcgaggagguggugaucccccagaagaagggcaagaaggccgccgccaccagcgccaagaaggugguggugagccccaccaagaagguggccguggccacccccgccaagaaggccgccgugacccccggcaagaaggccgccgccacccccgccaagaagaccgugacccccgccaaggccgugaccacccccggcaagaagggcgccacccccggcaaggcccugguggccacccccggcaagaagggcgccgccauccccgccaagggcgccaagaacggcaagaacgccaagaaggaggacagcgacgaggaggaggacgacgacagcgaggaggacgaggaggacgacgaggacgaggacgaggacgaggacgagaucgagcccgccgccaugaaggccgccgccgccgcccccgccagcgaggacgaggacgacgaggacgacgaggacgacgaggacgacgacgacgacgaggaggacgacagcgaggaggaggccauggagaccacccccgccaagggcaagaaggccgccaagguggugcccgugaaggccaagaacguggccgaggacgaggacgaggaggaggacgacgaggacgaggacgacgacgacgacgaggacgacgaggacgacgacgacgaggacgacgaggaggaggaggaggaggaggaggaggagcccgugaaggaggcccccggcaagagaaagaaggagauggccaagcagaaggccgcccccgaggccaagaagcagaagguggagggcaccgagcccaccaccgccuucaaccuguucgugggcaaccugaacuucaacaagagcgcccccgagcugaagaccggcaucagcgacguguucgccaagaacgaccuggccgugguggacgugagaaucggcaugaccagaaaguucggcuacguggacuucgagagcgccgaggaccuggagaaggcccuggagcugaccggccugaagguguucggcaacgagaucaagcuggagaagcccaagggcaaggacagcaagaaggagagagacgccagaacccugcuggccaagaaccugcccuacaaggugacccaggacgagcugaaggagguguucgaggacgccgccgagaucagacuggugagcaaggacggcaagagcaagggcaucgccuacaucgaguucaagaccgaggccgacgccgagaagaccuucgaggagaagcagggcaccgagaucgacggcagaagcaucagccuguacuacaccggcgagaagggccagaaccaggacuacagaggcggcaagaacagcaccuggagcggcgagagcaagacccuggugcugagcaaccugagcuacagcgccaccgaggagacccugcaggagguguucgagaaggccaccuucaucaaggugccccagaaccagaacggcaagagcaagggcuacgccuucaucgaguucgccagcuucgaggacgccaaggaggcccugaacagcugcaacaagagagagaucgagggcagagccaucagacuggagcugcagggccccagaggcagccccaacgccagaagccagcccagcaagacccuguucgugaagggccugagcgaggacaccaccgaggagacccugaaggagagcuucgacggcagcgugagagccagaaucgugaccgacagagagaccggcagcagcaagggcuucggcuucguggacuucaacagcgaggaggacgccaaggccgccaaggaggccauggaggacggcgagaucgacggcaacaaggugacccuggacugggccaagcccaagggcgagggcggcuucggcggcagaggcggcggcagaggcggcuucggcggcagaggcggcggcagaggcggcagaggcggcuucggcggcagaggcagaggcggcuucggcggcagaggcggcuucagaggcggcagaggcggcggcggcgaccacaagccccagggcaagaagaccaaguucgaguaa

SEQ ID NO: 20368 - RNA, 4326 nt, Artificial Sequence
  NCOA1__Homo_sapiens__XP_005264682
augagcggccugggcgacagcagcagcgaccccgccaaccccgacagccacaagagaaagggcagccccugcgacacccuggccagcagcaccgagaagagaagaagagagcaggagaacaaguaccuggaggagcuggccgagcugcugagcgccaacaucagcgacaucgacagccugagcgugaagcccgacaagugcaagauccugaagaagaccguggaccagauccagcugaugaagagaauggagcaggagaagagcaccaccgacgacgacgugcagaagagcgacaucagcagcagcagccagggcgugaucgagaaggagagccugggcccccugcugcuggaggcccuggacggcuucuucuucguggugaacugcgagggcagaaucguguucgugagcgagaacgugaccagcuaccugggcuacaaccaggaggagcugaugaacaccagcguguacagcauccugcacgugggcgaccacgccgaguucgugaagaaccugcugcccaagagccuggugaacggcgugcccuggccccaggaggccaccagaagaaacagccacaccuucaacugcagaaugcugauccacccccccgacgagcccggcaccgagaaccaggaggccugccagagauacgaggugaugcagugcuucaccgugagccagcccaagagcauccaggaggacggcgaggacuuccagagcugccugaucugcaucgccagaagacugcccagaccccccgccaucaccggcguggagagcuucaugaccaagcaggacaccaccggcaagaucaucagcaucgacaccagcagccugagagccgccggcagaaccggcugggaggaccuggugagaaagugcaucuacgccuucuuccagccccagggcagagagcccagcuacgccagacagcuguuccaggaggugaugaccagaggcaccgccagcagccccagcuacagauucauccugaacgacggcaccaugcugagcgcccacaccaagugcaagcugugcuacccccagagccccgacaugcagcccuucaucaugggcauccacaucaucgacagagagcacagcggccugagcccccaggacgacaccaacagcggcaugagcauccccagagugaaccccagcgugaaccccagcaucagccccgcccacggcguggccagaagcagcacccugccccccagcaacagcaacauggugagcaccagaaucaacagacagcagagcagcgaccugcacagcagcagccacagcaacagcagcaacagccagggcagcuucggcugcagccccggcagccagaucguggccaacguggcccugaaccagggccaggccagcagccagagcagcaaccccagccugaaccugaacaacagccccauggagggcaccggcaucagccuggcccaguucaugagccccagaagacaggugaccagcggccuggccaccagacccagaaugcccaacaacagcuucccccccaacaucagcacccugagcagccccgugggcaugaccagcagcgccugcaacaacaacaacagaagcuacagcaacauccccgugaccagccugcagggcaugaacgagggccccaacaacagcgugggcuucagcgccagcagccccgugcugagacagaugagcagccagaacagccccagcagacugaacauccagcccgccaaggccgagagcaaggacaacaaggagaucgccagcauccugaacgagaugauccagagcgacaacagcagcagcgacggcaagccccuggacagcggccugcugcacaacaacgacagacugagcgacggcgacagcaaguacagccagaccagccacaagcuggugcagcugcugaccaccaccgccgagcagcagcugagacacgccgacaucgacaccagcugcaaggacgugcugagcugcaccggcaccagcaacagcgccagcgccaacagcagcggcggcagcugccccagcagccacagcagccugaccgagagacacaagauccugcacagacugcugcaggagggcagccccagcgacaucaccacccugagcguggagcccgacaagaaggacagcgccagcaccagcgugagcgugaccggccaggugcagggcaacagcagcaucaagcuggagcuggacgccagcaagaagaaggagagcaaggaccaccagcugcugagauaccugcuggacaaggacgagaaggaccugagaagcacccccaaccugagccuggacgacgugaaggugaagguggagaagaaggagcagauggaccccugcaacaccaaccccacccccaugaccaagcccacccccgaggagaucaagcuggaggcccagagccaguucaccgccgaccuggaccaguucgaccagcugcugcccacccuggagaaggccgcccagcugcccggccugugcgagaccgacagaauggacggcgccgugaccagcgugaccaucaagagcgagauccugcccgccagccugcagagcgccaccgccagacccaccagcagacugaacagacugcccgagcuggagcuggaggccaucgacaaccaguucggccagcccggcaccggcgaccagauccccuggaccaacaacaccgugaccgccaucaaccagagcaagagcgaggaccagugcaucagcagccagcuggacgagcugcugugcccccccaccaccguggagggcagaaacgacgagaaggcccugcuggagcagcuggugagcuuccugagcggcaaggacgagaccgagcuggccgagcuggacagagcccugggcaucgacaagcuggugcagggcggcggccuggacgugcugagcgagagauuccccccccagcaggccacccccccccugaucauggaggagagacccaaccuguacagccagcccuacagcagccccagccccaccgccaaccugcccagccccuuccagggcauggugagacagaagcccagccugggcaccaugcccgugcaggugaccccccccagaggcgccuucagccccggcaugggcaugcagcccagacagacccugaacagaccccccgccgcccccaaccagcugagacugcagcugcagcagagacugcagggccagcagcagcugauccaccagaacagacaggccauccugaaccaguucgccgccaccgcccccgugggcaucaacaugagaagcggcaugcagcagcagaucaccccccagcccccccugaacgcccagaugcuggcccagagacagagagagcuguacagccagcagcacagacagagacagcugauccagcagcagagagccaugcugaugagacagcagagcuucggcaacaaccugccccccagcagcggccugcccgugcagaugggcaaccccagacugccccagggcgccccccagcaguuccccuacccccccaacuacggcaccaaccccggcaccccccccgccagcaccagccccuucagccagcuggccgccaaccccgaggccagccuggccaacagaaacagcauggugagcagaggcaugaccggcaacaucggcggccaguucggcaccggcaucaacccccagaugcagcagaacguguuccaguaccccggcgccggcauggugccccagggcgaggccaacuucgcccccagccugagccccggcagcagcauggugcccaugcccaucccccccccccagagcagccugcugcagcagaccccccccgccagcggcuaccagagccccgacaugaaggccuggcagcagggcgccaucggcaacaacaacguguucagccaggccgugcagaaccagcccacccccgcccagcccggcguguacaacaacaugagcaucaccgugagcauggccggcggcaacaccaacgugcagaacaugaaccccaugauggcccagaugcagaugagcagccugcagaugcccggcaugaacaccgugugccccgagcagaucaacgaccccgcccugagacacaccggccuguacugcaaccagcugagcagcaccgaccugcugaagaccgaggccgacggcacccagcaggugcagcaggugcagguguucgccgacgugcagugcaccgugaaccuggugggcggcgaccccuaccugaaccagcccggcccccugggcacccagaagcccaccagcggcccccagaccccccaggcccagcagaagagccugcugcagcagcugcugaccgaguaa

SEQ ID NO: 20369 - RNA, 4395 nt, Artificial Sequence
  NCOA2__Homo_sapiens__XP_005251188
augagcggcaugggcgagaacaccagcgaccccagcagagccgagaccagaaagagaaaggagugccccgaccagcugggccccagccccaagagaaacaccgagaagagaaacagagagcaggagaacaaguacaucgaggagcuggccgagcugaucuucgccaacuucaacgacaucgacaacuucaacuucaagcccgacaagugcgccauccugaaggagaccgugaagcagaucagacagaucaaggagcaggagaaggccgccgccgccaacaucgacgaggugcagaagagcgacgugagcagcaccggccagggcgugaucgacaaggacgcccugggccccaugaugcuggaggcccuggacggcuucuucuucguggugaaccuggagggcaacgugguguucgugagcgagaacgugacccaguaccugagauacaaccaggaggagcugaugaacaagagcguguacagcauccugcacgugggcgaccacaccgaguucgugaagaaccugcugcccaagagcaucgugaacggcggcagcuggagcggcgagccccccagaagaaacagccacaccuucaacugcagaaugcuggugaagccccugcccgacagcgaggaggagggccacgacaaccaggaggcccaccagaaguacgagaccaugcagugcuucgccgugagccagcccaagagcaucaaggaggagggcgaggaccugcagagcugccugaucugcguggccagaagagugcccaugaaggagagacccgugcugcccagcagcgagagcuucaccaccagacaggaccugcagggcaagaucaccagccuggacaccagcaccaugagagccgccaugaagcccggcugggaggaccuggugagaagaugcauccagaaguuccacgcccagcacgagggcgagagcgugagcuacgccaagagacaccaccacgaggugcugagacagggccuggccuucagccagaucuacagauucagccugagcgacggcacccugguggccgcccagaccaagagcaagcugaucagaagccagaccaccaacgagccccagcuggugaucagccugcacaugcugcacagagagcagaacgugugcgugaugaaccccgaccugaccggccagaccaugggcaagccccugaaccccaucagcagcaacagccccgcccaccaggcccugugcagcggcaaccccggccaggacaugacccugagcagcaacaucaacuuccccaucaacggccccaaggagcagaugggcaugcccaugggcagauucggcggcagcggcggcaugaaccacgugagcggcaugcaggccaccaccccccagggcagcaacuacgcccugaagaugaacagccccagccagagcagccccggcaugaaccccggccagcccaccagcaugcugagccccagacacagaaugagccccggcguggccggcagccccagaaucccccccagccaguucagccccgccggcagccugcacagccccgugggcgugugcagcagcaccggcaacagccacagcuacaccaacagcagccugaacgcccugcaggcccugagcgagggccacggcgugagccugggcagcagccuggccagccccgaccugaagaugggcaaccugcagaacagccccgugaacaugaacccccccccccugagcaagaugggcagccuggacagcaaggacugcuucggccuguacggcgagcccagcgagggcaccaccggccaggccgagagcagcugccaccccggcgagcagaaggagaccaacgaccccaaccugccccccgccgugagcagcgagagagccgacggccagagcagacugcacgacagcaagggccagaccaagcugcugcagcugcugaccaccaagagcgaccagauggagcccagcccccuggccagcagccugagcgacaccaacaaggacagcaccggcagccugcccggcagcggcagcacccacggcaccagccugaaggagaagcacaagauccugcacagacugcugcaggacagcagcagccccguggaccuggccaagcugaccgccgaggccaccggcaaggaccugagccaggagagcagcagcaccgcccccggcagcgaggugaccaucaagcaggagcccgugagccccaagaagaaggagaacgcccugcugagauaccugcuggacaaggacgacaccaaggacaucggccugcccgagaucacccccaagcuggagagacuggacagcaagaccgaccccgccagcaacaccaagcugaucgccaugaagaccgagaaggaggagaugagcuucgagcccggcgaccagcccggcagcgagcuggacaaccuggaggagauccuggacgaccugcagaacagccagcugccccagcuguuccccgacaccagacccggcgcccccgccggcagcguggacaagcaggccaucaucaacgaccugaugcagcugaccgccgagaacagccccgugacccccgugggcgcccagaagaccgcccugagaaucagccagagcaccuucaacaaccccagacccggccagcugggcagacugcugcccaaccagaaccugccccuggacaucacccugcagagccccaccggcgccggccccuucccccccaucagaaacagcagccccuacagcgugaucccccagcccggcaugaugggcaaccagggcaugaucggcaaccagggcaaccugggcaacagcagcaccggcaugaucggcaacagcgccagcagacccaccaugcccagcggcgagugggccccccagagcagcgccgugagagugaccugcgccgccaccaccagcgccaugaacagacccgugcagggcggcaugaucagaaaccccgccgccagcauccccaugagacccagcagccagcccggccagagacagacccugcagagccaggugaugaacaucggccccagcgagcuggagaugaacaugggcggcccccaguacagccagcagcaggccccccccaaccagaccgcccccuggcccgagagcauccugcccaucgaccaggccagcuucgccagccagaacagacagcccuucggcagcagccccgacgaccugcugugcccccaccccgccgccgagagccccagcgacgagggcgcccugcuggaccagcuguaccuggcccugagaaacuucgacggccuggaggagaucgacagagcccugggcauccccgagcuggugagccagagccaggccguggaccccgagcaguucagcagccaggacagcaacaucaugcuggagcagaaggcccccguguucccccagcaguacgccagccaggcccagauggcccagggcagcuacagccccaugcaggaccccaacuuccacaccaugggccagagacccagcuacgccacccugagaaugcagcccagacccggccugagacccaccggccuggugcagaaccagcccaaccagcugagacugcagcugcagcacagacugcaggcccagcagaacagacagccccugaugaaccagaucagcaacgugagcaacgugaaccugacccugagacccggcgugcccacccaggcccccaucaacgcccagaugcuggcccagagacagagagagauccugaaccagcaccugagacagagacagaugcaccagcagcagcaggugcagcagagaacccugaugaugagaggccagggccugaacaugacccccagcaugguggcccccagcggcaugcccgccaccaugagcaaccccagaaucccccaggccaacgcccagcaguuccccuucccccccaacuacggcaucagccagcagcccgaccccggcuucaccggcgccaccaccccccagagcccccugaugagccccagaauggcccacacccagagccccaugaugcagcagagccaggccaaccccgccuaccaggcccccagcgacaucaacggcugggcccagggcaacaugggcggcaacagcauguucagccagcagagccccccccacuucggccagcaggccaacaccagcauguacagcaacaacaugaacaucaacgugagcauggccaccaacaccggcggcaugagcagcaugaaccagaugaccggccagaucagcaugaccagcgugaccagcgugcccaccagcggccugagcagcaugggccccgagcaggugaacgaccccgcccugagaggcggcaaccuguuccccaaccagcugcccggcauggacaugaucaagcaggagggcgacaccaccagaaaguacugcuaa

SEQ ID NO: 20370 - RNA, 4248 nt, Artificial Sequence
  NCOA3__Homo_sapiens__NP_001167559
augagcggccugggcgagaaccuggacccccuggccagcgacagcagaaagagaaagcugcccugcgacacccccggccagggccugaccugcagcggcgagaagagaagaagagagcaggagagcaaguacaucgaggagcuggccgagcugaucagcgccaaccugagcgacaucgacaacuucaacgugaagcccgacaagugcgccauccugaaggagaccgugagacagaucagacagaucaaggagcagggcaagaccaucagcaacgacgacgacgugcagaaggccgacgugagcagcaccggccagggcgugaucgacaaggacagccugggcccccugcugcugcaggcccuggacggcuuccuguucguggugaacagagacggcaacaucguguucgugagcgagaacgugacccaguaccugcaguacaagcaggaggaccuggugaacaccagcguguacaacauccugcacgaggaggacagaaaggacuuccugaagaaccugcccaagagcaccgugaacggcgugagcuggaccaacgagacccagagacagaagagccacaccuucaacugcagaaugcugaugaagaccccccacgacauccuggaggacaucaacgccagccccgagaugagacagagauacgagaccaugcagugcuucgcccugagccagcccagagccaugauggaggagggcgaggaccugcagagcugcaugaucugcguggccagaagaaucaccaccggcgagagaaccuuccccagcaaccccgagagcuucaucaccagacacgaccugagcggcaagguggugaacaucgacaccaacagccugagaagcagcaugagacccggcuucgaggacaucaucagaagaugcauccagagauucuucagccugaacgacggccagagcuggagccagaagagacacuaccaggaggugaccagcgacggcaucuucagccccaccgccuaccugaacggccacgccgagacccccguguacagauucagccuggccgacggcaccaucgugaccgcccagaccaagagcaagcuguucagaaaccccgugaccaacgacagacacggcuucgugagcacccacuuccugcagagagagcagaacggcuacagacccaaccccaaccccgugggccagggcaucagaccccccauggccggcugcaacagcagcgugggcggcaugagcaugagccccaaccagggccugcagaugcccagcagcagagccuacggccuggccgaccccagcaccaccggccagaugagcggcgccagauacggcggcagcagcaacaucgccagccugacccccggccccggcaugcagagccccagcagcuaccagaacaacaacuacggccugaacaugagcagccccccccacggcagccccggccuggcccccaaccagcagaacaucaugaucagccccagaaacagaggcagccccaagaucgccagccaccaguucagccccguggccggcgugcacagccccauggccagcagcggcaacaccggcaaccacagcuucagcagcagcagccugagcgcccugcaggccaucagcgagggcgugggcaccagccugcugagcacccugagcagccccggccccaagcuggacaacagccccaacaugaacaucacccagcccagcaaggugagcaaccaggacagcaagagcccccugggcuucuacugcgaccagaaccccguggagagcagcaugugccagagcaacagcagagaccaccugagcgacaaggagagcaaggagagcagcguggagggcgccgagaaccagagaggcccccuggagagcaagggccacaagaagcugcugcagcugcugaccugcagcagcgacgacagaggccacagcagccugaccaacagcccccuggacagcagcugcaaggagagcagcgugagcgugaccagccccagcggcgugagcagcagcaccagcggcggcgugagcagcaccagcaacaugcacggcagccugcugcaggagaagcacagaauccugcacaagcugcugcagaacggcaacagccccgccgagguggccaagaucaccgccgaggccaccggcaaggacaccagcagcaucaccagcugcggcgacggcaacguggugaagcaggagcagcugagccccaagaagaaggagaacaacgcccugcugagauaccugcuggacagagacgaccccagcgacgcccugagcaaggagcugcagccccagguggagggcguggacaacaagaugagccagugcaccagcagcaccauccccagcagcagccaggagaaggaccccaagaucaagaccgagaccagcgaggagggcagcggcgaccuggacaaccuggacgccauccugggcgaccugaccagcagcgacuucuacaacaacagcaucagcagcaacggcagccaccugggcaccaagcagcagguguuccagggcaccaacagccugggccugaagagcagccagagcgugcagagcaucagaccccccuacaacagagccgugagccuggacagccccgugagcgugggcagcagcccccccgugaagaacaucagcgccuuccccaugcugcccaagcagcccaugcugggcggcaaccccagaaugauggacagccaggagaacuacggcagcagcaugggcgacuggggccugcccaacagcaaggccggcagaauggagcccaugaacagcaacagcaugggcagacccggcggcgacuacaacaccagccugcccagacccgcccugggcggcagcauccccacccugccccugagaagcaacagcauccccggcgccagacccgugcugcagcagcagcagcagaugcugcagaugagacccggcgagauccccaugggcaugggcgccaaccccuacggccaggccgccgccagcaaccagcugggcagcuggcccgacggcaugcugagcauggagcaggugagccacggcacccagaacagaccccugcugagaaacagccuggacgaccuggugggcccccccagcaaccuggagggccagagcgacgagagagcccugcuggaccagcugcacacccugcugagcaacaccgacgccaccggccuggaggagaucgacagagcccugggcauccccgagcuggugaaccagggccaggcccuggagcccaagcaggacgccuuccagggccaggaggccgccgugaugauggaccagaaggccggccuguacggccagaccuaccccgcccagggcccccccaugcagggcggcuuccaccugcagggccagagccccagcuucaacagcaugaugaaccagaugaaccagcagggcaacuucccccugcagggcaugcaccccagagccaacaucaugagacccagaaccaacacccccaagcagcugagaaugcagcugcagcagagacugcagggccagcaguuccugaaccagagcagacaggcccuggagcugaagauggagaaccccaccgccggcggcgccgccgugaugagacccaugaugcagccccagcagggcuuccugaacgcccagaugguggcccagagaagcagagagcugcugagccaccacuucagacagcagagaguggccaugaugaugcagcagcagcagcagcagcagcagcagcagcagcagcagcagcagcagcagcagcagcagcagcagcagcagcagcagcagcagcagacccaggccuucagccccccccccaacgugaccgccagccccagcauggacggccugcuggccggccccaccaugccccaggcccccccccagcaguuccccuaccagcccaacuacggcaugggccagcagcccgaccccgccuucggcagagugagcagcccccccaacgccaugaugagcagcagaaugggccccagccagaaccccaugaugcagcacccccaggccgccagcaucuaccagagcagcgagaugaagggcuggcccagcggcaaccuggccagaaacagcagcuucagccagcagcaguucgcccaccagggcaaccccgccguguacagcauggugcacaugaacggcagcagcggccacaugggccagaugaacaugaaccccaugcccaugagcggcaugcccaugggccccgaccagaaguacugcuaa

SEQ ID NO: 20371 - RNA, 1953 nt, Artificial Sequence
  NCOA4__Homo_sapiens__NP_001138732
augggcgcccagcugaccaccuucgcccuggccggcgccgugagaagaaugaacaccuuccaggaccagagcggcagcagcagcaacagagagccccugcugagaugcagcgacgccagaagagaccuggagcuggccaucggcggcgugcugagagccgagcagcagaucaaggacaaccugagagaggugaaggcccagauccacagcugcaucagcagacaccuggagugccugagaagcagagagguguggcuguacgagcagguggaccugaucuaccagcugaaggaggagacccugcagcagcaggcccagcagcuguacagccugcugggccaguucaacugccugacccaccagcuggagugcacccagaacaaggaccuggccaaccaggugagcgugugccuggagagacugggcagccugacccugaagcccgaggacagcaccgugcugcuguucgaggccgacaccaucacccugagacagaccaucaccaccuucggcagccugaagaccauccagauccccgagcaccugauggcccacgccagcagcgccaacaucggccccuuccuggagaagagaggcugcaucagcaugcccgagcagaagagcgccagcggcaucguggccgugcccuucagcgaguggcugcugggcagcaagcccgccagcggcuaccaggcccccuacauccccagcaccgacccccaggacuggcugacccagaagcagacccuggagaacagccagaccagcagcagagccugcaacuucuucaacaacgugggcggcaaccugaagggccuggagaacuggcugcugaagagcgagaagagcagcuaccagaagugcaacagccacagcaccaccagcagcuucagcaucgagauggagaaggugggcgaccaggagcugcccgaccaggacgagauggaccugagcgacuggcuggugaccccccaggagagccacaagcugagaaagcccgagaacggcagcagagagaccagcgagaaguucaagcugcuguuccagagcuacaacgugaacgacuggcuggugaagaccgacagcugcaccaacugccagggcaaccagcccaagggcguggagaucgagaaccugggcaaccugaagugccugaacgaccaccuggaggccaagaagccccugagcacccccagcauggugaccgaggacuggcuggugcagaaccaccaggaccccugcaagguggaggaggugugcagagccaacgagcccugcaccagcuucgccgagugcgugugcgacgagaacugcgagaaggaggcccuguacaaguggcugcugaagaaggagggcaaggacaagaacggcaugcccguggagcccaagcccgagcccgagaagcacaaggacagccugaacauguggcugugccccagaaaggaggugaucgagcagaccaaggcccccaaggccaugacccccagcagaaucgccgacagcuuccaggugaucaagaacagcccccugagcgaguggcugaucagaccccccuacaaggagggcagccccaaggaggugcccggcaccgaggacagagccggcaagcagaaguucaagagccccaugaacaccagcuggugcagcuucaacaccgccgacugggugcugcccggcaagaagaugggcaaccugagccagcugagcagcggcgaggacaaguggcugcugagaaagaaggcccaggaggugcugcugaacagcccccugcaggaggagcacaacuucccccccgaccacuacggccugcccgccgugugcgaccuguucgccugcaugcagcugaagguggacaaggagaaguggcuguacagaaccccccugcaggccuacuucaagaugaacuuccaggacgugaccgugggcaacuuccagauccccugcggcuucuaa

SEQ ID NO: 20372 - RNA, 1740 nt, Artificial Sequence
  NCOA5__Homo_sapiens__NP_066018
augaacaccgcccccagcagacccagccccaccagaagagaccccuacggcuucggcgacagcagagacagcagaagagacagaagccccaucagaggcagccccagaagagagcccagagacggcagaaacggcagagacgccagagacagcagagacaucagagaccccagagaccugagagaccacagacacagcagagaccugagagaccacagagacagcagaagcgugagagacgugagagacgugagagaccugagagacuucagagaccugagagacagcagagacuucagagaccagagagaccccauguacgacagauacagagacaugagagacagcagagaccccauguacagaagagagggcagcuacgacagauaccugagaauggacgacuacugcagaagaaaggacgacagcuacuucgacagauacagagacagcuucgacggcagaggcccccccggccccgagagccagagcagagccaaggagagacugaagagagaggagagaagaagagaggagcuguacagacaguacuucgaggagauccagagaagauucgacgccgagagacccguggacugcagcgugaucguggugaacaagcagaccaaggacuacgccgagagcgugggcagaaaggugagagaccugggcauggugguggaccugaucuuccugaacaccgaggugagccugagccaggcccuggaggacgugagcagaggcggcagccccuucgccaucgugaucacccagcagcaccagauccacagaagcugcaccgugaacaucauguucggcaccccccaggagcacagaaacaugccccaggccgacgccauggugcugguggccagaaacuacgagagauacaagaacgagugcagagagaaggagagagaggagaucgccagacaggccgccaagauggccgacgaggccauccugcaggagagagagagaggcggccccgaggagggcgugagaggcggccacccccccgccauccagagccugaucaaccugcuggccgacaacagauaccugaccgccgaggagaccgacaagaucaucaacuaccugagagagagaaaggagagacugaugagaagcagcaccgacagccugcccggccccaucagcagacagccccugggcgccaccagcggcgccagccugaagacccagcccagcagccagccccugcagagcggccaggugcugcccagcgccacccccacccccagcgccccccccaccagccagcaggagcugcaggccaagauccugagccuguucaacagcggcaccgugaccgccaacagcagcagcgccagccccagcguggccgccggcaacacccccaaccagaacuucagcaccgccgccaacagccagccccagcagagaagccaggccagcggcaaccagccccccagcauccugggccagggcggcagcgcccagaacaugggccccagacccggcgcccccagccagggccuguucggccagcccagcagcagacuggcccccgccagcaacaugaccagccagagacccgugagcagcaccggcaucaacuucgacaaccccagcgugcagaaggcccuggacacccugauccagagcggccccgcccugagccaccuggugagccagaccaccgcccagaugggccagccccaggcccccaugggcagcuaccagagacacuacuaa

SEQ ID NO: 20373 - RNA, 3213 nt, Artificial Sequence
  NCOA6__Homo_sapiens__NP_001229468
auggugcuggacgaccugcccaaccuggaggacaucuacaccagccugugcagcagcaccauggaggacagcgagauggacuucgacagcggccuggaggacgacgacaccaagagcgacagcauccuggaggacagcaccaucuucguggccuucaagggcaacaucgacgacaaggacuucaaguggaagcuggacgccauccugaagaacgugcccaaccugcugcacauggagagcagcaagcugaaggugcagaagguggagcccuggaacagcgugagagugaccuucaacauccccagagaggccgccgagagacugagaauccuggcccagagcaacaaccagcagcugagagaccugggcauccugagcgugcagaucgagggcgagggcgccaucaaccuggcccuggcccagaacagaagccaggacgugagaaugaacggccccaugggcgccggcaacagcgugagaauggaggccggcuuccccauggccagcggccccggcaucaucagaaugaacaaccccgccaccgugaugaucccccccggcggcaacgugagcagcagcaugauggcccccggccccaaccccgagcugcagcccagaacccccagacccgccagccagagcgacgccauggacccccugcugagcggccugcacauccagcagcagagccaccccagcggcagccuggcccccccccaccaccccaugcagcccgugagcgugaacagacagaugaaccccgccaacuucccccagcugcagcagcagcagcagcagcagcagcagcagcagcagcagcagcagcagcagcagcagcagcagcagcagcagcagcugcaggccagacccccccagcagcaccagcagcagcagccccagggcaucagaccccaguucaccgcccccacccaggugcccgugccccccggcuggaaccagcugcccagcggcgcccugcagcccccccccgcccagggcagccugggcaccaugaccgccaaccagggcuggaagaaggccccccugcccggccccaugcagcagcagcugcaggccagacccagccuggccaccgugcagacccccagccacccccccccccccuaccccuucggcagccagcaggccagccaggcccacaccaacuucccccagaugagcaaccccggccaguucaccgccccccagaugaagagccugcagggcggccccagcagagugcccaccccccugcagcagccccaccugaccaacaagagccccgccagcagccccagcagcuuccagcagggcagccccgccagcagccccaccgugaaccagacccagcagcagaugggccccagacccccccagaacaacccccugccccagggcuuccagcagcccgugagcagccccggcagaaaccccauggugcagcagggcaacgugccccccaacuucauggugaugcagcagcagccccccaaccagggcccccagagccugcaccccggccugggcggcaugcccaagagacugccccccggcuucagcgccggccaggccaaccccaacuucaugcagggccaggugcccagcaccaccgccaccacccccggcaacagcggcgccccccagcugcaggccaaccagaacgugcagcacgccggcggccagggcgccggccccccccagaaccagaugcaggugagccacggcccccccaacaugaugcagcccagccugaugggcauccacggcaacaugaacaaccagcaggccggcaccagcggcgugccccaggugaaccugagcaacaugcagggccagccccagcagggcccccccagccagcugaugggcaugcaccagcagaucgugcccagccagggccagauggugcagcagcagggcacccugaacccccagaaccccaugauccugagcagagcccagcugaugccccagggccagaugauggugaacccccccagccagaaccugggccccagcccccagagaaugaccccccccaagcagaugcugagccagcagggcccccagaugauggccccccacaaccagaugaugggcccccagggccaggugcugcugcagcagaaccccaugaucgagcagaucaugaccaaccagaugcagggcaacaagcagcaguucaacacccagaaccagagcaacgugaugcccggccccgcccagaucaugagaggccccacccccaacaugcagggcaacauggugcaguucaccggccagaugagcggccagaugcugccccagcagggccccgugaacaacagccccagccaggugaugggcauccagggccaggugcugagaccccccggccccagcccccacauggcccagcagcacggcgaccccgccaccaccgccaacaacgacgugagccugagccagaugaugcccgacgugagcauccagcagaccaacauggugcccccccacgugcaggccaugcagggcaacagcgccagcggcaaccacuucagcggccacggcaugagcuucaacgcccccuucagcggcgcccccaacggcaaccagaugagcugcggccagaaccccggcuuccccgugaacaaggacgugacccugaccagcccccugcuggugaaccugcugcagagcgacaucagcgccggccacuucggcgugaacaacaagcagaacaacaccaacgccaacaagcccaagaagaagaagccccccagaaagaagaagaacagccagcaggaccugaacacccccgacaccagacccgccggccuggaggaggccgaccagcccccccugcccggcgagcagggcaucaaccuggacaacagcggccccaagcugcccgaguucagcaacagaccccccgcccccagccagaaccuggugagcaaggagaccagcaccaccgcccugcaggccagcguggccagacccgagcuggaggugaacgccgccaucgugagcggccagagcagcgagcccaaggagaucguggagaagagcaagauccccggcagaagaaacagcagaaccgaggagcccaccguggccagcgagagcguggagaacggccacagaaagagaagcagcagacccgccagcgccagcagcagcaccaaggacaucaccagcgccgugcagagcaagagaagaaagagcaaguaa

SEQ ID NO: 20374 - RNA, 2796 nt, Artificial Sequence
  NCOA7__Homo_sapiens__NP_001116314
auggacaccaaggaggagaagaaggagagaaagcagagcuacuucgccagacugaagaagaagaagcaggccaagcagaacgccgagaccgccagcgccguggccaccagaacccacaccggcaaggaggacaacaacaccguggugcuggagcccgacaagugcaacaucgccguggaggaggaguacaugaccgacgagaagaagaagagaaagagcaaccagcugaaggagaucagaagaaccgagcugaagagauacuacagcaucgacgacaaccagaacaagacccacgacaagaaggagaagaagaugguggugcagaagccccacggcaccauggaguacaccgccggcaaccaggacacccugaacagcaucgcccugaaguucaacaucacccccaacaagcugguggagcugaacaagcuguucacccacaccaucgugcccggccaggugcuguucgugcccgacgccaacagccccagcagcacccugagacugagcagcagcagccccggcgccaccgugagccccagcagcagcgacgccgaguacgacaagcugcccgacgccgaccuggccagaaaggcccugaagcccaucgagagagugcugagcagcaccagcgaggaggacgagcccggcguggugaaguuccugaagaugaacugcagauacuucaccgacggcaagggcguggugggcggcgugaugaucgugacccccaacaacaucauguucgacccccacaagagcgacccccuggugaucgagaacggcugcgaggaguacggccugaucugccccauggaggagguggugagcaucgcccuguacaacgacaucagccacaugaagaucaaggacgcccugcccagccccggcgagugggaggaccuggccagcgagaaggacaucaaccccuucagcaaguucaagagcaucaacaaggagaagagacagcagaacggcgagaagaucaugaccagcgacagcagacccaucgugccccuggagaagagcaccggccacacccccaccaagcccagcggcagcagcgugagcgagaagcugaagaagcuggacagcagcagagagaccagccacggcagccccaccgugaccaagcugagcaaggagcccagcgacaccagcagcgccuucgagagcaccgccaaggagaacuuccugggcgaggacgacgacuucguggaccuggaggagcugagcagccagaccggcggcggcaugcacaagaaggacacccugaaggagugccugagccuggaccccgaggagagaaagaaggccgagagccagaucaacaacagcgccguggagaugcaggugcagagcgcccuggccuuccugggcaccgagaacgacguggagcugaagggcgcccuggaccuggagaccugcgagaagcaggacaucaugcccgagguggacaagcagagcggcagccccgagagcagaguggagaacacccugaacauccacgaggaccuggacaaggugaagcugaucgaguacuaccugaccaagaacaaggagggcccccaggugagcgagaaccugcagaagaccgagcugagcgacggcaagagcaucgagcccggcggcaucgacaucacccugagcagcagccugagccaggccggcgaccccaucaccgagggcaacaaggagcccgacaagaccugggugaagaagggcgagccccugcccgugaagcugaacagcagcaccgaggccaacgugaucaaggaggcccuggacagcagccuggagagcacccuggacaacagcugccagggcgcccagauggacaacaagagcgaggugcagcuguggcugcugaagagaauccaggugcccaucgaggacauccugcccagcaaggaggagaagagcaagaccccccccauguuccugugcaucaaggugggcaagcccaugagaaagagcuucgccacccacaccgccgccauggugcagcaguacggcaagagaagaaagcagcccgaguacugguucgccgugcccagagagagaguggaccaccuguacaccuucuucgugcaguggagccccgacguguacggcaaggacgccaaggagcagggcuucguggugguggagaaggaggagcugaacaugaucgacaacuucuucagcgagcccaccaccaagagcugggagaucaucaccguggaggaggccaagagaagaaagagcaccugcagcuacuacgaggacgaggacgaggaggugcugcccgugcugagaccccacagcgcccugcuggagaacaugcacaucgagcagcuggccagaagacugcccgccagagugcagggcuaccccuggagacuggccuacagcacccuggagcacggcaccagccugaagacccuguacagaaagagcgccagccuggacagccccgugcugcuggugaucaaggacauggacaaccagaucuucggcgccuacgccacccaccccuucaaguucagcgaccacuacuacggcaccggcgagaccuuccuguacaccuucagcccccacuucaagguguucaaguggagcggcgagaacagcuacuucaucaacggcgacaucagcagccuggagcugggcggcggcggcggcagauucggccuguggcuggacgccgaccuguaccacggcagaagcaacagcugcagcaccuucaacaacgacauccugagcaagaaggaggacuucaucgugcaggaccuggaggugugggccuucgacuaa

SEQ ID NO: 20375 - RNA, 2745 nt, Artificial Sequence
  NCOR1__Homo_sapiens__NP_001177367
augagcagcagcggcuacccccccaaccagggcgccuucagcaccgagcagagcagauaccccccccacagcgugcaguacaccuuccccaacaccagacaccagcaggaccccgccuucggcggcaagcacgaggcccccagcagccccaucagcggccagcccugcggcgacgaccagaacgccagccccagcaagcugagcaaggaggagcugauccagagcauggacagaguggacagagagaucgccaagguggagcagcagauccugaagcugaagaagaagcagcagcagcuggaggaggaggccgccaagccccccgagcccgagaagcccgugagccccccccccguggagcagaagcacagaagcaucgugcagaucaucuacgacgagaacagaaagaaggccgaggaggcccacaagaucuucgagggccugggccccaagguggagcugccccuguacaaccagcccagcgacaccaagguguaccacgagaacaucaagaccaaccaggugaugagaaagaagcugauccuguucuucaagagaagaaaccacgccagaaagcagagagagcagaagaucugccagagauacgaccagcugauggaggccugggagaagaagguggacagaaucgagaacaaccccagaagaaaggccaaggagagcaagaccagagaguacuacgagaagcaguuccccgagaucagaaagcagagagagcagcaggagagauuccagagagugggccagagaggcgccggccugagcgccaccaucgccagaagcgagcacgagaucagcgagaucaucgacggccugagcgagcaggagaacaacgagaagcagaugagacagcugagcgugaucccccccaugauguucgacgccgagcagagaagagugaaguucaucaacaugaacggccugauggaggaccccaugaagguguacaaggacagacaguucaugaacguguggaccgaccacgagaaggagaucuucaaggacaaguucauccagcaccccaagaacuucggccugaucgccagcuaccuggagagaaagagcgugcccgacugcgugcuguacuacuaccugaccaagaagaacgagaacuacaaggcccuggugagaagaaacuacggcaagagaagaggcagaaaccagcagaucgccagacccagccaggaggagaagguggaggagaaggaggaggacaaggccgagaagaccgagaagaaggaggaggagaagaaggacgaggaggagaaggacgagaaggaggacagcaaggagaacaccaaggagaaggacaagaucgacggcaccgccgaggagaccgaggagagagagcaggccacccccagaggcagaaagaccgccaacagccagggcagaagaaagggcagaaucaccagaagcaugaccaacgaggccgccgccgccagcgccgccgccgccgccgccaccgaggagcccccccccccccugccccccccccccgagcccaucagcaccgagcccguggagaccagcagauggaccgaggaggagauggagguggccaagaagggccugguggagcacggcagaaacugggccgccaucgccaagauggugggcaccaagagcgaggcccagugcaagaacuucuacuucaacuacaagagaagacacaaccuggacaaccugcugcagcagcacaagcagaagaccagcagaaagcccagagaggagagagacgugagccagugcgagagcguggccagcaccgugagcgcccaggaggacgaggacaucgaggccagcaacgaggaggagaaccccgaggacagcgagggcgccgagaacagcagcgacaccgagagcgcccccagccccagccccguggaggccgugaagcccagcgaggacagccccgagaacgccaccagcagaggcaacaccgagcccgccguggagcuggagcccaccaccgagaccgcccccagcaccagccccagccuggccgugcccagcaccaagcccgccgaggacgagagcguggagacccaggugaacgacagcaucagcgccgagaccgccgagcagauggacguggaccagcaggagcacagcgccgaggagggcagcgugugcgaccccccccccgccaccaaggccgacagcguggacguggaggugagagugcccgagaaccacgccagcaagguggagggcgacaacaccaaggagagagaccuggacagagccagcgagaagguggagcccagagacgaggaccuggugguggcccagcagaucaacgcccagagacccgagccccagagcgacaacgacagcagcgccaccugcagcgccgacgaggacguggacggcgagcccgagagacagagaauguuccccauggacagcaagcccagccugcugaaccccaccggcagcauccuggugagcagcccccugaagcccaacccccuggaccugccccagcugcagcacagagccgccgugaucccccccauggugagcugcacccccugcaacauccccaucggcacccccgugagcggcuacgcccuguaccagagacacaucaaggccaugcacgagagcgcccugcuggaggagcagagacagagacaggagcagaucgaccuggagugcagaagcagcaccagccccugcggcaccagcaagagccccaacagagagugggagggcagauaa

SEQ ID NO: 20376 - RNA, 7377 nt, Artificial Sequence
  NCOR2__Homo_sapiens__NP_001070729
augagcggcagcacccagcccguggcccagaccuggagagccaccgagcccagauaccccccccacagccugagcuaccccgugcagaucgccagaacccacaccgacgugggccugcuggaguaccagcaccacagcagagacuacgccagccaccugagccccggcagcaucauccagccccagagaagaagacccagccugcugagcgaguuccagcccggcaacgagagaagccaggagcugcaccugagacccgagagccacagcuaccugcccgagcugggcaagagcgagauggaguucaucgagagcaagagacccagacuggagcugcugcccgacccccugcugagacccagcccccugcuggccaccggccagcccgccggcagcgaggaccugaccaaggacagaagccugaccggcaagcuggagcccgugagcccccccagccccccccacaccgaccccgagcuggagcuggugccccccagacugagcaaggaggagcugauccagaacauggacagaguggacagagagaucaccaugguggagcagcagaucagcaagcugaagaagaagcagcagcagcuggaggaggaggccgccaagccccccgagcccgagaagcccgugagccccccccccaucgagagcaagcacagaagccuggugcagaucaucuacgacgagaacagaaagaaggccgaggccgcccacagaauccuggagggccugggcccccagguggagcugccccuguacaaccagcccagcgacaccagacaguaccacgagaacaucaagaucaaccaggccaugagaaagaagcugauccuguacuucaagagaagaaaccacgccagaaagcagugggagcagaaguucugccagagauacgaccagcugauggaggccugggagaagaagguggagagaaucgagaacaaccccagaagaagagccaaggagagcaaggugagagaguacuacgagaagcaguuccccgagaucagaaagcagagagagcugcaggagagaaugcagagagugggccagagaggcagcggccugagcaugagcgccgccagaagcgagcacgaggugagcgagaucaucgacggccugagcgagcaggagaaccuggagaagcagaugagacagcuggccgugaucccccccaugcuguacgacgccgaccagcagagaaucaaguucaucaacaugaacggccugauggccgaccccaugaagguguacaaggacagacaggugaugaacauguggagcgagcaggagaaggagaccuucagagagaaguucaugcagcaccccaagaacuucggccugaucgccagcuuccuggagagaaagaccguggccgagugcgugcuguacuacuaccugaccaagaagaacgagaacuacaagagccuggugagaagaagcuacagaagaagaggcaagagccagcagcagcagcagcagcagcagcagcagcagcagcagcagcagcagcagcccaugcccagaagcagccaggaggagaaggacgagaaggagaaggagaaggaggccgagaaggaggaggagaagcccgagguggagaacgacaaggaggaccugcugaaggagaagaccgacgacaccagcggcgaggacaacgacgagaaggaggccguggccagcaagggcagaaagaccgccaacagccagggcagaagaaagggcagaaucaccagaagcauggccaacgaggccaacagcgaggaggccaucaccccccagcagagcgccgagcuggccagcauggagcugaacgagagcagcagauggaccgaggaggagauggagaccgccaagaagggccugcuggagcacggcagaaacuggagcgccaucgccagaauggugggcagcaagaccgugagccagugcaagaacuucuacuucaacuacaagaagagacagaaccuggacgagauccugcagcagcacaagcugaagauggagaaggagagaaacgccagaagaaagaagaagaaggcccccgccgccgccagcgaggaggccgccuucccccccgugguggaggacgaggagauggaggccagcggcgugagcggcaacgaggaggagaugguggaggaggccgaggccaccgugaacaacagcagcgacaccgagagcauccccagcccccacaccgaggccgccaaggacaccggccagaacggccccaagccccccgccacccugggcgccgacggccccccccccggcccccccacccccccccccgaggacauccccgcccccaccgagcccacccccgccagcgaggccaccggcgcccccacccccccccccgccccccccagccccagcgcccccccccccguggugcccaaggaggagaaggaggaggagaccgccgccgccccccccguggaggagggcgaggagcagaagccccccgccgccgaggagcuggccguggacaccggcaaggccgaggagcccgugaagagcgagugcaccgaggaggccgaggagggccccgccaagggcaaggacgccgaggccgccgaggccaccgccgagggcgcccugaaggccgagaagaaggagggcggcagcggcagagccaccaccgccaagagcagcggcgccccccaggacagcgacagcagcgccaccugcagcgccgacgagguggacgaggccgagggcggcgacaagaacagacugcugagccccagacccagccugcugacccccaccggcgaccccagagccaacgccagcccccagaagccccuggaccugaagcagcugaagcagagagccgccgccaucccccccauccaggugaccaaggugcacgagccccccagagaggacgccgcccccaccaagcccgccccccccgcccccccccccccccagaaccugcagcccgagagcgacgccccccagcagcccggcagcagccccagaggcaagagcagaagccccgccccccccgccgacaaggaggccgagaagcccguguucuuccccgccuucgccgccgaggcccagaagcugcccggcgacccccccugcuggaccagcggccugcccuuccccgugccccccagagaggugaucaaggccagcccccacgcccccgaccccagcgccuucagcuacgccccccccggccacccccugccccugggccugcacgacaccgccagacccgugcugcccagaccccccaccaucagcaacccccccccccugaucagcagcgccaagcaccccagcgugcuggagagacagaucggcgccaucagccagggcaugagcgugcagcugcacgugcccuacagcgagcacgccaaggcccccgugggccccgugaccaugggccugccccugcccauggaccccaagaagcuggcccccuucagcggcgugaagcaggagcagcugagccccagaggccaggccggcccccccgagagccugggcgugcccaccgcccaggaggccagcgugcugagaggcaccgcccugggcagcgugcccggcggcagcaucaccaagggcauccccagcaccagagugcccagcgacagcgccaucaccuacagaggcagcaucacccacggcacccccgccgacgugcuguacaagggcaccaucaccagaaucaucggcgaggacagccccagcagacuggacagaggcagagaggacagccugcccaagggccacgugaucuacgagggcaagaagggccacgugcugagcuacgagggcggcaugagcgugacccagugcagcaaggaggacggcagaagcagcagcggccccccccacgagaccgccgcccccaagagaaccuacgacaugauggagggcagagugggcagagccaucagcagcgccagcaucgagggccugaugggcagagccaucccccccgagagacacagcccccaccaccugaaggagcagcaccacaucagaggcagcaucacccagggcauccccagaagcuacguggaggcccaggaggacuaccugagaagagaggccaagcugcugaagagagagggcaccccccccccccccccccccagcagagaccugaccgaggccuacaagacccaggcccugggcccccugaagcugaagcccgcccacgagggccugguggccaccgugaaggaggccggcagaagcauccacgagauccccagagaggagcugagacacacccccgagcugccccuggcccccagaccccugaaggagggcagcaucacccagggcaccccccugaaguacgacaccggcgccagcaccaccggcagcaagaagcacgacgugagaagccugaucggcagccccggcagaaccuucccccccgugcacccccuggacgugauggccgacgccagagcccuggagagagccugcuacgaggagagccugaagagcagacccggcaccgccagcagcagcggcggcagcaucgccagaggcgcccccgugaucgugcccgagcugggcaagcccagacagagcccccugaccuacgaggaccacggcgcccccuucgccggccaccugcccagaggcagccccgugaccaccagagagcccacccccagacugcaggagggcagccugagcagcagcaaggccagccaggacagaaagcugaccagcacccccagagagaucgccaagagcccccacagcaccgugcccgagcaccacccccaccccaucagccccuacgagcaccugcugagaggcgugagcggcguggaccuguacagaagccacaucccccuggccuucgaccccaccagcauccccagaggcaucccccuggacgccgccgccgccuacuaccugcccagacaccuggcccccaaccccaccuacccccaccuguacccccccuaccugaucagaggcuaccccgacaccgccgcccuggagaacagacagaccaucaucaacgacuacaucaccagccagcagaugcaccacaacgccgccaccgccauggcccagagagccgacaugcugagaggccugagccccagagagagcagccuggcccugaacuacgccgccggccccagaggcaucaucgaccugagccaggugccccaccugcccgugcuggugccccccacccccggcacccccgccaccgccauggacagacuggccuaccugcccaccgccccccagcccuucagcagcagacacagcagcagcccccugagccccggcggccccacccaccugaccaagcccaccaccaccagcagcagcgagagagagagagacagagacagagagagagacagagacagagagagagagaagagcauccugaccagcaccaccaccguggagcacgcccccaucuggagacccggcaccgagcagagcagcggcagcagcggcggcggcggcggcagcagcagcagacccgccagccacagccacgcccaccagcacagccccaucagccccagaacccaggacgcccugcagcagagacccagcgugcugcacaacaccggcaugaagggcaucaucaccgccguggagcccagcacccccaccgugcugagaagcaccagcaccagcagccccgugagacccgccgccaccuucccccccgccacccacugcccccugggcggcacccuggacggcguguaccccacccugauggagcccgugcugcugcccaaggaggcccccagaguggccagacccgagagacccagagccgacaccggccacgccuuccuggccaagccccccgccagaagcggccuggagcccgccagcagccccagcaagggcagcgagcccagaccccuggugccccccgugagcggccacgccaccaucgccagaacccccgccaagaaccuggccccccaccacgccagccccgacccccccgccccccccgccagcgccagcgacccccacagagagaagacccagagcaagcccuucagcauccaggagcuggagcugagaagccugggcuaccacggcagcagcuacagccccgagggcguggagcccgugagccccgugagcagccccagccugacccacgacaagggccugcccaagcaccuggaggagcuggacaagagccaccuggagggcgagcugagacccaagcagcccggccccgugaagcugggcggcgaggccgcccaccugccccaccugagaccccugcccgagagccagcccagcagcagcccccugcugcagaccgcccccggcgugaagggccaccagagaguggugacccuggcccagcacaucagcgaggugaucacccaggacuacaccagacaccacccccagcagcugagcgccccccugcccgccccccuguacagcuuccccggcgccagcugccccgugcuggaccugagaagaccccccagcgaccuguaccugcccccccccgaccacggcgcccccgccagaggcagcccccacagcgagggcggcaagagaagccccgagcccaacaagaccagcgugcugggcggcggcgaggacggcaucgagcccgugagcccccccgagggcaugaccgagcccggccacagcagaagcgccguguacccccugcuguacagagacggcgagcagaccgagcccagcagaaugggcagcaagagccccggcaacaccagccagccccccgccuucuucagcaagcugaccgagagcaacagcgccauggugaagagcaagaagcaggagaucaacaagaagcugaacacccacaacagaaacgagcccgaguacaacaucagccagcccggcaccgagaucuucaacaugcccgccaucaccggcaccggccugaugaccuacagaagccaggccgugcaggagcacgccagcaccaacaugggccuggaggccaucaucagaaaggcccugaugggcggcggcggcaaggccaaggugagcggcagacccagcagcagaaaggccaagagccccgcccccggccuggccagcggcgacagaccccccagcgugagcagcgugcacagcgagggcgacugcaacagaagaaccccccugaccaacagagugugggaggacagacccagcagcgccggcagcacccccuuccccuacaacccccugaucaugagacugcaggccggcgugauggccagcccccccccccccggccugcccgccggcagcggcccccuggccggcccccaccacgccugggacgaggagcccaagccccugcugugcagccaguacgagacccugagcgacagcgaguaa

SEQ ID NO: 20377 - RNA, 912 nt, Artificial Sequence
  NCR1__Homo_sapiens__NP_001138929
augagcagcacccugcccgcccugcugugcgugggccugugccugagccagagaaucagcgcccagcagcagacccugcccaagcccuucaucugggccgagccccacuucauggugcccaaggagaagcaggugaccaucugcugccagggcaacuacggcgccguggaguaccagcugcacuucgagggcagccuguucgccguggacagacccaagccccccgagagaaucaacaaggugcaguucuacauccccgacaugaacagcagaauggccggccaguacagcugcaucuacagagugggcgagcuguggagcgagcccagcaaccugcuggaccugguggugaccgagauguacgacacccccacccugagcgugcaccccggccccgaggugaucagcggcgagaaggugaccuucuacugcagacuggacaccgccaccagcauguuccugcugcugaaggagggcagaagcagccacgugcagagaggcuacggcaaggugcaggccgaguucccccugggccccgugaccaccgcccacagaggcaccuacagaugcuucggcagcuacaacaaccacgccuggagcuuccccagcgagcccgugaagcugcuggugaccggcgacaucgagaacaccagccuggcccccgaggaccccaccuuccccgacaccuggggcaccuaccugcugaccaccgagaccggccugcagaaggaccacgcccugugggaccacaccgcccagaaccugcugagaaugggccuggccuuccuggugcugguggcccuggugugguuccugguggaggacuggcugagcagaaagagaaccagagagagagccagcagagccagcaccugggagggcagaagaagacugaacacccagacccuguaa

SEQ ID NO: 20378 - RNA, 813 nt, Artificial Sequence
  NCR2__Homo_sapiens__NP_001186438
auggccuggagagcccugcacccccugcugcugcugcugcugcuguuccccggcagccaggcccagagcaaggcccaggugcugcagagcguggccggccagacccugaccgugagaugccaguacccccccaccggcagccuguacgagaagaagggcuggugcaaggaggccagcgcccuggugugcaucagacuggugaccagcagcaagcccagaaccauggccuggaccagcagauucaccaucugggacgaccccgacgccggcuucuucaccgugaccaugaccgaccugagagaggaggacagcggccacuacuggugcagaaucuacagacccagcgacaacagcgugagcaagagcgugagauucuaccugguggugagccccgccagcgccagcacccagaccagcuggacccccagagaccuggugagcagccagacccagacccagagcugcgugccccccaccgccggcgccagacaggcccccgagagccccagcaccauccccgugcccagccaccccagcagcccccugcccgugccccugcccagcagaccccagaacagcacccugagacccggccccgccgcccccaucgcccuggugcccguguucugcggccugcugguggccaagagccuggugcugagcgcccugcugguguggugggugcugagaaacagacacaugcagcaccagggcagaagccugcugcaccccgcccagcccagaccccaggcccacagacacuucccccugagccacagagcccccggcggcaccuacggcggcaagcccuaa

SEQ ID NO: 20379 - RNA, 534 nt, Artificial Sequence
  NCR3__Homo_sapiens__NP_001138938
auggccuggaugcugcugcugauccugaucauggugcaccccggcagcugcgcccugugggugagccagccccccgagaucagaacccuggagggcagcagcgccuuccugcccugcagcuucaacgccagccagggcagacuggccaucggcagcgugaccugguucagagacgagguggugcccggcaaggaggugagaaacggcacccccgaguucagaggcagacuggccccccuggccagcagcagauuccugcacgaccaccaggccgagcugcacaucagagacgugagaggccacgacgccagcaucuacgugugcagaguggaggugcugggccugggcgugggcaccggcaacggcaccagacuggugguggagaaggagcacccccagcugggcgccggcaccgugcugcugcugagagccggcuucuacgccgugagcuuccugagcguggccgugggcagcaccguguacuaccagggcaaguacgccaagagcacccugagcggcuucccccagcuguaa

SEQ ID NO: 20380 - RNA, 1365 nt, Artificial Sequence
  NCR3LG1__Homo_sapiens__NP_001189368
augaccuggagagccgccgccagcaccugcgccgcccugcugauccugcugugggcccugaccaccgagggcgaccugaagguggagaugauggccggcggcacccagaucaccccccugaacgacaacgugaccaucuucugcaacaucuucuacagccagccccugaacaucaccagcaugggcaucaccugguucuggaagagccugaccuucgacaaggaggugaagguguucgaguucuucggcgaccaccaggaggccuucagacccggcgccaucgugagccccuggagacugaagagcggcgacgccagccugagacugcccggcauccagcuggaggaggccggcgaguacagaugcgaggugguggugaccccccugaaggcccagggcaccgugcagcuggaggugguggccagccccgccagcagacugcugcuggaccaggugggcaugaaggagaacgaggacaaguacaugugcgagagcagcggcuucuaccccgaggccaucaacaucaccugggagaagcagacccagaaguucccccaccccaucgagaucagcgaggacgugaucaccggccccaccaucaagaacauggacggcaccuucaacgugaccagcugccugaagcugaacagcagccaggaggaccccggcaccguguaccagugcguggugagacacgccagccugcacaccccccugagaagcaacuucacccugaccgccgccagacacagccugagcgagaccgagaagaccgacaacuucagcauccacugguggcccaucagcuucaucggcgugggccuggugcugcugaucgugcugauccccuggaagaagaucugcaacaagagcagcagcgccuacaccccccugaagugcauccugaagcacuggaacagcuucgacacccagacccugaagaaggagcaccugaucuucuucugcaccagagccuggcccagcuaccagcugcaggacggcgaggccuggccccccgagggcagcgugaacaucaacaccauccagcagcuggacguguucugcagacaggagggcaaguggagcgaggugcccuacgugcaggccuucuucgcccugagagacaaccccgaccugugccagugcugcagaaucgaccccgcccugcugaccgugaccagcggcaagagcaucgacgacaacagcaccaagagcgagaagcagacccccagagagcacagcgacgccgugcccgacgcccccauccugcccgugagccccaucugggagcccccccccgccaccaccagcaccacccccgugcugagcagccagccccccacccugcugcugccccugcaguaa

SEQ ID NO: 20381 - RNA, 519 nt, Artificial Sequence
  NCS1__Homo_sapiens__NP_001122298
auggccaccaucaccgagaaggaggugcagcagugguacaagggcuucaucaaggacugccccagcggccagcuggacgccgccggcuuccagaagaucuacaagcaguucuuccccuucggcgaccccaccaaguucgccaccuucguguucaacguguucgacgagaacaaggacggcagaaucgaguucagcgaguucauccaggcccugagcgugaccagcagaggcacccuggacgagaagcugagaugggccuucaagcuguacgaccuggacaacgacggcuacaucaccagaaacgagaugcuggacaucguggacgccaucuaccagauggugggcaacaccguggagcugcccgaggaggagaacacccccgagaagagaguggacagaaucuucgccaugauggacaagaacgccgacggcaagcugacccugcaggaguuccaggagggcagcaaggccgaccccagcaucgugcaggcccugagccuguacgacggccugguguaa

SEQ ID NO: 20382 - RNA, 2070 nt, Artificial Sequence
  NCSTN__Homo_sapiens__NP_001277113
auggacuucaaccugauccuggagagccugugcagaggcaacagcguggagagaaagaucuacaucccccugaacaagaccgcccccugcgugagacugcugaacgccacccaccagaucggcugccagagcagcaucagcggcgacaccggcgugauccacgugguggagaaggaggaggaccugcagugggugcugaccgacggccccaacccccccuacauggugcugcuggagagcaagcacuucaccagagaccugauggagaagcugaagggcagaaccagcagaaucgccggccuggccgugagccugaccaagcccagccccgccagcggcuucagccccagcgugcagugccccaacgacggcuucggcguguacagcaacagcuacggccccgaguucgcccacugcagagagauccaguggaacagccugggcaacggccuggccuacgaggacuucagcuuccccaucuuccugcuggaggacgagaacgagaccaaggugaucaagcagugcuaccaggaccacaaccugagccagaacggcagcgcccccaccuucccccugugcgccaugcagcuguucagccacaugcacgccgugaucagcaccgccaccugcaugagaagaagcagcauccagagcaccuucagcaucaaccccgagaucgugugcgacccccugagcgacuacaacguguggagcaugcugaagcccaucaacaccaccggcacccugaagcccgacgacagaguggugguggccgccaccagacuggacagcagaagcuucuucuggaacguggcccccggcgccgagagcgccguggccagcuucgugacccagcuggccgccgccgaggcccugcagaaggcccccgacgugaccacccugcccagaaacgugauguucguguucuuccagggcgagaccuucgacuacaucggcagcagcagaaugguguacgacauggagaagggcaaguuccccgugcagcuggagaacguggacagcuucguggagcugggccagguggcccugagaaccagccuggagcuguggaugcacaccgaccccgugagccagaagaacgagagcgugagaaaccagguggaggaccugcuggccacccuggagaagagcggcgccggcgugcccgccgugauccugagaagacccaaccagagccagccccugccccccagcagccugcagagauuccugagagccagaaacaucagcggcguggugcuggccgaccacagcggcgccuuccacaacaaguacuaccagagcaucuacgacaccgccgagaacaucaacgugagcuaccccgaguggcugagccccgaggaggaccugaacuucgugaccgacaccgccaaggcccuggccgacguggccaccgugcugggcagagcccuguacgagcuggccggcggcaccaacuucagcgacaccgugcaggccgacccccagaccgugaccagacugcuguacggcuuccugaucaaggccaacaacagcugguuccagagcauccugagacaggaccugagaagcuaccugggcgacggcccccugcagcacuacaucgccgugagcagccccaccaacaccaccuacguggugcaguacgcccuggccaaccugaccggcaccguggugaaccugaccagagagcagugccaggaccccagcaaggugcccagcgagaacaaggaccuguacgaguacagcugggugcagggcccccugcacagcaacgagaccgacagacugcccagaugcgugagaagcaccgccagacuggccagagcccugagccccgccuucgagcugagccaguggagcagcaccgaguacagcaccuggaccgagagcagauggaaggacaucagagccagaaucuuccugaucgccagcaaggagcuggagcugaucacccugaccgugggcuucggcauccugaucuucagccugaucgugaccuacugcaucaacgccaaggccgacgugcuguucaucgcccccagagagcccggcgccgugagcuacuaa

SEQ ID NO: 20383 - RNA, 1929 nt, Artificial Sequence
  NDC80__Homo_sapiens__NP_006092
augaagagaagcagcgugagcagcggcggcgccggcagacugagcaugcaggagcugagaagccaggacgugaacaagcagggccuguacaccccccagaccaaggagaagcccaccuucggcaagcugagcaucaacaagcccaccagcgagagaaaggugagccuguucggcaagagaaccagcggccacggcagcagaaacagccagcugggcaucuucagcagcagcgagaagaucaaggaccccagaccccugaacgacaaggccuucauccagcagugcaucagacagcugugcgaguuccugaccgagaacggcuacgcccacaacgugagcaugaagagccugcaggcccccagcgugaaggacuuccugaagaucuucaccuuccuguacggcuuccugugccccagcuacgagcugcccgacaccaaguucgaggaggaggugcccagaaucuucaaggaccugggcuaccccuucgcccugagcaagagcagcauguacaccgugggcgccccccacaccuggccccacaucguggccgcccugguguggcugaucgacugcaucaagauccacaccgccaugaaggagagcagcccccuguucgacgacggccagcccuggggcgaggagaccgaggacggcaucaugcacaacaagcuguuccuggacuacaccaucaagugcuacgagagcuucaugagcggcgccgacagcuucgacgagaugaacgccgagcugcagagcaagcugaaggaccuguucaacguggacgccuucaagcuggagagccuggaggccaagaacagagcccugaacgagcagaucgccagacuggagcaggagagagagaaggagcccaacagacuggagagccugagaaagcugaaggccagccugcagggcgacgugcagaaguaccaggccuacaugagcaaccuggagagccacagcgccauccuggaccagaagcugaacggccugaacgaggagaucgccagaguggagcuggagugcgagaccaucaagcaggagaacaccagacugcagaacaucaucgacaaccagaaguacagcguggccgacaucgagagaaucaaccacgagagaaacgagcugcagcagaccaucaacaagcugaccaaggaccuggaggccgagcagcagaagcuguggaacgaggagcugaaguacgccagaggcaaggaggccaucgagacccagcuggccgaguaccacaagcuggccagaaagcugaagcugauccccaagggcgccgagaacagcaagggcuacgacuucgagaucaaguucaaccccgaggccggcgccaacugccuggugaaguacagagcccagguguacgugccccugaaggagcugcugaacgagaccgaggaggagaucaacaaggcccugaacaagaagaugggccuggaggacacccuggagcagcugaacgccaugaucaccgagagcaagagaagcgugagaacccugaaggaggaggugcagaagcuggacgaccuguaccagcagaagaucaaggaggccgaggaggaggacgagaagugcgccagcgagcuggagagccuggagaagcacaagcaccugcuggagagcaccgugaaccagggccugagcgaggccaugaacgagcuggacgccgugcagagagaguaccagcugguggugcagaccaccaccgaggagagaagaaaggugggcaacaaccugcagagacugcuggagaugguggccacccacgugggcagcguggagaagcaccuggaggagcagaucgccaagguggacagagaguacgaggagugcaugagcgaggaccugagcgagaacaucaaggagaucagagacaaguacgagaagaaggccacccugaucaagagcagcgaggaguaa

SEQ ID NO: 20384 - RNA, 1008 nt, Artificial Sequence
  NDE1__Homo_sapiens__NP_060138
auggaggacagcggcaagaccuucagcagcgaggaggaggaggccaacuacuggaaggaccuggccaugaccuacaagcagagagccgagaacacccaggaggagcugagagaguuccaggagggcagcagagaguacgaggccgagcuggagacccagcugcagcagaucgagaccagaaacagagaccugcugagcgagaacaacagacugagaauggagcuggagaccaucaaggagaaguucgaggugcagcacagcgagggcuacagacagaucagcgcccuggaggacgaccuggcccagaccaaggccaucaaggaccagcugcagaaguacaucagagagcuggagcaggccaacgacgaccuggagagagccaagagagccaccaucaugagccuggaggacuucgagcagagacugaaccaggccaucgagagaaacgccuuccuggagagcgagcuggacgagaaggagaaccugcuggagagcgugcagagacugaaggacgaggccagagaccugagacaggagcuggccgugcagcagaagcaggagaagcccagaacccccaugcccagcagcguggaggccgagagaaccgacaccgccgugcaggccaccggcagcgugcccagcacccccaucgcccacagaggccccagcagcagccugaacacccccggcagcuucagaagaggccuggacgacagcaccggcggcaccccccugacccccgccgccagaaucagcgcccugaacaucgugggcgaccugcugagaaaggugggcgcccuggagagcaagcuggccagcugcagaaaccugguguacgaccagagccccaacagaaccggcggccccgccagcggcagaagcagcaagaacagagacggcggcgagagaagacccagcagcaccagcgugccccugggcgacaagggccuggacaccagcugcagauggcugagcaagagcaccaccagaagcagcagcagcugcuaa

SEQ ID NO: 20385 - RNA, 987 nt, Artificial Sequence
  NDEL1__Homo_sapiens__NP_001020750
auggacggcgaggacauccccgacuucagcagccugaaggaggagaccgccuacuggaaggagcugagccugaaguacaagcagagcuuccaggaggccagagacgagcugguggaguuccaggagggcagcagagagcuggaggccgagcuggaggcccagcuggugcaggccgagcagagaaacagagaccugcaggccgacaaccagagacugaaguacgagguggaggcccugaaggagaagcuggagcaccaguacgcccagagcuacaagcaggugagcgugcuggaggacgaccugagccagaccagagccaucaaggagcagcugcacaaguacgugagagagcuggagcaggccaacgacgaccuggagagagccaagagagccaccaucgugagccuggaggacuucgagcagagacugaaccaggccaucgagagaaacgccuuccuggagagcgagcuggacgagaaggagagccugcuggugagcgugcagagacugaaggacgaggccagagaccugagacaggagcuggccgugagagagagacagcaggaggugaccagaaagagcgcccccagcagccccacccuggacugcgagaagauggacagcgccgugcaggccagccugagccugcccgccacccccgugggcaagggcaccgagaacaccuuccccagccccaaggccauccccaacggcuucggcaccagcccccugacccccagcgccagaaucagcgcccugaacaucgugggcgaccugcugagaaaggugggcgcccuggagagcaagcuggccgccugcagaaacuucgccaaggaccaggccagcagaaagagcuacaucagcggcaacgugaacugcggcgugcugaacggcaacggcaccaaguucagcagaagcggccacaccagcuucuucgacaagggccaggagaaggugaucuuccccacccuguucaugggccaguaa

SEQ ID NO: 20386 - RNA, 666 nt, Artificial Sequence
  NDFIP1__Homo_sapiens__NP_085048
auggcccuggcccuggccgcccuggccgccguggagcccgccugcggcagcagauaccagcagcugcagaacgaggaggagagcggcgagcccgagcaggccgccggcgacgcccccccccccuacagcagcaucagcgccgagagcgccgccuacuucgacuacaaggacgagagcggcuuccccaagccccccagcuacaacguggccaccacccugcccagcuacgacgaggccgagagaaccaaggccgaggccaccaucccccuggugcccggcagagacgaggacuucgugggcagagacgacuucgacgacgccgaccagcugagaaucggcaacgacggcaucuucaugcugaccuucuucauggccuuccuguucaacuggaucggcuucuuccugagcuucugccugaccaccagcgccgccggcagauacggcgccaucagcggcuucggccugagccugaucaaguggauccugaucgugagauucagcaccuacuuccccggcuacuucgacggccaguacuggcugugguggguguuccuggugcugggcuuccugcuguuccugagaggcuucaucaacuacgccaaggugagaaagaugcccgagaccuucagcaaccugcccagaaccagagugcuguucaucuacuaa

SEQ ID NO: 20387 - RNA, 1011 nt, Artificial Sequence
  NDFIP2__Homo_sapiens__NP_061953
auggccagaagaagaagccagagagugugcgccagcggccccagcaugcugaacagcgccagaggcgcccccgagcugcugagaggcaccgccaccaacgccgaggugagcgccgccgccgccggcgccaccggcagcgaggagcugccccccggcgacagaggcugcagaaacggcggcggcagaggccccgccgccaccaccagcagcaccggcguggccgugggcgccgagcacggcgaggacagccugagcagaaagcccgaccccgagcccggcagaauggaccaccaccagcccggcaccggcagauaccaggugcugcugaacgaggaggacaacagcgagagcagcgccaucgagcagccccccaccagcaaccccgccccccagaucgugcaggccgccagcagcgcccccgcccuggagaccgacagcagccccccccccuacagcagcaucaccguggaggugcccaccaccagcgacaccgagguguacggcgaguucuaccccgugcccccccccuacagcguggccaccagccugcccaccuacgacgaggccgagaaggccaaggccgccgccauggccgccgccgccgccgagaccagccagagaauccaggaggaggagugcccccccagagacgacuucagcgacgccgaccagcugagagugggcaacgacggcaucuucaugcuggccuucuucauggccuucaucuucaacuggcugggcuucugccugagcuucugcaucaccaacaccaucgccggcagauacggcgccaucugcggcuucggccugagccugaucaaguggauccugaucgugagauucagcgacuacuucaccggcuacuucaacggccaguacuggcugugguggaucuuccuggugcugggccugcugcuguucuucagaggcuucgugaacuaccugaaggugagaaacaugagcgagagcauggccgccgcccacagaaccagauacuucuuccugcuguaa

SEQ ID NO: 20388 - RNA, 1707 nt, Artificial Sequence
  NDNF__Homo_sapiens__NP_078850
auggugcugcugcacuggugccugcuguggcugcuguucccccugagcagcagaacccagaagcugcccaccagagacgaggagcuguuccagaugcagaucagagacaaggccuucuuccacgacagcagcgugauccccgacggcgccgagaucagcagcuaccuguucagagacacccccaagagauacuucuucgugguggaggaggacaacaccccccugagcgugaccgugacccccugcgacgccccccuggaguggaagcugagccugcaggagcugcccgaggacagaagcggcgagggcagcggcgaccuggagccccuggagcagcagaagcagcagaucaucaacgaggagggcaccgagcuguucagcuacaagggcaacgacguggaguacuucaucagcagcagcagccccagcggccuguaccagcuggaccugcugagcaccgagaaggacacccacuucaagguguacgccaccaccacccccgagagcgaccagcccuaccccgagcugcccuacgaccccagaguggacgugaccagccugggcagaaccaccgugacccuggccuggaagcccagccccaccgccagccugcugaagcagcccauccaguacugcguggugaucaacaaggagcacaacuucaagagccugugcgccguggaggccaagcugagcgccgacgacgccuucaugauggcccccaagcccggccuggacuucagccccuucgacuucgcccacuucggcuuccccagcgacaacagcggcaaggagagaagcuuccaggccaagcccagccccaagcugggcagacacguguacagcagacccaagguggacauccagaagaucugcaucggcaacaagaacaucuucaccgugagcgaccugaagcccgacacccaguacuacuucgacguguucguggugaacaucaacagcaacaugagcaccgccuacgugggcaccuucgccagaaccaaggaggaggccaagcagaagaccguggagcugaaggacggcaagaucaccgacguguucgugaagagaaagggcgccaaguuccugagauucgcccccgugagcagccaccagaaggugaccuucuucauccacagcugccuggacgccgugcagauccaggugagaagagacggcaagcugcugcugagccagaacguggagggcauccagcaguuccagcugagaggcaagcccaaggccaaguaccuggugagacugaagggcaacaagaagggcgccagcaugcugaagauccuggccaccaccagacccaccaagcagagcuuccccagccugcccgaggacaccagaaucaaggccuucgacaagcugagaaccugcagcagcgccaccguggccuggcugggcacccaggagagaaacaaguucugcaucuacaagaaggagguggacgacaacuacaacgaggaccagaagaagagagagcagaaccagugccugggccccgacaucagaaagaagagcgagaaggugcugugcaaguacuuccacagccagaaccugcagaaggccgugaccaccgagaccaucaagggccugcagcccggcaagagcuaccugcuggacguguacgugaucggccacggcggccacagcgugaaguaccagagcaagguggugaagaccagaaaguucugcuaa

SEQ ID NO: 20389 - RNA, 966 nt, Artificial Sequence
  NDN__Homo_sapiens__NP_002478
augagcgagcagagcaaggaccugagcgaccccaacuucgccgccgaggcccccaacagcgaggugcacagcagccccggcgugagcgagggcgugccccccagcgccacccuggccgagccccagagccccccccugggccccaccgccgccccccaggccgccccccccccccaggcccccaacgacgagggcgaccccaaggcccugcagcaggccgccgaggagggcagagcccaccaggcccccagcgccgcccagcccggccccgccccccccgcccccgcccagcuggugcagaaggcccacgagcugaugugguacgugcuggugaaggaccagaagaagaugaucaucugguuccccgacauggugaaggacgugaucggcagcuacaagaaguggugcagaagcauccugagaagaaccagccugauccuggccagaguguucggccugcaccugagacugaccagccugcacaccauggaguucgcccuggugaaggcccuggagcccgaggagcuggacagaguggcccugagcaacagaaugcccaugaccggccugcugcugaugauccugagccugaucuacgugaagggcagaggcgccagagagagcgccguguggaacgugcugagaauccugggccugagacccuggaagaagcacagcaccuucggcgacgugagaaagcugaucaccgaggaguucgugcagaugaacuaccugaaguaccagagagugcccuacguggagccccccgaguacgaguucuucuggggcagcagagccagcagagagaucaccaagaugcagaucauggaguuccuggccagaguguucaagaaggacccccaggccuggcccagcagauacagagaggcccuggaggaggccagagcccugagagaggccaaccccaccgcccacuaccccagaagcagcgugagcgaggacuaa

SEQ ID NO: 20390 - RNA, 402 nt, Artificial Sequence
  NDP__Homo_sapiens__NP_000257
augagaaagcacgugcuggccgccagcuucagcaugcugagccugcuggugaucaugggcgacaccgacagcaagaccgacagcagcuucaucauggacagcgaccccagaagaugcaugagacaccacuacguggacagcaucagccacccccuguacaagugcagcagcaagauggugcugcuggccagaugcgagggccacugcagccaggccagcagaagcgagccccuggugagcuucagcaccgugcugaagcagcccuucagaagcagcugccacugcugcagaccccagaccagcaagcugaaggcccugagacugagaugcagcggcggcaugagacugaccgccaccuacagauacauccugagcugccacugcgaggagugcaacagcuaa

SEQ ID NO: 20391 - RNA, 1185 nt, Artificial Sequence
  NDRG1__Homo_sapiens__NP_001128714
augagcagagagaugcaggacguggaccuggccgaggugaagccccugguggagaagggcgagaccaucaccggccugcugcaggaguucgacgugcaggagcaggacaucgagacccugcacggcagcgugcacgugacccugugcggcacccccaagggcaacagacccgugauccugaccuaccacgacaucggcaugaaccacaagaccugcuacaacccccuguucaacuacgaggacaugcaggagaucacccagcacuucgccgugugccacguggacgcccccggccagcaggacggcgccgccagcuuccccgccggcuacauguaccccagcauggaccagcuggccgagaugcugcccggcgugcugcagcaguucggccugaagagcaucaucggcaugggcaccggcgccggcgccuacauccugaccagauucgcccugaacaaccccgagaugguggagggccuggugcugaucaacgugaaccccugcgccgagggcuggauggacugggccgccagcaagaucagcggcuggacccaggcccugcccgacaugguggugagccaccuguucggcaaggaggagaugcagagcaacguggagguggugcacaccuacagacagcacaucgugaacgacaugaaccccggcaaccugcaccuguucaucaacgccuacaacagcagaagagaccuggagaucgagagacccaugcccggcacccacaccgugacccugcagugccccgcccugcugguggugggcgacagcagccccgccguggacgccgugguggagugcaacagcaagcuggaccccaccaagaccacccugcugaagauggccgacugcggcggccugccccagaucagccagcccgccaagcuggccgaggccuucaaguacuucgugcagggcaugggcuacaugcccagcgccagcaugaccagacugaugagaagcagaaccgccagcggcagcagcgugaccagccuggacggcaccagaagcagaagccacaccagcgagggcaccagaagcagaagccacaccagcgagggcaccagaagcagaagccacaccagcgagggcgcccaccuggacaucacccccaacagcggcgccgccggcaacagcgccggccccaagagcauggaggugagcugcuaa

SEQ ID NO: 20392 - RNA, 1104 nt, Artificial Sequence
  NDRG2__Homo_sapiens__NP_001269140
auggagaacggcggcagcaugcaggccaccauggccgagcugcaggaggugcagaucaccgaggagaagccccugcugcccggccagacccccgaggccgccaagacccacagcguggagacccccuacggcagcgugaccuucaccguguacggcacccccaagcccaagagacccgccauccugaccuaccacgacgugggccugaacuacaagagcugcuuccagccccuguuccaguucgaggacaugcaggagaucauccagaacuucgugagagugcacguggacgcccccggcauggaggagggcgcccccguguucccccugggcuaccaguaccccagccuggaccagcuggccgacaugauccccugcgugcugcaguaccugaacuucagcaccaucaucggcgugggcgugggcgccggcgccuacauccuggccagauacgcccugaaccaccccgacaccguggagggccuggugcugaucaacaucgaccccaacgccaagggcuggauggacugggccgcccacaagcugaccggccugaccagcagcauccccgagaugauccugggccaccuguucagccaggaggagcugagcggcaacagcgagcugauccagaaguacagaaacaucaucacccacgcccccaaccuggacaacaucgagcuguacuggaacagcuacaacaacagaagagaccugaacuucgagagaggcggcgacaucacccugagaugccccgugaugcugguggugggcgaccaggccccccacgaggacgccgugguggagugcaacagcaagcuggaccccacccagaccagcuuccugaagauggccgacagcggcggccagccccagcugacccagcccggcaagcugaccgaggccuucaaguacuuccugcagggcaugggcuacauggccagcagcugcaugaccagacugagcagaagcagaaccgccagccugaccagcgccgccagcguggacggcaacagaagcagaagcagaacccugagccagagcagcgagagcggcacccugagcagcggcccccccggccacaccauggaggugagcugcuaa

SEQ ID NO: 20393 - RNA, 1092 nt, Artificial Sequence
  NDRG3__Homo_sapiens__NP_071922
auggacgagcugcaggacgugcagcugaccgagaucaagccccugcugaacgacaaggagcacgacaucgagaccacccacggcguggugcacgugaccaucagaggccugcccaagggcaacagacccgugauccugaccuaccacgacaucggccugaaccacaagagcugcuucaacgccuucuucaacuucgaggacaugcaggagaucacccagcacuucgccgugugccacguggacgcccccggccagcaggagggcgcccccagcuuccccaccggcuaccaguaccccaccauggacgagcuggccgagaugcugccccccgugcugacccaccugagccugaagagcaucaucggcaucggcgugggcgccggcgccuacauccugagcagauucgcccugaaccaccccgagcugguggagggccuggugcugaucaacguggaccccugcgccaagggcuggaucgacugggccgccagcaagcugagcggccugaccaccaacgugguggacaucauccuggcccaccacuucggccaggaggagcugcaggccaaccuggaccugauccagaccuacagaaugcacaucgcccaggacaucaaccaggacaaccugcagcuguuccugaacagcuacaacggcagaagagaccuggagaucgagagacccauccugggccagaacgacaacaagagcaagacccugaagugcagcacccugcugguggugggcgacaacagccccgccguggaggccgugguggagugcaacagcagacugaaccccaucaacaccacccugcugaagauggccgacugcggcggccugccccagguggugcagcccggcaagcugaccgaggccuucaaguacuuccugcagggcaugggcuacauccccagcgccagcaugaccagacuggccagaagcagaacccacagcaccagcagcagccugggcagcggcgagagccccuucagcagaagcgugaccagcaaccagagcgacggcacccaggagagcugcgagagccccgacgugcuggacagacaccagaccauggaggugagcugcuaa

SEQ ID NO: 20394 - RNA, 1176 nt, Artificial Sequence
  NDRG4__Homo_sapiens__NP_001123959
augaaggugcugggccacagacuggagcugcugaccggccugcugcugcacgacgugaccauggccggccugcaggagcugagauuccccgaggagaagccccugcugagaggccaggacgccaccgagcuggagagcagcgacgccuuccugcuggccgccgacaccgacuggaaggagcacgacaucgagacccccuacggccugcugcacguggugaucagaggcagccccaagggcaacagacccgccauccugaccuaccacgacgugggccugaaccacaagcugugcuucaacaccuucuucaacuucgaggacaugcaggagaucaccaagcacuucguggugugccacguggacgcccccggccagcaggugggcgccagccaguucccccagggcuaccaguuccccagcauggagcagcuggccgccaugcugcccagcguggugcagcacuucggcuucaaguacgugaucggcaucggcgugggcgccggcgccuacgugcuggccaaguucgcccugaucuuccccgaccugguggagggccuggugcuggugaacaucgaccccaacggcaagggcuggaucgacugggccgccaccaagcugagcggccugaccagcacccugcccgacaccgugcugagccaccuguucagccaggaggagcuggugaacaacaccgagcuggugcagagcuacagacagcagaucggcaacguggugaaccaggccaaccugcagcuguucuggaacauguacaacagcagaagagaccuggacaucaacagacccggcaccgugcccaacgccaagacccugagaugccccgugaugcugguggugggcgacaacgcccccgccgaggacggcgugguggagugcaacagcaagcuggaccccaccaccaccaccuuccugaagauggccgacagcggcggccugccccaggugacccagcccggcaagcugaccgaggccuucaaguacuuccugcagggcaugggcuacaugcccagcgccagcaugaccagacuggccagaagcagaaccgccagccugaccagcgccagcagcguggacggcagcagaccccaggccugcacccacagcgagagcagcgagggccugggccaggugaaccacaccauggaggugagcugcuaa

SEQ ID NO: 20395 - RNA, 2688 nt, Artificial Sequence
  NDST1__Homo_sapiens__XP_005268491
augcccgcccuggccugccugagaagacugugcagacacgugagcccccaggccgugcuguuccugcuguucaucuucugccuguucagcguguucaucagcgccuacuaccuguacggcuggaagagaggccuggagcccagcgccgacgcccccgagcccgacugcggcgaccccccccccguggcccccagcagacugcugccccugaagcccgugcaggccgccacccccagcagaaccgacccccuggugcugguguucguggagagccuguacagccagcugggccaggaggugguggccauccuggagagcagcagauucaaguacagaaccgagaucgcccccggcaagggcgacaugcccacccugaccgacaagggcagaggcagauucgcccugaucaucuacgagaacauccugaaguacgugaaccuggacgccuggaacagagagcugcuggacaaguacugcguggccuacggcgugggcaucaucggcuucuucaaggccaacgagaacagccugcugagcgcccagcugaagggcuucccccuguuccugcacagcaaccugggccugaaggacugcagcaucaaccccaagagcccccugcuguacgugaccagacccagcgagguggagaagggcgugcugcccggcgaggacuggaccguguuccagagcaaccacagcaccuacgagcccgugcugcuggccaagaccagaagcagcgagagcaucccccaccugggcgccgacgccggccugcacgccgcccugcacgccaccguggugcaggaccugggccugcacgacggcauccagagagugcuguucggcaacaaccugaacuucuggcugcacaagcugguguucguggacgccguggccuuccugaccggcaagagacugagccugccccuggacagauacauccugguggacaucgacgacaucuucgugggcaaggagggcaccagaaugaagguggaggacgugaaggcccuguucgacacccagaacgagcugagagcccacauccccaacuucaccuucaaccugggcuacagcggcaaguucuuccacaccggcaccaacgccgaggacgccggcgacgaccugcugcugagcuacgugaaggaguucuggugguucccccacauguggagccacaugcagccccaccuguuccacaaccagagcgugcuggccgagcagauggcccugaacaagaaguucgccguggagcacggcauccccaccgacaugggcuacgccguggccccccaccacagcggcguguaccccgugcacgugcagcuguacgaggccuggaagcagguguggagcaucagagugaccagcaccgaggaguacccccaccugaagcccgccagauacagaagaggcuucauccacaacggcaucauggugcugcccagacagaccugcggccuguucacccacaccaucuucuacaacgaguaccccggcggcagcagcgagcuggacaagaucaucaacggcggcgagcuguuccugaccgugcugcugaaccccaucagcaucuucaugacccaccugagcaacuacggcaacgacagacugggccuguacaccuucaagcaccuggugagauuccugcacagcuggaccaaccugagacugcagacccugccccccgugcagcuggcccagaaguacuuccagaucuucagcgaggagaaggacccccuguggcaggaccccugcgaggacaagagacacaaggacaucuggagcaaggagaagaccugcgacagauuccccaagcugcugaucaucggcccccagaagaccggcaccaccgcccuguaccuguuccugggcaugcaccccgaccugagcagcaacuaccccagcagcgagaccuucgaggagauccaguucuucaacggccacaacuaccacaagggcaucgacugguacauggaguucuuccccauccccagcaacaccaccagcgacuucuacuucgagaagagcgccaacuacuucgacagcgagguggcccccagaagagccgccgcccugcugcccaaggccaaggugcugaccauccugaucaaccccgccgacagagccuacagcugguaccagcaccagagagcccacgacgaccccguggcccugaaguacaccuuccacgaggugaucaccgccggcagcgacgccagcagcaagcugagagcccugcagaacagaugccuggugcccggcugguacgccacccacaucgagagauggcugagcgccuaccacgccaaccagauccuggugcuggacggcaagcugcugagaaccgagcccgccaaggugauggacauggugcagaaguuccugggcgugaccaacaccaucgacuaccacaagacccuggccuucgaccccaagaagggcuucuggugccagcugcuggagggcggcaagaccaagugccugggcaagagcaagggcagaaaguaccccgagauggaccuggacgugagcggcggccacaccaccugcagcaccugcaucagaagcagagccuuccugaaggacuacuacagagaccacaacaucgagcugagcaagcugcuguacaagaugggccagacccugcccaccuggcugagagaggaccugcagaacaccagauaa

SEQ ID NO: 20396 - RNA, 2448 nt, Artificial Sequence
  NDST2__Homo_sapiens__XP_005270312
augcugcagcuguggaagguggugagacccgccagacagcuggagcugcacagacugauccugcugcugaucgccuucagccugggcagcaugggcuuccuggccuacuacgugagcaccagccccaaggccaaggagccccugccccugccccugggcgacugcagcagcggcggcgccgccggccccggccccgccagaccccccgugccccccagaccccccagaccccccgagaccgccagaaccgagcccguggugcugguguucguggagagcgccuacagccagcugggccaggagaucguggccauccuggagagcagcagauucagauacagcaccgagcuggcccccggcagaggcgacaugcccacccugaccgacaacacccacggcagauacgugcuggugaucuacgagaaccugcugaaguacgugaaccuggacgccuggagcagagagcugcuggacagauacugcguggaguacggcgugggcaucaucggcuucuucagagcccacgagcacagccugcugagcgcccagcugaagggcuucccccuguuccugcacagcaaccugggccugagagacuaccaggugaaccccagcgccccccugcugcaccugaccagacccagcagacuggagcccggcccccugcccggcgacgacuggaccaucuuccagagcaaccacagcaccuacgagcccgugcugcuggccagccugagacccgccgagcccgccgugcccggccccgugcugagaagagccagacugcccaccguggugcaggaccugggccugcacgacggcauccagagagugcuguucggccacggccugagcuucuggcugcacaagcugaucuucguggacgccguggccuaccugaccggcaagagacugugccuggaccuggacagauacauccugguggacaucgacgacaucuucgugggcaaggagggcaccagaaugaagguggccgacguggaggcccugcugaccacccagaacaagcugagaacccuggugcccaacuucaccuucaaccugggcuucagcggcaaguucuaccacaccggcaccgaggaggaggacgccggcgacgacaugcugcugaagcacagaaaggaguucuggugguucccccacauguggagccacaugcagccccaccuguuccacaacagaagcgugcuggccgaccagaugagacugaacaagcaguucgcccuggagcacggcauccccaccgaccugggcuacgccguggccccccaccacagcggcguguaccccauccacacccagcuguacgaggccuggaagagcguguggggcauccaggugaccagcaccgaggaguacccccaccugagacccgccagauacagaagaggcuucauccacaacggcaucauggugcugcccagacagaccugcggccuguucacccacaccaucuucuacaacgaguaccccggcggcagcagagagcuggacagaagcaucagaggcggcgagcuguuccugaccgugcugcugaaccccaucagcaucuucaugacccaccugagcaacuacggcaacgacagacugggccuguacaccuucgagagccuggugagauuccugcagugcuggaccagacugagacugcagacccugccccccgugccccuggcccagaaguacuucgagcuguucccccaggagagaagcccccuguggcagaaccccugcgacgacaagagacacaaggacaucuggagcaaggagaagaccugcgacagacugcccaaguuccugaucgugggcccccagaagaccggcaccaccgccauccacuucuuccugagccugcaccccgccgugaccagcagcuuccccagccccagcaccuucgaggagauccaguucuucaacagccccaacuaccacaagggcaucgacugguacauggacuucuuccccgugcccagcaacgccagcaccgacuuccuguucgagaagagcgccaccuacuucgacagcgagguggugcccagaagaggcgccgcccugcugcccagagccaagaucaucaccgugcugaccaaccccgccgacagagccuacagcugguaccagcaccagagagcccacggcgaccccguggcccugaacuacaccuucuaccaggugaucagcgccagcagccagaccccccuggcccugagaagccugcagaacagaugccuggugcccggcuacuacagcacccaccugcagagauggcugaccuacuaccccagcggccagcugcugaucguggacggccaggagcugagaaccaaccccgccgccagcauggagagcauccagaaguuccugggccugaugaugaucagagacuucggcgccagagaccugaagguggugagacuggccguguaa

SEQ ID NO: 20397 - RNA, 2622 nt, Artificial Sequence
  NDST3__Homo_sapiens__NP_004775
augagcuucaucaugaagcugcacagacacuuccagagaaccgugauccugcuggccaccuucugcauggugagcaucaucaucagcgccuacuaccuguacagcggcuacaagcaggagaacgagcugagcgagaccgccagcgagguggacugcggcgaccugcagcaccugcccuaccagcugauggaggugaaggccaugaagcuguucgacgccagcagaaccgaccccaccgugcugguguucguggagagccaguacagcagccugggccaggacaucaucaugauccuggagagcagcagauuccaguaccacaucgagaucgcccccggcaagggcgaccugcccgugcugaucgacaagaugaagggcaaguacauccugaucaucuacgagaacauccugaaguacaucaacauggacagcuggaacagaagccugcuggacaaguacugcguggaguacggcgugggcgugaucggcuuccacaagaccagcgagaagagcgugcagagcuuccagcugaagggcuuccccuucagcaucuacggcaaccuggccgugaaggacugcugcaucaacccccacagcccccugaucagagugaccaagagcagcaagcuggagaagggcagccugcccggcaccgacuggaccguguuccagaucaaccacagcgccuaccagcccgugaucuucgccaaggugaagacccccgagaaccugagccccagcaucagcaagggcgccuucuacgccaccaucauccacgaccugggccugcacgacggcauccagagagugcuguucggcaacaaccugaacuucuggcugcacaagcugaucuucaucgacgccaucagcuuccugagcggcaagagacugacccugagccuggacagauacauccugguggacaucgacgacaucuucgugggcaaggagggcaccagaaugaacaccaacgacgugaaggcccugcuggacacccagaaccugcugagagcccagaucaccaacuucaccuucaaccugggcuucagcggcaaguucuaccacaccggcaccgaggaggaggacgagggcgacgacugccugcugggcagcguggacgaguucuggugguucccccacauguggagccacaugcagccccaccuguuccacaacgagagcagccugguggagcagaugauccugaacaagaaguucgcccuggagcacggcauccccaccgacaugggcuacgccguggccccccaccacagcggcguguaccccgugcacgugcagcuguacgaggccuggaagaagguguggaacaucaagaucaccagcaccgaggaguacccccaccugaagcccgccagauacagaagaggcuucauccacaagaacaucauggugcugcccagacagaccugcggccuguucacccacaccaucuucuacaaggaguaccccggcggccccaaggagcuggacaagagcauccagggcggcgagcuguucuucaccguggugcugaaccccaucagcaucuucaugacccaccugagcaacuacggcaacgacagacugggccuguacaccuucgugaaccuggccaacuucgugaagagcuggaccaaccugagacugcagacccugccccccgugcagcuggcccacaaguacuucgagcuguuccccgaccagaaggacccccuguggcagaaccccugcgacgacaagagacacagagacaucuggagcaaggagaagaccugcgacagacugcccaaguuccuggugaucggcccccagaagaccggcaccaccgcccuguaccuguuccuggugaugcaccccagcauccugagcaacagccccagccccaagaccuucgaggaggugcaguucuucaacagaaacaacuaccacagaggcaucgacugguacauggacuucuuccccgugcccagcaacgugaccaccgacuuccuguucgagaagagcgccaacuacuuccacagcgaggaggcccccaagagagccgccagccuggugcccaaggccaagaucaucaccauccugaucgaccccagcgacagagccuacagcugguaccagcaccagagaagccacgaggaccccgccgcccugaaguucagcuucuacgaggugaucagcgccggccccagagcccccagcgagcugagagcccugcagaagagaugccuggugcccggcugguacgccagccacaucgagagauggcugguguacuucccccccuuccagcugcugaucaucgacggccagcagcugagaaccgaccccgccaccgugauggacgaggugcagaaguuccugggcgugcugccccacuacaacuacagcgaggcccugaccuucgacagccacaagggcuucuggugccagcugcuggaggagggcaagaccaagugccugggcaagagcaagggcagaaaguacccccccauggacagcgacagcagaaccuuccugagcagcuacuacagagaccacaacguggagcugagcaagcugcugcacaagcugggccagccccugcccagcuggcugagacaggagcugcagaaggugagauaa

SEQ ID NO: 20398 - RNA, 2619 nt, Artificial Sequence
  NDST4__Homo_sapiens__NP_072091
augaaccugaucgugaagcugagaagaagcuucagaacccugaucgugcugcuggccaccuucugccuggugagcaucgugaucagcgccuacuuccuguacagcggcuacaagcaggagaugacccugaucgagaccaccgccgaggccgagugcaccgacaucaagauccugcccuacagaagcauggagcugaagaccgugaagcccaucgacaccagcaagaccgaccccaccgugcugcuguucguggagagccaguacagccagcugggccaggacaucaucgccauccuggagagcagcagauuccaguaccacauggugaucgcccccggcaagggcgacauccccccccugaccgacaacggcaagggcaaguacacccuggugaucuacgagaacauccugaaguacgugagcauggacagcuggaacagagagcugcuggagaaguacugcguggaguacagcgugagcaucaucggcuuccacaaggccaacgagaacagccugcccagcacccagcugaagggcuucccccugaaccuguucaacaaccuggcccugaaggacugcuucgugaacccccagagcccccugcugcacaucaccaaggcccccaagguggagaagggcccccugcccggcgaggacuggaccaucuuccaguacaaccacagcaccuaccagcccgugcugcugaccgagcugcagaccgagaagagccugagcagccugagcagcaagacccuguucgccaccgugauccaggaccugggccugcacgacggcauccagagagugcuguucggcaacaaccugaacuucuggcugcacaagcugaucuucaucgacgccaucagcuuccugagcggcaagagacugacccugagccuggacagauacauccugguggacaucgacgacaucuucgugggcaaggagggcaccagaaugaacgugaaggacgugaaggcccugcuggagacccagaaccugcugagaacccagguggccaacuucaccuucaaccugggcuucagcggcaaguucuaccacaccggcaccgaggaggaggacgagggcgacgaccugcugcugagaagcguggacgaguucuggugguucccccacauguggagccacaugcagccccaccuguuccacaacgagagcagccugguggagcagaugauccugaacaaggaguucgcccuggagcacggcauccccaucaacaugggcuacgccguggccccccaccacagcggcguguaccccgugcacauccagcuguacgccgccuggaagaagguguggggcauccaggugaccagcaccgaggaguacccccaccugaagcccgccagauacagaaagggcuucauccacaacagcaucauggugcugcccagacagaccugcggccuguucacccacaccaucuucuacaaggaguaccccggcggcccccaggagcuggacaagagcaucagaggcggcgagcuguuccugaccauccugcugaaccccaucagcaucuucaugacccaccugagcaacuacggcaacgacagacugggccuguacaccuucgugaaccuggugaacuucgugcagagcuggaccaaccugaagcugcagacccugccccccgugcagcuggcccaccaguacuucgagcuguuccccgagcagaaggacccccuguggcagaaccccugcgacgacaagagacacaaggacaucuggagcagagagaagaccugcgaccaccugcccaaguuccuggugaucggcccccagaagaccggcaccaccgcccuguaccuguuccugcugaugcaccccagcaucaucagcaaccugcccagccccaagaccuucgaggaggugcaguucuucaacggcaacaacuaccacaagggcaucgacugguacauggacuucuuccccacccccagcaacaccaccagcgacuuccuguucgagaagagcgccaacuacuuccacagcgaggaggcccccagaagagccgccagccuggugcccaaggccaagaucaucaccauccugaucgaccccagcgacagagccuacagcugguaccagcaccagagaagccacgaggaccccgccgcccugagauucaacuucuacgaggugaucagcaccggccacugggcccccagcgaccugaagacccugcagagaagaugccuggugcccggcugguacgccgugcacaucgagagauggcugaccuacuucgccaccagccagcugcugaucaucgacggccagcagcugagaagcgaccccgccaccgugauggacgaggugcagaaguuccugggcgugacccccagauacaacuacagcgaggcccugaccuucgacccccagaagggcuucuggugccagcugcuggagggcggcaagaccaagugccugggcaagagcaagggcagaaaguacccccccauggaccccgagagcagaaccuuccugagcaacuacuacagagaccacaacguggagcugagcaagcugcugcacagacugggccagccccugcccagcuggcugagacaggagcugcagaaggugagauaa

SEQ ID NO: 20399 - RNA, 1068 nt, Artificial Sequence
  NDUFA10__Homo_sapiens__NP_004535
auggcccugagacugcugaagcuggccgccaccagcgccagcgccagagugguggccgccggcgcccagagagugagaggcauccacagcagcgugcagugcaagcugagauacggcauguggcacuuccugcugggcgacaaggccagcaagagacugaccgagagaagcagagugaucaccguggacggcaacaucugcaccggcaagggcaagcuggccaaggagaucgccgagaagcugggcuucaagcacuuccccgaggccggcauccacuaccccgacagcaccaccggcgacggcaagccccuggccaccgacuacaacggcaacugcagccuggagaaguucuacgacgaccccagaagcaacgacggcaacagcuacagacugcagagcuggcuguacagcagcagacugcugcaguacagcgacgcccuggagcaccugcugaccaccggccagggcguggugcuggagagaagcaucuucagcgacuucguguuccuggaggccauguacaaccagggcuucaucagaaagcagugcguggaccacuacaacgaggugaagagcgugaccaucugcgacuaccugcccccccaccuggugaucuacaucgacgugcccgugcccgaggugcagagaagaauccagaagaagggcgacccccacgagaugaagaucaccagcgccuaccugcaggacaucgagaacgccuacaagaagaccuuccugcccgagaugagcgagaagugcgaggugcugcaguacagcgccagagaggcccaggacagcaagaaggugguggaggacaucgaguaccugaaguucgacaagggccccuggcugaagcaggacaacagaacccuguaccaccugagacugcuggugcaggacaaguucgaggugcugaacuacaccagcauccccaucuuccugcccgaggugaccaucggcgcccaccagaccgacagagugcugcaccaguucagagagcugcccggcagaaaguacagccccggcuacaacaccgaggugggcgacaaguggaucuggcugaaguaa

SEQ ID NO: 20400 - RNA, 687 nt, Artificial Sequence
  NDUFA11__Homo_sapiens__NP_001180304
auggcccccaagguguucagacaguacugggacauccccgacggcaccgacugccacagaaaggccuacagcaccaccagcaucgccagcguggccggccugaccgccgccgccuacagagugacccugaacccccccggcaccuuccuggagggcguggccaaggugggccaguacaccuucaccgccgccgccgugggcgccguguucggccugaccaccugcaucagcgcccacgugagagagaagcccgacgacccccugaacuacuuccugggcggcugcgccggcggccugacccugggcgccagaaagaccggcagccacugcguggugcaggccggccugaagcugcuggccagcagcagcccccacaccagcgccagccagagcgccggcaucaucggcaugagccacugcgugcagagauucugggugcccagcagcagcgccugccuggaggugcugagcggcgagagcaccgacgugcacgccugcagcagcaccagaggcgccugcaacagcagcggcagcagaccccugcccgagcugggcgccagagccagcggcagccugagaaagggcggccacacccaccccgcccccagaggcgccggcgcccugacccccgugcaggcccugaucgagagccugcugaacacccugggcagcaaccccagaaccuaa

SEQ ID NO: 20401 - RNA, 192 nt, Artificial Sequence
  NDUFA12__Homo_sapiens__NP_001245267
auggagcuggugcaggugcugaagagaggccugcagcagaucaccggccacggcggccugagaggcuaccugagaguguucuucagaaccaacgacgccaaggugggcacccuggugggcgaggacaaguacggcaacaaguacuacgaggacaacaagcaguucuucggcaucgugggcuucaccguguaa

SEQ ID NO: 20402 - RNA, 435 nt, Artificial Sequence
  NDUFA13__Homo_sapiens__NP_057049
auggccgccagcaaggugaagcaggacaugcccccccccggcggcuacggccccaucgacuacaagagaaaccugcccagaagaggccugagcggcuacagcaugcuggccaucggcaucggcacccugaucuacggccacuggagcaucaugaaguggaacagagagagaagaagacugcagaucgaggacuucgaggccagaaucgcccugcugccccugcugcaggccgagaccgacagaagaacccugcagaugcugagagagaaccuggaggaggaggccaucaucaugaaggacgugcccgacuggaaggugggcgagagcguguuccacaccaccagaugggugcccccccugaucggcgagcuguacggccugagaaccaccgaggaggcccugcacgccagccacggcuucaugugguacaccuaa

SEQ ID NO: 20403 - RNA, 213 nt, Artificial Sequence
  NDUFA1__Homo_sapiens__NP_004532
augugguucgagauccugcccggccugagcgugaugggcgugugccugcugauccccggccuggccaccgccuacauccacagauucaccaacggcggcaaggagaagagaguggcccacuucggcuaccacuggagccugauggagagagacagaagaaucagcggcguggacagauacuacgugagcaagggccuggagaacaucgacuaa

SEQ ID NO: 20404 - RNA, 231 nt, Artificial Sequence
  NDUFA2__Homo_sapiens__NP_001171941
auggccgccgccgccgccagcagaggcgugggcgccaagcugggccugagagagaucagaauccaccugugccagagaagccccggcagccagggcgugagagacuucaucgagaagagauacguggagcugaagaaggccaaccccgaccugcccauccugaucagagagugcagcgacgugcagcccaagcugugggccagauacgccagcagagugcagaacagcuaa

SEQ ID NO: 20405 - RNA, 351 nt, Artificial Sequence
  NDUFA5__Homo_sapiens__NP_001269349
augcccuacagagugggccagaccaccggccuggugggccuggccgugugcaacaccccccacgagagacugagaauccuguacaccaagauccuggacgugcuggaggagauccccaagaacgccgccuacagaaaguacaccgagcagaucaccaacgagaagcuggccauggugaaggccgagcccgacgugaagaagcuggaggaccagcugcagggcggccagcuggaggaggugauccugcaggccgagcacgagcugaaccuggccagaaagaugagagaguggaagcugugggagccccugguggaggagccccccgccgaccaguggaaguggcccaucuaa

SEQ ID NO: 20406 - RNA, 465 nt, Artificial Sequence
  NDUFA6__Homo_sapiens__NP_002481
augggcaaggacaucagacccagaagcgccagagccgccugcaagggcgugggccuguggagcggcugcuucggcaagauggccggcagcggcgugagacaggccaccagcaccgccagcaccuucgugaagcccaucuucagcagagacaugaacgaggccaagagaagagugagagagcuguacagagccugguacagagaggugcccaacaccgugcaccaguuccagcuggacaucaccgugaagaugggcagagacaaggugagagagauguucaugaagaacgcccacgugaccgaccccagagugguggaccugcuggugaucaagggcaagaucgagcuggaggagaccaucaagguguggaagcagagaacccacgugaugagauucuuccacgagaccgaggcccccagacccaaggacuuccugagcaaguucuacgugggccacgaccccuaa

SEQ ID NO: 20407 - RNA, 1134 nt, Artificial Sequence
  NDUFA9__Homo_sapiens__NP_004993
auggccgccgccgcccagagcagaguggugagagugcugagcaugagcagaagcgccaucaccgccaucgccaccagcgugugccacggcccccccugcagacagcugcaccacgcccugaugccccacggcaagggcggcagaagcagcgugagcggcaucguggccaccguguucggcgccaccggcuuccugggcagauacguggugaaccaccugggcagaaugggcagccaggugaucauccccuacagaugcgacaaguacgacaucaugcaccugagacccaugggcgaccugggccagcugcuguuccuggagugggacgccagagacaaggacagcaucagaagaguggugcagcacagcaacguggugaucaaccugaucggcagagacugggagaccaagaacuucgacuucgaggacguguucgugaagaucccccaggccaucgcccagcugagcaaggaggccggcguggagaaguucauccacgugagccaccugaacgccaacaucaagagcagcagcagauaccugagaaacaaggccgugggcgagaagguggugagagacgccuuccccgaggccaucaucgugaagcccagcgacaucuucggcagagaggacagauuccugaacagcuucgccagcaugcacagauucggccccaucccccugggcagccugggcuggaagaccgugaagcagcccguguacgugguggacgugagcaagggcaucgugaacgccgugaaggaccccgacgccaacggcaagagcuucgccuucgugggccccagcagauaccugcuguuccaccuggugaaguacaucuucgccguggcccacagacuguuccugcccuucccccugccccuguucgccuacagauggguggccagaguguucgagaucagccccuucgagcccuggaucaccagagacaagguggagagaaugcacaucaccgacaugaagcugccccaccugcccggccuggaggaccugggcauccaggccaccccccuggagcugaaggccaucgaggugcugagaagacacagaaccuacagauggcugagcgccgagaucgaggacgugaagcccgccaagaccgugaacaucuaa

SEQ ID NO: 20408 - RNA, 471 nt, Artificial Sequence
  NDUFAB1__Homo_sapiens__NP_004994
auggccagcagagugcugagcgccuacgugagcagacugcccgccgccuucgccccccugcccagagugagaaugcuggccguggccagaccccugagcaccgcccugugcagcgccggcacccagaccagacugggcacccugcagcccgcccuggugcuggcccaggugcccggcagagugacccagcugugcagacaguacagcgacaugcccccccugacccuggagggcauccaggacagagugcuguacgugcugaagcuguacgacaagaucgaccccgagaagcugagcgugaacagccacuucaugaaggaccugggccuggacagccuggaccagguggagaucaucauggccauggaggacgaguucggcuucgagauccccgacaucgacgccgagaagcugaugugcccccaggagaucguggacuacaucgccgacaagaaggacguguacgaguaa

SEQ ID NO: 20409 - RNA, 984 nt, Artificial Sequence
  NDUFAF1__Homo_sapiens__NP_057097
auggcccuggugcacaagcugcugagaggcaccuacuuccugagaaaguucagcaagcccaccagcgcccuguaccccuuccugggcaucagauucgccgaguacagcagcagccugcagaagcccguggccagccccggcaaggccagcagccagagaaagaccgagggcgaccugcagggcgaccaccagaaggagguggcccuggacaucaccagcagcgaggagaagcccgacgugagcuucgacaaggccaucagagacgaggccaucuaccacuucagacugcugaaggacgagaucguggaccacuggagaggccccgagggccacccccugcacgaggugcugcuggagcaggccaaggugguguggcaguucagaggcaaggaggaccuggacaaguggaccgugaccagcgacaagaccaucggcggcagaagcgagguguuccugaagaugggcaagaacaaccagagcgcccugcuguacggcacccugagcagcgaggccccccaggacggcgagagcaccagaagcggcuacugcgccaugaucagcagaauccccagaggcgccuucgagagaaagaugagcuacgacuggagccaguucaacacccuguaccugagagugagaggcgacggcagacccuggauggugaacaucaaggaggacaccgacuucuuccagagaaccaaccagauguacagcuacuucauguucaccagaggcggccccuacuggcaggaggugaagauccccuucagcaaguucuucuucagcaacagaggcagaaucagagacgugcagcacgagcugccccuggacaagaucagcagcaucggcuucacccuggccgacaagguggacggccccuucuuccuggagaucgacuucaucggcguguucaccgaccccgcccacaccgaggaguucgccuacgagaacagccccgagcugaaccccagacuguucaaguaa

SEQ ID NO: 20410 - RNA, 510 nt, Artificial Sequence
  NDUFAF2__Homo_sapiens__NP_777549
augggcuggagccaggaccuguucagagcccuguggagaagccugagcagagaggugaaggagcacgugggcaccgaccaguucggcaacaaguacuacuacaucccccaguacaagaacuggagaggccagaccaucagagagaagagaaucguggaggccgccaacaagaaggagguggacuacgaggccggcgacauccccaccgagugggaggccuggaucagaagaaccagaaagaccccccccaccauggaggagauccugaagaacgagaagcacagagaggagaucaagaucaagagccaggacuucuacgagaaggagaagcugcugagcaaggagaccagcgaggagcugcugcccccccccgugcagacccagaucaagggccacgccagcgcccccuacuucggcaaggaggagcccagcguggcccccagcagcaccggcaagaccuuccagcccggcagcuggaugcccagagacggcaagagccacaaccaguaa

SEQ ID NO: 20411 - RNA, 555 nt, Artificial Sequence
  NDUFAF3__Homo_sapiens__NP_951032
auggccaccgcccuggcccugagaagccuguacagagccagacccagccugagaugcccccccguggagcugcccugggcccccagaagaggccacagacugagccccgccgacgacgagcuguaccagagaaccagaaucagccugcugcagagagaggccgcccaggccauguacaucgacagcuacaacagcagaggcuucaugaucaacggcaacagagugcugggccccugcgcccugcugccccacagcguggugcaguggaacgugggcagccaccaggacaucaccgaggacagcuucagccuguucuggcugcuggagcccagaaucgagaucgugguggugggcaccggcgacagaaccgagagacugcagagccaggugcugcaggccaugagacagagaggcaucgccguggaggugcaggacacccccaacgccugcgccaccuucaacuuccugugccacgagggcagagugaccggcgccgcccugauccccccccccggcggcaccagccugaccagccugggccaggccgcccaguaa

SEQ ID NO: 20412 - RNA, 528 nt, Artificial Sequence
  NDUFAF4__Homo_sapiens__NP_054884
augggcgcccuggugaucagaggcaucagaaacuucaaccuggagaacagagccgagagagagaucagcaagaugaagcccagcguggcccccagacaccccagcaccaacagccugcugagagagcagaucagccuguaccccgaggugaagggcgagaucgccagaaaggacgagaagcugcugagcuuccugaaggacguguacguggacagcaaggaccccgugagcagccugcaggugaaggccgccgagaccugccaggagcccaaggaguucagacugcccaaggaccaccacuucgacaugaucaacaucaagagcauccccaagggcaagaucagcaucguggaggcccugacccugcugaacaaccacaagcuguuccccgagaccuggaccgccgagaagaucaugcaggaguaccagcuggagcagaaggacgugaacagccugcugaaguacuucgugaccuucgagguggagaucuucccccccgaggacaagaaggccaucagaagcaaguaa

SEQ ID NO: 20413 - RNA, 954 nt, Artificial Sequence
  NDUFAF5__Homo_sapiens__NP_001034464
augcugagacccgccggccuguggagacugugcagaagacccugggccgccagagugcccgccgagaaccugggcagaagagaggugaccagcggcgugagccccagaggcagcaccagccccagaacccugaacaucuucgacagagaccugaagagaaagcagaagaacugggccgccagacagcccgagcccaccaaguucgacuaccugaaggaggaggugggcagcagaaucgccgacagaguguacgacauccccagaaacuucccccuggcccuggaccugggcugcggcagaggcuacaucgcccaguaccugaacaagcugcagcuguuccacugcagaaagcugcuggagagcuucagcaagcugacccugcagaagaugcugugccugcacugggugaacgaccugcccagagcccuggagcagauccacuacauccugaagcccgacggcguguucaucggcgccauguucggcggcgacacccuguacgagcugagaugcagccugcagcuggccgagaccgagagagagggcggcuucagcccccacaucagccccuucaccgccgugaacgaccugggccaccugcugggcagagccggcuucaacacccugaccguggacaccgacgagauccaggugaacuaccccggcauguucgagcugauggaggaccugcagggcaugggcgagagcaacugcgccuggaacagaaaggcccugcugcacagagacaccaugcuggccgccgccgccguguacagagagauguacagaaacgaggacggcagcgugcccgccaccuaccagaucuacuacaugaucggcuggaaguaccacgagagccaggccagacccgccgagagaggcagcgccaccgugagcuucggcgagcugggcaagaucaacaaccugaugccccccggcaagaagagccaguaa

SEQ ID NO: 20414 - RNA, 1002 nt, Artificial Sequence
  NDUFAF6__Homo_sapiens__NP_689629
auggccgccagcgcccacggcagcguguggggcccccugagacugggcauccccggccugugcugcagaagacccccccugggccuguacgccagaaugagaagacugcccggccccgaggugagcggcagaagcguggccgccgccagcggccccggcgccuggggcaccgaccacuacugccuggagcugcugagaaagagagacuacgagggcuaccugugcagccugcugcugcccgccgagagcagaagcagcguguucgcccugagagccuucaacguggagcuggcccaggugaaggacagcgugagcgagaagaccaucggccugaugagaaugcaguucuggaagaagaccguggaggacaucuacugcgacaaccccccccaccagcccguggccaucgagcuguggaaggccgugaagagacacaaccugaccaagagauggcugaugaagaucguggacgagagagagaagaaccuggacgacaaggccuacagaaacaucaaggagcuggagaacuacgccgagaacacccagagcagccugcuguaccugacccuggagauccugggcaucaaggaccugcacgccgaccacgccgccagccacaucggcaaggcccagggcaucgugaccugccugagagccacccccuaccacggcagcagaagaaagguguuccugcccauggacaucugcaugcugcacggcgugagccaggaggacuuccugagaagaaaccaggacaagaacgugagagacgugaucuacgacaucgccagccaggcccaccugcaccugaagcacgccagaagcuuccacaagaccgugcccgugaaggccuuccccgccuuccugcagaccgugagccuggaggacuuccugaagaagauccagagaguggacuucgacaucuuccaccccagccugcagcagaagaacacccugcugccccuguaccuguacauccagagcuggagaaagaccuacuaa

SEQ ID NO: 20415 - RNA, 519 nt, Artificial Sequence
  NDUFB10__Homo_sapiens__NP_004539
augcccgacagcugggacaaggacguguaccccgagccccccagaagaacccccgugcagcccaaccccaucguguacaugaugaaggccuucgaccugaucguggacagacccgugacccuggugagagaguucaucgagagacagcacgccaagaacagauacuacuacuaccacagacaguacagaagagugcccgacaucaccgagugcaaggaggaggacaucaugugcauguacgaggccgagaugcaguggaagagagacuacaagguggaccaggagaucaucaacaucaugcaggacagacugaaggccugccagcagagagagggccagaacuaccagcagaacugcaucaaggagguggagcaguucacccagguggccaaggccuaccaggacagauaccaggaccugggcgccuacagcagcgccagaaagugccuggccaagcagagacagagaaugcugcaggagagaaaggccgccaaggaggccgccgccgccaccagcuaa

SEQ ID NO: 20416 - RNA, 462 nt, Artificial Sequence
  NDUFB11__Homo_sapiens__NP_001129470
auggccgccggccuguucggccugagcgccagaagacugcuggccgccgccgccaccagaggccugcccgccgccagagugagaugggagagcagcuucagcagaaccgugguggcccccagcgccguggccggcaagagaccccccgagcccaccacccccuggcaggaggaccccgagcccgaggacgagaaccuguacgagaagaaccccgacagccacggcuacgacaaggaccccgugcuggacguguggaacaugagacugguguucuucuucggcgugagcaucauccuggugcugggcagcaccuucguggccuaccugcccgacuacagaaugaaggaguggagcagaagagaggccgagagacuggugaaguacagagaggccaacggccugcccaucauggagagcaacugcuucgaccccagcaagauccagcugcccgaggacgaguaa

SEQ ID NO: 20417 - RNA, 318 nt, Artificial Sequence
  NDUFB2__Homo_sapiens__NP_004537
augagcgcccugaccagacuggccagcuucgccagagugggcggcagacuguucagaagcggcugcgccagaaccgccggcgacggcggcgugagacacgccggcggcggcgugcacaucgagcccagauacagacaguucccccagcugaccagaagccagguguuccagagcgaguucuucagcggccugaugugguucuggauccuguggagauucuggcacgacagcgaggaggugcugggccacuuccccuaccccgaccccagccaguggaccgacgaggagcugggcaucccccccgacgacgaggacuaa

SEQ ID NO: 20418 - RNA, 297 nt, Artificial Sequence
  NDUFB3__Homo_sapiens__NP_001244031
auggcccacgagcacggccacgagcacggccaccacaagauggagcugcccgacuacagacaguggaagaucgagggcaccccccuggagaccauccagaagaagcuggccgccaagggccugagagaccccuggggcagaaacgaggccuggagauacaugggcggcuucgccaagagcgugagcuucagcgacguguucuucaagggcuucaaguggggcuucgccgccuucgugguggccgugggcgccgaguacuaccuggagagccugaacaaggacaagaagcaccacuaa

SEQ ID NO: 20419 - RNA, 363 nt, Artificial Sequence
  NDUFB4__Homo_sapiens__NP_001161803
augagcuuccccaaguacaagcccagcagccugagaacccugcccgagacccuggaccccgccgaguacaacaucagccccgagaccagaagagcccaggccgagagacuggccaucagagcccagcugaagagagaguaccugcugcaguacaacgaccccaacagaagaggccugaucgagaaccccgcccugcugagaugggccuacgccagaaccaucaacguguaccccaacuucagacccacccccaagaacagccugaugggcgcccugugcggcuucggcccccugaucuucaucuacuacaucaucaagaccgagagagugagcauccagaccagaugccugguguucgaguaa

SEQ ID NO: 20420 - RNA, 414 nt, Artificial Sequence
  NDUFB5__Homo_sapiens__NP_001186886
auggccgccaugagccugcugagaagagugagcgugaccgccguggccgcccugagcggcagaccccugggcaccagacugggcuucggcggcuuccugaccagaggcuuccccaaggccgccggccaggccgagcuggccgagauccccgagggcuacgugcccgagcacugggaguacuacaagcaccccaucagcagauggaucgccagaaacuucuacgacagccccgagaagaucuacgagagaaccauggccgugcugcagaucgaggccgagaaggccgagcugagagugaaggagcuggaggugagaaagcugaugcacgugagaggcgacggccccugguacuacuacgagaccaucgacaaggagcugaucgaccacagccccaaggccacccccgacaacuaa

SEQ ID NO: 20421 - RNA, 387 nt, Artificial Sequence
  NDUFB6__Homo_sapiens__NP_002484
augaccggcuacacccccgacgagaagcugagacugcagcagcugagagagcugagaagaagauggcugaaggaccaggagcugagccccagagagcccgugcugcccccccagaagaugggccccauggagaaguucuggaacaaguuccuggagaacaagagccccuggagaaagauggugcacggcguguacaagaagagcaucuucguguucacccacgugcuggugcccguguggaucauccacuacuacaugaaguaccacgugagcgagaagcccuacggcaucguggagaagaagagcagaaucuuccccggcgacaccauccuggagaccggcgaggugaucccccccaugaaggaguuccccgaccagcaccacuaa

SEQ ID NO: 20422 - RNA, 519 nt, Artificial Sequence
  NDUFB8__Homo_sapiens__NP_001271296
auggccguggccagagccggcgugcugggcgugcaguggcugcagagagccagcagaaacgugaugccccugggcgccagaaccgccagccacaugaccaaggacauguuccccggccccuaccccagaacccccgaggagagagccgccgccgccaagaaguacaacaugagaguggaggacuacgagcccuaccccgacgacggcaugggcuacggcgacuaccccaagcugcccgacagaagccagcacgagagagaccccugguacagcugggaccagcccggccugagacugaacuggggcgagcccaugcacuggcaccuggacauguacaacagaaacagaguggacaccagccccacccccgugagcuggcacgugaugugcaugcagcuguucggcuuccuggccuucaugaucuucaugugcugggugggcgacguguaccccguguaccagcccgugugcagacaccacuucagcuacaaccugggcuuccugagcgcccugggcuaa

SEQ ID NO: 20423 - RNA, 540 nt, Artificial Sequence
  NDUFB9__Homo_sapiens__NP_004996
auggccuuccuggccagcggccccuaccugacccaccagcagaaggugcugagacuguacaagagagcccugagacaccuggagagcuggugcgugcagagagacaaguacagauacuucgccugccugaugagagccagauucgaggagcacaagaacgagaaggacauggccaaggccacccagcugcugaaggaggccgaggaggaguucugguacagacagcacccccagcccuacaucuuccccgacagccccggcggcaccagcuacgagagauacgacugcuacaaggugcccgaguggugccuggacgacuggcaccccagcgagaaggccauguaccccgacuacuucgccaagagagagcaguggaagaagcugagaagagagagcugggagagagaggugaagcagcugcaggaggagaccccccccggcggcccccugaccgaggcccugccccccgccagaaaggagggcgaccugcccccccuguggugguacaucgugaccagacccagagagagacccauguaa

SEQ ID NO: 20424 - RNA, 267 nt, Artificial Sequence
  NDUFC2__Homo_sapiens__NP_001190983
augaucgccagaagaaaccccgagccccugagauuccugcccgacgaggccagaagccugcccccccccaagcugaccgaccccagacugcuguacaucggcuuccugggcuacugcagcggccugaucgacaaccugaucagaagaagacccaucgccaccgccggccugcacagacagcugcuguacaucaccgccuucuucuucgccggcuacuaccuggugaagcuggaggccuacgccaaccuguacguggacacccuguaa

SEQ ID NO: 20425 - RNA, 2076 nt, Artificial Sequence
  NDUFS1__Homo_sapiens__NP_001186910
augcugagaauccccgugagaaaggcccuggugggccugagcaagagccccaagggcugcgugagaaccaccgccaccgccgccagcaaccugaucgagguguucguggacggccagagcgugaugguggagcccggcaccaccgugcugcaggugguggccgccugcgccaugcccgugaugaagggcuggaacauccugaccaacagcgagaagagcaagaaggccagagagggcgugauggaguuccugcuggccaaccacccccuggacugccccaucugcgaccagggcggcgagugcgaccugcaggaccagagcaugauguucggcaacgacagaagcagauuccuggagggcaagagagccguggaggacaagaacaucggcccccuggugaagaccaucaugaccagaugcauccagugcaccagaugcaucagauucgccagcgagaucgccggcguggacgaccugggcaccaccggcagaggcaacgacaugcaggugggcaccuacaucgagaagauguucaugagcgagcugagcggcaacaucaucgacaucugccccgugggcgcccugaccagcaagcccuacgccuucaccgccagacccugggagaccagaaagaccgagagcaucgacgugauggacgccgugggcagcaacaucguggugagcaccagaaccggcgaggugaugagaauccugcccagaaugcacgaggacaucaacgaggaguggaucagcgacaagaccagauucgccuacgacggccugaagagacagagacugaccgagcccauggugagaaacgagaagggccugcugaccuacaccagcugggaggacgcccugagcagaguggccggcaugcugcagagcuuccagggcaaggacguggccgccaucgccggcggccugguggacgccgaggcccugguggcccugaaggaccugcugaacagaguggacagcgacacccugugcaccgaggagguguuccccaccgccggcgccggcaccgaccugagaagcaacuaccugcugaacaccaccaucgccggcguggaggaggccgacguggugcugcuggugggcaccaaccccagauucgaggccccccuguucaacgccagaaucagaaagagcuggcugcacaacgaccugaagguggcccugaucggcagccccguggaccugaccuacaccuacgaccaccugggcgacagccccaagauccugcaggacaucgccagcggcagccaccccuucagccaggugcugaaggaggccaagaagcccaugguggugcugggcagcagcgcccugcagagaaacgacggcgccgccauccuggccgccgugagcagcaucgcccagaagaucagaaugaccagcggcgugaccggcgacuggaaggugaugaacauccugcacagaaucgccagccagguggccgcccuggaccugggcuacaagcccggcguggaggccaucagaaagaacccccccaaggugcuguuccugcugggcgccgacggcggcugcaucaccagacaggaccugcccaaggacugcuucaucaucuaccagggccaccacggcgacgugggcgcccccaucgccgacgugauccugcccggcgccgccuacaccgagaagagcgccaccuacgugaacaccgagggcagagcccagcagaccaagguggccgugaccccccccggccuggccagagaggacuggaagaucaucagagcccugagcgagaucgccggcaugacccugcccuacgacacccuggaccaggugagaaacagacuggaggaggugagccccaaccuggugagauacgacgacaucgagggcgccaacuacuuccagcaggccaacgagcugagcaagcuggugaaccagcagcugcuggccgacccccuggugcccccccagcugaccaucaaggacuucuacaugaccgacagcaucagcagagccagccagaccauggccaagugcgugaaggccgugaccgagggcgcccaggccguggaggagcccagcaucugcuaa

SEQ ID NO: 20426 - RNA, 1374 nt, Artificial Sequence
  NDUFS2__Homo_sapiens__NP_001159631
auggccgcccugagagcccugugcggcuucagaggcguggccgcccaggugcugagacccggcgccggcgugagacugcccauccagcccagcagaggcgugagacaguggcagcccgacguggagugggcccagcaguucggcggcgccgugauguaccccagcaaggagaccgcccacuggaagcccccccccuggaacgacguggacccccccaaggacaccaucgugaagaacaucacccugaacuucggcccccagcaccccgccgcccacggcgugcugagacuggugauggagcugagcggcgagauggugagaaagugcgacccccacaucggccugcugcacagaggcaccgagaagcugaucgaguacaagaccuaccugcaggcccugcccuacuucgacagacuggacuacgugagcaugaugugcaacgagcaggccuacagccuggccguggagaagcugcugaacaucagacccccccccagagcccaguggaucagagugcuguucggcgagaucaccagacugcugaaccacaucauggccgugaccacccacgcccuggaccugggcgccaugacccccuucuucuggcuguucgaggagagagagaagauguucgaguucuacgagagagugagcggcgccagaaugcacgccgccuacaucagacccggcggcgugcaccaggaccugccccugggccugauggacgacaucuaccaguucagcaagaacuucagccugagacuggacgagcuggaggagcugcugaccaacaacagaaucuggagaaacagaaccaucgacaucggcguggugaccgccgaggaggcccugaacuacggcuucagcggcgugaugcugagaggcagcggcauccagugggaccugagaaagacccagcccuacgacguguacgaccagguggaguucgacgugcccgugggcagcagaggcgacugcuacgacagauaccugugcagaguggaggagaugagacagagccugagaaucaucgcccagugccugaacaagaugccccccggcgagaucaagguggacgacgccaaggugagcccccccaagagagccgagaugaagaccagcauggagagccugauccaccacuucaagcuguacaccgagggcuaccaggugccccccggcgccaccuacaccgccaucgaggcccccaagggcgaguucggcguguaccuggugagcgacggcagcagcagacccuacagaugcaagaucaaggcccccggcuucgcccaccuggccggccuggacaagaugagcaagggccacaugcuggccgacgugguggccaucaucggcaccagacccaucguguaa

SEQ ID NO: 20427 - RNA, 795 nt, Artificial Sequence
  NDUFS3__Homo_sapiens__NP_004542
auggccgccgccgccguggccagacugugguggagaggcauccugggcgccagcgcccugaccagaggcaccggcagacccagcgugcugcugcugcccgugagaagagagagcgccggcgccgacaccagacccaccgugagacccagaaacgacguggcccacaagcagcugagcgccuucggcgaguacguggccgagauccugcccaaguacgugcagcaggugcaggugagcugcuucaacgagcuggaggugugcauccaccccgacggcgugauccccgugcugaccuuccugagagaccacaccaacgcccaguucaagagccugguggaccugaccgccguggacgugcccaccagacagaacagauucgagaucguguacaaccugcugagccugagauucaacagcagaaucagagugaagaccuacaccgacgagcugacccccaucgagagcgccgugagcguguucaaggccgccaacugguacgagagagagaucugggacauguucggcguguucuucgccaaccaccccgaccugagaagaauccugaccgacuacggcuucgagggccaccccuucagaaaggacuucccccugagcggcuacguggagcugagauacgacgacgaggugaagagagugguggccgagcccguggagcuggcccaggaguucagaaaguucgaccugaacagccccugggaggccuuccccguguacagacagccccccgagagccugaagcuggaggccggcgacaagaagcccgacgccaaguaa

SEQ ID NO: 20428 - RNA, 528 nt, Artificial Sequence
  NDUFS4__Homo_sapiens__NP_002486
auggccgccgugagcaugagcguggugcugagacagacccuguggagaagaagagccguggccguggccgcccugagcgugagcagagugcccaccagaagccugagaaccagcaccuggagacuggcccaggaccagacccaggacacccagcugaucaccguggacgagaagcuggacaucaccacccugaccggcgugcccgaggagcacaucaagaccagaaaggugagaaucuucgugcccgccagaaacaacaugcagagcggcgugaacaacaccaagaaguggaagauggaguucgacaccagagagagaugggagaacccccugaugggcugggccagcaccgccgacccccugagcaacauggugcugaccuucagcaccaaggaggacgccgugagcuucgccgagaagaacggcuggagcuacgacaucgaggagagaaaggugcccaagcccaagagcaagagcuacggcgccaacuucagcuggaacaagagaaccagagugagcaccaaguaa

SEQ ID NO: 20429 - RNA, 375 nt, Artificial Sequence
  NDUFS6__Homo_sapiens__NP_004544
auggccgccgccaugaccuucugcagacugcugaacagaugcggcgaggccgccagaagccugccccugggcgccagaugcuucggcgugagagugagccccaccggcgagaaggugacccacaccggccagguguacgacgacaaggacuacagaagaaucagauucgugggcagacagaaggaggugaacgagaacuucgccaucgaccugaucgccgagcagcccgugagcgagguggagaccagagugaucgccugcgacggcggcggcggcgcccugggccaccccaagguguacaucaaccuggacaaggagaccaagaccggcaccugcggcuacugcggccugcaguucagacagcaccaccacuaa

SEQ ID NO: 20430 - RNA, 642 nt, Artificial Sequence
  NDUFS7__Homo_sapiens__NP_077718
auggccgugcugagcgcccccggccugagaggcuucagaauccugggccugagaagcagcgugggccccgccgugcaggccagaggcgugcaccagagcguggccaccgacggccccagcagcacccagcccgcccugcccaaggccagagccguggcccccaagcccagcagcagaggcgaguacgugguggccaagcuggacgaccuggugaacugggccagaagaagcagccuguggcccaugaccuucggccuggccugcugcgccguggagaugaugcacauggccgcccccagauacgacauggacagauucggcgugguguucagagccagccccagacagagcgacgugaugaucguggccggcacccugaccaacaagauggcccccgcccugagaaagguguacgaccagaugcccgagcccagauacguggugagcaugggcagcugcgccaacggcggcggcuacuaccacuacagcuacagcguggugagaggcugcgacagaaucgugcccguggacaucuacauccccggcugcccccccaccgccgaggcccugcuguacggcauccugcagcugcagagaaagaucaagagagagagaagacugcagaucugguacagaagauaa

SEQ ID NO: 20431 - RNA, 633 nt, Artificial Sequence
  NDUFS8__Homo_sapiens__NP_002487
augagaugccugaccacccccaugcugcugagagcccuggcccaggccgccagagccggcccccccggcggcagaagccugcacagcagcgccguggccgccaccuacaaguacgugaacaugcaggaccccgagauggacaugaagagcgugaccgacagagccgccagaacccugcuguggaccgagcuguucagaggccugggcaugacccugagcuaccuguucagagagcccgccaccaucaacuaccccuucgagaagggcccccugagccccagauucagaggcgagcacgcccugagaagauaccccagcggcgaggagagaugcaucgccugcaagcugugcgaggccaucugccccgcccaggccaucaccaucgaggccgagcccagagccgacggcagcagaagaaccaccagauacgacaucgacaugaccaagugcaucuacugcggcuucugccaggaggccugccccguggacgccaucguggagggccccaacuucgaguucagcaccgagacccacgaggagcugcuguacaacaaggagaagcugcugaacaacggcgacaagugggaggccgagaucgccgccaacauccaggccgacuaccuguacagauaa

SEQ ID NO: 20432 - RNA, 1368 nt, Artificial Sequence
  NDUFV1__Homo_sapiens__NP_001159574
augcuggccaccagaagacugcugggcuggagccugcccgccagaaccgcccccaagaagaccagcuucggcagccugaaggacgaggacagaaucuucaccaaccuguacggcagacacgacuggagacugaagggcagccugagcagaggcgacugguacaagaccaaggagauccugcugaagggccccgacuggauccugggcgagaucaagaccagcggccugagaggcagaggcggcgccggcuuccccaccggccugaaguggagcuucaugaacaagcccagcgacggcagacccaaguaccugguggugaacgccgacgagggcgagcccggcaccugcaaggacagagagauccugagacacgacccccacaagcugcuggagggcugccuggugggcggcagagccaugggcgccagagccgccuacaucuacaucagaggcgaguucuacaacgaggccagcaaccugcagguggccaucagagaggccuacgaggccggccugaucggcaagaacgccugcggcagcggcuacgacuucgacguguucguggugagaggcgccggcgccuacaucugcggcgaggagaccgcccugaucgagagcaucgagggcaagcagggcaagcccagacugaagccccccuuccccgccgacgugggcguguucggcugccccaccaccguggccaacguggagaccguggccgugagccccaccaucugcagaagaggcggcaccugguucgccggcuucggcagagagagaaacagcggcaccaagcuguucaacaucagcggccacgugaaccaccccugcaccguggaggaggagaugagcgugccccugaaggagcugaucgagaagcacgccggcggcgugaccggcggcugggacaaccugcuggccgugauccccggcggcagcagcaccccccugauccccaagagcgugugcgagaccgugcugauggacuucgacgcccuggugcaggcccagaccggccugggcaccgccgccgugaucgugauggacagaagcaccgacaucgugaaggccaucgccagacugaucgaguucuacaagcacgagagcugcggccagugcacccccugcagagagggcguggacuggaugaacaaggugauggccagauucgugagaggcgacgccagacccgccgagaucgacagccugugggagaucagcaagcagaucgagggccacaccaucugcgcccugggcgacggcgccgccuggcccgugcagggccugaucagacacuucagacccgagcuggaggagagaaugcagagauucgcccagcagcaccaggccagacaggccgccagcuaa

SEQ ID NO: 20433 - RNA, 750 nt, Artificial Sequence
  NDUFV2__Homo_sapiens__NP_066552
auguucuucagcgccgcccugagagccagagccgccggccugaccgcccacuggggcagacacgugagaaaccugcacaagaccgugaugcagaacggcgccggcggcgcccuguucgugcacagagacacccccgagaacaaccccgacacccccuucgacuucacccccgagaacuacaagagaaucgaggccaucgugaagaacuaccccgagggccacaaggccgccgccgugcugcccgugcuggaccuggcccagagacagaacggcuggcugcccaucagcgccaugaacaagguggccgaggugcugcaggugccccccaugagaguguacgagguggccaccuucuacaccauguacaacagaaagcccgugggcaaguaccacauccaggugugcaccaccacccccugcaugcugagaaacagcgacagcauccuggaggccauccagaagaagcugggcaucaaggugggcgagaccacccccgacaagcuguucacccugaucgagguggagugccugggcgccugcgugaacgcccccauggugcagaucaacgacaacuacuacgaggaccugaccgccaaggacaucgaggagaucaucgacgagcugaaggccggcaagauccccaagcccggccccagaagcggcagauucagcugcgagcccgccggcggccugaccagccugaccgagccccccaagggccccggcuucggcgugcaggccggccuguaa

SEQ ID NO: 20434 - RNA, 327 nt, Artificial Sequence
  NDUFV3__Homo_sapiens__NP_001001503
auggccgcccccugccugcugagacagggcagagccggcgcccugaagaccaugcugcaggaggcccagguguucagaggccuggccagcaccgugagccugagcgccgagagcggcaagagcgagaagggccagccccagaacagcaagaagcagagcccccccaagaagcccgcccccgugcccgccgagcccuucgacaacaccaccuacaagaaccugcagcaccacgacuacagcaccuacaccuuccuggaccugaaccuggagcugagcaaguucagaaugccccagcccagcagcggcagagagagccccagacacuaa

SEQ ID NO: 20435 - RNA, 25578 nt, Artificial Sequence
  NEB__Homo_sapiens__NP_001157979
auggccgacgacgaggacuacgaggaggugguggaguacuacaccgaggaggugguguacgaggaggugcccggcgagaccaucaccaagaucuacgagaccaccaccaccagaaccagcgacuacgagcagagcgagaccagcaagcccgcccuggcccagcccgcccuggcccagcccgccagcgccaagcccguggagagaagaaaggugaucagaaagaagguggaccccagcaaguucaugacccccuacaucgcccacagccagaagaugcaggaccuguucagccccaacaaguacaaggagaaguucgagaagaccaagggccagcccuacgccagcaccaccgacacccccgagcugagaagaaucaagaaggugcaggaccagcugagcgaggugaaguacagaauggacggcgacguggccaagaccaucugccacguggacgagaaggccaaggacaucgagcacgccaagaaggugagccagcaggugagcaaggugcuguacaagcagaacugggaggacaccaaggacaaguaccugcugccccccgacgcccccgagcuggugcaggccgugaagaacaccgccauguucagcaagaagcuguacaccgaggacugggaggccgacaagagccuguucuaccccuacaacgacagccccgagcugagaagaguggcccaggcccagaaggcccugagcgacguggccuacaagaagggccuggccgagcagcaggcccaguucaccccccuggccgacccccccgacaucgaguucgccaagaaggugaccaaccaggugagcaagcagaaguacaaggaggacuacgagaacaagaucaagggcaaguggagcgagacccccugcuucgagguggccaacgccagaaugaacgccgacaacaucagcaccagaaaguaccaggaggacuucgagaacaugaaggaccagaucuacuucaugcagaccgagacccccgaguacaagaugaacaagaaggccggcguggccgccagcaaggugaaguacaaggaggacuacgagaagaacaagggcaaggccgacuacaacgugcugcccgccagcgagaacccccagcugagacagcugaaggccgccggcgacgcccugagcgacaagcuguacaaggagaacuacgagaagaccaaggccaagagcaucaacuacugcgagacccccaaguucaagcuggacaccgugcugcagaacuucagcagcgacaagaaguacaaggacagcuaccugaaggacauccugggccacuacgugggcagcuucgaggaccccuaccacagccacugcaugaaggugaccgcccagaacagcgacaagaacuacaaggccgaguacgaggaggacagaggcaagggcuucuucccccagaccaucacccaggaguacgaggccaucaagaagcuggaccagugcaaggaccacaccuacaaggugcaccccgacaagaccaaguucacccaggugaccgacagccccgugcugcugcaggcccaggugaacagcaagcagcugagcgaccugaacuacaaggccaagcacgagagcgagaaguucaagugccacaucccccccgacacccccgccuucauccagcacaaggugaacgccuacaaccugagcgacaaccuguacaagcaggacugggagaagagcaaggccaagaaguucgacaucaagguggacgccaucccccugcuggccgccaaggccaacaccaagaacaccagcgacgugauguacaagaaggacuacgagaagaacaagggcaagaugaucggcgugcugagcaucaacgacgaccccaagaugcugcacagccugaagguggccaagaaccagagcgacagacuguacaaggagaacuacgagaagaccaaggccaagagcaugaacuacugcgagacccccaaguaccagcuggacacccagcugaagaacuucagcgaggccagauacaaggaccuguacgugaaggacgugcugggccacuacgugggcagcauggaggaccccuaccacacccacugcaugaagguggccgcccagaacagcgacaagagcuacaaggccgaguacgaggaggacaagggcaagugcuacuucccccagaccaucacccaggaguacgaggccaucaagaagcuggaccagugcaaggaccacaccuacaaggugcaccccgacaagaccaaguucaccgccgugaccgacagccccgugcugcugcaggcccagcugaacaccaagcagcugagcgaccugaacuacaaggccaagcacgagggcgagaaguucaagugccacauccccgccgacgccccccaguucauccagcacagagugaacgccuacaaccugagcgacaacguguacaagcaggacugggagaagagcaaggccaagaaguucgacaucaagguggacgccaucccccugcuggccgccaaggccaacaccaagaacaccagcgacgugauguacaagaaggacuacgagaagagcaagggcaagaugaucggcgcccugagcaucaacgacgaccccaagaugcugcacagccugaagaccgccaagaaccagagcgacagagaguacagaaaggacuacgagaagagcaagaccaucuacaccgccccccuggacaugcugcaggugacccaggccaagaagagccaggccaucgccagcgacguggacuacaagcacauccugcacagcuacagcuacccccccgacagcaucaacguggaccuggccaagaaggccuacgcccugcagagcgacguggaguacaaggccgacuacaacagcuggaugaagggcugcggcugggugcccuucggcagccuggagauggagaaggccaagagagccagcgacauccugaacgagaagaaguacagacagcaccccgacacccugaaguucaccagcaucgaggacgcccccaucaccgugcagagcaagaucaaccaggcccagagaagcgacaucgccuacaaggccaagggcgaggagaucauccacaaguacaaccugccccccgaccugccccaguucauccaggccaaggugaacgccuacaacaucagcgagaacauguacaaggccgaccugaaggaccugagcaagaagggcuacgaccugagaaccgacgccauccccaucagagccgccaaggccgccagacaggccgccagcgacgugcaguacaagaaggacuacgagaaggccaagggcaagauggugggcuuccagagccugcaggacgaccccaagcuggugcacuacaugaacguggccaagauccagagcgacagagaguacaagaaggacuacgagaagaccaagagcaaguacaacaccccccacgacauguucaacgugguggccgccaagaaggcccaggacguggugagcaacgugaacuacaagcacagccugcaccacuacaccuaccugcccgacgccauggaccuggagcugagcaagaacaugaugcagauccagagcgacaacguguacaaggaggacuacaacaacuggaugaagggcaucggcuggauccccaucggcagccuggacguggagaaggugaagaaggccggcgacgcccugaacgagaagaaguacagacagcaccccgacacccugaaguucaccagcaucguggacagccccgugauggugcaggccaagcagaacaccaagcaggugagcgacauccuguacaaggccaagggcgaggacgugaagcacaaguacaccaugagccccgaccugccccaguuccugcaggccaagugcaacgccuacaacaucagcgacgugugcuacaagagagacuggcacgaccugaucgccaagggcaacaacgugcugggcgacgccauccccaucaccgccgccaaggccagcagaaacaucgccagcgacuacaaguacaaggaggccuacgagaagagcaagggcaagcacgugggcuucagaagccugcaggacgaccccaagcuggugcacuacaugaacguggccaagcugcagagcgacagagaguacaagaagaacuacgagaacaccaagaccagcuaccacacccccggcgacauggugagcaucaccgccgccaagauggcccaggacguggccaccaacgugaacuacaagcagccccugcaccacuacaccuaccugcccgacgccaugagccuggagcacaccagaaacgugaaccagauccagagcgacaacguguacaaggacgaguacaacagcuuccugaagggcaucggcuggauccccaucggcagccuggagguggagaaggugaagaaggccggcgacgcccugaacgagagaaaguacagacagcaccccgacaccgugaaguucaccagcgugcccgacagcaugggcauggugcuggcccagcacaacaccaagcagcugagcgaccugaacuacaagguggagggcgagaagcugaagcacaaguacaccaucgaccccgagcugccccaguucauccaggccaaggugaacgcccugaacaugagcgacgcccacuacaaggccgacuggaagaagaccaucgccaagggcuacgaccugagacccgacgccauccccaucguggccgccaagagcagcagaaacaucgccagcgacugcaaguacaaggaggccuacgagaaggccaagggcaagcaggugggcuuccugagccugcaggacgaccccaagcuggugcacuacaugaacguggccaagauccagagcgacagagaguacaagaagggcuacgaggccagcaagaccaaguaccacaccccccuggacauggugagcgugaccgccgccaagaagagccaggagguggccaccaacgccaacuacagacagagcuaccaccacuacacccugcugcccgacgcccugaacguggagcacagcagaaacgccaugcagauccagagcgacaaccuguacaagagcgacuucaccaacuggaugaagggcaucggcugggugcccaucgagagccuggagguggagaaggccaagaaggccggcgagauccugagcgagaagaaguacagacagcaccccgagaagcugaaguucaccuacgccauggacaccauggagcaggcccugaacaagagcaacaagcugaacauggacaagagacuguacaccgagaaguggaacaaggacaagaccaccauccacgugaugcccgacacccccgacauccugcugagcagagugaaccagaucaccaugagcgacaagcuguacaaggccggcugggaggaggagaagaagaagggcuacgaccugagacccgacgccaucgccaucaaggccgccagagccagcagagacaucgccagcgacuacaaguacaagaaggccuacgagcaggccaagggcaagcacaucggcuucagaagccuggaggacgaccccaagcuggugcacuucaugcagguggccaagaugcagagcgacagagaguacaagaagggcuacgagaagagcaagaccagcuuccacacccccguggacaugcugagcgugguggccgccaagaagagccaggagguggccaccaacgccaacuacagaaacgugauccacaccuacaacaugcugcccgacgccaugagcuucgagcuggccaagaacaugaugcagauccagagcgacaaccaguacaaggccgacuacgccgacuucaugaagggcaucggcuggcugccccugggcagccuggaggccgagaagaacaagaaggccauggagaucaucagcgagaagaaguacagacagcaccccgacacccugaaguacagcacccugauggacagcaugaacauggugcuggcccagaacaacgccaagaucaugaacgagcaccuguacaagcaggccugggaggccgacaagaccaaggugcacaucaugcccgacaucccccagaucauccuggccaaggccaacgccaucaacaugagcgacaagcuguacaagcugagccuggaggagagcaagaagaagggcuacgaccugagacccgacgccauccccaucaaggccgccaaggccagcagagacaucgccagcgacuacaaguacaaguacaacuacgagaagggcaagggcaagauggugggcuucagaagccuggaggacgaccccaagcuggugcacagcaugcagguggccaagaugcagagcgacagagaguacaagaagaacuacgagaacaccaagaccagcuaccacacccccgccgacaugcugagcgugaccgccgccaaggacgcccaggccaacaucaccaacaccaacuacaagcaccugauccacaaguacauccugcugcccgacgccaugaacaucgagcugaccagaaacaugaacagaauccagagcgacaacgaguacaagcaggacuacaacgagugguacaagggccugggcuggagccccgccggcagccuggagguggagaaggccaagaaggccaccgaguacgccagcgaccagaaguacagacagcaccccagcaacuuccaguucaagaagcugaccgacagcauggacauggugcuggccaagcagaacgcccacaccaugaacaagcaccuguacaccaucgacuggaacaaggacaagaccaagauccacgugaugcccgacacccccgacauccugcaggccaagcagaaccagacccuguacagccagaagcuguacaagcugggcugggaggaggcccugaagaagggcuacgaccugcccguggacgccaucagcgugcagcuggccaaggccagcagagacaucgccagcgacuacaaguacaagcagggcuacagaaagcagcugggccaccacgugggcuucagaagccugcaggacgaccccaagcuggugcugagcaugaacguggccaagaugcagagcgagagagaguacaagaaggacuucgagaaguggaagaccaaguucagcagccccguggacaugcugggcguggugcuggccaagaagugccaggagcuggugagcgacguggacuacaagaacuaccugcaccaguggaccugccugcccgaccagaacgacguggugcaggccaagaagguguacgagcugcagagcgagaaccuguacaagagcgaccuggaguggcugagaggcaucggcuggagcccccugggcagccuggaggccgagaagaacaagagagccagcgagaucaucagcgagaagaaguacagacagccccccgacagaaacaaguucaccagcauccccgacgccauggacaucgugcuggccaagaccaacgccaagaacagaagcgacagacuguacagagaggccugggacaaggacaagacccagauccacaucaugcccgacacccccgacaucgugcuggccaaggccaaccugaucaacaccagcgacaagcuguacagaaugggcuacgaggagcugaagagaaagggcuacgaccugcccguggacgccauccccaucaaggccgccaaggccagcagagagaucgccagcgaguacaaguacaaggagggcuucagaaagcagcugggccaccacaucggcgccagaaacaucgaggacgaccccaagaugauguggagcaugcacguggccaagauccagagcgacagagaguacaagaaggacuucgagaaguggaagaccaaguucagcagccccguggacaugcugggcguggugcuggccaagaagugccagacccuggugagcgacguggacuacaagaacuaccugcaccaguggaccugccugcccgaccagagcgacgugauccacgccagacaggccuacgaccugcagagcgacaaccuguacaagagcgaccugcaguggcugaagggcaucggcuggaugaccagcggcagccuggaggacgagaagaacaagagagccacccagauccugagcgaccacguguacagacagcaccccgaccaguucaaguucagcagccugauggacagcauccccauggugcuggccaagaacaacgccaucaccaugaaccacagacuguacaccgaggccugggacaaggacaagaccaccgugcacaucaugcccgacacccccgaggugcugcuggccaagcagaacaaggugaacuacagcgagaagcuguacaagcugggccuggaggaggccaagagaaagggcuacgacaugagaguggacgccauccccaucaaggccgccaaggccagcagagacaucgccagcgaguucaaguacaaggagggcuacagaaagcagcugggccaccacaucggcgccagagccaucagagacgaccccaagaugauguggagcaugcacguggccaagauccagagcgacagagaguacaagaaggacuucgagaaguggaagaccaaguucagcagccccguggacaugcugggcguggugcuggccaagaagugccagacccuggugagcgacguggacuacaagaacuaccugcaccaguggaccugccugcccgaccagagcgacgugauccacgccagacaggccuacgaccugcagagcgacaacauguacaagagcgaccugcaguggaugagaggcaucggcugggugagcaucggcagccuggacguggagaagugcaagagagccaccgagauccugagcgacaagaucuacagacagccccccgacagauucaaguucaccagcgugaccgacagccuggagcaggugcuggccaagaacaacgccaucaccaugaacaagagacuguacaccgaggccugggacaaggacaagacccagauccacaucaugcccgacacccccgagaucaugcuggccagaaugaacaagaucaacuacagcgagagccuguacaagcuggccaacgaggaggccaagaagaagggcuacgaccugagaagcgacgccauccccaucguggccgccaaggccagcagagacaucaucagcgacuacaaguacaaggacggcuacugcaagcagcugggccaccacaucggcgccagaaacaucgaggacgaccccaagaugauguggagcaugcacguggccaagauccagagcgacagagaguacaagaaggacuucgagaaguggaagaccaaguucagcagccccguggacaugcugggcguggugcuggccaagaagugccagacccuggugagcgacguggacuacaagaacuaccugcacgaguggaccugccugcccgaccagagcgacgugauccacgccagacaggccuacgaccugcagagcgacaacaucuacaagagcgaccugcaguggcugagaggcaucggcugggugcccaucggcagcauggacguggugaagugcaagagagccaccgagauccugagcgacaacaucuacagacagccccccgacaagcugaaguucaccagcgugaccgacagccuggagcaggugcuggccaagaacaacgcccugaacaugaacaagagacuguacaccgaggccugggacaaggacaagacccagauccacaucaugcccgacacccccgagaucaugcuggccagacagaacaagaucaacuacagcgagacccuguacaagcuggccaacgaggaggccaagaagaagggcuacgaccugagaagcgacgccauccccaucguggccgccaaggccagcagagacgugaucagcgacuacaaguacaaggacggcuacagaaagcagcugggccaccacaucggcgccagaaacaucgaggacgaccccaagaugauguggagcaugcacguggccaagauccagagcgacagagaguacaagaaggacuucgagaaguggaagaccaaguucagcagccccguggacaugcugggcguggugcuggccaagaagugccagacccuggugagcgacguggacuacaagaacuaccugcacgaguggaccugccugcccgaccagaacgacgugauccacgccagacaggccuacgaccugcagagcgacaacaucuacaagagcgaccugcaguggcugagaggcaucggcugggugcccaucggcagcauggacguggugaagugcaagagagccgccgagauccugagcgacaacaucuacagacagccccccgacaagcugaaguucaccagcgugaccgacagccuggagcaggugcuggccaagaacaacgcccugaacaugaacaagagacuguacaccgaggccugggacaaggacaagacccaggugcacaucaugcccgacacccccgagaucaugcuggccagacagaacaagaucaacuacagcgagagccuguacagacaggccauggaggaggccaagaaggagggcuacgaccugagaagcgacgccauccccaucguggccgccaaggccagcagagacaucgccagcgacuacaaguacaaggaggccuacagaaagcagcugggccaccacaucggcgccagagccgugcacgacgaccccaagaucauguggagccugcacaucgccaaggugcagagcgacagagaguacaagaaggacuucgagaaguacaagaccagauacagcagccccguggacaugcugggcaucgugcuggccaagaagugccagacccuggugagcgacguggacuacaagcacccccugcacgaguggaucugccugcccgaccagaacgacaucauccacgccagaaaggccuacgaccugcagagcgacaaccuguacaagagcgaccuggaguggaugaagggcaucggcugggugcccaucgacagccuggagguggugagagccaagagagccggcgagcugcugagcgacaccaucuacagacagagacccgagacccugaaguucaccagcaucaccgacacccccgagcaggugcuggccaagaacaacgcccugaacaugaacaagagacuguacaccgaggccugggacaacgacaagaagaccauccacgugaugcccgacacccccgagaucaugcuggccaagcugaacagaaucaacuacagcgacaagcuguacaagcuggcccuggaggagagcaagaaggagggcuacgaccugagacuggacgccauccccauccaggccgccaaggccagcagagacaucgccagcgacuacaaguacaaggagggcuacagaaagcagcugggccaccacaucggcgccagaaacaucaaggacgaccccaagaugauguggagcauccacguggccaagauccagagcgacagagaguacaagaaggaguucgagaaguggaagaccaaguucagcagccccguggacaugcugggcguggugcuggccaagaagugccagauccuggugagcgacaucgacuacaagcacccccugcacgaguggaccugccugcccgaccagaacgacgugauccaggccagaaaggccuacgaccugcagagcgacgccaucuacaagagcgaccuggaguggcugagaggcaucggcugggugcccaucggcagcguggagguggagaaggugaagagagccggcgagauccugagcgacagaaaguacagacagcccgccgaccagcugaaguucaccugcaucaccgacacccccgagaucgugcuggccaagaacaacgcccugaccaugagcaagcaccuguacaccgaggccugggacgccgacaagaccagcauccacgugaugcccgacacccccgacauccugcuggccaagagcaacagcgccaacaucagccagaagcuguacaccaagggcugggacgagagcaagaugaaggacuacgaccugagagccgacgccaucagcaucaagagcgccaaggccagcagagacaucgccagcgacuacaaguacaaggaggccuacgagaagcagaagggccaccacaucggcgcccagagcaucgaggacgaccccaagaucaugugcgccauccacgccggcaagauccagagcgagagagaguacaagaaggaguuccagaaguggaagaccaaguucagcagccccguggacaugcugagcauccugcuggccaagaagugccagacccuggugaccgacaucgacuacagaaacuaccugcacgaguggaccugcaugcccgaccagaacgacaucauccaggccaagaaggccuacgaccugcagagcgacagcguguacaaggccgaccuggaguggcugagaggcaucggcuggaugcccgagggcagcguggagaugaacagagugaagguggcccaggaccuggugaacgagagacuguacagaaccagacccgaggcccugagcuucaccagcaucguggacacccccgagguggugcuggccaaggccaacagccugcagaucagcgagaagcuguaccaggaggccuggaacaaggacaagagcaacaucaccauccccagcgacacccccgagaugcugcaggcccacaucaacgcccugcagaucagcaacaagcuguaccagaaggacuggaacgacgccaagcagaagggcuacgacaucagagccgacgccaucgagaucaagcacgccaaggccagcagagagaucgccagcgaguacaaguacaaggagggcuacagaaagcagcugggccaccacaugggcuucagaacccugcaggacgaccccaagagcgugugggccauccacgccgccaagauccagagcgacagagaguacaagaaggccuacgagaagagcaagggcauccacaacaccccccuggacaugaugagcaucgugcaggccaagaagugccaggugcuggugagcgacaucgacuacagaaacuaccugcaccaguggaccugccugcccgaccagaacgacgugauccaggccaagaaggccuacgaccugcagagcgacaaccuguacaagagcgaccuggaguggcugaagggcaucggcuggcugcccgagggcagcguggaggugaugagagugaagaacgcccagaaccugcugaacgagagacuguacagaaucaagcccgaggcccugaaguucaccagcaucguggacacccccgaggugauccaggccaagaucaacgccgugcagaucagcgagccccuguacagagacgccugggagaaggagaaggccaacgugaacgugcccgccgacaccccccugaugcugcagagcaagaucaacgcccugcagaucagcaacaagagauaccagcaggccugggaggacgugaagaugaccggcuacgaccugagagccgacgccaucggcauccagcacgccaaggccagcagagacaucgccagcgacuaccuguacaagaccgccuacgagaagcagaagggccacuacaucggcugcagaagcgccaaggaggaccccaagcuggugugggccgccaacgugcugaagaugcagaacgacagacuguacaagaaggccuacaacgaccacaaggccaagaucagcauccccguggacauggugagcaucagcgccgccaaggagggccaggcccuggccagcgacguggacuacagacacuaccugcaccacuggagcugcuuccccgaccagaacgacgugauccaggccagaaaggccuacgaccugcagagcgacagcguguacaaggccgaccuggaguggcugagaggcaucggcuggaugcccgagggcagcguggagaugaacagagugaagguggcccaggaccuggugaacgagagacuguacagaaccagacccgaggcccugagcuucaccagcaucguggacacccccgagguggugcuggccaaggccaacagccugcagaucagcgagaagcuguaccaggaggccuggaacaaggacaagagcaacaucaccauccccagcgacacccccgagaugcugcaggcccacaucaacgcccugcagaucagcaacaagcuguaccagaaggacuggaacgacaccaagcagaagggcuacgacaucagagccgacgccaucgagaucaagcacgccaaggccagcagagagaucgccagcgaguacaaguacaaggagggcuacagaaagcagcugggccaccacaugggcuucagaacccugcaggacgaccccaagagcgugugggccauccacgccgccaagauccagagcgacagagaguacaagaaggccuacgagaagagcaagggcauccacaacaccccccuggacaugaugagcaucgugcaggccaagaagugccaggugcuggugagcgacaucgacuacagaaacuaccugcaccaguggaccugccugcccgaccagaacgacgugauccaggccaagaaggccuacgaccugcagagcgacaaccuguacaagagcgaccuggaguggcugaagggcaucggcuggcugcccgagggcagcguggaggugaugagagugaagaacgcccagaaccugcugaacgagagacuguacagaaucaagcccgaggcccugaaguucaccagcaucguggacacccccgaggugauccaggccaagaucaacgccgugcagaucagcgagccccuguacagaaacgccugggagaaggagaaggccaacgugaacgugcccgccgacaccccccugaugcugcagagcaagaucaacgcccugcagaucagcaacaagagauaccagcaggccugggaggacgugaagaugaccggcuacgaccugagagccgacgccaucggcauccagcacgccaaggccagcagagacaucgccagcgacuaccuguacaagaccgccuacgagaagcagaagggccacuacaucggcugcagaagcgccaaggaggaccccaagcuggugugggccgccaacgugcugaagaugcagaacgacagacuguacaagaaggccuacaacgaccacaaggccaagaucagcauccccguggacauggugagcaucagcgccgccaaggagggccaggcccuggccagcgacguggacuacagacacuaccugcaccacuggagcugcuuccccgaccagaacgacgugauccaggccagaaaggccuacgaccugcagagcgacagcguguacaaggccgaccuggaguggcugagaggcaucggcuggaugcccgagggcagcguggagaugaacagagugaagguggcccaggaccuggugaacgagagacuguacagaaccagacccgaggcccugagcuucaccagcaucguggacacccccgagguggugcuggccaaggccaacagccugcagaucagcgagaagcuguaccaggaggccuggaacaaggacaagagcaacaucaccauccccagcgacacccccgagaugcugcaggcccacaucaacgcccugcagaucagcaacaagcuguaccagaaggacuggaacgacaccaagcagaagggcuacgacaucagagccgacgccaucgagaucaagcacgccaaggccagcagagagaucgccagcgaguacaaguacaaggagggcuacagaaagcagcugggccaccacaugggcuucagaacccugcaggacgaccccaagagcgugugggccauccacgccgccaagauccagagcgacagagaguacaagaaggccuacgagaagagcaagggcauccacaacaccccccuggacaugaugagcaucgugcaggccaagaagugccaggugcuggugagcgacaucgacuacagaaacuaccugcaccaguggaccugccugcccgaccagaacgacgugauccaggccaagaaggccuacgaccugcagagcgacaaccuguacaagagcgaccuggaguggcugaagggcaucggcuggcugcccgagggcagcguggaggugaugagagugaagaacgcccagaaccugcugaacgagagacuguacagaaucaagcccgaggcccugaaguucaccagcaucguggacacccccgaggugauccaggccaagaucaacgccgugcagaucagcgagccccuguacagagacgccugggagaaggagaaggccaacgugaacgugcccgccgacaccccccugaugcugcagagcaagaucaacgcccugcagaucagcaacaagagauaccagcaggccugggaggacgugaagaugaccggcuacgaccugagagccgacgccaucggcauccagcacgccaaggccagcagagacaucgccagcgacuaccuguacaagaccgccuacgagaagcagaagggccacuacaucggcugcagaagcgccaaggaggaccccaagcuggugugggccgccaacgugcugaagaugcagaacgacagacuguacaagaaggccuacaacgaccacaaggccaagaucagcauccccguggacauggugagcaucagcgccgccaaggagggccaggcccuggccagcgacguggacuacagacacuaccugcacagauggagcugcuuccccgaccagaacgacgugauccaggccagaaaggccuacgaccugcagagcgacgcccuguacaaggccgaccuggaguggcugagaggcaucggcuggaugccccagggcagccccgaggugcugagagugaagaacgcccagaacaucuucugcgacagcguguacagaacccccguggugaaccugaaguacaccagcaucguggacacccccgagguggugcuggccaagagcaacgccgagaacaucagcauccccaaguacagagaggugugggacaaggacaagaccagcauccacaucaugcccgacacccccgagaucaaccuggccagagccaacgcccugaacgugagcaacaagcuguacagagagggcugggacgagaugaaggccggcugcgacgugagacuggacgccauccccauccaggccgccaaggccagcagagagaucgccagcgacuacaaguacaagcuggaccacgagaagcagaagggccacuacgugggcacccugaccgccagagacgacaacaagaucagaugggcccugaucgccgacaagcugcagaacgagagagaguacagacuggacugggccaaguggaaggccaagauccagagccccguggacaugcugagcauccugcacagcaagaacagccaggcccuggugagcgacauggacuacagaaacuaccugcaccaguggaccugcaugcccgaccagaacgacgugauccaggccaagaaggccuacgagcugcagagcgacaacguguacaaggccgaccuggaguggcugagaggcaucggcuggaugcccaacgacagcgugagcgugaaccacgccaagcacgccgccgacaucuucagcgagaagaaguacagaaccaagaucgagacccugaacuucacccccguggacgacagaguggacuacgugaccgccaagcagagcggcgagauccuggacgacaucaaguacagaaaggacuggaacgccaccaagagcaaguacacccugaccgagaccccccugcugcacaccgcccaggaggccgccagaauccuggaccaguaccuguacaaggagggcugggagagacagaaggccaccggcuacauccugccccccgacgccgugcccuucgugcacgcccaccacugcaacgacgugcagagcgagcugaaguacaaggccgagcacgugaagcagaagggccacuacgugggcgugcccaccaugagagacgaccccaagcuggugugguucgagcacgccggccagauccagaacgagagacuguacaaggaggacuaccacaagaccaaggccaagaucaacauccccgccgacauggugagcgugcuggccgccaagcagggccagacccuggugagcgacaucgacuacagaaacuaccugcaccaguggaugugccaccccgaccagaacgacgugauccaggccagaaaggccuacgaccugcagagcgacaacguguacagagccgaccuggaguggcugagaggcaucggcuggaucccccuggacagcguggaccacgugagagugaccaagaaccaggagaugaugagccagaucaaguacaagaagaacgcccuggagaacuaccccaacuucagaagcgugguggacccccccgagaucgugcuggccaagaucaacagcgugaaccagagcgacgugaaguacaaggagaccuucaacaaggccaagggcaaguacaccuucagccccgacaccccccacaucagccacagcaaggacaugggcaagcuguacagcaccauccuguacaagggcgccugggagggcaccaaggccuacggcuacacccuggacgagagauacauccccaucgugggcgccaagcacgccgaccuggugaacagcgagcugaaguacaaggagaccuacgagaagcagaagggccacuaccuggccggcaaggugaucggcgaguuccccggcguggugcacugccuggacuuccagaagaugagaagcgcccugaacuacagaaagcacuacgaggacaccaaggccaacgugcacauccccaacgacaugaugaaccacgugcuggccaagagaugccaguacauccugagcgaccuggaguacagacacuacuuccaccaguggaccagccugcuggaggagcccaacgugaucagagugagaaacgcccaggagauccugagcgacaacguguacaaggacgaccugaacuggcugaagggcaucggcugcuacgugugggacaccccccagauccugcacgccaagaagagcuacgaccugcagagccagcugcaguacaccgccgccggcaaggagaaccugcagaacuacaaccuggugaccgacaccccccuguacgugaccgccgugcagagcggcaucaacgccagcgaggugaaguacaaggagaacuaccaccagaucaaggacaaguacaccaccgugcuggagaccguggacuacgacagaaccagaaaccugaagaaccuguacagcagcaaccuguacaaggaggccugggacagagugaaggccaccagcuacauccugcccagcagcacccugagccugacccacgccaagaaccagaagcaccuggccagccacaucaaguacagagaggaguacgagaaguucaaggcccuguacacccugcccagaagcguggacgacgaccccaacaccgccagaugccugagagugggcaagcugaacaucgacagacuguacagaagcguguacgagaagaacaagaugaagauccacaucgugcccgacaugguggagauggugaccgccaaggacagccagaagaaggugagcgagaucgacuacagacugagacugcacgaguggaucugccaccccgaccugcaggugaacgaccacgugagaaaggugaccgaccagaucagcgacaucguguacaaggacgaccugaacuggcugaagggcaucggcugcuacgugugggacacccccgagauccugcacgccaagcacgccuacgaccugagagacgacaucaaguacaaggcccacaugcugaagaccagaaacgacuacaagcuggugaccgacacccccguguacgugcaggccgugaagagcggcaagcagcugagcgacgccguguaccacuacgacuacgugcacagcgugagaggcaagguggcccccaccaccaagaccguggaccuggacagagcccugcacgccuacaagcugcagagcagcaaccuguacaagaccagccugagaacccugcccaccggcuacagacugcccggcgacaccccccacuucaagcacaucaaggacaccagauacaugagcagcuacuucaaguacaaggaggccuacgagcacaccaaggccuacggcuacacccugggccccaaggacgugcccuucgugcacgugagaagagugaacaacgugaccagcgagagacuguacagagagcuguaccacaagcugaaggacaagauccacaccacccccgacacccccgagaucagacaggugaagaagacccaggaggccgugagcgagcugaucuacaagagcgacuucuucaagaugcagggccacaugaucagccugcccuacaccccccaggugauccacugcagauacgugggcgacaucaccagcgacaucaaguacaaggaggaccugcaggugcugaagggcuucggcugcuuccuguacgacacccccgacauggugagaagcagacaccugagaaagcuguggagcaacuaccuguacaccgacaaggccagaaagaugagagacaaguacaagguggugcuggacacccccgaguacagaaaggugcaggagcugaagacccaccugagcgagcugguguacagagccgccggcaagaagcagaagagcaucuucaccagcgugcccgacacccccgaccugcugagagccaagagaggccagaagcugcagagccaguaccuguacguggagcuggccaccaaggagagaccccaccaccacgccggcaaccagaccaccgcccugaagcacgccaaggacgugaaggacauggugagcgagaagaaguacaagauccaguacgagaagaugaaggacaaguacacccccgugcccgacacccccauccugaucagagccaagagagccuacuggaacgccagcgaccugagauacaaggagaccuuccagaagaccaagggcaaguaccacaccgugaaggacgcccuggacaucguguaccacagaaaggugaccgacgacaucagcaagaucaaguacaaggagaacuacaugagccagcugggcaucuggagaagcauccccgacagacccgagcacuuccaccacagagccgugaccgacaccgugagcgacgugaaguacaaggaggaccugaccuggcugaagggcaucggcugcuacgccuacgacacccccgacuucacccuggccgagaagaacaagacccuguacagcaaguacaaguacaaggagguguucgagagaaccaagagcgacuucaaguacguggccgacagccccaucaacagacacuucaaguacgccacccagcugaugaacgagaagaaguacagagccgacuacgagcagagaaaggacaaguaccaccuggugguggacgagcccagacaccugcuggccaagaccgccggcgaccagaucagccagaucaaguacagaaagaacuacgagaagagcaaggacaaguucaccagcaucguggacacccccgagcaccugagaaccaccaaggugaacaagcagaucagcgacauccuguacaagcuggaguacaacaaggccaagcccagaggcuacaccaccauccacgacacccccaugcugcugcacgugagaaaggugaaggacgaggugagcgaccugaaguacaaggagguguaccagagaaacaagagcaacugcaccaucgagcccgacgccgugcacaucaaggccgccaaggacgccuacaaggugaacaccaaccuggacuacaagaagcaguacgaggccaacaaggcccacuggaaguggacccccgacagacccgacuuccugcaggccgccaagagcagccugcagcagagcgacuucgaguacaagcuggacagagaguuccugaagggcugcaagcugagcgugaccgacgacaagaacaccgugcuggcccugagaaacacccugaucgagagcgaccugaaguacaaggagaagcacgugaaggagagaggcaccugccacgccgugcccgacaccccccagauccugcuggccaagaccgugagcaaccuggugagcgagaacaaguacaaggaccacgugaagaagcaccuggcccagggcagcuacaccacccugcccgagaccagagacaccgugcacgugaaggaggugaccaagcacgugagcgacaccaacuacaagaagaaguucgugaaggagaagggcaagagcaacuacagcaucaugcuggagccccccgaggugaagcacgccauggagguggccaagaagcagagcgacguggccuacagaaaggacgccaaggagaaccugcacuacaccaccguggccgacagacccgacaucaagaaggccacccaggccgccaagcaggccagcgagguggaguacagagccaagcacagaaaggagggcagccacggccugagcaugcugggcagacccgacaucgagauggccaagaaggccgccaagcugagcagccaggugaaguacagagagaacuucgacaaggagaagggcaagacccccaaguacaaccccaaggacagccagcuguacaaggugaugaaggacgccaacaaccuggccagcgaggugaaguacaaggccgaccugaagaagcugcacaagcccgugaccgacaugaaggagagccugaucaugaaccacgugcugaacaccagccagcuggccagcagcuaccaguacaagaagaaguacgagaagagcaagggccacuaccacaccauccccgacaaccuggagcagcugcaccugaaggaggccaccgagcugcagagcaucgugaaguacaaggagaaguacgagaaggagagaggcaagcccaugcuggacuucgagacccccaccuacaucaccgccaaggagagccagcagaugcagagcggcaaggaguacagaaaggacuacgaggagagcaucaagggcagaaaccugaccggccuggaggugacccccgcccugcugcacgugaaguacgccaccaagaucgccagcgagaaggaguacagaaaggaccuggaggagagcaucagaggcaagggccugaccgagauggaggacacccccgacaugcugagagccaagaacgccacccagauccugaacgagaaggaguacaagagagaccuggagcuggaggugaagggcagaggccugaacgccauggccaacgagacccccgacuucaugagagccagaaacgccaccgacaucgccagccagaucaaguacaagcagagcgccgagauggagaaggccaacuucaccagcgugguggacacccccgagaucauccacgcccagcaggugaagaaccugagcagccagaagaaguacaaggaggacgccgagaagagcaugagcuacuacgagaccgugcuggacacccccgagauccagagagugagagagaaccagaagaacuucagccugcugcaguaccagugcgaccugaagaacagcaagggcaagaucaccguggugcaggacacccccgagauccugagagugaaggagaaccagaagaacuucagcagcgugcuguacaaggaggacgugagccccggcaccgccaucggcaagacccccgagaugaugagagugaagcagacccaggaccacaucagcagcgugaaguacaaggaggccaucggccagggcacccccauccccgaccugcccgaggugaagagagugaaggagacccagaagcacaucagcagcgugauguacaaggagaaccugggcaccggcauccccaccaccgugacccccgagaucgagagagugaagagaaaccaggagaacuucagcagcgugcuguacaaggagaaccugggcaagggcauccccacccccaucacccccgagauggagagagugaagagaaaccaggagaacuucagcagcauccuguacaaggagaaccugagcaagggcaccccccugcccgugacccccgagauggagagagugaagcugaaccaggagaacuucagcagcgugcuguacaaggagaacgugggcaagggcauccccauccccaucacccccgagauggagagagugaagcacaaccaggagaacuucagcagcgugcuguacaaggagaaccugggcaccggcauccccauccccaucacccccgagaugcagagagugaagcacaaccaggagaaccugagcagcgugcuguacaaggagaacaugggcaagggcaccccccugcccgugacccccgagauggagagagugaagcacaaccaggagaacaucagcagcgugcuguacaaggagaacaugggcaagggcaccccccugcccgugacccccgagauggagagagugaagcacaaccaggagaacaucagcagcgugcuguacaaggagaacaugggcaagggcaccccccuggccgugacccccgagauggagagagugaagcacaaccaggagaacaucagcagcgugcuguacaaggagaacgugggcaaggccaccgccacccccgugacccccgagaugcagagagugaagagaaaccaggagaacaucagcagcgugcuguacaaggagaaccugggcaaggccacccccacccccuucacccccgagauggagagagugaagagaaaccaggagaacuucagcagcgugcuguacaaggagaacaugagaaaggccacccccacccccgugacccccgagauggagagagccaagagaaaccaggagaacaucagcagcgugcuguacagcgacagcuucagaaagcagauccagggcaaggccgccuacgugcuggacacccccgagaugagaagagugagagagacccagagacacaucagcaccgugaaguaccacgaggacuucgagaagcacaagggcugcuucacccccguggugaccgaccccaucaccgagagagugaagaagaacaugcaggacuucagcgacaucaacuacagaggcauccagagaaaggugguggagauggagcagaagagaaacgaccaggaccaggagaccaucaccggccugagaguguggagaaccaaccccggcagcguguucgacuacgaccccgccgaggacaacauccagagcagaagccugcacaugaucaacgugcaggcccagagaagaagcagagagcagagcagaagcgccagcgcccugagcaucagcggcggcgaggagaagagcgagcacagcgaggcccccgaccaccaccugagcaccuacagcgacggcggcguguucgccgugagcaccgccuacaagcacgccaagaccaccgagcugccccagcagagaagcagcagcguggccacccagcagaccaccgugagcagcauccccagccaccccagcaccgccggcaagaucuucagagccauguacgacuacauggccgccgacgccgacgaggugagcuucaaggacggcgacgccaucaucaacgugcaggccaucgacgagggcuggauguacggcaccgugcagagaaccggcagaaccggcaugcugcccgccaacuacguggaggccaucuaa

SEQ ID NO: 20436 - RNA, 3045 nt, Artificial Sequence
  NEBL__Homo_sapiens__NP_006384
augagagugcccguguucgaggacaucaaggacgagaccgaggaggagaagaucggcgaggaggagaacgaggaggaccagguguucuacaagcccgugaucgaggaccugagcauggagcuggccagaaagugcaccgagcugaucagcgacaucagauacaaggaggaguucaagaagagcaaggacaagugcaccuucgugaccgacagccccaugcugaaccacgugaagaacaucggcgccuucaucagcgaggccaaguacaagggcaccaucaaggccgaccugagcaacagccuguacaagagaaugcccgccaccaucgacagcguguucgccggcgaggugacccagcugcagagcgagguggccuacaagcagaagcacgacgccgccaagggcuucagcgacuacgcccacaugaaggagccccccgaggugaagcacgccauggaggugaacaagcaccagagcaacaucagcuacagaaaggacgugcaggacacccacaccuacagcgccgagcuggacagacccgacaucaagauggccacccagaucagcaagaucaucagcaacgccgaguacaagaagggccagggcaucaugaacaaggagcccgccgugaucggcagacccgacuucgagcacgccguggaggccagcaagcugagcagccagaucaaguacaaggagaaguucgacaacgagaugaaggacaagaagcaccacuacaacccccuggagagcgccagcuucagacagaaccagcuggccgccacccuggccagcaacgugaaguacaagaaggacauccagaacaugcacgaccccgugagcgaccugcccaaccugcuguuccuggaccacgugcugaaggccagcaagaugcugagcggcagagaguacaagaagcuguucgaggagaacaagggcauguaccacuucgacgccgacgccguggagcaccugcaccacaagggcaacgccgugcugcagagccaggugaaguacaaggaggaguacgagaagaacaagggcaagcccaugcuggaguucguggagacccccagcuaccaggccagcaaggaggcccagaagaugcagagcgagaagguguacaaggaggacuucgagaaggagaucaagggcagaagcagccuggaccuggacaagacccccgaguuccugcacgugaaguacaucaccaaccugcugagagagaaggaguacaagaaggaccuggagaacgagaucaagggcaagggcauggagcugaacagcgaggugcuggacauccagagagccaagagagccagcgagauggccagcgagaaggaguacaagaaggaccuggagagcaucaucaagggcaagggcaugcaggccggcaccgacacccuggagaugcagcacgccaagaaggccgccgagaucgccagcgagaaggacuacaagagagaccuggagaccgagaucaagggcaagggcaugcaggugagcaccgacacccuggacgugcagagagccaagaaggccagcgagauggccagccagaagcaguacaagaaggaccuggagaacgagaucaagggcaagggcaugcaggugagcauggacauccccgacauccugagagccaagagaaccagcgagaucuacagccagagaaaguacaaggacgaggccgagaagaugcugagcaacuacagcaccaucgccgacacccccgagauccagagaaucaagaccacccagcagaacaucagcgccguguucuacaagaaggaggugggcgccggcaccgccgugaaggacagccccgagaucgagagagugaagaagaaccagcagaacaucagcagcgugaaguacaaggaggagaucaagcacgccaccgccaucagcgacccccccgagcugaagagagugaaggagaaccagaagaacaucagcaaccugcaguacaaggagcagaacuacaaggccacccccgugagcaugacccccgagaucgagagagugagaagaaaccaggagcagcugagcgccgugaaguacaagggcgagcugcagagaggcaccgccaucagcgacccccccgagcugaagagagccaaggagaaccagaagaacaucagcaacguguacuacagaggccagcugggcagagccaccacccugagcgugacccccgagauggagagagugaagaagaaccaggagaacaucagcagcgugaaguacacccaggaccacaagcagaugaagggcagacccagccugauccuggacacccccgccaugagacacgugaaggaggcccagaaccacaucagcauggugaaguaccacgaggacuucgagaagaccaagggcagaggcuucacccccgugguggacgaccccgugaccgagagagugagaaagaacacccagguggugagcgacgccgccuacaagggcgugcacccccacaucguggagauggacagaagacccggcaucaucguggaccugaagguguggagaaccgaccccggcagcaucuucgaccuggacccccuggaggacaacauccagagcagaagccugcacaugcugagcgagaaggccagccacuacagaagacacuggagcagaagccacagcagcagcaccuucggcaccggccugggcgacgacagaagcgagaucagcgagaucuaccccagcuucagcugcugcagcgaggugaccagacccagcgacgagggcgcccccgugcugcccggcgccuaccagcagagccacagccagggcuacggcuacaugcaccagaccagcgugagcagcaugagaagcaugcagcacagccccaaccugagaaccuacagagccauguacgacuacagcgcccaggacgaggacgaggugagcuucagagacggcgacuacaucgugaacgugcagcccaucgacgacggcuggauguacggcaccgugcagagaaccggcagaaccggcaugcugcccgccaacuacaucgaguucgugaacuaa

SEQ ID NO: 20437 - RNA, 1056 nt, Artificial Sequence
  NECAB1__Homo_sapiens__NP_071746
auggaggacagccaggagaccagccccagcagcaacaacagcagcgaggagcugagcagcgcccugcaccugagcaagggcaugagcaucuuccuggacauccugagaagagccgacaagaacgacgacggcaagcugagcuucgaggaguucaaggccuacuucgccgacggcgugcugagcggcgaggagcugcacgagcuguuccacaccaucgacacccacaacaccaacaaccuggacaccgaggagcugugcgaguacuucagccagcaccugggcgaguacgagaacgugcuggccgcccuggaggaccugaaccugagcauccugaaggccaugggcaagaccaagaaggacuaccaggaggccagcaaccuggagcaguucgugaccagauuccugcugaaggagacccugaaccagcugcagagccugcagaacagccuggagugcgccauggagaccaccgaggagcagaccagacaggagagacagggccccgccaagcccgaggugcugagcauccaguggcccggcaagagaagcagcagaagagugcagagacacaacagcuucagccccaacagcccccaguucaacgugagcggccccggccugcuggaggaggacaaccaguggaugacccagaucaacagacugcagaagcugaucgacagacuggagaagaaggaccugaagcuggagccccccgaggaggagaucaucgagggcaacaccaagagccacaucaugcuggugcagagacagaugagcgugaucgaggaggaccuggaggaguuccagcuggcccugaagcacuacguggagagcgccagcagccagagcggcugccugagaaucagcauccagaagcugagcaacgagagcagauacaugaucuacgaguucugggagaacagcagcguguggaacagccaccugcagaccaacuacagcaagaccuuccagagaagcaacguggacuuccuggagacccccgagcugaccagcaccaugcuggugcccgccagcugguggauccugaacaacuaa

SEQ ID NO: 20438 - RNA, 1089 nt, Artificial Sequence
  NECAB3__Homo_sapiens__NP_112508
auggccugcgccggccugcugaccgugugccugcugagaccccccgccccccagccccagccccagacccccagacacccccagcuggcccccgaccccggccccgccggccacacccuguuccaggacguguucagaagagccgacaagaacgacgacggcaagcugagcuucgaggaguuccagaacuacuucgccgacggcgugcugagccugggcgagcugcaggagcuguucagcggcaucgacggccaccugaccgacaaccuggagaccgagaagcugugcgacuacuucagcgagcaccugggcguguacagacccgugcuggccgcccuggagagccugaacagagccgugcuggccgccauggacgccaccaagcuggaguacgagagagccagcaagguggaccaguucgugaccagauuccugcugagagagaccgugagccagcugcaggcccugcagagcagccuggagggcgccagcgacacccuggaggcccaggcccacggcuggagaagcgacgccgagagcguggaggcccagagcagacugugcggcagcagaagagccggcagaagagcccugagaagcgugagcagaagcagcaccuggagccccggcagcagcgacaccggcagaagcagcgaggccgagaugcaguggagacugcaggugaacagacugcaggagcugaucgaccagcuggagugcaaggcccccagacuggagccccugagagaggaggaccuggccaagggccccgaccugcacauccugauggcccagagacaggugcagguggccgaggagggccugcaggacuuccacagagcccugagaugcuacguggacuucaccggcgcccagagccacugccugcacgugagcgcccagaagaugcuggacggcgccagcuucacccuguacgaguucuggcaggacgaggccagcuggagaagacaccagcagagccccggcagcaaggccuuccagagaauccugaucgaccaccugagagcccccgacacccugaccaccguguucuuccccgccagcugguggaucaugaacaacaacuaa

SEQ ID NO: 20439 - RNA, 828 nt, Artificial Sequence
  NECAP1__Homo_sapiens__NP_056324
auggccaccgagcuggaguacgagagcgugcugugcgugaagcccgacgugagcguguacagaaucccccccagagccagcaacagaggcuacagagccagcgacuggaagcuggaccagcccgacuggaccggcagacugagaaucaccagcaagggcaagaccgccuacaucaagcuggaggacaaggugagcggcgagcuguucgcccaggcccccguggagcaguaccccggcaucgccguggagaccgugaccgacagcagcagauacuucgugaucagaauccaggacggcaccggcagaagcgccuucaucggcaucggcuucaccgacagaggcgacgccuucgacuucaacgugagccugcaggaccacuucaagugggugaagcaggagagcgagaucagcaaggagagccaggagauggacgccagacccaagcuggaccugggcuucaaggagggccagaccaucaagcugugcaucggcaacaucaccaacaagaagggcggcgccagcaagcccagaaccgccagaggcggcggccugagccugcugccccccccccccggcggcaaggugaccauccccccccccagcagcagcguggccaucagcaaccacgugacccccccccccauccccaagagcaaccacggcggcagcgacgccgacauccugcuggaccuggacagccccgcccccgugaccacccccgcccccacccccgugagcgugagcaacgaccuguggggcgacuucagcaccgccagcagcagcgugcccaaccaggccccccagcccagcaacugggugcaguucuaa

SEQ ID NO: 20440 - RNA, 1983 nt, Artificial Sequence
  NEDD1__Homo_sapiens__NP_001128648
augcaggagaaccugagauucgccagcagcggcgacgacaucaagaucugggacgccagcagcaugacccugguggacaaguucaacccccacaccagcccccacggcaucagcagcaucugcuggagcagcaacaacaacuuccuggugaccgccagcagcagcggcgacaagaucguggugagcagcugcaagugcaagcccgugccccugcuggagcuggccgagggccagaagcagaccugcgugaaccugaacagcaccagcauguaccuggugagcggcggccugaacaacaccgugaacaucugggaccugaagagcaagagagugcacagaagccugaaggaccacaaggaccaggugaccugcgugaccuacaacuggaacgacugcuacaucgccagcggcagccugagcggcgagaucauccugcacagcgugaccaccaaccugagcagcacccccuucggccacggcagcaaccagagcgugagacaccugaaguacagccuguucaagaagagccugcugggcagcgugagcgacaacggcaucgugacccugugggacgugaacagccagagccccuaccacaacuucgacagcgugcacaaggcccccgccagcggcaucugcuucagccccgugaacgagcugcuguucgugaccaucggccuggacaagagaaucauccuguacgacaccagcagcaagaagcuggugaagacccugguggccgacaccccccugaccgccguggacuucaugcccgacggcgccacccuggccaucggcagcagcagaggcaagaucuaccaguacgaccugagaaugcugaagagccccgugaagaccaucagcgcccacaagaccagcgugcagugcaucgccuuccaguacagcaccgugcugaccaagagcagccugaacaagggcugcagcaacaagcccaccaccgugaacaagagaagcgugaacgugaacgccgccagcggcggcgugcagaacagcggcaucgugagagaggcccccgccaccagcaucgccaccgugcugccccagcccaugaccagcgccaugggcaagggcaccguggccgugcaggagaaggccggccugcccagaagcaucaacaccgacacccugagcaaggagaccgacagcggcaagaaccaggacuucagcagcuucgacgacaccggcaagagcagccugggcgacauguucagccccaucagagacgacgccguggugaacaagggcagcgacgagagcaucggcaagggcgacggcuucgacuuccugccccagcugaacagcguguucccccccagaaagaaccccgugaccagcagcaccagcgugcugcacagcagcccccugaacguguucaugggcagccccggcaaggaggagaacgagaacagagaccugaccgccgagagcaagaagaucuacaugggcaagcaggagagcaaggacagcuucaagcagcuggccaagcuggugaccagcggcgccgagagcggcaaccugaacaccagccccagcagcaaccagaccagaaacagcgagaaguucgagaagcccgagaacgagaucgaggcccagcugaucugcgagccccccaucaacggcagcagcacccccaaccccaagaucgccagcagcgugaccgccggcguggccagcagccugagcgagaagaucgccgacagcaucggcaacaacagacagaacgccccccugaccagcauccagaucagauucauccagaacaugauccaggagacccuggacgacuucagagaggccugccacagagacaucgugaaccugcagguggagaugaucaagcaguuccacaugcagcugaacgagaugcacagccugcuggagagauacagcgugaacgagggccugguggccgagaucgagagacugagagaggagaacaagagacugagagcccacuucuaa

SEQ ID NO: 20441 - RNA, 3960 nt, Artificial Sequence
  NEDD4__Homo_sapiens__NP_001271267
auggcccagagccugagacugcacuucgccgccagaagaagcaacaccuacccccugagcgagaccagcggcgacgaccuggacagccacgugcacaugugcuucaagagacccaccagaaucagcaccagcaacguggugcagaugaagcugacccccagacagaccgcccuggccccccugaucaaggagaacgugcagagccaggagagaagcagcgugcccagcagcgagaacgugaacaagaagagcagcugccugcagaucagccugcagcccaccagauacagcggcuaccugcagagcagcaacgugcuggccgacagcgacgacgccagcuucaccugcauccugaaggacggcaucuacagcagcgccgugguggacaacgagcugaacgccgugaacgacggccaccuggugagcagccccgccaucugcagcggcagccugagcaacuucagcaccagcgacaacggcagcuacagcagcaacggcagcgacuucggcagcugcgccagcaucaccagcggcggcagcuacaccaacagcgugaucagcgacagcagcagcuacaccuucccccccagcgacgacaccuuccugggcggcaaccugcccagcgacagcaccagcaacagaagcgugcccaacagaaacaccacccccugcgagaucuucagcagaagcaccagcaccgaccccuucgugcaggacgaccuggagcacggccuggagaucaugaagcugcccgugagcagaaacaccaagaucccccugaagagauacagcagccuggugaucuuccccagaagccccagcaccaccagacccaccagccccaccagccugugcacccugcugagcaagggcagcuaccagaccagccaccaguucaucaucagccccagcgagaucgcccacaacgaggacggcaccagcgccaagggcuuccugagcaccgccgugaacggccugagacugagcaagaccaucugcacccccggcgaggugagagacaucagaccccugcacagaaagggcagccugcagaagaagaucgugcugagcaacaacacccccagacagaccgugugcgagaagagcagcgagggcuacagcugcgugagcgugcacuucacccagagaaaggccgccacccuggacugcgagaccaccaacggcgacugcaagcccgagaugagcgagaucaagcugaacagcgacagcgaguacaucaagcugaugcacagaaccagcgccugccugcccagcagccagaacguggacugccagaucaacaucaacggcgagcuggagagaccccacagccagaugaacaagaaccacggcauccugagaagaagcaucagccugggcggcgccuaccccaacaucagcugccugagcagccugaagcacaacugcagcaagggcggccccagccagcugcugaucaaguucgccagcggcaacgagggcaagguggacaaccugagcagagacagcaacagagacugcaccaacgagcugagcaacagcugcaagaccagagacgacuuccugggccagguggacgugccccuguacccccugcccaccgagaaccccagacuggagagacccuacaccuucaaggacuucgugcugcaccccagaagccacaagagcagagugaagggcuaccugagacugaagaugaccuaccugcccaagaccagcggcagcgaggacgacaacgccgagcaggccgaggagcuggagcccggcuggguggugcuggaccagcccgacgccgccugccaccugcagcagcagcaggagcccagcccccugccccccggcugggaggagagacaggacauccugggcagaaccuacuacgugaaccacgagagcagaagaacccaguggaagagacccaccccccaggacaaccugaccgacgccgagaacggcaacauccagcugcaggcccagagagccuucaccaccagaagacagaucagcgaggagaccgagagcguggacaacagagagagcagcgagaacugggagaucaucagagaggacgaggccaccauguacagcaaccaggccuuccccagccccccccccagcagcaaccuggacgugcccacccaccuggccgaggagcugaacgccagacugaccaucuucggcaacagcgccgugagccagcccgccagcagcagcaaccacagcagcagaagaggcagccugcaggccuacaccuucgaggagcagcccacccugcccgugcugcugcccaccagcagcggccugccccccggcugggaggagaagcaggacgagagaggcagaagcuacuacguggaccacaacagcagaaccaccaccuggaccaagcccaccgugcaggccaccguggagaccagccagcugaccagcagccagagcagcgccggcccccagagccaggccagcaccagcgacagcggccagcaggugacccagcccagcgagaucgagcagggcuuccugcccaagggcugggaggugagacacgcccccaacggcagacccuucuucaucgaccacaacaccaagaccaccaccugggaggaccccagacugaagauccccgcccaccugagaggcaagaccagccuggacaccagcaacgaccugggcccccugccccccggcugggaggagagaacccacaccgacggcagaaucuucuacaucaaccacaacaucaagagaacccagugggaggaccccagacuggagaacguggccaucaccggccccgccgugcccuacagcagagacuacaagagaaaguacgaguucuucagaagaaagcugaagaagcagaacgacauccccaacaaguucgagaugaagcugagaagagccaccgugcuggaggacagcuacagaagaaucaugggcgugaagagagccgacuuccugaaggccagacuguggaucgaguucgacggcgagaagggccuggacuacggcggcguggccagagagugguucuuccugaucagcaaggagauguucaaccccuacuacggccuguucgaguacagcgccaccgacaacuacacccugcagaucaaccccaacagcggccugugcaacgaggaccaccugagcuacuucaaguucaucggcagaguggccggcauggccguguaccacggcaagcugcuggacggcuucuucaucagacccuucuacaagaugaugcugcacaagcccaucacccugcacgacauggagagcguggacagcgaguacuacaacagccugagauggauccuggagaacgaccccaccgagcuggaccugagauucaucaucgacgaggagcuguucggccagacccaccagcacgagcugaagaacggcggcagcgagaucguggugaccaacaagaacaagaaggaguacaucuaccuggugauccaguggagauucgugaacagaauccagaagcagauggccgccuucaaggagggcuucuucgagcugaucccccaggaccugaucaagaucuucgacgagaacgagcuggagcugcugaugugcggccugggcgacguggacgugaacgacuggagagagcacaccaaguacaagaacggcuacagcgccaaccaccaggugauccagugguucuggaaggccgugcugaugauggacagcgagaagagaaucagacugcugcaguucgugaccggcaccagcagagugcccaugaacggcuucgccgagcuguacggcagcaacggcccccagagcuucaccguggagcaguggggcacccccgagaagcugcccagagcccacaccugcuucaacagacuggaccugccccccuacgagagcuucgaggagcugugggacaagcugcagauggccaucgagaacacccagggcuucgacggcguggacuaa

SEQ ID NO: 20442 - RNA, 2928 nt, Artificial Sequence
  NEDD4L__Homo_sapiens__NP_001138439
auggccaccggccugggcgagcccguguacggccugagcgaggacgagggcgagagcagaauccugagagugaagguggugagcggcaucgaccuggccaagaaggacaucuucggcgccagcgaccccuacgugaagcugagccuguacguggccgacgagaacagagagcuggcccuggugcagaccaagaccaucaagaagacccugaaccccaaguggaacgaggaguucuacuucagagugaaccccagcaaccacagacugcuguucgagguguucgacgagaacagacugaccagagacgacuuccugggccagguggacgugccccugagccaccugcccaccgaggaccccaccauggagagacccuacaccuucaaggacuuccugcugagacccagaagccacaagagcagagugaagggcuuccugagacugaagauggccuacaugcccaagaacggcggccaggacgaggagaacagcgaccagagagacgacauggagcacggcugggaggugguggacagcaacgacagcgccagccagcaccaggaggagcugcccccccccccccugccccccggcugggaggagaagguggacaaccugggcagaaccuacuacgugaaccacaacaacagaaccacccaguggcacagacccagccugauggacgugagcagcgagagcgacaacaacaucagacagaucaaccaggaggccgcccacagaagauucagaagcagaagacacaucagcgaggaccuggagcccgagcccagcgagggcggcgacgugcccgagcccugggagaccaucagcgaggaggugaacaucgccggcgacagccugggccuggcccugccccccccccccgccagccccggcagcagaaccagcccccaggagcugagcgaggagcugagcagaagacugcagaucacccccgacagcaacggcgagcaguucagcagccugauccagagagagcccagcagcagacugagaagcugcagcgugaccgacgccguggccgagcagggccaccugcccccccccagcgcccccgccggcagagccagaagcagcaccgugaccggcggcgaggagcccacccccagcguggccuacgugcacaccacccccggccugcccagcggcugggaggagagaaaggacgccaagggcagaaccuacuacgugaaccacaacaacagaaccaccaccuggaccagacccaucaugcagcuggccgaggacggcgccagcggcagcgccaccaacagcaacaaccaccugaucgagccccagaucagaagacccagaagccugagcagccccaccgugacccugagcgccccccuggagggcgccaaggacagccccgugagaagagccgugaaggacacccugagcaacccccagagcccccagcccagccccuacaacagccccaagccccagcacaaggugacccagagcuuccugccccccggcugggagaugagaaucgcccccaacggcagacccuucuucaucgaccacaacaccaagaccaccaccugggaggaccccagacugaaguuccccgugcacaugagaagcaagaccagccugaaccccaacgaccugggcccccugccccccggcugggaggagagaauccaccuggacggcagaaccuucuacaucgaccacaacagcaagaucacccagugggaggaccccagacugcagaaccccgccaucaccggccccgccgugcccuacagcagagaguucaagcagaaguacgacuacuucagaaagaagcugaagaagcccgccgacauccccaacagauucgagaugaagcugcacagaaacaacaucuucgaggagagcuacagaagaaucaugagcgugaagagacccgacgugcugaaggccagacuguggaucgaguucgagagcgagaagggccuggacuacggcggcguggccagagagugguucuuccugcugagcaaggagauguucaaccccuacuacggccuguucgaguacagcgccaccgacaacuacacccugcagaucaaccccaacagcggccugugcaacgaggaccaccugagcuacuucaccuucaucggcagaguggccggccuggccguguuccacggcaagcugcuggacggcuucuucaucagacccuucuacaagaugaugcugggcaagcagaucacccugaacgacauggagagcguggacagcgaguacuacaacagccugaaguggauccuggagaacgaccccaccgagcuggaccugauguucugcaucgacgaggagaacuucggccagaccuaccagguggaccugaagcccaacggcagcgagaucauggugaccaacgagaacaagagagaguacaucgaccuggugauccaguggagauucgugaacagagugcagaagcagaugaacgccuuccuggagggcuucaccgagcugcugcccaucgaccugaucaagaucuucgacgagaacgagcuggagcugcugaugugcggccugggcgacguggacgugaacgacuggagacagcacagcaucuacaagaacggcuacugccccaaccaccccgugauccagugguucuggaaggccgugcugcugauggacgccgagaagagaaucagacugcugcaguucgugaccggcaccagcagagugcccaugaacggcuucgccgagcuguacggcagcaacggcccccagcuguucaccaucgagcaguggggcagccccgagaagcugcccagagcccacaccugcuucaacagacuggaccugccccccuacgagaccuucgaggaccugagagagaagcugcugauggccguggagaacgcccagggcuucgagggcguggacuaa

SEQ ID NO: 20443 - RNA, 246 nt, Artificial Sequence
  NEDD8__Homo_sapiens__NP_006147
augcugaucaaggugaagacccugaccggcaaggagaucgagaucgacaucgagcccaccgacaagguggagagaaucaaggagagaguggaggagaaggagggcauccccccccagcagcagagacugaucuacagcggcaagcagaugaacgacgagaagaccgccgccgacuacaagauccugggcggcagcgugcugcaccuggugcuggcccugagaggcggcggcggccugagacaguaa

SEQ ID NO: 20444 - RNA, 2505 nt, Artificial Sequence
  NEDD9__Homo_sapiens__NP_001135865
auguggaccagaaaccugauggccagagcccuguacgacaacgugcccgagugcgccgaggagcuggccuucagaaagggcgacauccugaccgugaucgagcagaacaccggcggccuggagggcugguggcugugcagccugcacggcagacagggcaucgugcccggcaacagagugaagcugcugaucggccccaugcaggagaccgccagcagccacgagcagcccgccagcggccugaugcagcagaccuucggccagcagaagcuguaccaggugcccaacccccaggccgcccccagagacaccaucuaccaggugccccccagcuaccagaaccagggcaucuaccaggugcccaccggccacggcacccaggagcaggagguguaccaggugccccccagcgugcagagaagcaucggcggcaccagcggcccccacgugggcaagaaggugaucacccccgugagaaccggccacggcuacguguacgaguaccccagcagauaccagaaggacguguacgacaucccccccagccacaccacccagggcguguacgacaucccccccagcagcgccaagggccccguguucagcgugcccgugggcgagaucaagccccagggcguguacgacaucccccccaccaagggcguguacgccaucccccccagcgccugcagagacgaggccggccugagagagaaggacuacgacuuccccccccccaugagacaggccggcagacccgaccugagacccgagggcguguacgacaucccccccaccugcaccaagcccgccggcaaggaccugcacgugaaguacaacugcgacauccccggcgccgccgagcccguggccagaagacaccagagccugagccccaaccacccccccccccagcugggccagagcgugggcagccagaacgacgccuacgacgugcccagaggcgugcaguuccuggagccccccgccgagaccagcgagaaggccaacccccaggagagagacggcguguacgacgugccccugcacaacccccccgacgccaagggcagcagagaccugguggacggcaucaacagacugagcuucagcagcaccggcagcaccagaagcaacaugagcaccagcagcaccagcagcaaggagagcagccugagcgccagccccgcccaggacaagagacuguuccuggaccccgacaccgccaucgagagacugcagagacugcagcaggcccuggagaugggcgugagcagccugauggcccuggugaccaccgacuggagaugcuacggcuacauggagagacacaucaacgagaucagaaccgccguggacaagguggagcuguuccugaaggaguaccugcacuucgugaagggcgccguggccaacgccgccugccugcccgagcugauccugcacaacaagaugaagagagagcugcagagaguggaggacagccaccagauccugagccagaccagccacgaccugaacgagugcagcuggagccugaacauccuggccaucaacaagccccagaacaagugcgacgaccuggacagauucgugaugguggccaagaccgugcccgacgacgccaagcagcugaccaccaccaucaacaccaacgccgaggcccuguucagacccggccccggcagccugcaccugaagaacggccccgagagcaucaugaacagcaccgaguacccccacggcggcagccagggccagcugcugcaccccggcgaccacaaggcccaggcccacaacaaggcccugccccccggccugagcaaggagcaggcccccgacugcagcagcagcgacggcagcgagagaagcuggauggacgacuacgacuacgugcaccugcagggcaaggaggaguucgagagacagcagaaggagcugcuggagaaggagaacaucaugaagcagaacaagaugcagcuggagcaccaccagcugagccaguuccagcugcuggagcaggagaucaccaagcccguggagaacgacaucagcaaguggaagcccagccagagccugcccaccaccaacagcggcgugagcgcccaggacagacagcugcugugcuucuacuacgaccagugcgagacccacuucaucagccugcugaacgccaucgacgcccuguucagcugcgugagcagcgcccagccccccagaaucuucguggcccacagcaaguucgugauccugagcgcccacaagcugguguucaucggcgacacccugaccagacaggugaccgcccaggacaucagaaacaaggugaugaacagcagcaaccagcugugcgagcagcugaagaccaucgugauggccaccaagauggccgcccugcacuaccccagcaccaccgcccugcaggagauggugcaccaggugaccgaccugagcagaaacgcccagcuguucaagagaagccugcuggagauggccaccuucuaa

SEQ ID NO: 20445 - RNA, 3063 nt, Artificial Sequence
  NEFH__Homo_sapiens__NP_066554
augaugagcuucggcggcgccgacgcccugcugggcgcccccuucgccccccugcacggcggcggcagccugcacuacgcccuggccagaaagggcggcgccggcggcaccagaagcgccgccggcagcagcagcggcuuccacagcuggaccagaaccagcgugagcagcgugagcgccagccccagcagauucagaggcgccggcgccgccagcagcaccgacagccuggacacccugagcaacggccccgagggcugcaugguggccguggccaccagcagaagcgagaaggagcagcugcaggcccugaacgacagauucgccggcuacaucgacaaggugagacagcuggaggcccacaacagaagccuggagggcgaggccgccgcccugagacagcagcaggccggcagaagcgccaugggcgagcuguacgagagagaggugagagagaugagaggcgccgugcugagacugggcgccgccagaggccagcugagacuggagcaggagcaccugcuggaggacaucgcccacgugagacagagacuggacgacgaggccagacagagagaggaggccgaggccgccgccagagcccuggccagauucgcccaggaggccgaggccgccagaguggaccugcagaagaaggcccaggcccugcaggaggagugcggcuaccugagaagacaccaccaggaggaggugggcgagcugcugggccagauccagggcagcggcgccgcccaggcccagaugcaggccgagaccagagacgcccugaagugcgacgugaccagcgcccugagagagaucagagcccagcuggagggccacgccgugcagagcacccugcagagcgaggagugguucagagugagacuggacagacugagcgaggccgccaaggugaacaccgacgccaugagaagcgcccaggaggagaucaccgaguacagaagacagcugcaggccagaaccaccgagcuggaggcccugaagagcaccaaggacagccuggagagacagagaagcgagcuggaggacagacaccaggccgacaucgccagcuaccaggaggccauccagcagcuggacgccgagcugagaaacaccaagugggagauggccgcccagcugagagaguaccaggaccugcugaacgugaagauggcccuggacaucgagaucgccgccuacagaaagcugcuggagggcgaggagugcagaaucggcuucggccccauccccuucagccugcccgagggccugcccaagauccccagcgugagcacccacaucaaggugaagagcgaggagaagaucaaggugguggagaagagcgagaaggagaccgugaucguggaggagcagaccgaggagacccaggugaccgaggaggugaccgaggaggaggagaaggaggccaaggaggaggagggcaaggaggaggagggcggcgaggaggaggaggccgagggcggcgaggaggagaccaagagcccccccgccgaggaggccgccagccccgagaaggaggccaagagccccgugaaggaggaggccaagagccccgccgaggccaagagccccgagaaggaggaggccaagagccccgccgaggugaagagccccgagaaggccaagagccccgccaaggaggaggccaagagcccccccgaggccaagagccccgagaaggaggaggccaagagccccgccgaggugaagagccccgagaaggccaagagccccgccaaggaggaggccaagagccccgccgaggccaagagccccgagaaggccaagagccccgugaaggaggaggccaagagccccgccgaggccaagagccccgugaaggaggaggccaagagccccgccgaggugaagagccccgagaaggccaagagccccaccaaggaggaggccaagagccccgagaaggccaagagccccgagaaggaggaggccaagagccccgagaaggccaagagccccgugaaggccgaggccaagagccccgagaaggccaagagccccgugaaggccgaggccaagagccccgagaaggccaagagccccgugaaggaggaggccaagagccccgagaaggccaagagccccgugaaggaggaggccaagagccccgagaaggccaagagccccgugaaggaggaggccaagacccccgagaaggccaagagccccgugaaggaggaggccaagagccccgagaaggccaagagccccgagaaggccaagacccuggacgugaagagccccgaggccaagacccccgccaaggaggaggccagaagccccgccgacaaguuccccgagaaggccaagagccccgugaaggaggaggugaagagccccgagaaggccaagagcccccugaaggaggacgccaaggcccccgagaaggagauccccaagaaggaggaggugaagagccccgugaaggaggaggagaagccccaggaggugaaggugaaggagccccccaagaaggccgaggaggagaaggcccccgccacccccaagaccgaggagaagaaggacagcaagaaggaggaggcccccaagaaggaggcccccaagcccaagguggaggagaagaaggagcccgccguggagaagcccaaggagagcaagguggaggccaagaaggaggaggccgaggacaagaagaaggugcccacccccgagaaggaggcccccgccaagguggaggugaaggaggacgccaagcccaaggagaagaccgagguggccaagaaggagcccgacgacgccaaggccaaggagcccagcaagcccgccgagaagaaggaggccgcccccgagaagaaggacaccaaggaggagaaggccaagaagcccgaggagaagcccaagaccgaggccaaggccaaggaggacgacaagacccugagcaaggagcccagcaagcccaaggccgagaaggccgagaagagcagcagcaccgaccagaaggacagcaagccccccgagaaggccaccgaggacaaggccgccaagggcaaguaa

SEQ ID NO: 20446 - RNA, 1623 nt, Artificial Sequence
  NEFM__Homo_sapiens__NP_001099011
auggccagacaccugagagaguaccaggaccugcugaacgugaagauggcccuggacaucgagaucgccgccuacagaaagcugcuggagggcgaggagaccagauucagcaccuucgccggcagcaucaccggcccccuguacacccacagaccccccaucaccaucagcagcaagauccagaagcccaagguggaggcccccaagcugaaggugcagcacaaguucguggaggagaucaucgaggagaccaagguggaggacgagaagagcgagauggaggaggcccugaccgccaucaccgaggagcuggccgugagcaugaaggaggagaagaaggaggccgccgaggagaaggaggaggagcccgaggccgaggaggaggagguggccgccaagaagagccccgugaaggccaccgcccccgaggugaaggaggaggagggcgagaaggaggaggaggagggccaggaggaggaggaggaggaggacgagggcgccaagagcgaccaggccgaggagggcggcagcgagaaggagggcagcagcgagaaggaggagggcgagcaggaggagggcgagaccgaggccgaggccgagggcgaggaggccgaggccaaggaggagaagaagguggaggagaagagcgaggagguggccaccaaggaggagcugguggccgacgccaagguggagaagcccgagaaggccaagagccccgugcccaagagccccguggaggagaagggcaagagccccgugcccaagagccccguggaggagaagggcaagagccccgugcccaagagccccguggaggagaagggcaagagccccgugcccaagagccccguggaggagaagggcaagagccccgugagcaagagccccguggaggagaaggccaagagccccgugcccaagagccccguggaggaggccaagagcaaggccgaggugggcaagggcgagcagaaggaggaggaggagaaggaggugaaggaggcccccaaggaggagaagguggagaagaaggaggagaagcccaaggacgugcccgagaagaagaaggccgagagccccgugaaggaggaggccguggccgagguggugaccaucaccaagagcgugaaggugcaccuggagaaggagaccaaggaggagggcaagccccugcagcaggagaaggagaaggagaaggccggcggcgagggcggcagcgaggaggagggcagcgacaagggcgccaagggcagcagaaaggaggacaucgccgugaacggcgagguggagggcaaggaggagguggagcaggagaccaaggagaagggcagcggcagagaggaggagaagggcguggugaccaacggccuggaccugagccccgccgacgagaagaagggcggcgacaagagcgaggagaaggugguggugaccaagaccguggagaagaucaccagcgagggcggcgacggcgccaccaaguacaucaccaagagcgugaccgugacccagaagguggaggagcacgaggagaccuucgaggagaagcuggugagcaccaagaagguggagaaggugaccagccacgccaucgugaaggaggugacccagagcgacuaa

SEQ ID NO: 20447 - RNA, 1431 nt, Artificial Sequence
  NEIL1__Homo_sapiens__NP_001243481
augggcagaaccggccccagagccccccugcugcccaagaccagaaucuggagccugaccuucagcagaaagaccagccccgugggcgccagacccggcgccgcccccagaugcggcggcggcaaggugagagccagcgccguggccaagugcccccugccccugaaggcccaccugagacugagauucagaaccgccagaggccagagacagguggccaagcagggcggcagaagaacccugccccccagccugagaaugcccgagggccccgagcugcaccuggccagccaguucgugaacgaggccugcagagcccugguguucggcggcugcguggagaagagcagcgugagcagaaaccccgaggugcccuucgagagcagcgccuacagaaucagcgccagcgccagaggcaaggagcugagacugauccugagcccccugcccggcgcccagccccagcaggagccccuggcccugguguucagauucggcaugagcggcagcuuccagcuggugcccagagaggagcugcccagacacgcccaccugagauucuacaccgccccccccggccccagacuggcccugugcuucguggacaucagaagauucggcagaugggaccugggcggcaaguggcagcccggcagaggccccugcgugcugcaggaguaccagcaguucagagagaacgugcugagaaaccuggccgacaaggccuucgacagacccaucugcgaggcccugcuggaccagagauucuucaacggcaucggcaacuaccugagagccgagauccuguacagacugaagaucccccccuucgagaaggccagaagcgugcuggaggcccugcagcagcacagacccagccccgagcugacccugagccagaagaucagaaccaagcugcagaaccccgaccugcuggagcugugccacagcgugcccaaggagguggugcagcugggcggcaagggcuacggcagcgagagcggcgaggaggacuucgccgccuucagagccuggcugagaugcuacggcaugcccggcaugagcagccugcaggacagacacggcagaaccaucugguuccagggcgaccccggcccccuggcccccaagggcagaaagagcagaaagaagaagagcaaggccacccagcugagccccgaggacagaguggaggacgcccugccccccagcaaggcccccagcagaaccagaagagccaagagagaccugcccaagagaaccgccacccagagacccgagggcaccagccugcagcaggaccccgaggcccccaccgugcccaagaagggcagaagaaagggcagacaggccgccagcggccacugcagacccagaaaggugaaggccgacauccccagccuggagcccgagggcaccagcgccagcuaa

SEQ ID NO: 20448 - RNA, 816 nt, Artificial Sequence
  NEIL2__Homo_sapiens__NP_001129219
augggcccccccggcagcagccccacccccgagcccccccagaaggaggugcagaaggagggcgccgccgaccccaagcaggugggcgagcccagcggccagaagacccuggacggcagcagcagaagcgccgagcuggugccccagggcgaggacgacagcgaguaccuggagagagacgcccccgccggcgacgccggcagauggcugagagugagcuucggccuguucggcagcgugugggugaacgacuucagcagagccaagaaggccaacaagagaggcgacuggagagaccccagccccagacuggugcugcacuucggcggcggcggcuuccuggccuucuacaacugccagcugagcuggagcagcagccccguggugacccccaccugcgacauccugagcgagaaguuccacagaggccaggcccuggaggcccugggccaggcccagcccgugugcuacacccugcuggaccagagauacuucagcggccugggcaacaucaucaagaacgaggcccuguacagagccggcauccacccccugagccugggcagcgugcugagcgccagcagaagagaggugcugguggaccacgugguggaguucagcaccgccuggcugcagggcaaguuccagggcagaccccagcacacccagguguaccagaaggagcagugccccgccggccaccaggugaugaaggaggccuucggccccgaggacggccugcagagacugaccugguggugcccccagugccagccccagcugagcgaggagcccgagcagugccaguucagcuaa

SEQ ID NO: 20449 - RNA, 1818 nt, Artificial Sequence
  NEIL3__Homo_sapiens__NP_060718
augguggagggccccggcugcacccugaacggcgagaagaucagagccagagugcugcccggccaggccgugaccggcgugagaggcagcgcccugagaagccugcagggcagagcccugagacuggccgccagcaccgugguggugagcccccaggccgccgcccugaacaacgacagcagccagaacgugcugagccuguucaacggcuacguguacagcggcguggagacccugggcaaggagcuguucauguacuucggccccaaggcccugagaauccacuucggcaugaagggcuucaucaugaucaacccccuggaguacaaguacaagaacggcgccagccccgugcuggaggugcagcugaccaaggaccugaucugcuucuucgacagcagcguggagcugagaaacagcauggagagccagcagagaaucagaaugaugaaggagcuggacgugugcagccccgaguucagcuuccugagagccgagagcgaggugaagaagcagaagggcagaaugcugggcgacgugcugauggaccagaacgugcugcccggcgugggcaacaucaucaagaacgaggcccuguucgacagcggccugcaccccgccgugaaggugugccagcugaccgacgagcagauccaccaccugaugaagaugaucagagacuucagcauccuguucuacagaugcagaaaggccggccuggcccugagcaagcacuacaagguguacaagagacccaacugcggccagugccacugcagaaucaccgugugcagauucggcgacaacaacagaaugaccuacuucugcccccacugccagaaggagaacccccagcacguggacaucugcaagcugcccaccagaaacaccaucaucagcuggaccagcagcagaguggaccacgugauggacagcguggccagaaagagcgaggagcacuggaccugcguggugugcacccugaucaacaagcccagcagcaaggccugcgacgccugccugaccagcagacccaucgacagcgugcugaagagcgaggagaacagcaccguguucagccaccugaugaaguaccccugcaacaccuucggcaagccccacaccgaggugaagaucaacagaaagaccgccuucggcaccaccacccuggugcugaccgacuucagcaacaagagcagcacccuggagagaaagaccaagcagaaccagauccuggacgaggaguuccagaacagcccccccgccagcgugugccugaacgacauccagcaccccagcaagaagaccaccaacgacaucacccagcccagcagcaaggugaacaucagccccaccaucagcagcgagagcaagcuguucagccccgcccacaagaagcccaagaccgcccaguacagcagccccgagcugaagagcugcaaccccggcuacagcaacagcgagcugcagaucaacaugaccgacggccccagaacccugaaccccgacagccccagaugcagcaagcacaacagacugugcauccugagaguggugagaaaggacggcgagaacaagggcagacaguucuacgccugcccccugcccagagaggcccagugcggcuucuucgagugggccgaccugagcuuccccuucugcaaccacggcaagagaagcaccaugaagaccgugcugaagaucggccccaacaacggcaagaacuucuucgugugcccccugggcaaggagaagcagugcaacuucuuccagugggccgagaacggccccggcaucaagaucauccccggcugcuaa

SEQ ID NO: 20450 - RNA, 1425 nt, Artificial Sequence
  NEK10__Homo_sapiens__NP_001026911
auggugcccgugcagcccgccgagccccccgaggugcugaagagcgagcccuacggcgagaaggccgacgugugggccgugggcugcauccuguaccagauggccacccugagcccccccuucuacagcaccaacaugcugagccuggccaccaagaucguggaggccguguacgagcccgugcccgagggcaucuacagcgagaaggugaccgacaccaucagcagaugccugacccccgacgccgaggccagacccgacaucguggaggugagcagcaugaucagcgacgugaugaugaaguaccuggacaaccugagcaccagccagcugagccuggagaagaagcuggagagagagagaagaagaacccagagauacuucauggaggccaacagaaacaccgugaccugccaccacgagcuggccgugcugagccacgagaccuucgagaaggccagccugagcagcagcagcagcggcgccgccagccugaagagcgagcugagcgagagcgccgaccugccccccgagggcuuccaggccagcuacggcaaggacgaggacagagccugcgacgagauccugagcgacgacaacuucaaccuggagaacgccgagaaggacaccuacagcgagguggacgacgagcuggacaucagcgacaacagcagcagcagcagcagcagcccccugaaggagagcaccuucaacauccugaagagaagcuucagcgccagcggcggcgagagacagagccagaccagagacuucaccggcggcaccggcagcagacccagacccgcccugcugccccuggaccugcugcugaaggugcccccccacaugcugagagcccacaucaaggagaucgaggccgagcuggugaccggcuggcagagccacagccugcccgccgugauccugagaaaccugaaggaccacgccagcgccggcaucgccgugagccagagaaaggugagacagaucagcgaccccauccagcagauccugauccagcugcacaagaucaucuacaucacccagcugccccccgcccugcaccacaaccugaagagaagagugaucgagagauucaagaagagccuguucagccagcagagcaaccccugcaaccugaagagcgagaucaagaagcugagccagggcagccccgagcccaucgagcccaacuucuucaccgccgacuaccaccugcugcacagaagcagcggcggcaacagccugagccccaacgaccccaccggccugcccaccagcaucgagcuggaggagggcaucaccuacgagcagaugcagaccgugaucgaggaggugcuggaggagagcggcuacuacaacuucaccagcaacagauaccacagcuaccccuggggcaccaagaaccaccccaccaagagauaa

SEQ ID NO: 20451 - RNA, 1800 nt, Artificial Sequence
  NEK11__Homo_sapiens__NP_001139475
augcugaaguuccaggaggccgccaagugcgugagcggcagcaccgccaucagcaccuaccccaagacccugaucgccagaagauacgugcugcagcagaagcugggcagcggcagcuucggcaccguguaccuggugagcgacaagaaggccaagagaggcgaggagcugaaggugcugaaggagaucagcgugggcgagcugaaccccaacgagaccgugcaggccaaccuggaggcccagcugcugagcaagcuggaccaccccgccaucgugaaguuccacgccagcuucguggagcaggacaacuucugcaucaucaccgaguacugcgagggcagagaccuggacgacaagauccaggaguacaagcaggccggcaagaucuuccccgagaaccagaucaucgagugguucauccagcugcugcugggcguggacuacaugcacgagagaagaauccugcacagagaccugaagagcaagaacguguuccugaagaacaaccugcugaagaucggcgacuucggcgugagcagacugcugaugggcagcugcgaccuggccaccacccugaccggcaccccccacuacaugagccccgaggcccugaagcaccagggcuacgacaccaagagcgacaucuggagccuggccugcauccuguacgagaugugcugcaugaaccacgccuucgccggcagcaacuuccugagcaucgugcugaagaucguggagggcgacacccccagccugcccgagagauaccccaaggagcugaacgccaucauggagagcaugcugaacaagaaccccagccugagacccagcgccaucgagauccugaagauccccuaccuggacgagcagcugcagaaccugaugugcagauacagcgagaugacccuggaggacaagaaccuggacugccagaaggaggccgcccacaucaucaacgccaugcagaagagaauccaccugcagacccugagagcccugagcgaggugcagaagaugacccccagagagagaaugagacugagaaagcugcaggccgccgacgagaaggccagaaagcugaagaagaucguggaggagaaguacgaggagaacagcaagagaaugcaggagcugagaagcagaaacuuccagcagcugagcguggacgugcugcacgagaagacccaccugaagggcauggaggagaaggaggagcagcccgagggcagacugagcugcagcccccaggacgaggacgaggagagauggcagggcagagaggaggagagcgacgagcccacccuggagaaccugcccgagagccagcccauccccagcauggaccugcacgagcuggagagcaucguggaggacgccaccagcgaccugggcuaccacgagauccccgaggacccccugguggccgaggaguacuacgccgacgccuucgacagcuacugcgaggagagcgacgaggaggaggaggagaucgcccuggagagacccgagaaggagaucagaaacgagggcagccagcccgccuacagaaccaaccagcaggacagcgacaucgaggcccuggccagaugccuggagaacgugcugggcugcaccagccuggaccagcccugcagaagcuggggccagaaguaccugaagagaagcaucaucaccagcagagagcagggcaucagaaugcuggccaagcagagaagcgccagcguguggaagaaguggugccugaagcccgccaccgugcugaaguggaccagcagcugcacccugaagagcagcugcuaa

SEQ ID NO: 20452 - RNA, 3861 nt, Artificial Sequence
  NEK1__Homo_sapiens__NP_001186326
auggagaaguacgugagacugcagaagaucggcgagggcagcuucggcaaggccauccuggugaagagcaccgaggacggcagacaguacgugaucaaggagaucaacaucagcagaaugagcagcaaggagagagaggagagcagaagagagguggccgugcuggccaacaugaagcaccccaacaucgugcaguacagagagagcuucgaggagaacggcagccuguacaucgugauggacuacugcgagggcggcgaccuguucaagagaaucaacgcccagaagggcgugcuguuccaggaggaccagauccuggacugguucgugcagaucugccuggcccugaagcacgugcacgacagaaagauccugcacagagacaucaagagccagaacaucuuccugaccaaggacggcaccgugcagcugggcgacuucggcaucgccagagugcugaacagcaccguggagcuggccagaaccugcaucggcacccccuacuaccugagccccgagaucugcgagaacaagcccuacaacaacaagagcgacaucugggcccugggcugcgugcuguacgagcugugcacccugaagcacgccuucgaggccggcagcaugaagaaccuggugcugaagaucaucagcggcagcuucccccccgugagccugcacuacagcuacgaccugagaagccuggugagccagcuguucaagagaaaccccagagacagacccagcgugaacagcauccuggagaagggcuucaucgccaagagaaucgagaaguuccugagcccccagcugaucgccgaggaguucugccugaagaccuucagcaaguucggcagccagcccauccccgccaagagacccgccagcggccagaacagcaucagcgugaugcccgcccagaagaucaccaagcccgccgccaaguacggcaucccccuggccuacaagaaguacggcgacaagaagcugcacgagaagaagccccugcagaagcacaagcaggcccaccagacccccgagaagagagugaacaccggcgaggagagaagaaagaucagcgaggaggccgccagaaagagaagacuggaguucaucgagaaggagaagaagcagaaggaccagaucaucagccugaugaaggccgagcagaugaagagacaggagaaggagagacuggagagaaucaacagagccagagagcagggcuggagaaacgugcugagcgccggcggcagcggcgaggugaaggcccccuuccugggcagcggcggcaccaucgcccccagcagcuucagcagcagaggccaguacgagcacuaccacgccaucuucgaccagaugcagcagcagagagccgaggacaacgaggccaaguggaagagagagaucuacggcagaggccugcccgagagaggcauccugcccggcgugagacccggcuuccccuacggcgccgccggccaccaccacuuccccgacgccgacgacaucagaaagacccugaagagacugaaggccgugagcaagcaggccaacgccaacagacagaagggccagcuggccguggagagagccaagcagguggaggaguuccugcagagaaagagagaggccaugcagaacaaggccagagccgagggccacaugggcauccugcagaaccuggccgccauguacggcggcagacccagcagcagcagaggcggcaagcccagaaacaaggaggaggagguguaccuggccagacugagacagaucagacugcagaacuucaacgagagacagcagaucaaggccaagcugagaggcgagaagaaggaggccaaccacagcgagggccaggagggcagcgaggaggccgacaugagaagaaagaagaucgagagccugaaggcccacgccaacgccagagccgccgugcugaaggagcagcuggagagaaagagaaaggaggccuacgagagagagaagaaggugugggaggagcaccugguggccaagggcgugaagagcagcgacgugagccccccccugggccagcacgagaccggcggcagccccagcaagcagcagaugagaagcgugaucagcgugaccagcgcccugaaggaggugggcguggacagcagccugaccgacaccagagagaccagcgaggagaugcagaagaccaacaacgccaucagcagcaagagagagauccugagaagacugaacgagaaccugaaggcccaggaggacgagaagggcaagcagaaccugagcgacaccuucgagaucaacgugcacgaggacgccaaggagcacgagaaggagaagagcgugagcagcgacagaaagaagugggaggccggcggccagcuggugaucccccuggacgagcugacccuggacaccagcuucagcaccaccgagagacacaccgugggcgaggugaucaagcugggccccaacggcagccccagaagagccuggggcaagagccccaccgacagcgugcugaagauccugggcgaggccgagcugcagcugcagaccgagcugcuggagaacaccaccaucagaagcgagaucagccccgagggcgagaaguacaagccccugaucaccggcgagaagaaggugcagugcaucagccacgagaucaaccccagcgccaucguggacagccccguggagaccaagagccccgaguucagcgaggccagcccccagaugagccugaagcuggagggcaaccuggaggagcccgacgaccuggagaccgagauccugcaggagcccagcggcaccaacaaggacgagagccugcccugcaccaucaccgacguguggaucagcgaggagaaggagaccaaggagacccagagcgccgacagaaucaccauccaggagaacgaggugagcgaggacggcgugagcagcaccguggaccagcugagcgacauccacaucgagcccggcaccaacgacagccagcacagcaagugcgacguggacaagagcgugcagcccgagcccuucuuccacaagguggugcacagcgagcaccugaaccuggugccccaggugcagagcgugcagugcagccccgaggagagcuucgccuucagaagccacagccaccugccccccaagaacaagaacaagaacagccugcugaucggccugagcaccggccuguucgacgccaacaaccccaagaugcugagaaccugcagccugcccgaccugagcaagcuguucagaacccugauggacgugcccaccgugggcgacgugagacaggacaaccuggagaucgacgagaucgaggacgagaacaucaaggagggccccagcgacagcgaggacaucguguucgaggagaccgacaccgaccugcaggagcugcaggccagcauggagcagcugcugagagagcagcccggcgaggaguacagcgaggaggaggagagcgugcugaagaacagcgacguggagcccaccgccaacggcaccgacguggccgacgaggacgacaaccccagcagcgagagcgcccugaacgaggaguggcacagcgacaacagcgacggcgagaucgccagcgagugcgagugcgacagcguguucaaccaccuggaggagcugagacugcaccuggagcaggagaugggcuucgagaaguucuucgagguguacgagaagaucaaggccauccacgaggacgaggacgagaacaucgagaucugcagcaagaucgugcagaacauccugggcaacgagcaccagcaccuguacgccaagauccugcaccuggugauggccgacggcgccuaccaggaggacaacgacgaguaa

SEQ ID NO: 20453 - RNA, 1155 nt, Artificial Sequence
  NEK2__Homo_sapiens__NP_001191112
augcccagcagagccgaggacuacgaggugcuguacaccaucggcaccggcagcuacggcagaugccagaagaucagaagaaagagcgacggcaagauccugguguggaaggagcuggacuacggcagcaugaccgaggccgagaagcagaugcuggugagcgaggugaaccugcugagagagcugaagcaccccaacaucgugagauacuacgacagaaucaucgacagaaccaacaccacccuguacaucgugauggaguacugcgagggcggcgaccuggccagcgugaucaccaagggcaccaaggagagacaguaccuggacgaggaguucgugcugagagugaugacccagcugacccuggcccugaaggagugccacagaagaagcgacggcggccacaccgugcugcacagagaccugaagcccgccaacguguuccuggacggcaagcagaacgugaagcugggcgacuucggccuggccagaauccugaaccacgacaccagcuucgccaagaccuucgugggcacccccuacuacaugagccccgagcagaugaacagaaugagcuacaacgagaagagcgacaucuggagccugggcugccugcuguacgagcugugcgcccugaugccccccuucaccgccuucagccagaaggagcuggccggcaagaucagagagggcaaguucagaagaauccccuacagauacagcgacgagcugaacgagaucaucaccagaaugcugaaccugaaggacuaccacagacccagcguggaggagauccuggagaacccccugaucgccgaccugguggccgacgagcagagaagaaaccuggagagaagaggcagacagcugggcgagcccgagaagagccaggacagcagccccgugcugagcgagcugaagcugaaggagauccagcugcaggagagagagagagcccugaaggccagagaggagagacuggagcagaaggagcaggagcugugcgugagagagagacuggccgaggacaagcuggccagagccgagaaccugcugaagaacuacagccugcugaaggagagaaaguuccugagccuggccagcaaccccggcaugagaaucaaccuggugaacagaagcuggugcuacaaguaa

SEQ ID NO: 20454 - RNA, 1521 nt, Artificial Sequence
  NEK3__Homo_sapiens__NP_002489
auggacgacuacauggugcugagaaugaucggcgagggcagcuucggcagagcccugcuggugcagcacgagagcagcaaccagauguucgccaugaaggagaucagacugcccaagagcuucagcaacacccagaacagcagaaaggaggccgugcugcuggccaagaugaagcaccccaacaucguggccuucaaggagagcuucgaggccgagggccaccuguacaucgugauggaguacugcgacggcggcgaccugaugcagaagaucaagcagcagaagggcaagcuguuccccgaggacaugauccugaacugguucacccagaugugccugggcgugaaccacauccacaagaagagagugcugcacagagacaucaagagcaagaacaucuuccugacccagaacggcaaggugaagcugggcgacuucggcagcgccagacugcugagcaaccccauggccuucgccugcaccuacgugggcacccccuacuacgugccccccgagaucugggagaaccugcccuacaacaacaagagcgacaucuggagccugggcugcauccuguacgagcugugcacccugaagcaccccuuccaggccaacagcuggaagaaccugauccugaaggugugccagggcugcaucagcccccugcccagccacuacagcuacgagcugcaguuccuggugaagcagauguucaagagaaaccccagccacagacccagcgccaccacccugcugagcagaggcaucguggccagacuggugcagaagugccugccccccgagaucaucauggaguacggcgaggaggugcuggaggagaucaagaacagcaagcacaacacccccagaaagaagaccaaccccagcagaaucagaaucgcccugggcaacgaggccagcaccgugcaggaggaggagcaggacagaaagggcagccacaccgaccuggagagcaucaacgagaaccugguggagagcgcccugagaagagugaacagagaggagaagggcaacaagagcgugcaccugagaaaggccagcagccccaaccugcacagaagacagugggagaagaacgugcccaacaccgcccugaccgcccuggagaacgccagcauccugaccagcagccugaccgccgaggacgacagaggcggcagcgugaucaaguacagcaagaacaccaccagaaagcaguggcugaaggagacccccgacacccugcugaacauccugaagaacgccgaccugagccuggccuuccagaccuacaccaucuacagacccggcagcgagggcuuccugaagggcccccugagcgaggagaccgaggccagcgacagcguggacggcggccacgacagcgugauccuggaccccgagagacuggagcccggccuggacgaggaggacaccgacuucgaggaggaggacgacaaccccgacugggugagcgagcugaagaagagagccggcuggcagggccugugcgacagauaa

SEQ ID NO: 20455 - RNA, 2259 nt, Artificial Sequence
  NEK4__Homo_sapiens__NP_001180462
augccccuggccgccuacugcuaccugagaguggugggcaagggcagcuacggcgaggugacccuggugaagcacagaagagacggcaagcaguaccugcacgagaagcacauccugcacagagaccugaagacccagaacguguuccugaccagaaccaacaucaucaaggugggcgaccugggcaucgccagagugcuggagaaccacugcgacauggccagcacccugaucggcacccccuacuacaugagccccgagcuguucagcaacaagcccuacaacuacaagagcgacgugugggcccugggcugcugcguguacgagauggccacccugaagcacgccuucaacgccaaggacaugaacagccugguguacagaaucaucgagggcaagcugccccccaugcccagagacuacagccccgagcuggccgagcugaucagaaccaugcugagcaagagacccgaggagagacccagcgugagaagcauccugagacagcccuacaucaagagacagaucagcuucuuccuggaggccaccaagaucaagaccagcaagaacaacaucaagaacggcgacagccagagcaagcccuucgccaccguggugagcggcgaggccgagagcaaccacgaggugauccacccccagccccugagcagcgagggcagccagaccuacaucaugggcgagggcaagugccugagccaggagaagcccagagccagcggccugcugaagagccccgccagccugaaggcccacaccugcaagcaggaccugagcaacaccaccgagcuggccaccaucagcagcgugaacaucgacauccugcccgccaagggcagagacagcgugagcgacggcuucgugcaggagaaccagcccagauaccuggacgccagcaacgagcugggcggcaucugcagcaucagccagguggaggaggagaugcugcaggacaacaccaagagcagcgcccagcccgagaaccugauccccauguggagcagcgacaucgugaccggcgagaagaacgagcccgugaagccccugcagccccugaucaaggagcagaagcccaaggaccagagccuggcccugagccccaagcuggagugcagcggcaccauccuggcccacagcaaccugagacugcugggcagcagcgacagccccgccagcgccagcagaguggccggcaucaccggcgugugccaccacgcccaggaccagguggccggcgagugcaucaucgagaagcagggcagaauccaccccgaccugcagccccacaacagcggcagcgagcccagccugagcagacagagaagacagaagagaagagagcagaccgagcacagaggcgagaagagacaggugagaagagaccuguucgccuuccaggagagcccccccagauuccugcccagccaccccaucgugggcaagguggacgugaccagcacccagaaggaggccgagaaccagagaagaguggugaccggcagcgugagcagcagcagaagcagcgagaugagcagcagcaaggacagaccccugagcgccagagagagaagaagacugaagcagagccaggaggagaugagcagcagcggccccagcgugagaaaggccagccugagcguggccggccccggcaagccccaggaggaggaccagccccugcccgccagaagacugagcagcgacugcagcgugacccaggagagaaagcagauccacugccugagcgaggacgagcugagcagcagcaccagcagcaccgacaagagcgacggcgacuacggcgagggcaagggccagaccaacgagaucaacgcccuggugcagcugaugacccagacccugaagcuggacagcaaggagagcugcgaggacgugcccguggccaaccccgugagcgaguucaagcugcacagaaaguacagagacacccugauccugcacggcaagguggccgaggaggccgaggagauccacuucaaggagcugcccagcgccaucaugcccggcagcgagaagaucagaagacugguggaggugcugagaaccgacgugaucagaggccugggcgugcagcugcuggagcagguguacgaccugcuggaggaggaggacgaguucgacagagaggugagacugagagagcacaugggcgagaaguacaccaccuacagcgugaaggccagacagcugaaguucuucgaggagaacaugaacuucuaa

SEQ ID NO: 20456 - RNA, 1044 nt, Artificial Sequence
  NEK6__Homo_sapiens__NP_001138473
augcccagaagagaggugugcugggaggccgcccacuucagacaggaggagcagagccugcccagacccagagugagagcccuggugagacuggccugcagaauggccggccagcccggccacaugccccacggcggcagcagcaacaaccugugccacacccugggccccgugcacccccccgacccccagagacaccccaacacccugagcuucagaugcagccuggccgacuuccagaucgagaagaagaucggcagaggccaguucagcgagguguacaaggccaccugccugcuggacagaaagaccguggcccugaagaaggugcagaucuucgagaugauggacgccaaggccagacaggacugcgugaaggagaucggccugcugaagcagcugaaccaccccaacaucaucaaguaccuggacagcuucaucgaggacaacgagcugaacaucgugcuggagcuggccgacgccggcgaccugagccagaugaucaaguacuucaagaagcagaagagacugauccccgagagaaccguguggaaguacuucgugcagcugugcagcgccguggagcacaugcacagcagaagagugaugcacagagacaucaagcccgccaacguguucaucaccgccaccggcguggugaagcugggcgaccugggccugggcagauucuucagcagcgagaccaccgccgcccacagccuggugggcacccccuacuacaugagccccgagagaauccacgagaacggcuacaacuucaagagcgacaucuggagccugggcugccugcuguacgagauggccgcccugcagagccccuucuacggcgacaagaugaaccuguucagccugugccagaagaucgagcagugcgacuaccccccccugcccggcgagcacuacagcgagaagcugagagagcuggugagcaugugcaucugccccgacccccaccagagacccgacaucggcuacgugcaccagguggccaagcagaugcacaucuggaugagcagcaccuaa

SEQ ID NO: 20457 - RNA, 909 nt, Artificial Sequence
  NEK7__Homo_sapiens__NP_598001
auggacgagcagagccagggcaugcagggcccccccgugccccaguuccagccccagaaggcccugagacccgacaugggcuacaacacccuggccaacuucagaaucgagaagaagaucggcagaggccaguucagcgagguguacagagccgccugccugcuggacggcgugcccguggcccugaagaaggugcagaucuucgaccugauggacgccaaggccagagccgacugcaucaaggagaucgaccugcugaagcagcugaaccaccccaacgugaucaaguacuacgccagcuucaucgaggacaacgagcugaacaucgugcuggagcuggccgacgccggcgaccugagcagaaugaucaagcacuucaagaagcagaagagacugauccccgagagaaccguguggaaguacuucgugcagcugugcagcgcccuggagcacaugcacagcagaagagugaugcacagagacaucaagcccgccaacguguucaucaccgccaccggcguggugaagcugggcgaccugggccugggcagauucuucagcagcaagaccaccgccgcccacagccuggugggcacccccuacuacaugagccccgagagaauccacgagaacggcuacaacuucaagagcgacaucuggagccugggcugccugcuguacgagauggccgcccugcagagccccuucuacggcgacaagaugaaccuguacagccugugcaagaagaucgagcagugcgacuaccccccccugcccagcgaccacuacagcgaggagcugagacagcuggugaacaugugcaucaaccccgaccccgagaagagacccgacgugaccuacguguacgacguggccaagagaaugcacgccugcaccgccagcagcuaa

SEQ ID NO: 20458 - RNA, 2079 nt, Artificial Sequence
  NEK8__Homo_sapiens__NP_835464
auggagaaguacgagagaaucagaguggugggcagaggcgccuucggcaucgugcaccugugccugagaaaggccgaccagaagcuggugaucaucaagcagauccccguggagcagaugaccaaggaggagagacaggccgcccagaacgagugccaggugcugaagcugcugaaccaccccaacgugaucgaguacuacgagaacuuccuggaggacaaggcccugaugaucgccauggaguacgcccccggcggcacccuggccgaguucauccagaagagaugcaacagccugcuggaggaggagaccauccugcacuucuucgugcagauccugcuggcccugcaccacgugcacacccaccugauccugcacagagaccugaagacccagaacauccugcuggacaagcacagaaugguggugaagaucggcgacuucggcaucagcaagauccugagcagcaagagcaaggccuacaccguggugggcacccccugcuacaucagccccgagcugugcgagggcaagcccuacaaccagaagagcgacaucugggcccugggcugcgugcuguacgagcuggccagccugaagagagccuucgaggccgccaaccugcccgcccuggugcugaagaucaugagcggcaccuucgcccccaucagcgacagauacagccccgagcugagacagcuggugcugagccugcugagccuggagcccgcccagagacccccccugagccacaucauggcccagccccugugcaucagagcccugcugaaccugcacaccgacgugggcagcgugagaaugagaagagccgagaagagcguggcccccagcaacaccggcagcagaaccaccagcgugagaugcagaggcauccccagaggccccgugagacccgccaucccccccccccugagcagcguguacgccuggggcggcggccugggcaccccccugagacugcccaugcugaacaccgagguggugcagguggccgccggcagaacccagaaggccggcgugaccagaagcggcagacugauccugugggaggcccccccccugggcgccggcggcggcagccugcugcccggcgccguggagcagccccagccccaguucaucagcagauuccuggagggccagagcggcgugaccaucaagcacguggccugcggcgacuucuucaccgccugccugaccgacagaggcaucaucaugaccuucggcagcggcagcaacggcugccugggccacggcagccugaccgacaucagccagcccaccaucguggaggcccugcugggcuacgagauggugcagguggccugcggcgccagccacgugcuggcccugagcaccgagagagagcuguucgccuggggcagaggcgacagcggcagacugggccugggcaccagagagagccacagcugcccccagcaggugcccaugccccccggccaggaggcccagagaguggugugcggcaucgacagcagcaugauccugaccgugcccggccaggcccuggccugcggcagcaacagauucaacaagcugggccuggaccaccugagccugggcgaggagcccgugccccaccagcagguggaggaggcccugagcuucacccugcugggcagcgccccccuggaccaggagccccugcugagcaucgaccugggcaccgcccacagcgccgccgugaccgccagcggcgacugcuacaccuucggcagcaaccagcacggccagcugggcaccaacaccagaagaggcagcagagcccccugcaaggugcagggccuggagggcaucaagauggccaugguggccugcggcgacgccuucaccguggccaucggcgccgagagcgagguguacagcuggggcaagggcgccagaggcagacugggcagaagagacgaggacgccggccugcccagacccgugcagcuggacgagacccaccccuacaccgugaccagcgugagcugcugccacggcaacacccugcuggccgugagaagcgugaccgacgagcccgugccccccuaa

SEQ ID NO: 20459 - RNA, 2940 nt, Artificial Sequence
  NEK9__Homo_sapiens__NP_149107
augagcgugcugggcgaguacgagagacacugcgacagcaucaacagcgacuucggcagcgagagcggcggcugcggcgacagcagccccggccccagcgccagccagggccccagagccggcggcggcgccgccgagcaggaggagcugcacuacauccccaucagagugcugggcagaggcgccuucggcgaggccacccuguacagaagaaccgaggacgacagccuggugguguggaaggagguggaccugaccagacugagcgagaaggagagaagagacgcccugaacgagaucgugauccuggcccugcugcagcacgacaacaucaucgccuacuacaaccacuucauggacaacaccacccugcugaucgagcuggaguacugcaacggcggcaaccuguacgacaagauccugagacagaaggacaagcuguucgaggaggagaugguggugugguaccuguuccagaucgugagcgccgugagcugcauccacaaggccggcauccugcacagagacaucaagacccugaacaucuuccugaccaaggccaaccugaucaagcugggcgacuacggccuggccaagaagcugaacagcgaguacagcauggccgagacccuggugggcacccccuacuacaugagccccgagcugugccagggcgugaaguacaacuucaagagcgacaucugggccgugggcugcgugaucuucgagcugcugacccugaagagaaccuucgacgccaccaacccccugaaccugugcgugaagaucgugcagggcaucagagccauggagguggacagcagccaguacagccuggagcugauccagauggugcacagcugccuggaccaggaccccgagcagagacccaccgccgacgagcugcuggacagaccccugcugagaaagagaagaagagagauggaggagaaggugacccugcugaacgcccccaccaagagacccagaagcagcaccgugaccgaggcccccaucgccguggugaccagcagaaccagcgagguguacguguggggcggcggcaagagcaccccccagaagcuggacgugaucaagagcggcugcagcgccagacaggugugcgccggcaacacccacuucgccguggugaccguggagaaggagcuguacaccugggugaacaugcagggcggcaccaagcugcacggccagcugggccacggcgacaaggccagcuacagacagcccaagcacguggagaagcugcagggcaaggccaucagacaggugagcugcggcgacgacuucaccgugugcgugaccgacgagggccagcuguacgccuucggcagcgacuacuacggcugcaugggcguggacaagguggccggccccgaggugcuggagcccaugcagcugaacuucuuccugagcaaccccguggagcaggugagcugcggcgacaaccacgugguggugcugaccagaaacaaggagguguacagcuggggcugcggcgaguacggcagacugggccuggacagcgaggaggacuacuacaccccccagaagguggacgugcccaaggcccugaucaucguggccgugcagugcggcugcgacggcaccuuccugcugacccagagcggcaaggugcuggccugcggccugaacgaguucaacaagcugggccugaaccagugcaugagcggcaucaucaaccacgaggccuaccacgaggugcccuacaccaccagcuucacccuggccaagcagcugagcuucuacaagaucagaaccaucgcccccggcaagacccacaccgccgccaucgacgagagaggcagacugcugaccuucggcugcaacaagugcggccagcugggcgugggcaacuacaagaagagacugggcaucaaccugcugggcggcccccugggcggcaagcaggugaucagagugagcugcggcgacgaguucaccaucgccgccaccgacgacaaccacaucuucgccuggggcaacggcggcaacggcagacuggccaugacccccaccgagagaccccacggcagcgacaucugcaccagcuggcccagacccaucuucggcagccugcaccacgugcccgaccugagcugcagaggcuggcacaccauccugaucguggagaaggugcugaacagcaagaccaucagaagcaacagcagcggccugagcaucggcaccguguuccagagcagcagccccggcggcggcggcggcggcggcggcggcgaggaggaggacagccagcaggagagcgagacccccgaccccagcggcggcuucagaggcaccauggaggccgacagaggcauggagggccugaucagccccaccgaggccaugggcaacagcaacggcgccagcagcagcugccccggcuggcugagaaaggagcuggagaacgccgaguucauccccaugcccgacagccccagcccccugagcgccgccuucagcgagagcgagaaggacacccugcccuacgaggagcugcagggccugaagguggccagcgaggccccccuggagcacaagccccagguggaggccagcagccccagacugaaccccgccgugaccugcgccggcaagggcaccccccugaccccccccgccugcgccugcagcagccugcagguggagguggagagacugcagggccuggugcugaagugccuggccgagcagcagaagcugcagcaggagaaccugcagaucuucacccagcugcagaagcugaacaagaagcuggagggcggccagcaggugggcaugcacagcaagggcacccagaccgccaaggaggagauggagauggaccccaagcccgaccuggacagcgacagcuggugccugcugggcaccgacagcugcagacccagccuguaa

SEQ ID NO: 20460 - RNA, 1620 nt, Artificial Sequence
  NELFA__Homo_sapiens__NP_005654
augcccggccagagaagagcccugagccccaagauggccagcaugagagagagcgacaccggccuguggcugcacaacaagcugggcgccaccgacgagcugugggccccccccagcaucgccagccugcugaccgccgccgugaucgacaacaucagacugugcuuccacggccugagcagcgccgugaagcugaagcugcugcugggcacccugcaccugcccagaagaaccguggacgagaugaagggcgcccugauggagaucauccagcuggccagccuggacagcgaccccugggugcugaugguggccgacauccugaagagcuuccccgacaccggcagccugaaccuggagcuggaggagcagaaccccaacgugcaggacauccugggcgagcugagagagaaggugggcgagugcgaggccagcgccaugcugccccuggagugccaguaccugaacaagaacgcccugaccacccuggccggcccccugaccccccccgugaagcacuuccagcugaagagaaagcccaagagcgccacccugagagccgagcugcugcagaagagcaccgagaccgcccagcagcugaagagaagcgccggcgugcccuuccacgccaagggcagaggccugcugagaaagauggacaccaccaccccccugaagggcauccccaagcaggcccccuucagaagccccaccgcccccagcguguucagccccaccggcaacagaacccccaucccccccagcagaacccugcugagaaaggagagaggcgugaagcugcuggacaucagcgagcuggacauggugggcgccggcagagaggccaagagaagaagaaagacccuggacgccgaggugguggagaagcccgccaaggaggagaccgugguggagaacgccacccccgacuacgccgccggccuggugagcacccagaagcugggcagccugaacaacgagcccgcccugcccagcaccagcuaccugcccagcacccccagcguggugcccgccagcagcuacauccccagcagcgagaccccccccgcccccagcagcagagaggccagcagaccccccgaggagcccagcgcccccagccccacccugcccgcccaguucaagcagagagcccccauguacaacagcggccugagccccgccacccccacccccgccgcccccaccagcccccugacccccaccaccccccccgccguggcccccaccacccagaccccccccguggccaugguggccccccagacccaggcccccgcccagcagcagcccaagaagaaccugagccugaccagagagcagauguucgccgcccaggagauguucaagaccgccaacaaggugaccagacccgagaaggcccugauccugggcuucauggccggcagcagagagaaccccugccaggagcagggcgacgugauccagaucaagcugagcgagcacaccgaggaccugcccaaggccgacggccagggcagcaccaccaugcugguggacaccguguucgagaugaacuacgccaccggccaguggaccagauucaagaaguacaagcccaugaccaacgugagcuaa

SEQ ID NO: 20461 - RNA, 1887 nt, Artificial Sequence
  NELFB__Homo_sapiens__NP_056271
auggccgagcuggagggcgccggcgagagaggcagcggcggccccagaggccccgccgagagagccagcggcgugagcgccgccgcccccggcgagagagccggcgacggcgcccccagcagagccguggccggcgccagcgccauguucgccggccugcaggaccugggcguggccaacggcgaggaccugaaggagacccugaccaacugcaccgagccccugaaggccaucgagcaguuccagaccgagaacggcgugcugcugcccagccugcagagcgcccugcccuuccuggaccugcacggcacccccagacuggaguuccaccagagcguguucgacgagcugagagacaagcugcuggagagagugagcgccaucgccagcgagggcaaggccgaggagagauacaagaagcuggaggaccugcuggagaagagcuucagccuggugaagaugcccagccugcagcccguggugaugugcgugaugaagcaccugcccaaggugcccgagaagaagcugaagcuggugauggccgacaaggagcuguacagagccugcgccguggaggugaagagacagaucuggcaggacaaccaggcccuguucggcgacgaggugagcccccugcugaagcaguacauccuggagaaggagagcgcccuguucagcaccgagcugagcgugcugcacaacuucuucagccccagccccaagaccagaagacagggcgagguggugcagagacugaccagaauggugggcaagaacgugaagcuguacgacauggugcugcaguuccugagaacccuguuccugagaaccagaaacgugcacuacugcacccugagagccgagcugcugaugagccugcacgaccuggacgugggcgagaucugcaccguggaccccugccacaaguucaccuggugccuggacgccugcaucagagagagauucguggacagcaagagagccagagagcugcagggcuuccuggacggcgugaagaagggccaggagcaggugcugggcgaccugagcaugauccugugcgaccccuucgccaucaacacccuggcccugagcaccgugagacaccugcaggagcuggugggccaggagacccugcccagagacagccccgaccugcugcugcugcugagacugcuggcccugggccagggcgccugggacaugaucgacagccagguguucaaggagcccaagauggagguggagcugaucaccagauuccugcccaugcugaugagcuuccugguggacgacuacaccuucaacguggaccagaagcugcccgccgaggagaaggcccccgugagcuaccccaacacccugcccgagagcuucaccaaguuccugcaggagcagagaauggccugcgaggugggccuguacuacgugcugcacaucaccaagcagagaaacaagaacgcccugcugagacugcugcccggccugguggagaccuucggcgaccuggccuucggcgacaucuuccugcaccugcugaccggcaaccuggcccugcuggccgacgaguucgcccuggaggacuucugcagcagccuguucgacggcuucuuccugaccgccagccccagaaaggagaacgugcacagacacgcccugagacugcugauccaccugcaccccagaguggcccccagcaagcuggaggcccugcagaaggcccuggagcccaccggccagagcggcgaggccgugaaggagcuguacagccagcugggcgagaagcuggagcagcuggaccacagaaagcccagccccgcccaggccgccgagacccccgcccuggagcugccccugcccagcgugcccgcccccgccccccuguaa

SEQ ID NO: 20462 - RNA, 1800 nt, Artificial Sequence
  NELFCD__Homo_sapiens__NP_945327
augagaagagccagaagcagagagggcauggccggcgccgugcccggcgccaucauggacgaggacuacuacggcagcgccgccgaguggggcgacgaggccgacggcggccagcaggaggacgacagcggcgagggcgaggacgacgccgaggugcagcaggagugccugcacaaguucagcaccagagacuacaucauggagcccagcaucuucaacacccugaagagauacuuccaggccggcggcagccccgagaacgugauccagcugcugagcgagaacuacaccgccguggcccagaccgugaaccugcuggccgaguggcugauccagaccggcguggagcccgugcaggugcaggagaccguggagaaccaccugaagagccugcugaucaagcacuucgaccccagaaaggccgacagcaucuucaccgaggagggcgagacccccgccuggcuggagcagaugaucgcccacaccaccuggagagaccuguucuacaagcuggccgaggcccaccccgacugccugaugcugaacuucaccgugaagcugaucagcgacgccggcuaccagggcgagaucaccagcgugagcaccgccugccagcagcuggagguguucagcagagugcugagaaccagccuggccaccauccuggacggcggcgaggagaaccuggagaagaaccugcccgaguucgccaagauggugugccacggcgagcacaccuaccuguucgcccaggccaugaugagcgugcuggcccaggaggagcagggcggcagcgccgugagaagaaucgcccaggaggugcagagauucgcccaggagaagggccacgacgccagccagaucacccuggcccugggcaccgccgccagcuaccccagagccugccaggcccugggcgccaugcugagcaagggcgcccugaaccccgccgacaucaccgugcuguucaagauguucaccagcauggaccccccccccguggagcugaucagagugcccgccuuccuggaccuguucaugcagagccuguucaagcccggcgccagaaucaaccaggaccacaagcacaaguacauccacauccuggccuacgccgccagcgugguggagaccuggaagaagaacaagagagugagcaucaacaaggacgagcugaagagcaccagcaaggccguggagaccgugcacaaccugugcugcaacgagaacaagggcgccagcgagcugguggccgagcugagcacccuguaccagugcaucagauuccccgugguggccaugggcgugcugaaguggguggacuggaccgugagcgagcccagauacuuccagcugcagaccgaccacacccccgugcaccuggcccugcuggacgagaucagcaccugccaccagcugcugcacccccaggugcugcagcugcuggugaagcuguucgagaccgagcacagccagcuggacgugauggagcagcuggagcugaagaagacccugcuggacagaauggugcaccugcugagcagaggcuacgugcugcccguggugagcuacaucagaaagugccuggagaagcuggacaccgacaucagccugaucagauacuucgugaccgaggugcuggacgugaucgccccccccuacaccagcgacuucgugcagcuguuccugcccauccuggagaacgacagcaucgccggcaccaucaagaccgagggcgagcacgaccccgugaccgaguucaucgcccacugcaagagcaacuucaucauggugaacuaa

SEQ ID NO: 20463 - RNA, 1143 nt, Artificial Sequence
  NELFE__Homo_sapiens__NP_002895
augcuggugaucccccccggccugagcgaggaggaggaggcccugcagaagaaguucaacaagcugaagaagaagaagaaggcccugcuggcccugaagaagcagagcagcagcagcaccaccagccagggcggcgugaagagaagccugagcgagcagcccgugauggacaccgccaccgccaccgagcaggccaagcagcuggugaagagcggcgccaucagcgccaucaaggccgagaccaagaacagcggcuucaagagaagcagaacccuggagggcaagcugaaggaccccgagaagggccccgugcccaccuuccagcccuuccagagaagcaucagcgccgacgacgaccugcaggagagcagcagaagaccccagagaaagagccuguacgagagcuucgugagcagcagcgacagacugagagagcugggccccgacggcgaggaggccgagggccccggcgccggcgacggcccccccagaagcuucgacuggggcuacgaggagagaagcggcgcccacagcagcgccagcccccccagaagcagaagcagagacagaagccacgagagaaacagagacagagacagagacagagagagagacagagacagagacagagacagagacagagagagagacagagacagagacagagacagagacagagacagagagagagacagagacagagagagagacagagacagagacagagagggccccuucagaagaagcgacagcuuccccgagagaagagcccccagaaagggcaacacccuguacguguacggcgaggacaugacccccacccugcugagaggcgccuucagccccuucggcaacaucaucgaccugagcauggacccccccagaaacugcgccuucgugaccuacgagaagauggagagcgccgaccaggccguggccgagcugaacggcacccagguggagagcgugcagcugaaggugaacaucgccagaaagcagcccaugcuggacgccgccaccggcaagagcguguggggcagccuggccgugcagaacagccccaagggcugccacagagacaagagaacccagaucguguacagcgacgacguguacaaggagaaccugguggacggcuucuaa

SEQ ID NO: 20464 - RNA, 2262 nt, Artificial Sequence
  NELL1__Homo_sapiens__NP_001275643
augcccauggaccugauccugguggugugguucugcgugugcaccgccagaaccguggugggcuucggcauggaccccgaccugcagauggacaucgugaccgagcuggaccuggugaacaccacccugggcguggcccaggugagcggcaugcacaacgccagcaaggccuuccuguuccaggacaucgagagagagauccacgccgccccccacgugagcgagaagcugauccagcuguucagaaacaagagcgaguucaccauccuggccaccgugcagcagaagcccagcaccagcggcgugauccugagcaucagagagcuggagcacagaaucuacgagagagugaucgacccccccgacaccaaccugccccccggcaucaaccuguggcugggccagagaaaccagaagcacggccuguucaagggcaucauccaggacggcaagaucaucuucaugcccaacggcuacaucacccagugccccaaccugaaccacaccugccccaccugcagcgacuuccugagccuggugcagggcaucauggaccugcaggagcugcuggccaagaugaccgccaagcugaacuacgccgagaccagacugagccagcuggagaacugccacugcgagaagaccugccaggugagcggccugcuguacagagaccaggacagcuggguggacggcgaccacugcagaaacugcaccugcaagagcggcgccguggagugcagaagaaugagcugccccccccugaacugcagccccgacagccugcccgugcacaucgccggccagugcugcaaggugugcagacccaagugcaucuacggcggcaaggugcuggccgagggccagagaauccugaccaagagcugcagagagugcagaggcggcgugcuggugaagaucaccgagaugugccccccccugaacugcagcgagaaggaccacauccugcccgagaaccagugcugcagagugugcagaggccacaacuucugcgccgagggccccaagugcggcgagaacagcgagugcaagaacuggaacaccaaggccaccugcgagugcaagagcggcuacaucagcgugcagggcgacagcgccuacugcgaggacaucgacgagugcgccgccaagaugcacuacugccacgccaacaccgugugcgugaaccugcccggccuguacagaugcgacugcgugcccggcuacaucagaguggacgacuucagcugcaccgagcacgacgagugcggcagcggccagcacaacugcgacgagaacgccaucugcaccaacaccgugcagggccacagcugcaccugcaagcccggcuacgugggcaacggcaccaucugcagagccuucugcgaggagggcugcagauacggcggcaccugcguggcccccaacaagugcgugugccccagcggcuucaccggcagccacugcgagaaggacaucgacgagugcagcgagggcaucaucgagugccacaaccacagcagaugcgugaaccugcccggcugguaccacugcgagugcagaagcggcuuccacgacgacggcaccuacagccugagcggcgagagcugcaucgacaucgacgagugcgcccugagaacccacaccugcuggaacgacagcgccugcaucaaccuggccggcggcuucgacugccugugccccagcggccccagcugcagcggcgacugcccccacgagggcggccugaagcacaacggccagguguggacccugaaggaggacagaugcagcgugugcagcugcaaggacggcaagaucuucugcagaagaaccgccugcgacugccagaaccccagcgccgaccuguucugcugccccgagugcgacaccagagugaccagccagugccuggaccagaacggccacaagcuguacagaagcggcgacaacuggacccacagcugccagcagugcagaugccuggagggcgagguggacugcuggccccugaccugccccaaccugagcugcgaguacaccgccauccuggagggcgagugcugccccagaugcgugagcgaccccugccuggccgacaacaucaccuacgacaucagaaagaccugccuggacagcuacggcgugagcagacugagcggcagcguguggaccauggccggcagccccugcaccaccugcaagugcaagaacggcagagugugcugcagcguggacuucgagugccugcagaacaacuaa

SEQ ID NO: 20465 - RNA, 2601 nt, Artificial Sequence
  NELL2__Homo_sapiens__NP_001138579
augggcuuccccccccugcugaagggccaggccagcgccaccagaagcagccuggccagcugcagcugggugguguucuuccugagcugccugagcagacacgcccccgagaucgagggcggcagaagauggaccgagcugaucagaaccauggagagcagagugcugcugagaaccuucugccugaucuucggccugggcgccguguggggccugggcguggaccccagccugcagaucgacgugcugaccgagcuggagcugggcgagagcaccaccggcgugagacaggugcccggccugcacaacggcaccaaggccuuccuguuccaggacacccccagaagcaucaaggccagcaccgccaccgccgagcaguucuuccagaagcugagaaacaagcacgaguucaccauccuggugacccugaagcagacccaccugaacagcggcgugauccugagcauccaccaccuggaccacagauaccuggagcuggagagcagcggccacagaaacgaggugagacugcacuacagaagcggcagccacagaccccacaccgagguguuccccuacauccuggccgacgacaaguggcacaagcugagccuggccaucagcgccagccaccugauccugcacaucgacugcaacaagaucuacgagagagugguggagaagcccagcaccgaccugccccugggcaccaccuucuggcugggccagagaaacaacgcccacggcuacuucaagggcaucaugcaggacgugcagcugcuggugaugccccagggcuucaucgcccagugccccgaccugaacagaaccugccccaccugcaacgacuuccacggccuggugcagaagaucauggagcugcaggacauccuggccaagaccagcgccaagcugagcagagccgagcagagaaugaacagacuggaccagugcuacugcgagagaaccugcaccaugaagggcaccaccuacagagaguucgagagcuggaucgacggcugcaagaacugcaccugccugaacggcaccauccagugcgagacccugaucugccccaaccccgacugcccccugaagagcgcccuggccuacguggacggcaagugcugcaaggagugcaagagcaucugccaguuccagggcagaaccuacuucgagggcgagagaaacaccguguacagcagcagcggcgugugcgugcuguacgagugcaaggaccagaccaugaagcugguggagagcagcggcugccccgcccuggacugccccgagagccaccagaucacccugagccacagcugcugcaaggugugcaagggcuacgacuucugcagcgagagacacaacugcauggagaacagcaucugcagaaaccugaacgacagagccgugugcagcugcagagacggcuucagagcccugagagaggacaacgccuacugcgaggacaucgacgagugcgccgagggcagacacuacugcagagagaacaccaugugcgugaacacccccggcagcuucaugugcaucugcaagaccggcuacaucagaaucgacgacuacagcugcaccgagcacgacgagugcaucaccaaccagcacaacugcgacgagaacgcccugugcuucaacaccgugggcggccacaacugcgugugcaagcccggcuacaccggcaacggcaccaccugcaaggccuucugcaaggacggcugcagaaacggcggcgccugcaucgccgccaacgugugcgccugcccccagggcuucaccggccccagcugcgagaccgacaucgacgagugcagcgacggcuucgugcagugcgacagcagagccaacugcaucaaccugcccggcugguaccacugcgagugcagagacggcuaccacgacaacggcauguucagccccagcggcgagagcugcgaggacaucgacgagugcggcaccggcagacacagcugcgccaacgacaccaucugcuucaaccuggacggcggcuacgacugcagaugcccccacggcaagaacugcaccggcgacugcauccacgacggcaaggugaagcacaacggccagaucugggugcuggagaacgacagaugcagcgugugcagcugccagaacggcuucgugaugugcagaagaauggugugcgacugcgagaaccccaccguggaccuguucugcugccccgagugcgaccccagacugagcagccagugccugcaccagaacggcgagacccuguacaacagcggcgacaccugggugcagaacugccagcagugcagaugccugcagggcgagguggacugcuggccccugcccugccccgacguggagugcgaguucagcauccugcccgagaacgagugcugccccagaugcgugaccgaccccugccaggccgacaccaucagaaacgacaucaccaagaccugccuggacgagaugaacguggugagauucaccggcagcagcuggaucaagcacggcaccgagugcacccugugccagugcaagaacggccacaucugcugcagcguggacccccagugccugcaggagcuguaa

SEQ ID NO: 20466 - RNA, 3168 nt, Artificial Sequence
  NEMF__Homo_sapiens__NP_001288661
augaagagcagauucagcaccaucgaccugagagccgugcuggccgagcugaacgccagccugcugggcaugagagugaacaacguguacgacguggacaacaagaccuaccugaucagacugcagaagcccgacuucaaggccacccugcugcuggagagcggcaucagaauccacaccaccgaguucgaguggcccaagaacaugaugcccagcagcuucgccaugaagugcagaaagcaccugaagagcagaagacuggugagcgccaagcagcugggcguggacagaaucguggacuuccaguucggcagcgacgaggccgccuaccaccugaucaucgagcuguacgacagaggcaacaucgugcugaccgacuacgaguacgugauccugaacauccugagauucagaaccgacgaggccgacgacgugaaguucgccgugagagagagauacccccuggaccacgccagagccgccgagccccugcugacccuggagagacugaccgagaucguggccagcgcccccaagggcgagcugcugaagagagugcugaacccccugcugcccuacggccccgcccugaucgagcacugccugcuggagaacggcuucagcggcaacgugaagguggacgagaagcuggagaccaaggacaucgagaaggugcuggugagccugcagaaggccgaggacuacaugaagaccaccagcaacuucagcggcaagggcuacaucauccagaagagagagaucaagcccugccuggaggccgacaagcccguggaggacauccugaccuacgaggaguuccaccccuuccuguucagccagcacagccagugccccuacaucgaguucgagagcuucgacaaggccguggacgaguucuacagcaagaucgagggccagaagaucgaccugaaggcccugcagcaggagaagcaggcccugaagaagcuggacaacgugagaaaggaccacgagaacagacuggaggcccugcagcaggcccaggagaucgacaagcugaagggcgagcugaucgagaugaaccugcagaucguggacagagccauccagguggugagaagcgcccuggccaaccagaucgacuggaccgagaucggccugaucgugaaggaggcccaggcccagggcgaccccguggccagcgccaucaaggagcugaagcugcagaccaaccacgugaccaugcugcugagaaaccccuaccugcugagcgaggaggaggacgacgacguggacggcgacgugaacguggagaagaacgagaccgagccccccaagggcaagaagaagaagcagaagaacaagcagcugcagaagccccagaagaacaagccccugcugguggacguggaccugagccugagcgccuacgccaacgccaagaaguacuacgaccacaagagauacgccgccaagaagacccagaagaccguggaggccgccgagaaggccuucaagagcgccgagaagaagaccaagcagacccugaaggaggugcagaccgugaccagcauccagaaggccagaaagguguacugguucgagaaguuccugugguucaucagcagcgagaacuaccugaucaucggcggcagagaccagcagcagaacgagaucaucgugaagagauaccugacccccggcgagcccaucccccccagaacccugaccgaggccggcaccauggcccugugcuacagcgccgccugggacgccagagugaucaccagcgccugguggguguaccaccaccaggugagcaagaccgcccccaccggcgaguaccugaccaccggcagcuucaugaucagaggcaagaagaacuuccugccccccagcuaccugaugaugggcuucagcuuccuguucaagguggacgagagcugcguguggagacaccagggcgagagaaaggugagagugcaggacgaggacauggagacccuggccagcugcaccagcgagcugaucagcgaggagauggagcagcuggacggcggcgacaccagcagcgacgaggacaaggaggagcacgagacccccguggagguggagcugaugacccagguggaccaggaggacaucacccugcagagcggcagagacgagcugaacgaggagcugauccaggaggagagcagcgaggacgagggcgaguacgaggaggugagaaaggaccaggacagcgugggcgagaugaaggacgagggcgaggagacccugaacuaccccgacaccaccaucgaccugagccaccugcagccccagagaagcauccagaagcuggccagcaaggaggagagcagcaacagcagcgacagcaagagccagagcagaagacaccugagcgccaaggagagaagagagaugaagaagaagaagcugcccagcgacagcggcgaccuggaggcccuggagggcaaggacaaggagaaggagagcaccgugcacaucgagacccaccagaacaccagcaagaacguggccgccgugcagcccaugaagagaggccagaagagcaagaugaagaagaugaaggagaaguacaaggaccaggacgaggaggacagagagcugaucaugaagcugcugggcagcgccggcagcaacaaggaggagaagggcaagaagggcaagaagggcaagaccaaggacgagcccgugaagaagcagccccagaagcccagaggcggccagagagugagcgacaacaucaagaaggagacccccuuccuggaggugaucacccacgagcugcaggacuucgccguggacgacccccacgacgacaaggaggagcaggaccuggaccagcagggcaacgaggagaaccuguucgacagccugaccggccagccccaccccgaggacgugcugcuguucgccauccccaucugcgcccccuacaccaccaugaccaacuacaaguacaaggugaagcugacccccggcgugcagaagaagggcaaggccgccaagaccgcccugaacagcuucaugcacagcaaggaggccaccgccagagagaaggaccuguucagaagcgugaaggacaccgaccugagcagaaacauccccggcaaggugaaggugagcgcccccaaccugcugaacgugaagagaaaguaa

SEQ ID NO: 20467 - RNA, 4227 nt, Artificial Sequence
  NEO1__Homo_sapiens__NP_001166094
auggccgccgagagaggcgccagaagacugcugagcacccccagcuucuggcuguacugccugcugcugcugggcagaagagcccccggcgccgccgccgccagaagcggcagcgccccccagagccccggcgccagcaucagaaccuucacccccuucuacuuccugguggagcccguggacacccugagcgugagaggcagcagcgugauccugaacugcagcgccuacagcgagcccagccccaagaucgaguggaagaaggacggcaccuuccugaaccuggugagcgacgacagaagacagcugcugcccgacggcagccuguucaucagcaacguggugcacagcaagcacaacaagcccgacgagggcuacuaccagugcguggccaccguggagagccugggcaccaucaucagcagaaccgccaagcugaucguggccggccugcccagauucaccagccagcccgagcccagcagcguguacgccggcaacaacgccauccugaacugcgaggugaacgccgaccuggugcccuucgugagaugggagcagaacagacagccccugcugcuggacgacagagugaucaagcugcccagcggcaugcuggugaucagcaacgccaccgagggcgacggcggccuguacagaugcgugguggagagcggcggcccccccaaguacagcgacgagguggagcugaaggugcugcccgaccccgaggugaucagcgaccugguguuccugaagcagcccagcccccuggugagagugaucggccaggacguggugcugcccugcguggccagcggccugcccacccccaccaucaaguggaugaagaacgaggaggcccuggacaccgagagcagcgagagacuggugcugcuggccggcggcagccuggagaucagcgacgugaccgaggacgacgccggcaccuacuucugcaucgccgacaacggcaacgagaccaucgaggcccaggccgagcugaccgugcaggcccagcccgaguuccugaagcagcccaccaacaucuacgcccacgagagcauggacaucguguucgagugcgaggugaccggcaagcccacccccaccgugaagugggugaagaacggcgacauggugauccccagcgacuacuucaagaucgugaaggagcacaaccugcaggugcugggccuggugaagagcgacgagggcuucuaccagugcaucgccgagaacgacgugggcaacgcccaggccggcgcccagcugaucauccuggagcacgcccccgccaccaccggcccccugcccagcgcccccagagacgugguggccagccuggugagcaccagauucaucaagcugaccuggagaacccccgccagcgacccccacggcgacaaccugaccuacagcguguucuacaccaaggagggcaucgccagagagagaguggagaacaccagccaccccggcgagaugcaggugaccauccagaaccugaugcccgccaccguguacaucuucagagugauggcccagaacaagcacggcagcggcgagagcagcgccccccugagaguggagacccagcccgaggugcagcugcccggccccgcccccaaccugagagccuacgccgccagccccaccagcaucaccgugaccugggagacccccgugagcggcaacggcgagauccagaacuacaagcuguacuacauggagaagggcaccgacaaggagcaggacguggacgugagcagccacagcuacaccaucaacggccugaagaaguacaccgaguacagcuucagagugguggccuacaacaagcacggccccggcgugagcacccccgacguggccgugagaacccugagcgacgugcccagcgccgccccccagaaccugagccuggaggugagaaacagcaagagcaucaugauccacuggcagccccccgcccccgccacccagaacggccagaucaccggcuacaagaucagauacagaaaggccagcagaaagagcgacgugaccgagacccuggugagcggcacccagcugagccagcugaucgagggccuggacagaggcaccgaguacaacuucagaguggccgcccugaccaucaacggcaccggccccgccaccgacuggcugagcgccgagaccuucgagagcgaccuggacgagaccagagugcccgaggugcccagcagccugcacgugagaccccuggugaccagcaucguggugagcuggaccccccccgagaaccagaacaucguggugagaggcuacgccaucggcuacggcaucggcagcccccacgcccagaccaucaagguggacuacaagcagagauacuacaccaucgagaaccuggaccccagcagccacuacgugaucacccugaaggccuucaacaacgugggcgagggcaucccccuguacgagagcgccgugaccagaccccacaccgacaccagcgagguggaccuguucgugaucaacgcccccuacacccccgugcccgaccccacccccaugaugccccccgugggcgugcaggccagcauccugagccacgacaccaucagaaucaccugggccgacaacagccugcccaagcaccagaagaucaccgacagcagauacuacaccgugagauggaagaccaacauccccgccaacaccaaguacaagaacgccaacgccaccacccugagcuaccuggugaccggccugaagcccaacacccuguacgaguucagcgugauggugaccaagggcagaagaagcagcaccuggagcaugaccgcccacggcaccaccuucgagcuggugcccaccagcccccccaaggacgugaccguggugagcaaggagggcaagcccaagaccaucaucgugaacuggcagccccccagcgaggccaacggcaagaucaccggcuacaucaucuacuacagcaccgacgugaacgccgagauccacgacugggugaucgagcccguggugggcaacagacugacccaccagauccaggagcugacccuggacacccccuacuacuucaagauccaggccagaaacagcaagggcaugggccccaugagcgaggccgugcaguucagaacccccaaggccgacagcagcgacaagaugcccaacgaccaggccagcggcagcggcggcaagggcagcagacugcccgaccugggcagcgacuacaagccccccaugagcggcagcaacagcccccacggcagccccaccagcccccuggacagcaacaugcugcuggugaucaucgugagcgugggcgugaucaccaucguggugguggugaucaucgccguguucugcaccagaagaaccaccagccaccagaagaagaagagagccgccugcaagagcgugaacggcagccacaaguacaagggcaacagcaaggacgugaagccccccgaccuguggauccaccacgagagacuggagcugaagcccaucgacaagagccccgaccccaaccccaucaugaccgacacccccauccccagaaacagccaggacaucacccccguggacaacagcauggacagcaacauccaccagagaagaaacagcuacagaggccacgagagcgaggacagcaugagcacccuggccggcagaagaggcaugagacccaagaugaugaugcccuucgacagccagcccccccagcagagcgugagaaacacccccagcaccgacaccaugcccgccagcagcagccagaccugcugcaccgaccaccaggaccccgagggcgccaccagcagcagcuaccuggccagcagccaggaggaggacagcggccagagccugcccaccgcccacgugagacccagccacccccugaagagcuucgccgugcccgccauccccccccccggcccccccaccuacgaccccgcccugcccagcaccccccugcugagccagcaggcccugaaccaccacauccacagcgugaagaccgccagcaucggcacccugggcagaagcagaccccccaugcccgugguggugcccagcgcccccgaggugcaggagaccaccagaaugcuggaggacagcgagagcagcuacgagcccgacgagcugaccaaggagauggcccaccuggagggccugaugaaggaccugaacgccaucaccaccgccuaa

SEQ ID NO: 20468 - RNA, 4866 nt, Artificial Sequence
  NES__Homo_sapiens__NP_006608
auggagggcugcaugggcgaggagagcuuccagaugugggagcugaacagaagacuggaggccuaccuggccagagugaaggcccuggaggagcagaacgagcugcugagcgccgagcugggcggccugagagcccagagcgccgacaccagcuggagagcccacgccgacgacgagcuggccgcccugagagcccugguggaccagagauggagagagaagcacgccgccgagguggccagagacaaccuggccgaggagcuggagggcguggccggcagaugccagcagcugagacuggccagagagagaaccaccgaggagguggccagaaacagaagagccguggaggccgagaagugcgccagagccuggcugagcagccagguggccgagcuggagagagagcuggaggcccugagaguggcccacgaggaggagagagugggccugaacgcccaggccgccugcgcccccagaugccccgccccccccagaggcccccccgcccccgcccccgagguggaggagcuggccagaagacugggcgaggccuggagaggcgccgugagaggcuaccaggagagaguggcccacauggagaccagccugggccaggccagagagagacugggcagagccgugcagggcgccagagagggcagacuggagcugcagcagcugcaggccgagagaggcggccugcuggagagaagagccgcccuggagcagagacuggagggcagauggcaggagagacugagagccaccgagaaguuccagcuggccguggaggcccuggagcaggagaagcagggccugcagagccagaucgcccaggugcuggagggcagacagcagcuggcccaccugaagaugagccugagccuggagguggccaccuacagaacccugcuggaggccgagaacagcagacugcagacccccggcggcggcagcaagaccagccugagcuuccaggaccccaagcuggagcugcaguuccccagaacccccgagggcagaagacugggcagccugcugcccgugcugagccccaccagccugcccagcccccugcccgccacccuggagacccccgugcccgccuuccugaagaaccaggaguuccugcaggccagaacccccacccuggccagcacccccaucccccccaccccccaggcccccagccccgccguggacgccgagaucagagcccaggacgccccccugagccugcugcagacccagggcggcagaaagcaggcccccgagccccugagagccgaggccagaguggccauccccgccagcgugcugcccggccccgaggagcccggcggccagagacaggaggccagcaccggccagagccccgaggaccacgccagccuggcccccccccugagccccgaccacagcagccuggaggccaaggacggcgagagcggcggcagcagaguguucagcaucugcagaggcgagggcgagggccagaucuggggccugguggagaaggagaccgccaucgagggcaagguggugagcagccugcagcaggagaucugggaggaggaggaccugaacagaaaggagauccaggacagccaggugccccuggagaaggagacccugaagagccugggcgaggagauccaggagagccugaagacccuggagaaccagagccacgagacccuggagagagagaaccaggagugccccagaagccuggaggaggaccuggagacccugaagagccuggagaaggagaacaaggagcugcugaaggacguggagguggugagaccccuggagaaggaggccgugggccagcugaagcccaccggcaaggaggacacccagacccugcagagccugcagaaggagaaccaggagcugaugaagagccuggagggcaaccuggagaccuuccuguuccccggcaccgagaaccaggagcuggugagcagccugcaggagaaccuggagagccugaccgcccuggagaaggagaaccaggagccccugagaagccccgaggugggcgacgaggaggcccugagaccccugaccaaggagaaccaggagccccugagaagccuggaggacgagaacaaggaggccuucagaagccuggagaaggagaaccaggagccccugaagacccuggaggaggaggaccagagcaucgugagaccccuggagaccgagaaccacaagagccugagaagccuggaggagcaggaccaggagacccugagaacccuggagaaggagacccagcagagaagaagaagccugggcgagcaggaccagaugacccugagaccccccgagaagguggaccuggagccccugaagagccuggaccaggagaucgccagaccccuggagaacgagaaccaggaguuccugaagagccugaaggaggagagcguggaggccgugaagagccuggagaccgagauccuggagagccugaagagcgccggccaggagaaccuggagacccugaagagccccgagacccaggccccccuguggacccccgaggagaucaaccagggcgccaugaacccccuggagaaggagauccaggagccccuggagagcguggaggugaaccaggagaccuucagacugcuggaggaggagaaccaggagagccugagaagccugggcgccuggaaccuggagaaccugagaagccccgaggagguggacaaggagagccagagaaaccuggaggaggaggagaaccugggcaagggcgaguaccaggagagccugagaagccuggaggaggagggccaggagcugccccagagcgccgacgugcagagaugggaggacaccguggagaaggaccaggagcuggcccaggagagcccccccggcauggccggcguggagaacgaggacgaggccgagcugaaccugagagagcaggacggcuucaccggcaaggaggaggugguggagcagggcgagcugaacgccaccgaggagguguggauccccggcgagggccaccccgagagccccgagcccaaggagcagagaggccugguggagggcgccagcgugaagggcggcgccgagggccugcaggaccccgagggccagagccagcaggugggcgcccccggccugcaggccccccagggccugcccgaggccaucgagccccugguggaggacgacguggcccccggcggcgaccaggccagccccgaggugaugcugggcagcgagcccgccaugggcgagagcgccgccggcgccgagcccggccccggccagggcgugggcggccugggcgaccccggccaccugaccagagaggaggugauggagcccccccuggaggaggagagccuggaggccaagagagugcagggccuggagggccccagaaaggaccuggaggaggccggcggccugggcaccgaguucagcgagcugcccggcaagagcagagaccccugggagccccccagagagggcagagaggagagcgaggccgaggcccccagaggcgccgaggaggccuuccccgccgagacccugggccacaccggcagcgacgcccccagccccuggccccugggcagcgaggaggccgaggaggacgugccccccgugcuggugagccccagccccaccuacacccccauccuggaggacgcccccggcccccagccccaggccgagggcagccaggaggccagcuggggcgugcagggcagagccgaggcccugggcaagguggagagcgagcaggaggagcugggcagcggcgagauccccgagggcccccaggaggagggcgaggagagcagagaggagagcgaggaggacgagcugggcgagacccugcccgacagcaccccccugggcuucuaccugagaagccccaccagccccagaugggaccccaccggcgagcagagaccccccccccagggcgagaccggcaaggagggcugggaccccgccgugcuggccagcgagggccuggaggccccccccagcgagaaggaggagggcgaggagggcgaggaggagugcggcagagacagcgaccugagcgaggaguucgaggaccugggcaccgaggcccccuuccugcccggcgugcccggcgagguggccgagccccugggccaggugccccagcugcugcuggaccccgccgccugggacagagacggcgagagcgacggcuucgccgacgaggaggagagcggcgaggagggcgaggaggaccaggaggagggcagagagcccggcgccggcagauggggccccggcagcagcgugggcagccugcaggcccugagcagcagccagagaggcgaguuccuggagagcgacagcgugagcgugagcgugcccugggacgacagccugagaggcgccguggccggcgcccccaagaccgcccuggagaccgagagccaggacagcgccgagcccagcggcagcgaggaggagagcgaccccgugagccuggagagagaggacaaggugcccggcccccuggagauccccagcggcauggaggacgccggccccggcgccgacaucaucggcgugaacggccagggccccaaccuggagggcaagagccagcacgugaacggcggcgugaugaacggccuggagcagagcgaggaggugggccagggcaugccccuggugagcgagggcgacagaggcagccccuuccaggaggaggagggcagcgcccugaagaccagcugggccggcgcccccgugcaccugggccagggccaguuccugaaguucacccagagagagggcgacagagagagcuggagcagcggcgaggacuaa

SEQ ID NO: 20469 - RNA, 1791 nt, Artificial Sequence
  NET1__Homo_sapiens__NP_001040625
auggagcccgagcuggccgcccagaagcagcccagacccagaagaagaagcagaagagccagcggccugagcaccgagggcgccaccggccccagcgccgacaccagcggcagcgagcuggacggcagaugcagccugagaagaggcagcagcuucaccuuccugacccccggccccaacugggacuucacccugaagagaaagagaagagagaaggacgacgacguggugagccugagcagccuggaccugaaggagcccagcaacaagagagugagaccccuggccagagugaccagccuggccaaccugaucagccccgugagaaacggcgccgugagaagauucggccagaccauccagagcuucacccugagaggcgaccacagaagccccgccagcgcccagaaguucagcagcagaagcaccgugcccacccccgccaagagaagaagcagcgcccuguggagcgagaugcuggacaucaccaugaaggagagccugaccaccagagagaucagaagacaggaggccaucuacgagaugagcagaggcgagcaggaccugaucgaggaccugaagcuggccagaaaggccuaccacgaccccaugcugaagcugagcaucaugagcgaggaggagcugacccacaucuucggcgaccuggacagcuacaucccccugcacgaggaccugcugaccagaaucggcgaggccaccaagcccgacggcaccguggagcagaucggccacauccuggugagcuggcugcccagacugaacgccuacagaggcuacugcagcaaccagcuggccgccaaggcccugcuggaccagaagaagcaggaccccagagugcaggacuuccugcagagaugccuggagagccccuucagcagaaagcuggaccuguggagcuuccuggacauccccagaagcagacuggugaaguacccccugcugcugaaggagauccugaagcacacccccaaggagcaccccgacgugcagcugcuggaggacgccauccugaucauccagggcgugcugagcgacaucaaccugaagaagggcgagagcgagugccaguacuacaucgacaagcuggaguaccuggacgagaagcagagagaccccagaaucgaggccagcaaggugcugcugugccacggcgagcugagaagcaagagcggccacaagcuguacaucuuccuguuccaggacauccuggugcugaccagacccgugaccagaaacgagagacacagcuaccagguguacagacagcccauccccgugcaggagcuggugcuggaggaccugcaggacggcgacgugagaaugggcggcagcuucagaggcgccuucagcaacagcgagaaggccaagaacaucuucagaaucagauuccacgaccccagccccgcccagagccacacccugcaggccaacgacguguuccacaagcagcagugguucaacugcaucagagccgccaucgcccccuuccagagcgccggcagcccccccgagcugcagggccugcccgagcugcacgaggagugcgagggcaaccaccccagcgccagaaagcugaccgcccagagaagagccagcaccgugagcagcgugacccagguggagguggacgagaacgccuacagaugcggcagcggcaugcagauggccgaggacagcaagagccugaagacccaccagacccagcccggcaucagaagagccagagacaaggcccugagcggcggcaagagaaaggagacccugguguaa

SEQ ID NO: 20470 - RNA, 471 nt, Artificial Sequence
  NETO1__Homo_sapiens__NP_620552
augcuggccgagcccuuccccaaggugguggccagccugaucauccugcaccugagcggcgccaccaagaagggcaccgagaagcagaccaccagcgagacccagaagagcgugcagugcggcaccuggaccaagcacgccgagggcggcaucuucaccagccccaacuaccccagcaaguacccccccgacagagagugcaucuacaucaucgaggccgcccccagacagugcaucgagcuguacuucgacgagaaguacagcaucgagcccagcugggagugcaaguucgaccacaucgaggugagagacggccccuucggcuucagccccaucaucggcagauucugcggccagcagaacccccccgugaucaagagcagcggcagauuccuguggaucaaguucuucgccgacggcgagcuggagagcaugggcuucagcgccagauacaacuucacccccgaguaa

SEQ ID NO: 20471 - RNA, 1578 nt, Artificial Sequence
  NETO2__Homo_sapiens__NP_060562
auggcccuggagagacugugcagcgugcugaaggugcugcugaucaccgugcuggugguggagggcaucgccguggcccagaagacccaggacggccagaacaucggcaucaagcacauccccgccacccagugcggcaucugggugagaaccagcaacggcggccacuucgccagccccaacuaccccgacagcuacccccccaacaaggagugcaucuacauccuggaggccgcccccagacagagaaucgagcugaccuucgacgagcacuacuacaucgagcccagcuucgagugcagauucgaccaccuggaggugagagacggccccuucggcuucagcccccugaucgacagauacugcggcgugaagagccccccccugaucagaagcaccggcagauucauguggaucaaguucagcagcgacgaggagcuggagggccugggcuucagagccaaguacagcuucauccccgaccccgacuucaccuaccugggcggcauccugaaccccauccccgacugccaguucgagcugagcggcgccgacggcaucgugagaagcagccagguggagcaggaggagaagaccaagcccggccaggccguggacugcaucuggaccaucaaggccacccccaaggccaagaucuaccugagauuccuggacuaccagauggagcacagcaacgagugcaagagaaacuucguggccguguacgacggcagcagcagcaucgagaaccugaaggccaaguucugcagcaccguggccaacgacgugaugcugaagaccggcaucggcgugaucagaaugugggccgacgagggcagcagacugagcagauucagaaugcuguucaccagcuucguggagccccccugcaccagcagcaccuucuucugccacagcaacaugugcaucaacaacagccuggugugcaacggcgugcagaacugcgccuaccccugggacgagaaccacugcaaggagaagaagaaggccggcguguucgagcagaucaccaagacccacggcaccaucaucggcaucaccagcggcaucgugcuggugcugcugaucaucagcauccuggugcaggugaagcagcccagaaagaaggugauggccugcaagaccgccuucaacaagaccggcuuccaggagguguucgaccccccccacuacgagcuguucagccugagagacaaggagaucagcgccgaccuggccgaccugagcgaggagcuggacaacuaccagaagaugagaagaagcagcaccgccagcagaugcauccacgaccaccacugcggcagccaggccagcagcgugaagcagagcagaaccaaccugagcagcauggagcugcccuucagaaacgacuucgcccagccccagcccaugaagaccuucaacagcaccuucaagaagagcagcuacaccuucaagcagggccacgagugccccgagcaggcccuggaggacagagugauggaggagauccccugcgagaucuacgugagaggcagagaggacagcgcccaggccagcaucagcaucgacuucuaa

SEQ ID NO: 20472 - RNA, 1248 nt, Artificial Sequence
  NEU1__Homo_sapiens__NP_000425
augaccggcgagagacccagcaccgcccugcccgacagaagauggggccccagaauccugggcuucuggggcggcugcagaguguggguguucgccgccaucuuccugcugcugagccuggccgccagcuggagcaaggccgagaacgacuucggccuggugcagccccuggugaccauggagcagcugcugugggugagcggcagacagaucggcagcguggacaccuucagaaucccccugaucaccgccacccccagaggcacccugcuggccuucgccgaggccagaaagaugagcagcagcgacgagggcgccaaguucaucgcccugagaagaagcauggaccagggcagcaccuggagccccaccgccuucaucgugaacgacggcgacgugcccgacggccugaaccugggcgccguggugagcgacguggagaccggcgugguguuccuguucuacagccugugcgcccacaaggccggcugccagguggccagcaccaugcugguguggagcaaggacgacggcgugagcuggagcacccccagaaaccugagccuggacaucggcaccgagguguucgcccccggccccggcagcggcauccagaagcagagagagcccagaaagggcagacugaucgugugcggccacggcacccuggagagagacggcguguucugccugcugagcgacgaccacggcgccagcuggagauacggcagcggcgugagcggcauccccuacggccagcccaagcaggagaacgacuucaaccccgacgagugccagcccuacgagcugcccgacggcagcguggugaucaacgccagaaaccagaacaacuaccacugccacugcagaaucgugcugagaagcuacgacgccugcgacacccugagacccagagacgugaccuucgaccccgagcugguggaccccgugguggccgccggcgccguggugaccagcagcggcaucguguucuucagcaaccccgcccaccccgaguucagagugaaccugacccugagauggagcuucagcaacggcaccagcuggagaaaggagaccgugcagcuguggcccggccccagcggcuacagcagccuggccacccuggagggcagcauggacggcgaggagcaggccccccagcuguacgugcuguacgagaagggcagaaaccacuacaccgagagcaucagcguggccaagaucagcguguacggcacccuguaa

SEQ ID NO: 20473 - RNA, 1386 nt, Artificial Sequence
  NEU3__Homo_sapiens__NP_006647
augagacccgccgaccugccccccagacccauggaggagagccccgccagcagcagcgcccccaccgagaccgaggagcccggcagcagcgccgaggugauggaggaggugaccaccugcagcuucaacagcccccuguucagacaggaggacgacagaggcaucaccuacagaauccccgcccugcuguacaucccccccacccacaccuuccuggccuucgccgagaagagaagcaccagaagagacgaggacgcccugcaccuggugcugagaagaggccugagaaucggccagcuggugcaguggggcccccugaagccccugauggaggccacccugcccggccacagaaccaugaaccccugccccgugugggagcagaagagcggcugcguguuccuguucuucaucugcgugagaggccacgugaccgagagacagcagaucgugagcggcagaaacgccgccagacugugcuucaucuacagccaggacgccggcugcagcuggagcgaggugagagaccugaccgaggaggugaucggcagcgagcugaagcacugggccaccuucgccgugggccccggccacggcauccagcugcagagcggcagacuggugauccccgccuacaccuacuacauccccagcugguucuucugcuuccagcugcccugcaagaccagaccccacagccugaugaucuacagcgacgaccugggcgugaccuggcaccacggcagacugaucagacccauggugaccguggagugcgagguggccgaggugaccggcagagccggccaccccgugcuguacugcagcgccagaacccccaacagaugcagagccgaggcccugagcaccgaccacggcgagggcuuccagagacuggcccugagcagacagcugugcgagcccccccacggcugccagggcagcguggugagcuucagaccccuggagaucccccacagaugccaggacagcagcagcaaggacgcccccaccauccagcagagcagccccggcagcagccugagacuggaggaggaggccggcacccccagcgagagcuggcugcuguacagccaccccaccagcagaaagcagagaguggaccugggcaucuaccugaaccagaccccccuggaggccgccugcuggagcagacccuggauccugcacugcggccccugcggcuacagcgaccuggccgcccuggaggaggagggccuguucggcugccuguucgagugcggcaccaagcaggagugcgagcagaucgccuucagacuguucacccacagagagauccugagccaccugcagggcgacugcaccagccccggcagaaaccccagccaguucaagagcaacuaa

SEQ ID NO: 20474 - RNA, 1725 nt, Artificial Sequence
  NEURL1__Homo_sapiens__NP_004201
augggcaacaacuucagcagcauccccagccugcccagaggcaaccccagcagagcccccagaggccacccccagaaccugaaggacagcaucggcggccccuuccccgugaccagccacagaugccaccacaagcagaagcacugccccgccgugcugcccagcggcggccugcccgccaccccccugcuguuccacccccacaccaagggcagccagauccugauggaccugagccacaaggccgugaagagacaggccagcuucugcaacgccaucaccuucagcaacagacccgugcugaucuacgagcaggugagacugaagaucaccaagaagcagugcugcuggagcggcgcccugagacugggcuucaccagcaaggaccccagcagaauccaccccgacagccugcccaaguacgccugccccgaccuggugagccagagcggcuucugggccaaggcccugcccgaggaguucgccaacgagggcaacaucaucgccuucuggguggacaagaagggcagaguguuccacagaaucaacgacagcgccgugaugcuguucuucagcggcgugagaaccgccgacccccugugggcccugguggacguguacggccugaccagaggcgugcagcugcuggacagcgagcuggugcugcccgacugccugagacccagaagcuucaccgcccugagaagacccagccugagaagagaggccgacgacgccagacugagcgugagccugugcgaccugaacgugcccggcgccgacggcgacgaggccgcccccgccgccggcugccccaucccccagaacagccugaacagccagcacagcagagcccugcccgcccagcuggacggcgaccugagauuccacgcccugagagccggcgcccacgugagaauccuggacgagcagaccguggccagaguggagcacggcagagacgagagagcccugguguucaccagcagacccgugagaguggccgagaccaucuucgugaaggugaccagaagcggcggcgccagacccggcgcccugagcuucggcgugaccaccugcgaccccggcacccugagacccgccgaccugcccuucagccccgaggcccugguggacagaaaggaguucugggccgugugcagagugcccggcccccugcacagcggcgacauccugggccugguggugaacgccgacggcgagcugcaccugagccacaacggcgccgccgccggcaugcagcugugcguggacgccagccagccccuguggaugcuguucggccugcacggcaccaucacccagaucagaauccugggcagcaccauccuggccgagagaggcauccccagccugcccugcagccccgccagcacccccaccagccccagcgcccugggcagcagacugagcgacccccugcugagcaccugcagcagcggcccccugggcagcagcgccggcggcaccgcccccaacagccccgugagccugcccgagagccccgugacccccggccugggccaguggagcgacgagugcaccaucugcuacgagcacgccguggacaccgugaucuacaccugcggccacaugugccugugcuacgccugcggccugagacugaagaaggcccugcacgccugcugccccaucugcagaagacccaucaaggacaucaucaagaccuacagaagcagcuaa

SEQ ID NO: 20475 - RNA, 858 nt, Artificial Sequence
  NEURL2__Homo_sapiens__NP_542787
auggccgccgccagcgagcccguggacagcggcgcccuguggggccuggagagacccgagcccccccccaccagauuccacagagugcacggcgccaacaucagaguggaccccagcggcaccagagccaccagaguggagagcuucgcccacggcgugugcuucagcagagagccccuggcccccggccagguguuccugguggagaucgaggagaaggagcugggcuggugcggccaccugagacugggccugaccgcccuggaccccgccagccuggcccccgugcccgaguucagccugcccgaccuggugaaccugggccacaccuggguguucgccaucaccagacaccacaacagagugcccagagagggcagacccgaggccgaggccgccgcccccagcagaccccccacccugcugguggagcccuaccugagaaucgagcaguucagaauccccagagacagacuggugggcagaagcagacccggccuguacagccaccugcuggaccagcuguacgagcugaacgugcugccccccaccgccagaagaagcagacugggcgugcuguucugccccagacccgacggcaccgccgacaugcacaucaucaucaacggcgaggacaugggccccagcgccagaggccugcccgccgcccagccccuguacgccgugguggacguguucgccagcaccaagagcgugagacuggugcagcuggaguacggccugcccagccugcagacccugugcagacuggugauccagagaagcauggugcacagacuggccaucgacggccugcaccugcccaaggagcugaaggacuucugcaaguacgaguaa

SEQ ID NO: 20476 - RNA, 1071 nt, Artificial Sequence
  NEUROD1__Homo_sapiens__NP_002491
augaccaagagcuacagcgagagcggccugaugggcgagccccagccccagggcccccccagcuggaccgacgagugccugagcagccaggacgaggagcacgaggccgacaagaaggaggacgaccuggaggccaugaacgccgaggaggacagccugagaaacggcggcgaggaggaggacgaggacgaggaccuggaggaggaggaggaggaggaggaggaggacgacgaccagaagcccaagagaagaggccccaagaagaagaagaugaccaaggccagacuggagagauucaagcugagaagaaugaaggccaacgccagagagagaaacagaaugcacggccugaacgccgcccuggacaaccugagaaagguggugcccugcuacagcaagacccagaagcugagcaagaucgagacccugagacuggccaagaacuacaucugggcccugagcgagauccugagaagcggcaagagccccgaccuggugagcuucgugcagacccugugcaagggccugagccagcccaccaccaaccugguggccggcugccugcagcugaaccccagaaccuuccugcccgagcagaaccaggacaugcccccccaccugcccaccgccagcgccagcuuccccgugcaccccuacagcuaccagagccccggccugcccagcccccccuacggcaccauggacagcagccacguguuccacgugaagccccccccccacgccuacagcgccgcccuggagcccuucuucgagagcccccugaccgacugcaccagccccagcuucgacggcccccugagccccccccugagcaucaacggcaacuucagcuucaagcacgagcccagcgccgaguucgagaagaacuacgccuucaccaugcacuaccccgccgccacccuggccggcgcccagagccacggcagcaucuucagcggcaccgccgcccccagaugcgagauccccaucgacaacaucaugagcuucgacagccacagccaccacgagagagugaugagcgcccagcugaacgccaucuuccacgacuaa

SEQ ID NO: 20477 - RNA, 1173 nt, Artificial Sequence
  NEUROD2__Homo_sapiens__XP_005257466
augaugccccccagccugggcaccaugcugaccagacuguucagcgagcccggccugcugagcgacgugcccaaguucgccagcuggggcgacggcgaggacgacgagcccagaagcgacaagggcgacgccccccccccccccccccccgcccccggccccggcgcccccggccccgccagagccgccaagcccgugccccugagaggcgaggagggcaccgaggccacccuggccgaggugaaggaggagggcgagcugggcggcgaggaggaggaggaggaggaggaggaggagggccuggacgaggccgagggcgagagacccaagaagagaggccccaagaagagaaagaugaccaaggccagacuggagagaagcaagcugagaagacagaaggccaacgccagagagagaaacagaaugcacgaccugaacgccgcccuggacaaccugagaaagguggugcccugcuacagcaagacccagaagcugagcaagaucgagacccugagacuggccaagaacuacaucugggcccugagcgagauccugagaagcggcaagagacccgaccuggugagcuacgugcagacccugugcaagggccugagccagcccaccaccaaccugguggccggcugccugcagcugaacagcagaaacuuccugaccgagcagggcgccgacggcgccggcagauuccacggcagcggcggccccuucgccaugcaccccuaccccuaccccugcagcagacuggccggcgcccagugccaggccgccggcggccugggcggcggcgccgcccacgcccugagaacccacggcuacugcgccgccuacgagacccuguacgccgccgccggcggcggcggcgccagccccgacuacaacagcagcgaguacgagggcccccugagccccccccugugccugaacggcaacuucagccugaagcaggacagcagccccgaccacgagaagagcuaccacuacagcaugcacuacagcgcccugcccggcagcagacccaccggccacggccugguguucggcagcagcgccgugagaggcggcgugcacagcgagaaccugcugagcuacgacaugcaccugcaccacgacagaggccccauguacgaggagcugaacgccuucuuccacaacuaa

SEQ ID NO: 20478 - RNA, 996 nt, Artificial Sequence
  NEUROD4__Homo_sapiens__NP_067014
augagcaagaccuucgugaagagcaaggagaugggcgagcuggugaacacccccagcuggauggacaagggccugggcagccagaacgaggugaaggaggaggagagcagacccggcaccuacggcaugcugagcagccugaccgaggagcacgacagcaucgaggaggaggaggaggaggaggaggacggcgagaagcccaagagaagaggccccaagaagaagaagaugaccaaggccagacuggagagauucagagccagaagagugaaggccaacgccagagagagaaccagaaugcacggccugaacgacgcccuggacaaccugagaagagugaugcccugcuacagcaagacccagaagcugagcaagaucgagacccugagacuggccagaaacuacaucugggcccugagcgaggugcuggagaccggccagacccccgagggcaagggcuucguggagaugcugugcaagggccugagccagcccaccagcaaccugguggccggcugccugcagcugggcccccagagcgugcugcuggagaagcacgaggacaagagccccaucugcgacagcgccaucagcgugcacaacuucaacuaccagagccccggccugcccagcccccccuacggccacauggagacccaccugcugcaccugaagccccagguguucaagagccugggcgagagcagcuucggcagccaccugcccgacugcagcaccccccccuacgagggcccccugacccccccccugagcaucagcggcaacuucagccugaagcaggacggcagccccgaccuggagaagagcuacagcuucaugccccacuaccccagcagcagccugagcagcggccacgugcacagcacccccuuccaggccggcacccccagauacgacgugcccaucgacaugagcuacgacagcuacccccaccacggcaucggcacccagcugaacaccguguucaccgaguaa

SEQ ID NO: 20479 - RNA, 1014 nt, Artificial Sequence
  NEUROD6__Homo_sapiens__NP_073565
augcugacccugcccuucgacgagagcguggugaugcccgagagccagaugugcagaaaguucagcagagagugcgaggaccagaagcagaucaagaagcccgagagcuucagcaagcagaucgugcugagaggcaagagcaucaagagagcccccggcgaggagaccgagaaggaggaggaggaggaggacagagaggaggaggacgagaacggccugcccagaagaagaggccugagaaagaagaagaccaccaagcugagacuggagagagugaaguucagaagacaggaggccaacgccagagagagaaacagaaugcacggccugaacgacgcccuggacaaccugagaaagguggugcccugcuacagcaagacccagaagcugagcaagaucgagacccugagacuggccaagaacuacaucugggcccugagcgagauccugagaaucggcaagagacccgaccugcugaccuucgugcagaaccugugcaagggccugagccagcccaccaccaaccugguggccggcugccugcagcugaacgccagaagcuuccugaugggccagggcggcgaggccgcccaccacaccagaagccccuacagcaccuucuacccccccuaccacagccccgagcugaccaccccccccggccacggcacccuggacaacagcaagagcaugaagcccuacaacuacugcagcgccuacgagagcuucuacgagagcaccagccccgagugcgccagcccccaguucgagggcccccugagccccccccccaucaacuacaacggcaucuucagccugaagcaggaggagacccuggacuacggcaagaacuacaacuacggcaugcacuacugcgccgugccccccagaggcccccugggccagggcgccauguucagacugcccaccgacagccacuuccccuacgaccugcaccugagaagccagagccugaccaugcaggacgagcugaacgccguguuccacaacuaa

SEQ ID NO: 20480 - RNA, 714 nt, Artificial Sequence
  NEUROG1__Homo_sapiens__NP_006152
augcccgccagacuggagaccugcaucagcgaccuggacugcgccagcagcagcggcagcgaccugagcggcuuccugaccgacgaggaggacugcgccagacugcagcaggccgccagcgccagcggcccccccgcccccgccagaagaggcgcccccaacaucagcagagccagcgaggugcccggcgcccaggacgacgagcaggagagaagaagaagaagaggcagaaccagagugagaagcgaggcccugcugcacagccugagaagaagcagaagagugaaggccaacgacagagagagaaacagaaugcacaaccugaacgccgcccuggacgcccugagaagcgugcugcccagcuuccccgacgacaccaagcugaccaagaucgagacccugagauucgccuacaacuacaucugggcccuggccgagacccugagacuggccgaccagggccugcccggcggcggcgccagagagagacugcugcccccccagugcgugcccugccugcccggcccccccagccccgccagcgacgccgagagcuggggcagcggcgccgccgccgccagcccccugagcgaccccagcagccccgccgccagcgaggacuucaccuacagacccggcgaccccguguucagcuuccccagccugcccaaggaccugcugcacaccacccccugcuucauccccuaccacuaa

SEQ ID NO: 20481 - RNA, 819 nt, Artificial Sequence
  NEUROG2__Homo_sapiens__NP_076924
auguucgugaagagcgagacccuggagcugaaggaggaggaggacgugcuggugcugcugggcagcgccagccccgcccuggccgcccugaccccccugagcagcagcgccgacgaggaggaggaggaggagcccggcgccagcggcggcgccagaagacagagaggcgccgaggccggccagggcgccagaggcggcguggccgccggcgccgagggcugcagacccgccagacugcugggccuggugcacgacugcaagagaagacccagcagagccagagccgugagcagaggcgccaagaccgccgagaccgugcagagaaucaagaagaccagaagacugaaggccaacaacagagagagaaacagaaugcacaaccugaacgccgcccuggacgcccugagagaggugcugcccaccuuccccgaggacgccaagcugaccaagaucgagacccugagauucgcccacaacuacaucugggcccugaccgagacccugagacuggccgaccacugcggcggcggcggcggcggccugcccggcgcccuguucagcgaggccgugcugcugagccccggcggcgccagcgccgcccugagcagcagcggcgacagccccagccccgccagcaccuggagcugcaccaacagccccgcccccagcagcagcgugagcagcaacagcaccagccccuacagcugcacccugagccccgccagccccgccggcagcgacauggacuacuggcagccccccccccccgacaagcacagauacgccccccaccugcccaucgccagagacugcaucuaa

SEQ ID NO: 20482 - RNA, 645 nt, Artificial Sequence
  NEUROG3__Homo_sapiens__NP_066279
augaccccccagcccagcggcgcccccaccgugcaggugaccagagagaccgagagaagcuuccccagagccagcgaggacgaggugaccugccccaccagcgccccccccagccccaccagaaccagaggcaacugcgccgaggccgaggagggcggcugcagaggcgcccccagaaagcugagagccagaagaggcggcagaagcagacccaagagcgagcuggcccugagcaagcagagaagaagcagaagaaagaaggccaacgacagagagagaaacagaaugcacaaccugaacagcgcccuggacgcccugagaggcgugcugcccaccuuccccgacgacgccaagcugaccaagaucgagacccugagauucgcccacaacuacaucugggcccugacccagacccugagaaucgccgaccacagccuguacgcccuggagccccccgccccccacugcggcgagcugggcagccccggcggcagccccggcgacuggggcagccuguacagccccgugagccaggccggcagccugagccccgccgccagccuggaggagagacccggccugcugggcgccaccuucagcgccugccugagccccggcagccuggccuucagcgacuuccuguaa

SEQ ID NO: 20483 - RNA, 8457 nt, Artificial Sequence
  NF1__Homo_sapiens__NP_000258
auggccgcccacagacccguggagugggugcaggccguggugagcagauucgacgagcagcugcccaucaagaccggccagcagaacacccacaccaaggugagcaccgagcacaacaaggagugccugaucaacaucagcaaguacaaguucagccuggugaucagcggccugaccaccauccugaagaacgugaacaacaugagaaucuucggcgaggccgccgagaagaaccuguaccugagccagcugaucauccuggacacccuggagaagugccuggccggccagcccaaggacaccaugagacuggacgagaccaugcuggugaagcagcugcugcccgagaucugccacuuccugcacaccugcagagagggcaaccagcacgccgccgagcugagaaacagcgccagcggcgugcuguucagccugagcugcaacaacuucaacgccguguucagcagaaucagcaccagacugcaggagcugaccgugugcagcgaggacaacguggacgugcacgacaucgagcugcugcaguacaucaacguggacugcgccaagcugaagagacugcugaaggagaccgccuucaaguucaaggcccugaagaagguggcccagcuggccgugaucaacagccuggagaaggccuucuggaacuggguggagaacuaccccgacgaguucaccaagcuguaccagaucccccagaccgacauggccgagugcgccgagaagcuguucgaccugguggacggcuucgccgagagcaccaagagaaaggccgccguguggccccugcagaucauccugcugauccugugccccgagaucauccaggacaucagcaaggacgugguggacgagaacaacaugaacaagaagcuguuccuggacagccugagaaaggcccuggccggccacggcggcagcagacagcugaccgagagcgccgccaucgccugcgugaagcugugcaaggccagcaccuacaucaacugggaggacaacagcgugaucuuccugcuggugcagagcauggugguggaccugaagaaccugcuguucaaccccagcaagcccuucagcagaggcagccagcccgccgacguggaccugaugaucgacugccuggugagcugcuucagaaucagcccccacaacaaccagcacuucaagaucugccuggcccagaacagccccagcaccuuccacuacgugcuggugaacagccugcacagaaucaucaccaacagcgcccuggacugguggcccaagaucgacgccguguacugccacagcguggagcugagaaacauguucggcgagacccugcacaaggccgugcagggcugcggcgcccaccccgccaucagaauggcccccagccugaccuucaaggagaaggugaccagccugaaguucaaggagaagcccaccgaccuggagaccagaagcuacaaguaccugcugcugagcauggugaagcugauccacgccgaccccaagcugcugcugugcaaccccagaaagcagggccccgagacccagggcagcaccgccgagcugaucaccggccuggugcagcuggugccccagagccacaugcccgagaucgcccaggaggccauggaggcccugcuggugcugcaccagcuggacagcaucgaccuguggaaccccgacgcccccguggagaccuucugggagaucagcagccagaugcuguucuacaucugcaagaagcugaccagccaccagaugcugagcagcaccgagauccugaaguggcugagagagauccugaucugcagaaacaaguuccugcugaagaacaagcaggccgacagaagcagcugccacuuccugcuguucuacggcgugggcugcgacauccccagcagcggcaacaccagccagaugagcauggaccacgaggagcugcugagaacccccggcgccagccugagaaagggcaagggcaacagcagcauggacagcgccgccggcugcagcggcaccccccccaucugcagacaggcccagaccaagcuggagguggcccuguacauguuccuguggaaccccgacaccgaggccgugcugguggccaugagcugcuucagacaccugugcgaggaggccgacaucagaugcggcguggacgaggugagcgugcacaaccugcugcccaacuacaacaccuucauggaguucgccagcgugagcaacaugaugagcaccggcagagccgcccugcagaagagagugauggcccugcugagaagaaucgagcaccccaccgccggcaacaccgaggccugggaggacacccacgccaagugggagcaggccaccaagcugauccugaacuaccccaaggccaagauggaggacggccaggccgccgagagccugcacaagaccaucgugaagagaagaaugagccacgugagcggcggcggcagcaucgaccugagcgacaccgacagccugcaggaguggaucaacaugaccggcuuccugugcgcccugggcggcgugugccugcagcagagaagcaacagcggccuggccaccuacagcccccccaugggccccgugagcgagagaaagggcagcaugaucagcgugaugagcagcgagggcaacgccgacacccccgugagcaaguucauggacagacugcugagccugauggugugcaaccacgagaaggugggccugcagaucagaaccaacgugaaggaccuggugggccuggagcugagccccgcccuguaccccaugcuguucaacaagcugaagaacaccaucagcaaguucuucgacagccagggccaggugcugcugaccgacaccaacacccaguucguggagcagaccaucgccaucaugaagaaccugcuggacaaccacaccgagggcagcagcgagcaccugggccaggccagcaucgagaccaugaugcugaaccuggugagauacgugagagugcugggcaacauggugcacgccauccagaucaagaccaagcugugccagcugguggaggugaugauggccagaagagacgaccugagcuucugccaggagaugaaguucagaaacaagaugguggaguaccugaccgacugggugaugggcaccagcaaccaggccgccgacgacgacgugaagugccugaccagagaccuggaccaggccagcauggaggccguggugagccugcuggccggccugccccugcagcccgaggagggcgacggcguggagcugauggaggccaagagccagcuguuccugaaguacuucacccuguucaugaaccugcugaacgacugcagcgagguggaggacgagagcgcccagaccggcggcagaaagagaggcaugagcagaagacuggccagccugagacacugcaccgugcuggccaugagcaaccugcugaacgccaacguggacagcggccugaugcacagcaucggccugggcuaccacaaggaccugcagaccagagccaccuucauggaggugcugaccaagauccugcagcagggcaccgaguucgacacccuggccgagaccgugcuggccgacagauucgagagacugguggagcuggugaccaugaugggcgaccagggcgagcugcccaucgccauggcccuggccaacguggugcccugcagccagugggacgagcuggccagagugcuggugacccuguucgacagcagacaccugcuguaccagcugcuguggaacauguucagcaaggagguggagcuggccgacagcaugcagacccuguucagaggcaacagccuggccagcaagaucaugaccuucugcuucaagguguacggcgccaccuaccugcagaagcugcuggacccccugcugagaaucgugaucaccagcagcgacuggcagcacgugagcuucgagguggaccccaccagacuggagcccagcgagagccuggaggagaaccagagaaaccugcugcagaugaccgagaaguucuuccacgccaucaucagcagcagcagcgaguuccccccccagcugagaagcgugugccacugccuguaccagguggugagccagagauucccccagaacagcaucggcgccgugggcagcgccauguuccugagauucaucaaccccgccaucgugagccccuacgaggccggcauccuggacaagaagcccccccccagaaucgagagaggccugaagcugaugagcaagauccugcagagcaucgccaaccacgugcuguucaccaaggaggagcacaugagacccuucaacgacuucgugaagagcaacuucgacgccgccagaagauucuuccuggacaucgccagcgacugccccaccagcgacgccgugaaccacagccugagcuucaucagcgacggcaacgugcuggcccugcacagacugcuguggaacaaccaggagaagaucggccaguaccugagcagcaacagagaccacaaggccgugggcagaagacccuucgacaagauggccacccugcuggccuaccugggcccccccgagcacaagcccguggccgacacccacuggagcagccugaaccugaccagcagcaaguucgaggaguucaugaccagacaccaggugcacgagaaggaggaguucaaggcccugaagacccugagcaucuucuaccaggccggcaccagcaaggccggcaaccccaucuucuacuacguggccagaagauucaagaccggccagaucaacggcgaccugcugaucuaccacgugcugcugacccugaagcccuacuacgccaagcccuacgagaucgugguggaccugacccacaccggccccagcaacagauucaagaccgacuuccugagcaagugguucgugguguuccccggcuucgccuacgacaacgugagcgccguguacaucuacaacugcaacagcugggugagagaguacaccaaguaccacgagagacugcugaccggccugaagggcagcaagagacugguguucaucgacugccccggcaagcuggccgagcacaucgagcacgagcagcagaagcugcccgccgccacccuggcccuggaggaggaccugaagguguuccacaacgcccugaagcuggcccacaaggacaccaaggugagcaucaaggugggcagcaccgccgugcaggugaccagcgccgagagaaccaaggugcugggccagagcguguuccugaacgacaucuacuacgccagcgagaucgaggagaucugccugguggacgagaaccaguucacccugaccaucgccaaccagggcaccccccugaccuucaugcaccaggagugcgaggccaucgugcagagcaucauccacaucagaaccagaugggagcugagccagcccgacagcaucccccagcacaccaagaucagacccaaggacgugcccggcacccugcugaacaucgcccugcugaaccugggcagcagcgaccccagccugagaagcgccgccuacaaccugcugugcgcccugaccugcaccuucaaccugaagaucgagggccagcugcuggagaccagcggccugugcauccccgccaacaacacccuguucaucgugagcaucagcaagacccuggccgccaacgagccccaccugacccuggaguuccuggaggagugcaucagcggcuucagcaagagcagcaucgagcugaagcaccugugccuggaguacaugacccccuggcugagcaaccuggugagauucugcaagcacaacgacgacgccaagagacagagagugaccgccauccuggacaagcugaucaccaugaccaucaacgagaagcagauguaccccagcauccaggccaagaucuggggcagccugggccagaucaccgaccugcuggacguggugcuggacagcuucaucaagaccagcgccaccggcggccugggcagcaucaaggccgaggugauggccgacaccgccguggcccuggccagcggcaacgugaagcuggugagcagcaaggugaucggcagaaugugcaagaucaucgacaagaccugccugagccccacccccacccuggagcagcaccugaugugggacgacaucgccauccuggccagauacaugcugaugcugagcuucaacaacagccuggacguggccgcccaccugcccuaccuguuccacguggugaccuuccugguggccaccggcccccugagccugagagccagcacccacggccuggugaucaacaucauccacagccugugcaccugcagccagcugcacuucagcgaggagaccaagcaggugcugagacugagccugaccgaguucagccugcccaaguucuaccugcuguucggcaucagcaaggugaagagcgccgccgugaucgccuucagaagcagcuacagagacagaagcuucagccccggcagcuacgagagagagaccuucgcccugaccagccuggagaccgugaccgaggcccugcuggagaucauggaggccugcaugagagacauccccaccugcaaguggcuggaccaguggaccgagcuggcccagagauucgccuuccaguacaaccccagccugcagcccagagcccuggugguguucggcugcaucagcaagagagugagccacggccagaucaagcagaucaucagaauccugagcaaggcccuggagagcugccugaagggccccgacaccuacaacagccaggugcugaucgaggccaccgugaucgcccugaccaagcugcagccccugcugaacaaggacagcccccugcacaaggcccuguucuggguggccguggccgugcugcagcuggacgaggugaaccuguacagcgccggcaccgcccugcuggagcagaaccugcacacccuggacagccugagaaucuucaacgacaagagccccgaggagguguucauggccaucagaaacccccuggaguggcacugcaagcagauggaccacuucgugggccugaacuucaacagcaacuucaacuucgcccuggugggccaccugcugaagggcuacagacaccccagccccgccaucguggccagaaccgugagaauccugcacacccugcugacccuggugaacaagcacagaaacugcgacaaguucgaggugaacacccagagcguggccuaccuggccgcccugcugaccgugagcgaggaggugagaagcagaugcagccugaagcacagaaagagccugcugcugaccgacaucagcauggagaacgugcccauggacaccuaccccauccaccacggcgaccccagcuacagaacccugaaggagacccagcccuggagcagccccaagggcagcgagggcuaccuggccgccaccuaccccaccgugggccagaccagccccagagccagaaagagcaugagccuggacaugggccagcccagccaggccaacaccaagaagcugcugggcaccagaaagagcuucgaccaccugaucagcgacaccaaggcccccaagagacaggagauggagagcggcaucaccaccccccccaagaugagaagaguggccgagaccgacuacgagauggagacccagagaaucagcagcagccagcagcacccccaccugagaaaggugagcgugagcgagagcaacgugcugcuggacgaggaggugcugaccgaccccaagauccaggcccugcugcugaccgugcuggccacccuggugaaguacaccaccgacgaguucgaccagagaauccuguacgaguaccuggccgaggccagcgugguguuccccaagguguuccccguggugcacaaccugcuggacagcaagaucaacacccugcugagccugugccaggaccccaaccugcugaaccccauccacggcaucgugcagagcgugguguaccacgaggagagccccccccaguaccagaccagcuaccugcagagcuucggcuucaacggccuguggagauucgccggccccuucagcaagcagacccagauccccgacuacgccgagcugaucgugaaguuccuggacgcccugaucgacaccuaccugcccggcaucgacgaggagaccagcgaggagagccugcugacccccaccagccccuacccccccgcccugcagagccagcugagcaucaccgccaaccugaaccugagcaacagcaugaccagccuggccaccagccagcacagccccggcaucgacaaggagaacguggagcugagccccaccaccggccacugcaacagcggcagaaccagacacggcagcgccagccaggugcagaagcagagaagcgccggcagcuucaagagaaacagcaucaagaagaucguguaa

SEQ ID NO: 20484 - RNA, 1788 nt, Artificial Sequence
  NF2__Homo_sapiens__NP_000259
auggccggcgccaucgccagcagaaugagcuucagcagccugaagagaaagcagcccaagaccuucaccgugagaaucgugaccauggacgccgagauggaguucaacugcgagaugaaguggaagggcaaggaccuguucgaccuggugugcagaacccugggccugagagagaccugguucuucggccugcaguacaccaucaaggacaccguggccuggcugaagauggacaagaaggugcuggaccacgacgugagcaaggaggagcccgugaccuuccacuuccuggccaaguucuaccccgagaacgccgaggaggagcuggugcaggagaucacccagcaccuguucuuccugcaggugaagaagcagauccuggacgagaagaucuacugcccccccgaggccagcgugcugcuggccagcuacgccgugcaggccaaguacggcgacuacgaccccagcgugcacaagagaggcuuccuggcccaggaggagcugcugcccaagagagugaucaaccuguaccagaugacccccgagaugugggaggagagaaucaccgccugguacgccgagcacagaggcagagccagagacgaggccgagauggaguaccugaagaucgcccaggaccuggagauguacggcgugaacuacuucgccaucagaaacaagaagggcaccgagcugcugcugggcguggacgcccugggccugcacaucuacgaccccgagaacagacugacccccaagaucagcuuccccuggaacgagaucagaaacaucagcuacagcgacaaggaguucaccaucaagccccuggacaagaagaucgacguguucaaguucaacagcagcaagcugagagugaacaagcugauccugcagcugugcaucggcaaccacgaccuguucaugagaagaagaaaggccgacagccuggaggugcagcagaugaaggcccaggccagagaggagaaggccagaaagcagauggagagacagagacuggccagagagaagcagaugagagaggaggccgagagaaccagagacgagcuggagagaagacugcugcagaugaaggaggaggccaccauggccaacgaggcccugaugagaagcgaggagaccgccgaccugcuggccgagaaggcccagaucaccgaggaggaggccaagcugcuggcccagaaggccgccgaggccgagcaggagaugcagagaaucaaggccaccgccaucagaaccgaggaggagaagagacugauggagcagaaggugcuggaggccgaggugcuggcccugaagauggccgaggagagcgagagaagagccaaggaggccgaccagcugaagcaggaccugcaggaggccagagaggccgagagaagagccaagcagaagcugcuggagaucgccaccaagcccaccuacccccccaugaaccccauccccgccccccugccccccgacauccccagcuucaaccugaucggcgacagccugagcuucgacuucaaggacaccgacaugaagagacugagcauggagaucgagaaggagaagguggaguacauggagaagagcaagcaccugcaggagcagcugaacgagcugaagaccgagaucgaggcccugaagcugaaggagagagagaccgcccuggacauccugcacaacgagaacagcgacagaggcggcagcagcaagcacaacaccaucaagaagcugacccugcagagcgccaagagcagaguggccuucuucgaggagcuguaa

SEQ ID NO: 20485 - RNA, 813 nt, Artificial Sequence
  NFAM1__Homo_sapiens__NP_666017
auggagaaccagcccgugagauggagagcccugcccggccugcccagaccccccggccugcccgccgcccccuggcugcugcugggcgugcugcugcugcccggcacccugagacuggccggcggccagagcgugacccacaccggccugcccaucauggccagccuggccaacaccgccaucagcuucagcugcagaaucaccuaccccuacaccccccaguucaagguguucaccgugagcuacuuccacgaggaccugcagggccagagaagccccaagaagcccaccaacugccaccccggccugggcaccgagaaccagagccacacccuggacugccaggugacccuggugcugcccggcgccagcgccaccggcaccuacuacugcagcgugcacuggccccacagcaccgugagaggcagcggcaccuucauccuggugagagacgccggcuacagagagcccccccagagcccccagaagcugcugcuguucggcuucaccggccugcugagcgugcugagcguggugggcaccgcccugcugcuguggaacaagaagagaaugagaggccccggcaaggaccccaccagaaagugccccgaccccagaagcgccagcagccccaagcagcaccccagcgagagcguguacaccgcccugcagagaagagagaccgagguguacgccugcaucgagaacgaggacggcagcagccccaccgccaagcagagcccccugagccaggagagaccccacagauucgaggacgacggcgagcugaaccugguguacgagaaccuguaa

SEQ ID NO: 20486 - RNA, 3723 nt, Artificial Sequence
  NFASC__Homo_sapiens__NP_001005388
auggccagacagccccccccccccugggugcacgccgccuuccugcugugccugcugagccugggcggcgccaucgagauccccauggaccccagcauccagaacgagcugacccagccccccaccaucaccaagcagagcgccaaggaccacaucguggaccccagagacaacauccugaucgagugcgaggccaagggcaaccccgcccccagcuuccacuggaccagaaacagcagauucuucaacaucgccaaggaccccagagugagcaugagaagaagaagcggcacccuggugaucgacuucagaagcggcggcagacccgaggaguacgagggcgaguaccagugcuucgccagaaacaaguucggcaccgcccugagcaacagaaucagacugcaggugagcaagagcccccuguggcccaaggagaaccuggaccccgugguggugcaggagggcgccccccugacccugcagugcaaccccccccccggccugcccagccccgugaucuucuggaugagcagcagcauggagcccaucacccaggacaagagagugagccagggccacaacggcgaccuguacuucagcaacgugaugcugcaggacaugcagaccgacuacagcugcaacgccagauuccacuucacccacaccauccagcagaagaaccccuucacccugaaggugcugaccaccagaggcguggccgagagaacccccagcuucauguacccccagggcaccgccagcagccagauggugcugagaggcauggaccugcugcuggagugcaucgccagcggcgugcccacccccgacaucgccugguacaagaagggcggcgaccugcccagcgacaaggccaaguucgagaacuucaacaaggcccugagaaucaccaacgugagcgaggaggacagcggcgaguacuucugccuggccagcaacaagaugggcagcaucagacacaccaucagcgugagagugaaggccgcccccuacuggcuggacgagcccaagaaccugauccuggcccccggcgaggacggcagacuggugugcagagccaacggcaaccccaagcccaccgugcaguggauggugaacggcgagccccugcagagcgccccccccaaccccaacagagagguggccggcgacaccaucaucuucagagacacccagaucagcagcagagccguguaccagugcaacaccagcaacgagcacggcuaccugcuggccaacgccuucgugagcgugcuggacgugccccccagaaugcugagccccagaaaccagcugaucagagugauccuguacaacagaaccagacuggacugccccuucuucggcagccccauccccacccugagaugguucaagaacggccagggcagcaaccuggacggcggcaacuaccacguguacgagaacggcagccuggagaucaagaugaucagaaaggaggaccagggcaucuacaccugcguggccaccaacauccugggcaaggccgagaaccaggugagacuggaggugaaggaccccaccagaaucuacagaaugcccgaggaccagguggccagaagaggcaccaccgugcagcuggagugcagagugaagcacgaccccagccugaagcugaccgugagcuggcugaaggacgacgagccccuguacaucggcaacagaaugaagaaggaggacgacagccugaccaucuucggcguggccgagagagaccagggcagcuacaccugcguggccagcaccgagcuggaccaggaccuggccaaggccuaccugaccgugcuggccgaccaggccacccccaccaacagacuggccgcccugcccaagggcagacccgacagacccagagaccuggagcugaccgaccuggccgagagaagcgugagacugaccuggauccccggcgacgccaacaacagccccaucaccgacuacguggugcaguucgaggaggaccaguuccagcccggcguguggcacgaccacagcaaguaccccggcagcgugaacagcgccgugcugagacugagccccuacgugaacuaccaguucagagugaucgccaucaacgaggugggcagcagccaccccagccugcccagcgagagauacagaaccagcggcgccccccccgagagcaaccccggcgacgugaagggcgagggcaccagaaagaacaacauggagaucaccuggacccccaugaacgccaccagcgccuucggccccaaccugagauacaucgugaaguggagaagaagagagaccagagaggccuggaacaacgugaccguguggggcagcagauacguggugggccagacccccguguacgugcccuacgagaucagagugcaggccgagaacgacuucggcaagggccccgagcccgagagcgugaucggcuacagcggcgaggaccugcccagcgcccccagaagauucagagugagacagcccaaccuggagaccaucaaccuggagugggaccaccccgagcaccccaacggcaucaugaucggcuacacccugaaguacguggccuucaacggcaccaaggugggcaagcagaucguggagaacuucagccccaaccagaccaaguucaccgugcagagaaccgaccccgugagcagauacagauucacccugagcgccagaacccaggugggcagcggcgaggccgugaccgaggagagccccgccccccccaacgaggccacccccaccgccgccccccccacccugccccccaccaccgugggcgccaccggcgccgugagcagcaccgacgccaccgccaucgccgccaccaccgaggccaccaccgugcccaucauccccaccguggcccccaccaccaucgccaccaccaccaccguggccaccaccaccaccaccaccgccgccgccaccaccaccaccgagagcccccccaccaccaccagcggcaccaagauccacgagagcgcccccgacgagcagagcaucuggaacgugaccgugcugcccaacagcaagugggccaacaucaccuggaagcacaacuucggccccggcaccgacuucgugguggaguacaucgacagcaaccacaccaagaagaccgugcccgugaaggcccaggcccagcccauccagcugaccgaccuguaccccggcaugaccuacacccugagaguguacagcagagacaacgagggcaucagcagcaccgugaucaccuucaugaccagcaccgccuacaccaacaaccaggccgacaucgccacccagggcugguucaucggccugaugugcgccaucgcccugcuggugcugauccugcugaucgugugcuucaucaagagaagcagaggcggcaaguaccccgugagagagaagaaggacgugccccugggccccgaggaccccaaggaggaggacggcagcuucgacuacagcgacgaggacaacaagccccugcagggcagccagaccagccuggacggcaccaucaagcagcaggagagcgacgacagccugguggacuacggcgagggcggcgagggccaguucaacgaggacggcagcuucaucggccaguacaccgugaagaaggacaaggaggagaccgagggcaacgagagcagcgaggccaccagccccgugaacgccaucuacagccuggccuaa

SEQ ID NO: 20487 - RNA, 4647 nt, Artificial Sequence
  NFAT5__Homo_sapiens__NP_001106649
augcccagcgacuucaucagccugcugagcgccgaccuggaccuggagagccccaagagccuguacagcagagacagccugaagcugcaccccagccagaacuuccacagagccggccugcuggaggagagcguguacgaccugcugcccaaggagcugcagcugccccccagcagagagaccagcguggccagcaugagccagaccagcggcggcgaggccggcagccccccccccgccgugguggccgccgacgccagcagcgcccccagcagcagcagcaugggcggcgccugcagcagcuucaccaccagcagcagccccaccaucuacagcaccagcgugaccgacagcaaggccaugcagguggagagcugcagcagcgccgugggcgugagcaacagaggcgugagcgagaagcagcugaccagcaacaccgugcagcagcaccccagcacccccaagagacacaccgugcuguacaucagccccccccccgaggaccugcuggacaacagcagaaugagcugccaggacgagggcugcggccuggagagcgagcagagcugcagcauguggauggaggacagccccagcaacuucagcaacaugagcaccagcagcuacaacgacaacaccgaggugcccagaaagagcagaaagagaaaccccaagcagagacccggcgugaagagaagagacugcgaggagagcaacauggacaucuucgacgccgacagcgccaaggccccccacuacgugcugagccagcugaccaccgacaacaagggcaacagcaaggccggcaacggcacccuggagaaccagaagggcaccggcgugaagaagagccccaugcugugcggccaguaccccgugaagagcgagggcaaggagcugaagaucguggugcagcccgagacccagcacagagccagauaccugaccgagggcagcagaggcagcgugaaggacagaacccagcagggcuuccccaccgugaagcuggagggccacaacgagcccguggugcugcagguguucgugggcaacgacagcggcagagugaagccccacggcuucuaccaggccugcagagugaccggcagaaacaccacccccugcaaggagguggacaucgagggcaccaccgugaucgaggugggccuggaccccagcaacaacaugacccuggccguggacugcgugggcauccugaagcugagaaacgccgacguggaggccagaaucggcaucgccggcagcaagaagaagagcaccagagccagacugguguucagagugaacaucaugagaaaggacggcagcacccugacccugcagacccccagcagccccauccugugcacccagcccgccggcgugcccgagauccugaagaagagccugcacagcugcagcgugaagggcgaggaggagguguuccugaucggcaagaacuuccugaagggcaccaaggugaucuuccaggagaacgugagcgacgagaacagcuggaagagcgaggccgagaucgacauggagcuguuccaccagaaccaccugaucgugaaggugccccccuaccacgaccagcacaucacccugcccgugagcgugggcaucuacguggugaccaacgccggcagaagccacgacgugcagcccuucaccuacacccccgaccccgccgccggcgcccugaacgugaacgugaagaaggagaucagcagccccgccagacccugcagcuucgaggaggccaugaaggccaugaagaccaccggcugcaaccuggacaaggugaacaucauccccaacgcccugaugaccccccugauccccagcagcaugaucaagagcgaggacgugacccccauggaggugaccgccgagaagagaagcagcaccaucuucaagaccaccaagagcgugggcagcacccagcagacccuggagaacaucagcaacaucgccggcaacggcagcuucagcagccccagcagcagccaccugcccagcgagaacgagaagcagcagcagauccagcccaaggccuacaaccccgagacccugaccaccauccagacccaggacaucagccagcccggcaccuuccccgccgugagcgccagcagccagcugcccaacagcgacgcccugcugcagcaggccacccaguuccagaccagagagacccagagcagagagauccugcagagcgacggcaccguggugaaccugagccagcugaccgaggccagccagcagcagcagcagagcccccugcaggagcaggcccagacccugcagcagcagaucagcagcaacaucuuccccagccccaacagcgugagccagcugcagaacaccauccagcagcugcaggccggcagcuucaccggcagcaccgccagcggcagcagcggcagcguggaccuggugcagcaggugcuggaggcccagcagcagcugagcagcgugcuguucagcgcccccgacggcaacgagaacgugcaggagcagcugagcgccgacaucuuccagcaggugagccagauccagagcggcgugagccccggcauguucagcagcaccgagcccaccgugcacaccagacccgacaaccugcugcccggcagagccgagagcgugcacccccagagcgagaacacccugagcaaccagcagcagcagcagcagcagcagcagcaggugauggagagcagcgccgccauggugauggagaugcagcagagcaucugccaggccgccgcccagauccagagcgagcuguuccccagcaccgccagcgccaacggcaaccugcagcagagccccguguaccagcagaccagccacaugaugagcgcccugagcaccaacgaggacaugcagaugcagugcgagcuguucagcagcccccccgccgugagcggcaacgagaccagcaccaccaccacccagcagguggccacccccggcaccaccauguuccagaccagcagcagcggcgacggcgaggagaccggcacccaggccaagcagauccagaacagcguguuccagaccauggugcagaugcagcacagcggcgacaaccagccccaggugaaccuguucagcagcaccaagagcaugaugagcgugcagaacagcggcacccagcagcagggcaacggccuguuccagcagggcaacgagaugaugagccugcagagcggcaacuuccugcagcagagcagccacagccaggcccagcuguuccacccccagaaccccaucgccgacgcccagaaccugagccaggagacccagggcagccuguuccacagccccaaccccaucgugcacagccagaccagcaccaccagcagcgagcagaugcagccccccauguuccacagccagagcaccaucgccgugcugcagggcagcagcgugccccaggaccagcagagcaccaacaucuuccugagccagagccccaugaacaaccugcagaccaacaccguggcccaggaggccuucuucgccgcccccaacagcaucagcccccugcagagcaccagcaacagcgagcagcaggccgccuuccagcagcaggcccccaucagccacauccagacccccaugcugagccaggagcaggcccagcccccccagcagggccuguuccagccccagguggcccugggcagccugccccccaaccccaugccccagagccagcagggcaccauguuccagagccagcacagcaucguggccaugcagagcaacagccccagccaggagcagcagcagcagcagcagcagcagcagcagcagcagcagcagcagcagcagagcauccuguucagcaaccagaacaccauggccaccauggccagccccaagcagcccccccccaacaugaucuucaaccccaaccagaaccccauggccaaccaggagcagcagaaccagagcaucuuccaccagcagagcaacauggcccccaugaaccaggagcagcagcccaugcaguuccagagccagagcaccgugagcagccugcagaaccccggccccacccagagcgagagcagccagaccccccuguuccacagcagcccccagauccagcuggugcagggcagccccagcagccaggagcagcaggugacccuguuccugagccccgccagcaugagcgcccugcagaccagcaucaaccagcaggacaugcagcagagcccccuguacagcccccagaacaacaugcccggcauccagggcgccaccagcagcccccagccccaggccacccuguuccacaacaccgccggcggcaccaugaaccagcugcagaacagccccggcagcagccagcagaccagcggcauguuccuguucggcauccagaacaacugcagccagcugcugaccagcggccccgccacccugcccgaccagcugauggccaucagccagcccggccagccccagaacgagggccagccccccgugaccacccugcugagccagcagaugcccgagaacagcccccuggccagcagcaucaacaccaaccagaacaucgagaagaucgaccugcuggugagccugcagaaccagggcaacaaccugaccggcagcuucuaa

SEQ ID NO: 20488 - RNA, 2832 nt, Artificial Sequence
  NFATC1__Homo_sapiens__NP_001265598
augcccagcaccagcuuccccgugcccagcaaguucccccugggccccgccgccgccguguucggcagaggcgagacccugggccccgcccccagagccggcggcaccaugaagagcgccgaggaggagcacuacggcuacgccagcagcaacgugagccccgcccugccccugcccaccgcccacagcacccugcccgcccccugccacaaccugcagaccagcacccccggcaucaucccccccgccgaccaccccagcggcuacggcgccgcccuggacggcggccccgccggcuacuuccugagcagcggccacaccagacccgacggcgcccccgcccuggagagccccagaaucgagaucaccagcugccugggccuguaccacaacaacaaccaguucuuccacgacguggagguggaggacgugcugcccagcagcaagagaagccccagcaccgccacccugagccugcccagccuggaggccuacagagaccccagcugccugagccccgccagcagccugagcagcagaagcugcaacagcgaggccagcagcuacgagagcaacuacagcuaccccuacgccagcccccagaccagccccuggcagagccccugcgugagccccaagaccaccgaccccgaggagggcuuccccagaggccugggcgccugcacccugcugggcagccccagacacagccccagcaccagccccagagccagcgugaccgaggagagcuggcugggcgccagaagcagcagacccgccagccccugcaacaagagaaaguacagccugaacggcagacagccccccuacagcccccaccacagccccacccccagcccccacggcagccccagagugagcgugaccgacgacagcuggcugggcaacaccacccaguacaccagcagcgccaucguggccgccaucaacgcccugaccaccgacagcagccuggaccugggcgacggcgugcccgugaagagcagaaagaccacccuggagcagccccccagcguggcccugaagguggagcccgugggcgaggaccugggcagcccccccccccccgccgacuucgcccccgaggacuacagcagcuuccagcacaucagaaagggcggcuucugcgaccaguaccuggccgugccccagcaccccuaccagugggccaagcccaagccccugagccccaccagcuacaugagccccacccugcccgcccuggacuggcagcugcccagccacagcggccccuacgagcugagaaucgaggugcagcccaagagccaccacagagcccacuacgagaccgagggcagcagaggcgccgugaaggccagcgccggcggccaccccaucgugcagcugcacggcuaccuggagaacgagccccugaugcugcagcuguucaucggcaccgccgacgacagacugcugagaccccacgccuucuaccaggugcacagaaucaccggcaagaccgugagcaccaccagccacgaggccauccugagcaacaccaaggugcuggagaucccccugcugcccgagaacagcaugagagccgugaucgacugcgccggcauccugaagcugagaaacagcgacaucgagcugagaaagggcgagaccgacaucggcagaaagaacaccagagugagacugguguucagagugcacgugccccagcccagcggcagaacccugagccugcagguggccagcaaccccaucgagugcagccagagaagcgcccaggagcugccccugguggagaagcagagcaccgacagcuaccccguggugggcggcaagaagauggugcugagcggccacaacuuccugcaggacagcaaggugaucuucguggagaaggcccccgacggccaccacgugugggagauggaggccaagaccgacagagaccugugcaagcccaacagccuggugguggagaucccccccuucagaaaccagagaaucaccagccccgugcacgugagcuucuacgugugcaacggcaagagaaagagaagccaguaccagagauucaccuaccugcccgccaacgugcccaucaucaagaccgagcccaccgacgacuacgagcccgcccccaccugcggccccgugagccagggccugagcccccugcccagacccuacuacagccagcagcuggccaugccccccgaccccagcagcugccugguggccggcuucccccccugcccccagagaagcacccugaugcccgccgcccccggcgugagccccaagcugcacgaccugagccccgccgccuacaccaagggcguggccagccccggccacugccaccugggccugccccagcccgccggcgaggcccccgccgugcaggacgugcccagacccguggccacccaccccggcagccccggccagcccccccccgcccugcugccccagcaggugagcgccccccccagcagcagcugcccccccggccuggagcacagccugugccccagcagccccagccccccccugccccccgccacccaggagcccaccugccugcagcccugcagccccgccugcccccccgccaccggcagaccccagcaccugcccagcaccgugagaagagacgagagccccaccgccggccccagacugcugcccgaggugcacgaggacggcagccccaaccuggcccccauccccgugaccgugaagagagagcccgaggagcuggaccagcuguaccuggacgacgugaacgagaucaucagaaacgaccugagcagcaccagcacccacagcuaa

SEQ ID NO: 20489 - RNA, 2706 nt, Artificial Sequence
  NFATC2__Homo_sapiens__NP_001129493
augcagagagaggccgccuucagacugggccacugccacccccugagaaucaugggcagcguggaccaggaggagcccaacgcccacaagguggccagcccccccagcggccccgccuaccccgacgacgugcuggacuacggccugaagcccuacagcccccuggccagccugagcggcgagccccccggcagauucggcgagcccgacagagugggcccccagaaguuccugagcgccgccaagcccgccggcgccagcggccugagccccagaaucgagaucacccccagccacgagcugauccaggccgugggcccccugagaaugagagacgccggccugcugguggagcagcccccccuggccggcguggccgccagccccagauucacccugcccgugcccggcuucgagggcuacagagagccccugugccugagccccgccagcagcggcagcagcgccagcuucaucagcgacaccuucagccccuacaccagccccugcgugagccccaacaacggcggccccgacgaccugugcccccaguuccagaacauccccgcccacuacagccccagaaccagccccaucaugagccccagaaccagccuggccgaggacagcugccugggcagacacagccccgugcccagacccgccagcagaagcagcagccccggcgccaagagaagacacagcugcgccgaggcccugguggcccugccccccggcgccagcccccagagaagcagaagccccagcccccagcccagcagccacguggccccccaggaccacggcagccccgccggcuacccccccguggccggcagcgccgugaucauggacgcccugaacagccuggccaccgacagccccugcggcaucccccccaagauguggaagaccagccccgaccccagccccgugagcgccgcccccagcaaggccggccugcccagacacaucuaccccgccguggaguuccugggccccugcgagcagggcgagagaagaaacagcgcccccgagagcauccugcuggugccccccaccuggcccaagccccuggugcccgccauccccaucugcagcauccccgugaccgccagccugcccccccuggaguggccccugagcagccagagcggcagcuacgagcugagaaucgaggugcagcccaagccccaccacagagcccacuacgagaccgagggcagcagaggcgccgugaaggcccccaccggcggccaccccguggugcagcugcacggcuacauggagaacaagccccugggccugcagaucuucaucggcaccgccgacgagagaauccugaagccccacgccuucuaccaggugcacagaaucaccggcaagaccgugaccaccaccagcuacgagaagaucgugggcaacaccaaggugcuggagaucccccuggagcccaagaacaacaugagagccaccaucgacugcgccggcauccugaagcugagaaacgccgacaucgagcugagaaagggcgagaccgacaucggcagaaagaacaccagagugagacugguguucagagugcacauccccgagagcagcggcagaaucgugagccugcagaccgccagcaaccccaucgagugcagccagagaagcgcccacgagcugcccaugguggagagacaggacaccgacagcugccugguguacggcggccagcagaugauccugaccggccagaacuucaccagcgagagcaaggugguguucaccgagaagaccaccgacggccagcagaucugggagauggaggccaccguggacaaggacaagagccagcccaacaugcuguucguggagauccccgaguacagaaacaagcacaucagaacccccgugaaggugaacuucuacgugaucaacggcaagagaaagagaagccagccccagcacuucaccuaccaccccgugcccgccaucaagaccgagcccaccgacgaguacgaccccacccugaucugcagccccacccacggcggccugggcagccagcccuacuacccccagcaccccaugguggccgagagccccagcugccugguggccaccauggcccccugccagcaguucagaaccggccugagcagccccgacgccagauaccagcagcagaaccccgccgccgugcuguaccagagaagcaagagccugagccccagccugcugggcuaccagcagcccgcccugauggccgccccccugagccuggccgacgcccacagaagcgugcuggugcacgccggcagccagggccagagcagcgcccugcugcaccccagccccaccaaccagcaggccagccccgugauccacuacagccccaccaaccagcagcugagaugcggcagccaccaggaguuccagcacaucauguacugcgagaacuucgcccccggcaccaccagacccggccccccccccgugagccagggccagagacugagccccggcagcuaccccaccgugauccagcagcagaacgccaccagccagagagccgccaagaacggcccccccgugagcgaccagaaggaggugcugcccgccggcgugaccaucaagcaggagcagaaccuggaccagaccuaccuggacgacgagcugaucgacacccaccugagcuggauccagaacauccuguaa

SEQ ID NO: 20490 - RNA, 3207 nt, Artificial Sequence
  NFATC3__Homo_sapiens__NP_004546
augaccaccgccaacugcggcgcccacgacgagcuggacuucaagcugguguucggcgaggacggcgcccccgccccccccccccccggcagcagacccgccgaccuggagcccgacgacugcgccagcaucuacaucuucaacguggaccccccccccagcacccugaccaccccccugugccugccccaccacggccugcccagccacagcagcgugcugagccccagcuuccagcugcagagccacaagaacuacgagggcaccugcgagauccccgagagcaaguacagcccccugggcggccccaagcccuucgagugccccagcauccagaucaccagcaucagccccaacugccaccaggagcuggacgcccacgaggacgaccugcagaucaacgaccccgagagagaguuccuggagagacccagcagagaccaccuguaccugccccuggagcccagcuacagagagagcagccugagccccagccccgccagcagcaucagcagcagaagcugguucagcgacgccagcagcugcgagagccugagccacaucuacgacgacguggacagcgagcugaacgaggccgccgccagauucacccugggcagcccccugaccagccccggcggcagccccggcggcugccccggcgaggagaccuggcaccagcaguacggccugggccacagccugagccccagacagagccccugccacagccccagaagcagcgugaccgacgagaacuggcugagccccagacccgccagcggccccagcagcagacccaccagccccugcggcaagagaagacacagcagcgccgaggugugcuacgccggcagccugagcccccaccacagccccgugcccagccccggccacagccccagaggcagcgugaccgaggacaccuggcugaacgccagcgugcacggcggcagcggccugggccccgccguguuccccuuccaguacugcguggagaccgacaucccccugaagaccagaaagaccagcgaggaccaggccgccauccugcccggcaagcuggagcugugcagcgacgaccagggcagccugagccccgccagagagaccagcaucgacgacggccugggcagccaguacccccugaagaaggacagcugcggcgaccaguuccugagcgugcccagccccuucaccuggagcaagcccaagcccggccacacccccaucuucagaaccagcagccugcccccccuggacuggccccugcccgcccacuucggccagugcgagcugaagaucgaggugcagcccaagacccaccacagagcccacuacgagaccgagggcagcagaggcgccgugaaggccagcaccggcggccaccccguggugaagcugcugggcuacaacgagaagcccaucaaccugcagauguucaucggcaccgccgacgacagauaccugagaccccacgccuucuaccaggugcacagaaucaccggcaagaccguggccaccgccagccaggagaucaucaucgccagcaccaaggugcuggagaucccccugcugcccgagaacaacaugagcgccagcaucgacugcgccggcauccugaagcugagaaacagcgacaucgagcugagaaagggcgagaccgacaucggcagaaagaacaccagagugagacugguguucagagugcacaucccccagcccagcggcaaggugcugagccugcagaucgccagcauccccguggagugcagccagagaagcgcccaggagcugccccacaucgagaaguacagcaucaacagcugcagcgugaacggcggccacgagaugguggugaccggcagcaacuuccugcccgagagcaagaucaucuuccuggagaagggccaggacggcagaccccagugggagguggagggcaagaucaucagagagaagugccagggcgcccacaucgugcuggaggugccccccuaccacaaccccgccgugaccgccgccgugcaggugcacuucuaccugugcaacggcaagagaaagaagagccagagccagagauucaccuacacccccgugcugaugaagcaggagcacagagaggagaucgaccugagcagcgugcccagccugcccgugccccaccccgcccagacccagagacccagcagcgacagcggcugcagccacgacagcgugcugagcggccagagaagccugaucugcagcaucccccagaccuacgccagcauggugaccagcagccaccugccccagcugcagugcagagacgagagcgugagcaaggagcagcacaugauccccagccccaucgugcaccagcccuuccaggugacccccaccccccccgugggcagcagcuaccagcccaugcagaccaacgugguguacaacggccccaccugccugcccaucaacgccgccagcagccaggaguucgacagcgugcuguuccagcaggacgccacccugagcggccuggugaaccugggcugccagccccugagcagcauccccuuccacagcagcaacagcggcagcaccggccaccugcuggcccacaccccccacagcgugcacacccugccccaccugcagagcaugggcuaccacugcagcaacaccggccagagaagccugagcagccccguggccgaccagaucaccggccagcccagcagccagcugcagcccaucaccuacggccccagccacagcggcagcgccaccaccgccagccccgccgccagccacccccuggccagcagcccccugagcggcccccccagcccccagcugcagcccaugcccuaccagagccccagcagcggcaccgccagcagccccagccccgccaccagaaugcacagcggccagcacagcacccaggcccagagcaccggccagggcggccugagcgcccccagcagccugaucugccacagccugugcgaccccgccagcuucccccccgacggcgccaccgugagcaucaagcccgagcccgaggacagagagcccaacuucgccaccaucggccugcaggacaucacccuggacgacgaccaguucaucagcgaccuggagcaccagcccagcggcagcgccgagaaguggcccaaccacagcgugcugagcugccccgcccccuucuggagaaucuaa

SEQ ID NO: 20491 - RNA, 2895 nt, Artificial Sequence
  NFATC4__Homo_sapiens__NP_001129494
augaucaccacccugcccagccugcugcccgccagccuggccagcaucagccacagagugaccaaccugcccagcaacagccugagccacaaccccggccugagcaagcccgacuuccccggcaacagcagccccggccugcccagcagcagcagccccggcagagaccugggcgcccccgccggcagcaugggcgccgccagcugcgaggacgaggagcuggaguucaagcugguguucggcgaggagaaggaggcccccccccugggcgccggcggccugggcgaggagcuggacagcgaggacgccccccccugcugcagacuggcccugggcgagcccccccccuacggcgccgcccccaucggcauccccagaccccccccccccagacccggcaugcacagccccccccccagacccgcccccagccccggcaccugggagagccagcccgccagaagcgugagacugggcggccccggcggcggcgccggcggcgccggcggcggcagagugcuggagugccccagcaucagaaucaccagcaucagccccacccccgagccccccgccgcccuggaggacaaccccgacgccuggggcgacggcagccccagagacuaccccccccccgagggcuucggcggcuacagagaggccggcggccagggcggcggcgccuucuucagccccagccccggcagcagcagccugagcagcuggagcuucuucagcgacgccagcgacgaggccgcccuguacgccgccugcgacgagguggagagcgagcugaacgaggccgccagcagauucggccugggcagcccccugcccagccccagagccagccccagacccuggacccccgaggaccccuggagccuguacggccccagccccggcggcagaggccccgaggacagcuggcugcugcugagcgcccccggccccacccccgccagccccagacccgccagccccugcggcaagagaagauacagcagcagcggcacccccagcagcgccagccccgcccugagcagaagaggcagccugggcgaggagggcagcgagcccccccccccccccccccugccccuggccagagaccccggcagccccggccccuucgacuacgugggcgccccccccgccgagagcaucccccagaagaccagaagaaccagcagcgagcaggccguggcccugcccagaagcgaggagcccgccagcugcaacggcaagcugccccugggcgccgaggagagcguggccccccccggcggcagcagaaaggagguggccggcauggacuaccuggccgugcccagcccccuggccuggagcaaggccagaaucggcggccacagccccaucuucagaaccagcgcccugcccccccuggacuggccccugcccagccaguacgagcagcuggagcugagaaucgaggugcagcccagagcccaccacagagcccacuacgagaccgagggcagcagaggcgccgugaaggccgcccccggcggccaccccguggugaagcugcugggcuacagcgagaagccccugacccugcagauguucaucggcaccgccgacgagagaaaccugagaccccacgccuucuaccaggugcacagaaucaccggcaagaugguggccaccgccagcuacgaggccguggugagcggcaccaaggugcuggagaugacccugcugcccgagaacaacauggccgccaacaucgacugcgccggcauccugaagcugagaaacagcgacaucgagcugagaaagggcgagaccgacaucggcagaaagaacaccagagugagacugguguucagagugcacgugccccagggcggcggcaagguggugagcgugcaggccgccagcgugcccaucgagugcagccagagaagcgcccaggagcugccccagguggaggccuacagccccagcgccugcagcgugagaggcggcgaggagcuggugcugaccggcagcaacuuccugcccgacagcaaggugguguucaucgagagaggccccgacggcaagcugcagugggaggaggaggccaccgugaacagacugcagagcaacgaggugacccugacccugaccgugcccgaguacagcaacaagagagugagcagacccgugcagguguacuucuacgugagcaacggcagaagaaagagaagccccacccagagcuucagauuccugcccgugaucugcaaggaggagccccugcccgacagcagccugagaggcuuccccagcgccagcgccacccccuucggcaccgacauggacuucagcccccccagaccccccuaccccagcuacccccacgaggaccccgccugcgagacccccuaccugagcgagggcuucggcuacggcaugcccccccuguacccccagaccggccccccccccagcuacagacccggccugagaauguuccccgagaccagaggcaccaccggcugcgcccagccccccgccgugagcuuccugcccagacccuuccccagcgaccccuacggcggcagaggcagcagcuucagccugggccugcccuucagcccccccgcccccuucagaccccccccccugcccgccagccccccccuggagggccccuuccccagccagagcgacgugcacccccugcccgccgagggcuacaacaaggugggccccggcuacggccccggcgagggcgcccccgagcaggagaagagcagaggcggcuacagcagcggcuucagagacagcgugcccauccagggcaucacccuggaggagggcggcugcggcaccggcggcugcgagugcgagugcgugcaggagaucgcccugcacgugugcuaa

SEQ ID NO: 20492 - RNA, 1122 nt, Artificial Sequence
  NFE2__Homo_sapiens__XP_005268963
augagccccugccccccccagcagagcagaaacagagugauccagcugagcaccagcgagcugggcgagauggagcugaccuggcaggagaucaugagcaucaccgagcugcagggccugaacgcccccagcgagcccagcuucgagccccaggcccccgcccccuaccugggcccccccccccccaccaccuacugccccugcagcauccaccccgacagcggcuucccccugccccccccccccuacgagcugcccgccagcaccagccacgugcccgacccccccuacagcuacggcaacauggccauccccgugagcaagccccugagccugagcggccugcugagcgagccccugcaggacccccuggcccugcuggacaucggccugcccgccggcccccccaagccccaggaggaccccgagagcgacagcggccugagccugaacuacagcgacgccgagagccuggagcuggagggcaccgaggccggcagaagaagaagcgaguacguggagauguaccccguggaguaccccuacagccugaugcccaacagccuggcccacagcaacuacacccugcccgccgccgagaccccccuggcccuggagcccagcagcggccccgugagagccaagcccaccgccagaggcgaggccggcagcagagacgagagaagagcccuggccaugaagauccccuuccccaccgacaagaucgugaaccugcccguggacgacuucaacgagcugcuggccagauacccccugaccgagagccagcuggcccuggugagagacaucagaagaagaggcaagaacaagguggccgcccagaacugcagaaagagaaagcuggagaccaucgugcagcuggagagagagcuggagagacugaccaacgagagagagagacugcugagagccagaggcgaggccgacagaacccuggaggugaugagacagcagcugaccgagcuguacagagacaucuuccagcaccugagagacgagagcggcaacagcuacagccccgaggaguacgcccugcagcaggccgccgacggcaccaucuuccuggugcccagaggcaccaagauggaggccaccgacuaa

SEQ ID NO: 20493 - RNA, 2319 nt, Artificial Sequence
  NFE2L1__Homo_sapiens__NP_003195
augcugagccugaagaaguaccugaccgagggccugcugcaguucaccauccugcugagccugaucggcgugagaguggacguggacaccuaccugaccagccagcugcccccccugagagagaucauccugggccccagcagcgccuacacccagacccaguuccacaaccugagaaacacccuggacggcuacggcauccaccccaagagcaucgaccuggacaacuacuucaccgccagaagacugcugagccaggugagagcccuggacagauuccaggugcccaccaccgaggugaacgccuggcuggugcacagagaccccgagggcagcgugagcggcagccagcccaacagcggccuggcccuggagagcagcagcggccugcaggacgugaccggccccgacaacggcgugagagagagcgagaccgagcagggcuucggcgaggaccuggaggaccugggcgccguggccccccccgugagcggcgaccugaccaaggaggacaucgaccugaucgacauccuguggagacaggacaucgaccugggcgccggcagagagguguucgacuacagccacagacagaaggagcaggacguggagaaggagcugagagacggcggcgagcaggacaccugggccggcgagggcgccgaggcccuggccagaaaccugcugguggacggcgagaccggcgagagcuuccccgcccaggugcccagcggcgaggaccagaccgcccugagccuggaggagugccugagacugcuggaggccaccugccccuucggcgagaacgccgaguuccccgccgacaucagcagcaucaccgaggccgugcccagcgagagcgagccccccgcccugcagaacaaccugcugagcccccugcugaccggcaccgagagccccuucgaccuggagcagcaguggcaggaccugaugagcaucauggagaugcaggccauggaggugaacaccagcgccagcgagauccuguacagcgccccccccggcgacccccugagcaccaacuacagccuggcccccaacacccccaucaaccagaacgugagccugcaccaggccagccugggcggcugcagccaggacuuccugcuguucagccccgagguggagagccugcccguggccagcagcagcacccugcugccccuggcccccagcaacagcaccagccugaacagcaccuucggcagcaccaaccugaccggccuguucuuccccccccagcugaacggcaccgccaacgacaccgccggccccgagcugcccgacccccugggcggccugcuggacgaggccaugcuggacgagaucagccugauggaccuggccaucgaggagggcuucaaccccgugcaggccagccagcuggaggaggaguucgacagcgacagcggccugagccuggacagcagccacagccccagcagccugagcagcagcgagggcagcagcagcagcagcagcagcagcagcagcagcagcagcagcgccagcagcagcgccagcagcagcuucagcgaggagggcgccgugggcuacagcagcgacagcgagacccuggaccuggaggaggccgagggcgccgugggcuaccagcccgaguacagcaaguucugcagaaugagcuaccaggaccccgcccagcugagcugccugcccuaccuggagcacgugggccacaaccacaccuacaacauggcccccagcgcccuggacagcgccgaccugcccccccccagcgcccugaagaagggcagcaaggagaagcaggccgacuuccuggacaagcagaugagcagagacgagcacagagccagagccaugaagauccccuucaccaacgacaagaucaucaaccugcccguggaggaguucaacgagcugcugagcaaguaccagcugagcgaggcccagcugagccugaucagagacaucagaagaagaggcaagaacaagauggccgcccagaacugcagaaagagaaagcuggacaccauccugaaccuggagagagacguggaggaccugcagagagacaaggccagacugcugagagagaagguggaguuccugagaagccugagacagaugaagcagaaggugcagagccuguaccaggagguguucggcagacugagagacgagaacggcagacccuacagccccagccaguacgcccugcaguacgccggcgacggcagcgugcugcugauccccagaaccauggccgaccagcaggccagaagacaggagagaaagcccaaggacagaagaaaguaa

SEQ ID NO: 20494 - RNA, 1770 nt, Artificial Sequence
  NFE2L2__Homo_sapiens__NP_001138884
auggaccugaucgacauccuguggagacaggacaucgaccugggcgugagcagagagguguucgacuucagccagagaagaaaggaguacgagcuggagaagcagaagaagcuggagaaggagagacaggagcagcugcagaaggagcaggagaaggccuucuucgcccagcugcagcuggacgaggagaccggcgaguuccugcccauccagcccgcccagcacauccagagcgagaccagcggcagcgccaacuacagccagguggcccacauccccaagagcgacgcccuguacuucgacgacugcaugcagcugcuggcccagaccuuccccuucguggacgacaacgaggugagcagcgccaccuuccagagccuggugcccgacauccccggccacaucgagagccccguguucaucgccaccaaccaggcccagagccccgagaccagcguggcccagguggcccccguggaccuggacggcaugcagcaggacaucgagcaggugugggaggagcugcugagcauccccgagcugcagugccugaacaucgagaacgacaagcugguggagaccaccauggugcccagccccgaggccaagcugaccgagguggacaacuaccacuucuacagcagcauccccagcauggagaaggaggugggcaacugcagcccccacuuccugaacgccuucgaggacagcuucagcagcauccugagcaccgaggaccccaaccagcugaccgugaacagccugaacagcgacgccaccgugaacaccgacuucggcgacgaguucuacagcgccuucaucgccgagcccagcaucagcaacagcaugcccagccccgccacccugagccacagccugagcgagcugcugaacggccccaucgacgugagcgaccugagccugugcaaggccuucaaccagaaccaccccgagagcaccgccgaguucaacgacagcgacagcggcaucagccugaacaccagccccagcguggccagccccgagcacagcguggagagcagcagcuacggcgacacccugcugggccugagcgacagcgagguggaggagcuggacagcgcccccggcagcgugaagcagaacggccccaagacccccgugcacagcagcggcgacauggugcagccccugagccccagccagggccagagcacccacgugcacgacgcccagugcgagaacacccccgagaaggagcugcccgugagccccggccacagaaagacccccuucaccaaggacaagcacagcagcagacuggaggcccaccugaccagagacgagcugagagccaaggcccugcacauccccuuccccguggagaagaucaucaaccugcccgugguggacuucaacgagaugaugagcaaggagcaguucaacgaggcccagcuggcccugaucagagacaucagaagaagaggcaagaacaagguggccgcccagaacugcagaaagagaaagcuggagaacaucguggagcuggagcaggaccuggaccaccugaaggacgagaaggagaagcugcugaaggagaagggcgagaacgacaagagccugcaccugcugaagaagcagcugagcacccuguaccuggagguguucagcaugcugagagacgaggacggcaagcccuacagccccagcgaguacagccugcagcagaccagagacggcaacguguuccuggugcccaagagcaagaagcccgacgugaagaagaacuaa

SEQ ID NO: 20495 - RNA, 2085 nt, Artificial Sequence
  NFE2L3__Homo_sapiens__NP_004280
augaagcaccugaagagaugguggagcgccggcggcggccugcugcaccugacccugcugcugagccuggccggccugagaguggaccuggaccuguaccugcugcugcccccccccacccugcugcaggacgagcugcuguuccugggcggccccgccagcagcgccuacgcccugagccccuucagcgccagcggcggcuggggcagagccggccaccugcaccccaagggcagagagcuggaccccgccgccccccccgagggccagcugcugagagaggugagagcccugggcgugcccuucgugcccagaaccagcguggacgccuggcuggugcacagcguggccgccggcagcgccgacgaggcccacggccugcugggcgccgccgccgccagcagcaccggcggcgccggcgccagcguggacggcggcagccaggccgugcagggcggcggcggcgaccccagagccgccagaagcggcccccuggacgccggcgaggaggagaaggcccccgccgagcccaccgcccaggugcccgacgccggcggcugcgccagcgaggagaacggcgugcugagagagaagcacgaggccguggaccacagcagccagcacgaggagaacgaggagagagugagcgcccagaaggagaacagccugcagcagaacgacgacgacgagaacaagaucgccgagaagcccgacugggaggccgagaagaccaccgagagcagaaacgagagacaccugaacggcaccgacaccagcuucagccuggaggaccuguuccagcugcugagcagccagcccgagaacagccuggagggcaucagccugggcgacaucccccugcccggcagcaucagcgacggcaugaacagcagcgcccacuaccacgugaacuucagccaggccaucagccaggacgugaaccugcacgaggccauccugcugugccccaacaacaccuucagaagagaccccaccgccagaaccagccagagccaggagcccuuccugcagcugaacagccacaccaccaaccccgagcagacccugcccggcaccaaccugaccggcuuccugagccccguggacaaccacaugagaaaccugaccagccaggaccugcuguacgaccuggacaucaacaucuucgacgagaucaaccugaugagccuggccaccgaggacaacuucgaccccaucgacgugagccagcuguucgacgagcccgacagcgacagcggccugagccuggacagcagccacaacaacaccagcgugaucaagagcaacagcagccacagcgugugcgacgagggcgccaucggcuacugcaccgaccacgagagcagcagccaccacgaccuggagggcgccgugggcggcuacuaccccgagcccagcaagcugugccaccuggaccagagcgacagcgacuuccacggcgaccugaccuuccagcacguguuccacaaccacaccuaccaccugcagcccaccgcccccgagagcaccagcgagcccuuccccuggcccggcaagagccagaagaucagaagcagauaccuggaggacaccgacagaaaccugagcagagacgagcagagagccaaggcccugcacauccccuucagcguggacgagaucgugggcaugcccguggacagcuucaacagcaugcugagcagauacuaccugaccgaccugcaggugagccugaucagagacaucagaagaagaggcaagaacaagguggccgcccagaacugcagaaagagaaagcuggacaucauccugaaccuggaggacgacgugugcaaccugcaggccaagaaggagacccugaagagagagcaggcccagugcaacaaggccaucaacaucaugaagcagaagcugcacgaccuguaccacgacaucuucagcagacugagagacgaccagggcagacccgugaaccccaaccacuacgcccugcagugcacccacgacggcagcauccugaucgugcccaaggagcugguggccagcggccacaagaaggagacccagaagggcaagagaaaguaa

SEQ ID NO: 20496 - RNA, 1551 nt, Artificial Sequence
  NFIA__Homo_sapiens__XP_011539817
auguacagcccccugugccugacccaggacgaguuccaccccuucaucgaggcccugcugccccacgugagagccuucgccuacaccugguucaaccugcaggccagaaagagaaaguacuucaagaagcacgagaagagaaugagcaaggaggaggagagagccgugaaggacgagcugcugagcgagaagcccgaggugaagcagaagugggccagcagacugcuggccaagcugagaaaggacaucagacccgaguacagagaggacuucgugcugaccgugaccggcaagaagccccccugcugcgugcugagcaaccccgaccagaagggcaagaugagaagaaucgacugccugagacaggccgacaagguguggagacuggaccuggugauggugauccuguucaagggcaucccccuggagagcaccgacggcgagagacuggugaagagcccccagugcagcaaccccggccugugcgugcagccccaccacaucggcgugagcgugaaggagcuggaccuguaccuggccuacuucgugcacgccgccgacagcagccagagcgagagccccagccagcccagcgacgccgacaucaaggaccagcccgagaacggccaccugggcuuccaggacagcuucgugaccagcggcguguucagcgugaccgagcuggugagagugagccagacccccaucgccgccggcaccggccccaacuucagccugagcgaccuggagagcagcagcuacuacagcaugagccccggcgccaugagaagaagccugcccagcaccagcagcaccagcagcaccaagagacugaagagcguggaggacgagauggacagccccggcgaggagcccuucuacaccggccagggcagaagccccggcagcggcagccagagcagcggcuggcacgagguggagcccggcaugcccagccccaccacccugaagaagagcgagaagagcggcuucagcagccccagccccagccagaccagcagccugggcaccgccuucacccagcaccacagacccgugaucaccggccccagagaguucaagauggcccccagcauccugggcagccccuucuggaagguguacagcgccagcccccacgccacccccagcacccugcacuuccccaccagccccaucauccagcagcccggccccuacuucagccaccccgccaucagauaccacccccaggagacccugaaggaguucgugcagcuggugugccccgacgccggccagcaggccggccaggugggcuuccugaaccccaacggcagcagccagggcaaggugcacaaccccuuccugcccacccccaugcugcccccccccccccccccccccauggccagacccgugccccugcccgugcccgacaccaagccccccaccaccagcaccgagggcggcgccgccagccccaccagccccauccuggugcccggcaucaagguggccgccagccaccacccccccgacagaccccccgaccccuucagcacccuguaa

SEQ ID NO: 20497 - RNA, 1485 nt, Artificial Sequence
  NFIB__Homo_sapiens__NP_001177666
augauguacagccccaucugccugacccaggacgaguuccaccccuucaucgaggcccugcugccccacgugagagccaucgccuacaccugguucaaccugcaggccagaaagagaaaguacuucaagaagcacgagaagagaaugagcaaggacgaggagagagccgugaaggacgagcugcugagcgagaagcccgagaucaagcagaagugggccagcagacugcuggccaagcugagaaaggacaucagacaggaguacagagaggacuucgugcugaccgugaccggcaagaagcaccccugcugcgugcugagcaaccccgaccagaagggcaagaucagaagaaucgacugccugagacaggccgacaagguguggagacuggaccuggugauggugauccuguucaagggcaucccccuggagagcaccgacggcgagagacugaugaagagcccccacugcaccaaccccgcccugugcgugcagccccaccacaucaccgugagcgugaaggagcuggaccuguuccuggccuacuacgugcaggagcaggacagcggccagagcggcagccccagccacaacgaccccgccaagaacccccccggcuaccuggaggacagcuucgugaagagcggcguguucaacgugagcgagcuggugagagugagcagaacccccaucacccagggcaccggcgugaacuuccccaucggcgagauccccagccagcccuacuaccacgacaugaacagcggcgugaaccugcagagaagccugagcagcccccccagcagcaagagacccaagaccaucagcaucgacgagaacauggagcccagccccaccggcgacuucuaccccagccccagcagccccgccgccggcagcagaaccuggcacgagagagaccaggacaugagcagccccaccaccaugaagaagcccgagaagccccuguucagcagcgccagcccccaggacagcagccccagacugagcaccuucccccagcaccaccaccccggcauccccggcguggcccacagcgugaucagcaccagaaccccccccccccccagcccccugcccuuccccacccaggccauccugccccccgcccccagcagcuacuucagccaccccaccaucagauaccccccccaccugaacccccaggacacccugaagaacuacgugcccagcuacgaccccagcagcccccagaccagccagcccaacggcagcggccagguggugggcaaggugcccggccacuucacccccgugcuggcccccagcccccaccccagcgccgugagacccgugacccugagcaugaccgacaccaagcccaucaccaccagcaccgaggccuacaccgccagcggcaccagccaggccaacagauacgugggccugagccccagagaccccagcuuccugcaccagcagcagagcugguaccugggcuaa

SEQ ID NO: 20498 - RNA, 1527 nt, Artificial Sequence
  NFIC__Homo_sapiens__NP_001231931
auguacagcagcccccugugccugacccaggacgaguuccaccccuucaucgaggcccugcugccccacgugagagccuucgccuacaccugguucaaccugcaggccagaaagagaaaguacuucaagaagcacgagaagagaaugagcaaggacgaggagagagccgugaaggacgagcugcugggcgagaagcccgaggugaagcagaagugggccagcagacugcuggccaagcugagaaaggacaucagacccgagugcagagaggacuucgugcugagcaucaccggcaagaaggcccccggcugcgugcugagcaaccccgaccagaagggcaagaugagaagaaucgacugccugagacaggccgacaagguguggagacuggaccuggugauggugauccuguucaagggcaucccccuggagagcaccgacggcgagagacuggugaaggccgcccagugcggccaccccgugcugugcgugcagccccaccacaucggcguggccgugaaggagcuggaccuguaccuggccuacuucgugagagagagagacgccgagcagagcggcagccccagaaccggcaugggcagcgaccaggaggacagcaagcccaucacccuggacaccaccgacuuccaggagagcuucgugaccagcggcguguucagcgugaccgagcugauccaggugagcagaacccccguggugaccggcaccggccccaacuucagccugggcgagcugcagggccaccuggccuacgaccugaaccccgccagcaccggccugagaagaacccugcccagcaccagcagcagcggcagcaagagacacaagagcggcagcauggaggaggacguggacaccagccccggcggcgacuacuacaccagccccagcagccccaccagcagcagcagaaacuggaccgaggacauggagggcggcaucagcagccccgugaagaagaccgagauggacaagagccccuucaacagccccagcccccaggacagccccagacugagcagcuucacccagcaccacagacccgugaucgccgugcacagcggcaucgccagaagcccccaccccagcagcgcccugcacuuccccaccaccagcauccugccccagaccgccagcaccuacuucccccacaccgccaucagauaccccccccaccugaacccccaggacccccugaaggaccuggugagccuggccugcgaccccgccagccagcagcccggcccccugaacggcagcggccagcugaagaugcccagccacugccugagcgcccagaugcuggccccccccccccccggccugcccagacuggcccugccccccgccaccaagcccgccaccaccagcgagggcggcgccaccagccccaccagccccagcuacagcccccccgacaccagccccgccaacagaagcuucgugggccugggccccagagaccccgccggcaucuaccaggcccagagcugguaccugggcuaa

SEQ ID NO: 20499 - RNA, 1389 nt, Artificial Sequence
  NFIL3__Homo_sapiens__NP_001276929
augcagcugagaaagaugcagaccgugaagaaggagcaggccagccuggacgccagcagcaacguggacaagaugauggugcugaacagcgcccugaccgaggugagcgaggacagcaccaccggcgaggagcugcugcugagcgagggcagcgugggcaagaacaagagcagcgccugcagaagaaagagagaguucauccccgacgagaagaaggacgccauguacugggagaagagaagaaagaacaacgaggccgccaagagaagcagagagaagagaagacugaacgaccuggugcuggagaacaagcugaucgcccugggcgaggagaacgccacccugaaggccgagcugcugagccugaagcugaaguucggccugaucagcagcaccgccuacgcccaggagauccagaagcugagcaacagcaccgccguguacuuccaggacuaccagaccagcaagagcaacgugagcagcuucguggacgagcacgagcccagcauggugagcagcagcugcaucagcgugaucaagcacagcccccagagcagccugagcgacgugagcgaggugagcagcguggagcacacccaggagagcagcgugcagggcagcugcagaagccccgagaacaaguuccagaucaucaagcaggagcccauggagcuggagagcuacaccagagagcccagagacgacagaggcagcuacaccgccagcaucuaccagaacuacaugggcaacagcuucagcggcuacagccacagccccccccugcugcaggugaacagaagcagcagcaacagccccagaaccagcgagaccgacgacggcguggugggcaagagcagcgacggcgaggacgagcagcaggugcccaagggccccauccacagccccguggagcugaagcacgugcacgccaccguggugaaggugcccgaggugaacagcagcgcccugccccacaagcugagaaucaaggccaaggccaugcagaucaagguggaggccuucgacaacgaguucgaggccacccagaagcugagcagccccaucgacaugaccagcaagagacacuucgagcuggagaagcacagcgcccccagcauggugcacagcagccugacccccuucagcgugcaggugaccaacauccaggacuggagccugaagagcgagcacuggcaccagaaggagcugagcggcaagacccagaacagcuucaagaccggcgugguggagaugaaggacagcggcuacaaggugagcgaccccgagaaccuguaccugaagcagggcaucgccaaccugagcgccgagguggugagccugaagagacugaucgccacccagcccaucagcgccagcgacagcggcuaa

SEQ ID NO: 20500 - RNA, 1533 nt, Artificial Sequence
  NFIX__Homo_sapiens__NP_001257972
auggagaugagcugggccagacagagccuggccggcauccccgccgccugcgacgaguuccaccccuucaucgaggcccugcugccccacgugagagccuucagcuacaccugguucaaccugcaggccagaaagagaaaguacuucaagaagcacgagaagagaaugagcaaggacgaggagagagccgugaaggacgagcugcugggcgagaagcccgagaucaagcagaagugggccagcagacugcuggccaagcugagaaaggacaucagacccgaguucagagaggacuucgugcugaccaucaccggcaagaagccccccugcugcgugcugagcaaccccgaccagaagggcaagaucagaagaaucgacugccugagacaggccgacaagguguggagacuggaccuggugauggugauccuguucaagggcaucccccuggagagcaccgacggcgagagacuguacaagagcccccagugcagcaaccccggccugugcgugcagccccaccacaucggcgugaccaucaaggagcuggaccuguaccuggccuacuucgugcacacccccgagagcggccagagcgacagcagcaaccagcagggcgacgccgacaucaagccccugcccaacggccaccugagcuuccaggacugcuucgugaccagcggcguguggaacgugaccgagcuggugagagugagccagacccccguggccaccgccagcggccccaacuucagccuggccgaccuggagagccccagcuacuacaacaucaaccaggugacccugggcagaagaagcaucaccagcccccccagcaccagcaccaccaagagacccaagagcaucgacgacagcgagauggagagccccguggacgacguguucuaccccggcaccggcagaagccccgccgccggcagcagccagagcagcggcuggcccaacgacguggacgccggccccgccagccugaagaagagcggcaagcuggacuucugcagcgcccugagcagccagggcagcagccccagaauggccuucacccaccacccccugcccgugcuggccggcgugagacccggcagccccagagccaccgccagcgcccugcacuuccccagcaccagcaucauccagcagagcagccccuacuucacccaccccaccaucagauaccaccaccaccacggccaggacagccugaaggaguucgugcaguucgugugcagcgacggcagcggccaggccaccggccagcccaacggcagcggccagggcaaggugcccggcagcuuccugcugcccccccccccccccguggccagacccgugccccugcccaugcccgacagcaagagcaccagcaccgcccccgacggcgccgcccugaccccccccagccccagcuucgccaccaccggcgccagcagcgccaacagauucgugagcaucggccccagagacggcaacuuccugaacaucccccagcagagccagagcugguuccuguaa

SEQ ID NO: 20501 - RNA, 2907 nt, Artificial Sequence
  NFKB1__Homo_sapiens__NP_001158884
auggccgaggacgaccccuaccugggcagacccgagcagauguuccaccuggaccccagccugacccacaccaucuucaaccccgagguguuccagccccagauggcccugcccaccgacggccccuaccugcagauccuggagcagcccaagcagagaggcuucagauucagauacgugugcgagggccccagccacggcggccugcccggcgccagcagcgagaagaacaagaagagcuacccccaggugaagaucugcaacuacgugggccccgccaaggugaucgugcagcuggugaccaacggcaagaacauccaccugcacgcccacagccuggugggcaagcacugcgaggacggcaucugcaccgugaccgccggccccaaggacaugguggugggcuucgccaaccugggcauccugcacgugaccaagaagaagguguucgagacccuggaggccagaaugaccgaggccugcaucagaggcuacaaccccggccugcuggugcaccccgaccuggccuaccugcaggccgagggcggcggcgacagacagcugggcgacagagagaaggagcugaucagacaggccgcccugcagcagaccaaggagauggaccugagcguggugagacugauguucaccgccuuccugcccgacagcaccggcagcuucaccagaagacuggagcccguggugagcgacgccaucuacgacagcaaggcccccaacgccagcaaccugaagaucgugagaauggacagaaccgccggcugcgugaccggcggcgaggagaucuaccugcugugcgacaaggugcagaaggacgacauccagaucagauucuacgaggaggaggagaacggcggcgugugggagggcuucggcgacuucagccccaccgacgugcacagacaguucgccaucguguucaagacccccaaguacaaggacaucaacaucaccaagcccgccagcguguucgugcagcugagaagaaagagcgaccuggagaccagcgagcccaagcccuuccuguacuaccccgagaucaaggacaaggaggaggugcagagaaagagacagaagcugaugcccaacuucagcgacagcuucggcggcggcagcggcgccggcgccggcggcggcggcauguucggcagcggcggcggcggcggcggcaccggcagcaccggccccggcuacagcuucccccacuacggcuuccccaccuacggcggcaucaccuuccaccccggcaccaccaagagcaacgccggcaugaagcacggcaccauggacaccgagagcaagaaggaccccgagggcugcgacaagagcgacgacaagaacaccgugaaccuguucggcaaggugaucgagaccaccgagcaggaccaggagcccagcgaggccaccgugggcaacggcgaggugacccugaccuacgccaccggcaccaaggaggagagcgccggcgugcaggacaaccuguuccuggagaaggccaugcagcuggccaagagacacgccaacgcccuguucgacuacgccgugaccggcgacgugaagaugcugcuggccgugcagagacaccugaccgccgugcaggacgagaacggcgacagcgugcugcaccuggccaucauccaccugcacagccagcuggugagagaccugcuggaggugaccagcggccugaucagcgacgacaucaucaacaugagaaacgaccuguaccagaccccccugcaccuggccgugaucaccaagcaggaggacgugguggaggaccugcugagagccggcgccgaccugagccugcuggacagacugggcaacagcgugcugcaccuggccgccaaggagggccacgacaaggugcugagcauccugcugaagcacaagaaggccgcccugcugcuggaccaccccaacggcgacggccugaacgccauccaccuggccaugaugagcaacagccugcccugccugcugcugcugguggccgccggcgccgacgugaacgcccaggagcagaagagcggcagaaccgcccugcaccuggccguggagcacgacaacaucagccuggccggcugccugcugcuggagggcgacgcccacguggacagcaccaccuacgacggcaccaccccccugcacaucgccgccggcagaggcagcaccagacuggccgcccugcugaaggccgccggcgccgacccccugguggagaacuucgagccccuguacgaccuggacgacagcugggagaacgccggcgaggacgagggcguggugcccggcaccaccccccuggacauggccaccagcuggcagguguucgacauccugaacggcaagcccuacgagcccgaguucaccagcgacgaccugcuggcccagggcgacaugaagcagcuggccgaggacgugaagcugcagcuguacaagcugcuggagauccccgaccccgacaagaacugggccacccuggcccagaagcugggccugggcauccugaacaacgccuucagacugagccccgcccccagcaagacccugauggacaacuacgaggugagcggcggcaccgugagagagcugguggaggcccugagacagaugggcuacaccgaggccaucgaggugauccaggccgccagcagccccgugaagaccaccagccaggcccacagccugccccugagccccgccagcaccagacagcagaucgacgagcugagagacagcgacagcgugugcgacagcggcguggagaccagcuucagaaagcugagcuucaccgagagccugaccagcggcgccagccugcugacccugaacaagaugccccacgacuacggccaggagggcccccuggagggcaagaucuaa

SEQ ID NO: 20502 - RNA, 2700 nt, Artificial Sequence
  NFKB2__Homo_sapiens__NP_002493
auggagagcugcuacaaccccggccuggacggcaucaucgaguacgacgacuucaagcugaacagcagcaucguggagcccaaggagcccgcccccgagaccgccgacggccccuaccuggugaucguggagcagcccaagcagagaggcuucagauucagauacggcugcgagggccccagccacggcggccugcccggcgccagcagcgagaagggcagaaagaccuaccccaccgugaagaucugcaacuacgagggccccgccaagaucgagguggaccuggugacccacagcgacccccccagagcccacgcccacagccuggugggcaagcagugcagcgagcugggcaucugcgccgugagcgugggccccaaggacaugaccgcccaguucaacaaccugggcgugcugcacgugaccaagaagaacaugaugggcaccaugauccagaagcugcagagacagagacugagaagcagaccccagggccugaccgaggccgagcagagagagcuggagcaggaggccaaggagcugaagaaggugauggaccugagcaucgugagacugagauucagcgccuuccugagagccagcgacggcagcuucagccugccccugaagcccgugaucagccagcccauccacgacagcaagagccccggcgccagcaaccugaagaucagcagaauggacaagaccgccggcagcgugagaggcggcgacgagguguaccugcugugcgacaaggugcagaaggacgacaucgaggugagauucuacgaggacgacgagaacggcuggcaggccuucggcgacuucagccccaccgacgugcacaagcaguacgccaucguguucagaaccccccccuaccacaagaugaagaucgagagacccgugaccguguuccugcagcugaagagaaagagaggcggcgacgugagcgacagcaagcaguucaccuacuacccccugguggaggacaaggaggaggugcagagaaagagaagaaaggcccugcccaccuucagccagcccuucggcggcggcagccacaugggcggcggcagcggcggcgccgccggcggcuacggcggcgccggcggcggcggcagccugggcuucuuccccagcagccuggccuacagccccuaccagagcggcgccggccccaugggcugcuaccccggcggcggcggcggcgcccagauggccgccaccgugcccagcagagacagcggcgaggaggccgccgagcccagcgcccccagcagaaccccccagugcgagccccaggcccccgagaugcugcagagagccagagaguacaacgccagacuguucggccuggcccagagaagcgccagagcccugcuggacuacggcgugaccgccgacgccagagcccugcuggccggccagagacaccugcugaccgcccaggacgagaacggcgacaccccccugcaccuggccaucauccacggccagaccagcgugaucgagcagaucguguacgugauccaccacgcccaggaccugggcguggugaaccugaccaaccaccugcaccagaccccccugcaccuggccgugaucaccggccagaccagcguggugagcuuccugcugagagugggcgccgaccccgcccugcuggacagacacggcgacagcgccaugcaccuggcccugagagccggcgccggcgcccccgagcugcugagagcccugcugcagagcggcgcccccgccgugccccagcugcugcacaugcccgacuucgagggccuguaccccgugcaccuggccgugagagccagaagccccgagugccuggaccugcugguggacagcggcgccgagguggaggccaccgagagacagggcggcagaaccgcccugcaccuggccaccgagauggaggagcugggccuggugacccaccuggugaccaagcugagagccaacgugaacgccagaaccuucgccggcaacaccccccugcaccuggccgccggccugggcuaccccacccugaccagacugcugcugaaggccggcgccgacauccacgccgagaacgaggagccccugugcccccugcccagcccccccaccagcgacagcgacagcgacagcgagggccccgagaaggacaccagaagcagcuucagaggccacaccccccuggaccugaccugcagcaccaaggugaagacccugcugcugaacgccgcccagaacaccauggagcccccccugaccccccccagccccgccggccccggccugagccugggcgacaccgcccugcagaaccuggagcagcugcuggacggccccgaggcccagggcagcugggccgagcuggccgagagacugggccugagaagccugguggacaccuacagacagaccaccagccccagcggcagccugcugagaagcuacgagcuggccggcggcgaccuggccggccugcuggaggcccugagcgacaugggccuggaggagggcgugagacugcugagaggccccgagaccagagacaagcugcccagcaccgaggugaaggaggacagcgccuacggcagccagagcguggagcaggaggccgagaagcugggccccccccccgagccccccggcggccugugccacggccacccccagccccaggugcacuaa

SEQ ID NO: 20503 - RNA, 954 nt, Artificial Sequence
  NFKBIA__Homo_sapiens__NP_065390
auguuccaggccgccgagagaccccaggagugggccauggagggccccagagacggccugaagaaggagagacugcuggacgacagacacgacagcggccuggacagcaugaaggacgaggaguacgagcagauggugaaggagcugcaggagaucagacuggagccccaggaggugcccagaggcagcgagcccuggaagcagcagcugaccgaggacggcgacagcuuccugcaccuggccaucauccacgaggagaaggcccugaccauggaggugaucagacaggugaagggcgaccuggccuuccugaacuuccagaacaaccugcagcagaccccccugcaccuggccgugaucaccaaccagcccgagaucgccgaggcccugcugggcgccggcugcgaccccgagcugagagacuucagaggcaacaccccccugcaccuggccugcgagcagggcugccuggccagcgugggcgugcugacccagagcugcaccaccccccaccugcacagcauccugaaggccaccaacuacaacggccacaccugccugcaccuggccagcauccacggcuaccugggcaucguggagcugcuggugagccugggcgccgacgugaacgcccaggagcccugcaacggcagaaccgcccugcaccuggccguggaccugcagaaccccgaccuggugagccugcugcugaagugcggcgccgacgugaacagagugaccuaccagggcuacagccccuaccagcugaccuggggcagacccagcaccagaauccagcagcagcugggccagcugacccuggagaaccugcagaugcugcccgagagcgaggacgaggagagcuacgacaccgagagcgaguucaccgaguucaccgaggacgagcugcccuacgacgacugcguguucggcggccagagacugacccuguaa

SEQ ID NO: 20504 - RNA, 1071 nt, Artificial Sequence
  NFKBIB__Homo_sapiens__NP_002494
auggccggcguggccugccugggcaaggccgccgacgccgacgaguggugcgacagcggccugggcagccugggccccgacgccgccgcccccggcggccccggccugggcgccgagcugggccccggccugagcugggccccccugguguucggcuacgugaccgaggacggcgacaccgcccugcaccuggccgugauccaccagcacgagcccuuccuggacuuccugcugggcuucagcgccggcaccgaguacauggaccugcagaacgaccugggccagaccgcccugcaccuggccgccauccugggcgagaccagcaccguggagaagcuguacgccgccggcgccggccugugcguggccgagagaagaggccacaccgcccugcaccuggccugcagagugggcgcccacgccugcgccagagcccugcugcagcccagacccagaagacccagagaggcccccgacaccuaccuggcccagggccccgacagaacccccgacaccaaccacacccccguggcccuguaccccgacagcgaccuggagaaggaggaggaggagagcgaggaggacuggaagcugcagcuggaggccgagaacuacgagggccacaccccccugcacguggccgugauccacaaggacguggagauggugagacugcugagagacgccggcgccgaccuggacaagcccgagcccaccugcggcagaagcccccugcaccuggccguggaggcccaggccgccgacgugcuggagcugcugcugagagccggcgccaaccccgccgccagaauguacggcggcagaaccccccugggcagcgccaugcugagacccaaccccauccuggccagacugcugagagcccacggcgcccccgagcccgagggcgaggacgagaagagcggccccugcagcagcagcagcgacagcgacagcggcgacgagggcgacgaguacgacgacaucguggugcacagcagcagaagccagaccagacugccccccacccccgccagcaagccccugcccgacgaccccagacccguguaa

SEQ ID NO: 20505 - RNA, 1503 nt, Artificial Sequence
  NFKBIE__Homo_sapiens__NP_004547
augaaccagagaagaagcgagagcagacccggcaaccacagacugcaggccuacgccgagcccggcaagggcgacagcggcggcgccggcccccugagcggcagcgccagaagaggcagaggcggcggcggcgccaucagagugagaagacccugcuggagcggcggcgccggcagaggcggcggccccgccugggccgugagacugcccaccgugaccgccggcuggaccuggcccgcccugagaacccugagcagccugagagccggccccagcgagccccacagccccggcagaagaccccccagagccggcagaccccugugccaggccgacccccagcccggcaaggccgccagaagaagccuggagcccgaccccgcccagaccggccccagacccgccagagccgccggcaugagcgaggccagaaagggccccgacgaggccgaggagagccaguacgacagcggcaucgagagccugagaagccugagaagccugcccgagagcaccagcgcccccgccagcggccccagcgacggcagcccccagcccugcacccacccccccggccccgugaaggagccccaggagaaggaggacgccgacggcgagagagccgacagcaccuacggcagcagcagccugaccuacacccugagccugcugggcggccccgaggccgaggaccccgcccccagacugccccugccccacgugggcgcccugagcccccagcagcuggaggcccugaccuacaucagcgaggacggcgacacccuggugcaccuggccgugauccacgaggcccccgccgugcugcugugcugccuggcccugcugccccaggaggugcuggacauccagaacaaccuguaccagaccgcccugcaccuggccgugcaccuggaccagcccggcgccgugagagcccuggugcugaagggcgccagcagagcccugcaggacagacacggcgacaccgcccugcacguggccugccagagacagcaccuggccugcgccagaugccugcuggagggcagacccgagcccggcagaggcaccagccacagccuggaccugcagcugcagaacuggcagggccuggccugccugcacaucgccacccugcagaagaaccagccccugauggagcugcugcugagaaacggcgccgacaucgacgugcaggagggcaccagcggcaagaccgcccugcaccuggccguggagacccaggagagaggccuggugcaguuccugcugcaggccggcgcccagguggacgccagaaugcugaacggcugcaccccccugcaccuggccgccggcagaggccugaugggcaucagcagcacccugugcaaggccggcgccgacagccugcugagaaacguggaggacgagaccccccaggaccugaccgaggagagccuggugcugcugcccuucgacgaccugaagaucagcggcaagcugcugcugugcaccgacuaa

SEQ ID NO: 20506 - RNA, 1101 nt, Artificial Sequence
  NFKBIL1__Homo_sapiens__NP_001138433
augagcaaccccagcccccaggugcccgaggaggaggccagcaccagcgugugcagacccaagagcagcauggccagcaccagcagaagacagagaagagagagaagauucagaagauaccugagcgccggcagacuggugagagcccaggcccugcugcagagacaccccggccuggacguggacgccggccagccccccccccugcacagagccugcgccagacacgacgcccccgcccugugccugcugcugagacugggcgccgaccccgcccaccaggacagacacggcgacaccgcccugcacgccgccgccagacagggccccgacgccuacaccgacuucuuccugccccugcugagcagaugccccagcgccaugggcaucaagaacaaggacggcgagacccccggccagauccugggcuggggcccccccugggacagcgccgaggaggaggaggaggacgacgccagcaaggagagagaguggagacagaagcugcagggcgacgccagccacgagacccaggagcccgagagcuucagcgccuggagcgacagacuggccagagagcacgcccagaagugccagcagcagcagagagaggccgagggcagcagaagaccccccagagccgagggcagcagccagagcuggagacagcaggaggaggagcagagacuguucagagagagagccagagccaaggaggaggagcugagagagagcagagccagaagagcccaggaggcccugggcgacagagagcccaagcccaccagagccggccccagagaggagcaccccagaggcgccggcagaggcagccuguggagauucggcgacgugcccuggcccugccccggcggcggcgaccccgaggccauggccgccgcccugguggccagaggccccccccuggaggagcagggcgcccugagaagauaccugagagugcagcaggugagauggcaccccgacagauuccugcagagauucagaagccagaucgagaccugggagcugggcagagugaugggcgccgugaccgcccugagccaggcccugaacagacacgccgaggcccugaaguaa

SEQ ID NO: 20507 - RNA, 1857 nt, Artificial Sequence
  NFKBIZ__Homo_sapiens__NP_001005474
augggcgugggcagacagcagagaggccccuuccagggcgugagagugaagaacagcgugaaggagcugcugcugcacaucagaagccacaagcagaaggccagcggccaggccguggacgacuucaagacccagggcgugaacaucgagcaguucagagagcugaagaacaccgugagcuacagcggcaagagaaagggccccgacagccugagcgacggccccgccugcaagagacccgcccugcugcacagccaguuccugacccccccccagacccccacccccggcgagagcauggaggacgugcaccugaacgagcccaagcaggagagcagcgccgaccugcugcagaacaucaucaacaucaagaacgagugcagccccgugagccugaacaccgugcaggugagcuggcugaaccccgugguggugccccagagcagccccgccgagcagugccaggacuuccacggcggccagguguucagccccccccagaagugccagcccuuccaggugagaggcagccagcagaugaucgaccaggccagccuguaccaguacagcccccagaaccagcacguggagcagcagccccacuacacccacaagcccacccuggaguacagccccuuccccauccccccccagagccccgccuacgagcccaaccuguucgacggccccgagagccaguucugccccaaccagagccuggugagccugcugggcgaccagagagagagcgagaacaucgccaaccccaugcagaccagcagcagcgugcagcagcagaacgacgcccaccugcacagcuucagcaugaugcccagcagcgccugcgaggccauggugggccacgagauggccagcgacagcagcaacaccagccugcccuucagcaacaugggcaaccccaugaacaccacccagcugggcaagagccuguuccaguggcagguggagcaggaggagagcaagcuggccaacaucagccaggaccaguuccugagcaaggacgccgacggcgacaccuuccugcacaucgccguggcccagggcagaagagcccugagcuacgugcuggccagaaagaugaacgcccugcacaugcuggacaucaaggagcacaacggccagagcgccuuccagguggccguggccgccaaccagcaccugaucgugcaggaccuggugaacaucggcgcccaggugaacaccaccgacugcuggggcagaaccccccugcacgugugcgccgagaagggccacagccaggugcugcaggccauccagaagggcgccgugggcagcaaccaguucguggaccuggaggccaccaacuacgacggccugaccccccugcacugcgccgugaucgcccacaacgccguggugcacgagcugcagagaaaccagcagccccacagccccgaggugcaggagcugcugcugaagaacaagagccugguggacaccaucaagugccugauccagaugggcgccgccguggaggccaaggacagaaagagcggcagaaccgcccugcaccuggccgccgaggaggccaaccuggagcugaucagacuguuccuggagcugcccagcugccugagcuucgugaacgccaaggccuacaacggcaacaccgcccugcacguggccgccagccugcaguacagacugacccagcuggacgccgugagacugcugaugagaaagggcgccgaccccagcaccagaaaccuggagaacgagcagcccgugcaccuggugcccgacggccccgugggcgagcagaucagaagaauccugaagggcaagagcauccagcagagagccccccccuacuaa

SEQ ID NO: 20508 - RNA, 3900 nt, Artificial Sequence
  NFRKB__Homo_sapiens__NP_001137307
auggacagccuggaccacaugcugaccgacccccuggagcugggccccugcggcgacggccacggcaccagaaucauggaggacugccugcugggcggcaccagagugagccugcccgaggaccugcuggaggaccccgagaucuucuucgacguggugagccugagcaccuggcaggaggugcugagcgacagccagagagagcaccugcagcaguuccugccccaguuccccgaggacagcgccgagcagcagaacgagcugauccuggcccuguucagcggcgagaacuucagauucggcaacccccugcacaucgcccagaagcuguucagagacggccacuucaaccccgagguggugaaguacagacagcugugcuucaagagccaguacaagagauaccugaacagccagcagcaguacuuccacagacugcugaagcagauccuggccagcagaagcgaccugcuggagauggccagaagaagcggccccgcccugcccuucagacagaagagacccagccccagcagaacccccgaggagagagaguggagaacccagcagagauaccugaaggugcugagagaggugaaggaggagugcggcgacaccgcccugagcagcgacgaggaggaccugagcagcuggcugcccagcagccccgccagaagccccagccccgccgugccccugagaguggugcccacccugagcaccaccgacaugaagaccgccgacaagguggagcugggcgacagcgaccugaagaucaugcugaagaagcaccacgagaagagaaagcaccagcccgaccaccccgaccugcugaccggcgaccugacccugaacgacaucaugaccagagugaacgccggcagaaagggcagccuggccgcccuguacgaccuggccgugcugaagaagaaggugaaggagaaggaggagaagaagaagaagaagaucaagaccaucaagagcgaggccgaggaccuggccgagccccugagcagcaccgagggcguggccccccugagccaggcccccagcccccuggccauccccgccaucaaggaggagccccuggaggaccugaagcccugccugggcaucaacgagaucagcagcagcuucuucagccugcugcuggagauccugcugcuggagagccaggccagccugcccaugcuggaggagagagugcuggacuggcagagcagccccgccagcagccugaacagcugguucagcgccgcccccaacugggccgagcuggugcugcccgcccugcaguaccuggccggcgagagcagagccgugcccagcagcuucagccccuucguggaguucaaggagaagacccagcaguggaagcugcugggccagagccaggacaacgagaaggagcuggccgcccuguuccagcuguggcuggagaccaaggaccaggccuucugcaagcaggagaacgaggacagcagcgacgccaccacccccgugcccagagugagaaccgacuacguggugagacccagcaccggcgaggagaagagaguguuccaggagcaggagagauacagauacagccagccccacaaggccuucaccuucagaaugcacggcuucgagagcguggugggccccgugaagggcguguucgacaaggagaccagccugaacaaggccagagagcacagccugcugagaagcgacagacccgccuacgugaccauccugagccuggugagagacgccgccgccagacugcccaacggcgagggcaccagagccgagaucugcgagcugcugaaggacagccaguuccuggcccccgacgugaccagcacccaggugaacaccguggugagcggcgcccuggacagacugcacuacgagaaggaccccugcgugaaguacgacaucggcagaaagcuguggaucuaccugcacagagacagaagcgaggaggaguucgagagaauccaccaggcccaggccgccgccgccaaggccagaaaggcccugcagcagaagcccaagccccccagcaaggugaagagcagcagcaaggagagcagcaucaaggugcugagcagcggccccagcgagcagagccagaugagccugagcgacagcagcaugccccccacccccgugacccccgugacccccaccacccccgcccugcccgccauccccaucagccccccccccgugagcgccgugaacaagagcggccccagcaccgugagcgagcccgccaagagcagcagcggcgugcugcuggugagcagccccaccaugccccaccugggcaccaugcugagccccgccagcagccagaccgcccccagcagccaggccgccgccagaguggugagccacagcggcagcgccggccugagccaggugagagugguggcccagcccagccugcccgccgugccccagcagagcggcggccccgcccagacccugccccagaugcccgccggcccccagaucagagugcccgccaccgccacccagaccaagguggugccccagaccgugauggccaccgugcccgugaaggcccagaccaccgccgccaccgugcagagacccggccccggccagaccggccugaccgugaccagccugcccgccaccgccagccccgugagcaagcccgccaccagcagccccggcaccagcgcccccagcgccagcaccgccgccgugauccagaacgugaccggccagaacaucaucaagcagguggccaucaccggccagcugggcgugaagccccagaccggcaacagcaucccccugaccgccaccaacuucagaauccagggcaaggacgugcugagacugccccccagcagcaucaccaccgacgccaagggccagaccgugcugagaaucacccccgacaugauggccacccuggccaagagccaggugaccaccgugaagcugacccaggaccuguucggcaccggcggcaacaccaccggcaagggcaucagcgccacccugcacgugaccagcaaccccgugcacgccgccgacagccccgccaaggccagcagcgccagcgcccccagcagcacccccaccggcaccaccguggugaaggugacccccgaccugaagcccaccgaggccagcagcagcgccuucagacugaugcccgcccugggcgugagcguggccgaccagaagggcaagagcaccguggccagcagcgaggccaagcccgccgccaccaucagaaucgugcagggccugggcgugaugccccccaaggccggccagaccaucaccguggccacccacgccaagcagggcgccagcguggccagcggcagcggcaccgugcacaccagcgccgugagccugcccagcaugaacgccgccgugagcaagaccguggccguggccagcggcgccgccagcacccccaucagcaucagcaccggcgcccccaccgugagacaggugcccgugagcaccaccguggugagcaccagccaggccggcaagcugcccaccagaaucaccgugccccugagcgugaucagccagcccaugaagggcaagagcguggugaccgcccccaucaucaagggcaaccugggcgccaaccugagcggccugggcagaaacaucauccugaccaccaugcccgccggcaccaagcugaucgccggcaacaagcccgugagcuuccugaccgcccagcagcugcagcagcugcagcagcagggccaggccacccaggugagaauccagaccgugcccgccagccaccugcagcagggcaccgccagcggcagcagcaaggccgugagcaccgugguggugaccaccgcccccagccccaagcaggcccccgagcagcaguaa

SEQ ID NO: 20509 - RNA, 1221 nt, Artificial Sequence
  NFS1__Homo_sapiens__NP_001185918
augcugcugagagccgccuggagaagagccgccguggccgugaccgccgcccccggccccaagcccgccgcccccaccagaggccugagacugagagugggcgacagagccccccagagcgccgugcccgccgacaccgccgccgcccccgaggugggccccgugcugagaccccuguacauggacgugcaggccaccaccccccuggaccccagagugcuggacgccaugcugcccuaccugaucaacuacuacggcaacccccacagcagaacccacgccuacggcugggagagcgaggccgccauggagagagccagacagcagguggccagccugaucggcgccgaccccagagagaucaucuucaccagcggcgccaccgagagcaacaacaucgccaucaaggagcuggaggccgccauccagcccgacaccagccuggugagcgugaugaccgugaacaacgagaucggcgugaagcagcccaucgccgagaucggcagaaucugcagcagcagaaagguguacuuccacaccgacgccgcccaggccgugggcaagaucccccuggacgugaacgacaugaagaucgaccugaugagcaucagcggccacaagaucuacggccccaagggcgugggcgccaucuacaucagaagaagacccagagugagaguggaggcccugcagagcggcggcggccaggagagaggcaugagaagcggcaccgugcccaccccccugguggugggccugggcgccgccugcgagguggcccagcaggagauggaguacgaccacaagagaaucagcaagcugagcgagagacugauccagaacaucaugaagagccugcccgacguggugaugaacggcgaccccaagcaccacuaccccggcugcaucaaccugagcuucgccuacguggagggcgagagccugcugauggcccugaaggacguggcccugagcagcggcagcgccugcaccagcgccagccuggagcccagcuacgugcugagagccaucggcaccgacgaggaccuggcccacagcagcaucagauucggcaucggcagauucaccaccgaggaggagguggacuacaccguggagaagugcauccagcacgugaagagacugagagagaugagcccccugugggagauggugcaggacggcaucgaccugaagagcaucaaguggacccagcacuaa

SEQ ID NO: 20510 - RNA, 765 nt, Artificial Sequence
  NFU1__Homo_sapiens__NP_001002755
auggccgccaccgccagaagaggcuggggcgccgccgccguggccgccggccugagaagaagauucugccacaugcugaagaaccccuacaccaucaagaagcagccccugcaccaguucgugcagagaccccuguucccccugcccgccgccuucuaccaccccgugagauacauguucauccagacccaggacacccccaaccccaacagccugaaguucauccccggcaagcccgugcuggagaccagaaccauggacuuccccacccccgccgccgccuucagaagcccccuggccagacagcuguucagaaucgagggcgugaagagcguguucuucggccccgacuucaucaccgugaccaaggagaacgaggagcuggacuggaaccugcugaagcccgacaucuacgccaccaucauggacuucuucgccagcggccugccccuggugaccgaggagacccccagcggcgaggccggcagcgaggaggacgacgaggugguggccaugaucaaggagcugcuggacaccagaaucagacccaccgugcaggaggacggcggcgacgugaucuacaagggcuucgaggacggcaucgugcagcugaagcugcagggcagcugcaccagcugccccagcagcaucaucacccugaagaacggcauccagaacaugcugcaguucuacauccccgagguggagggcguggagcaggugauggacgacgagagcgacgagaaggaggccaacagccccuaa

SEQ ID NO: 20511 - RNA, 1044 nt, Artificial Sequence
  NFYA__Homo_sapiens__NP_002496
auggagcaguacaccgccaacagcaacagcagcaccgagcagaucguggugcaggccggccagauccagcagcagcagcagggcggcgugaccgccgugcagcugcagaccgaggcccagguggccagcgccagcggccagcaggugcagacccugcagguggugcagggccagccccugauggugcaggugagcggcggccagcugaucaccagcaccggccagcccaucauggugcaggccgugcccggcggccagggccagaccaucaugcaggugcccgugagcggcacccagggccugcagcagauccagcuggugccccccggccagauccagauccagggcggccaggccgugcaggugcagggccagcagggccagacccagcagaucaucauccagcagccccagaccgccgugaccgccggccagacccagacccagcagcagaucgccgugcagggccagcagguggcccagaccgccgagggccagaccaucguguaccagcccgugaacgccgacggcaccauccugcagcaggugaccgugcccgugagcggcaugaucaccauccccgccgccagccuggccggcgcccagaucgugcagaccggcgccaacaccaacaccaccagcagcggccagggcaccgugaccgugacccugcccguggccggcaacguggugaacagcggcggcauggugaugauggugcccggcgccggcagcgugcccgccauccagagaaucccccugcccggcgccgagaugcuggaggaggagccccuguacgugaacgccaagcaguaccacagaauccugaagagaagacaggccagagccaagcuggaggccgagggcaagauccccaaggagagaagaaaguaccugcacgagagcagacacagacacgccauggccagaaagagaggcgagggcggcagauucuucagccccaaggagaaggacagcccccacaugcaggaccccaaccaggccgacgaggaggccaugacccagaucaucagagugagcuaa

SEQ ID NO: 20512 - RNA, 624 nt, Artificial Sequence
  NFYB__Homo_sapiens__NP_006157
augaccauggacggcgacagcagcaccaccgacgccagccagcugggcaucagcgccgacuacaucggcggcagccacuacgugauccagccccacgacgacaccgaggacagcaugaacgaccacgaggacaccaacggcagcaaggagagcuucagagagcaggacaucuaccugcccaucgccaacguggccagaaucaugaagaacgccaucccccagaccggcaagaucgccaaggacgccaaggagugcgugcaggagugcgugagcgaguucaucagcuucaucaccagcgaggccagcgagagaugccaccaggagaagagaaagaccaucaacggcgaggacauccuguucgccaugagcacccugggcuucgacagcuacguggagccccugaagcuguaccugcagaaguucagagaggccaugaagggcgagaagggcaucggcggcgccgugaccgccaccgacggccugagcgaggagcugaccgaggaggccuucaccaaccagcugcccgccggccugaucaccaccgacggccagcagcagaacgugaugguguacaccaccagcuaccagcagaucagcggcgugcagcagauccaguucagcuaa

SEQ ID NO: 20513 - RNA, 1284 nt, Artificial Sequence
  NFYC__Homo_sapiens__XP_011539819
augagcaccgagggcggcuucggcggcaccagcagcagcgacgcccagcagagccugcagagcuucuggcccagagugauggaggagaucagaaaccugaccgugaaggacuucagagugcaggagcugccccuggccagaaucaagaagaucaugaagcuggacgaggacgugaagaugaucagcgccgaggcccccgugcuguucgccaaggccgcccagaucuucaucaccgagcugacccugagagccuggauccacaccgaggacaacaagagaagaacccugcagagaaacgacaucgccauggccaucaccaaguucgaccaguucgacuuccugaucgacaucgugcccagagacgagcugaagccccccaagagacaggaggaggugagacagagcgugacccccgccgagcccgugcaguacuacuucacccuggcccagcagcccaccgccgugcaggugcagggccagcagcagggccagcagaccaccagcagcaccaccaccauccagcccggccagaucaucaucgcccagccccagcagggccagaccacccccgugaccaugcaggugggcgagggccagcaggugcagaucgugcaggcccagccccagggccaggcccagcaggcccagagcggcaccggccagaccaugcaggugaugcagcagaucaucaccaacaccggcgagauccagcagauccccgugcagcugaacgccggccagcugcaguacaucagacuggcccagcccgugagcggcacccagguggugcagggccagauccagacccuggccaccaacgcccagcagggccagagaaacgccagccagggcaagcccagaagaugccugaaggagacccugcagaucacccagaccgaggugcagcagggccagcagcaguucagccaguucaccgacggccagagaaacagcgugcagcaggccagagugagcgagcugaccggcgaggccgagcccagagaggugaaggccaccggcaacagcacccccugcaccagcagccugcccaccacccacccccccagccacagagccggcgccagcugcgugugcugcagccagccccagcagagcagcaccagccccccccccagcgacgcccugcaguggguggugguggagcagcuguaccagauccagcaggugaccaugcccgccggccaggaccuggcccagcccauguucauccagagcgccaaccagcccagcgacggccaggccccccaggugaccggcgacuaa

SEQ ID NO: 20514 - RNA, 456 nt, Artificial Sequence
  NGB__Homo_sapiens__NP_067080
auggagagacccgagcccgagcugaucagacagagcuggagagccgugagcagaagcccccuggagcacggcaccgugcuguucgccagacuguucgcccuggagcccgaccugcugccccuguuccaguacaacugcagacaguucagcagccccgaggacugccugagcagccccgaguuccuggaccacaucagaaaggugaugcuggugaucgacgccgccgugaccaacguggaggaccugagcagccuggaggaguaccuggccagccugggcagaaagcacagagccgugggcgugaagcugagcagcuucagcaccgugggcgagagccugcuguacaugcuggagaagugccugggccccgccuucacccccgccaccagagccgccuggagccagcuguacggcgccguggugcaggccaugagcagaggcugggacggcgaguaa

SEQ ID NO: 20515 - RNA, 948 nt, Artificial Sequence
  NGDN__Homo_sapiens__NP_001036100
auggccgcccugggcgugcuggagagcgaccugcccagcgccgugacccugcugaagaaccugcaggagcaggugauggccgugaccgcccaggugaagagccugacccagaaggugcaggccggcgccuaccccaccgagaagggccugagcuuccuggaggugaaggaccagcugcugcugauguaccugauggaccugacccaccugauccuggacaaggccagcggcggcagccugcagggccacgacgccgugcugagacugguggagaucagaaccgugcuggagaagcugagaccccuggaccagaagcugaaguaccagaucgacaagcugaucaagaccgccgugaccggcagccugagcgagaacgacccccugagauucaagccccaccccagcaacaugaugagcaagcugagcagcgaggacgaggaggaggacgaggccgaggacgaccagagcgaggccagcggcaagaagagcgugaagggcgugagcaagaaguacgugccccccagacuggugcccgugcacuacgacgagaccgaggccgagagagagaagaagagacuggagagagccaagagaagagcccugagcagcagcgugaucagagagcugaaggagcaguacagcgacgcccccgaggagaucagagacgccagacacccccacgugaccagacagagccaggaggaccagcacagaaucaacuacgaggagagcaugauggugagacugagcgugagcaagagagagaagggcagaagaaagagagccaacgugaugagcagccagcugcacagccugacccacuucagcgacaucagcgcccugaccggcggcaccgugcaccuggacgaggaccagaaccccaucaagaagagaaagaagaucccccagaagggcagaaagaagaagggcuucagaagaagaagauaa

SEQ ID NO: 20516 - RNA, 1857 nt, Artificial Sequence
  NGEF__Homo_sapiens__NP_001107562
auggagcugcuggccgccgccuucagcgccgccugcgccguggaccacgacagcagcaccagcgagagcgacgccagagacagcgccgccggccaccugcccggcagcgagagcagcagcacccccggcaacggcgccacccccgaggaguggcccgcccuggccgacagccccaccacccugaccgaggcccugagaaugauccaccccauccccgccgacagcuggagaaaccugaucgagcagaucggccugcuguaccaggaguacagagacaagagcacccugcaggagaucgagaccagaagacagcaggacgccgagaucgaggacaacaccaacggcagccccgccagcgaggacacccccgaggaggaggaggaggaggaggaggaggaggagcccgccagcccccccgagagaaagacccugccccagaucugccugcugagcaacccccacagcagauucaaccuguggcaggaccugcccgagaucagaagcagcggcgugcuggagauccugcagcccgaggagaucaagcugcaggaggccauguucgagcuggugaccagcgaggccagcuacuacaagagccugaaccugcuggugagccacuucauggagaacgagagaaucagaaagauccugcaccccagcgaggcccacauccuguucagcaacgugcuggacgugcuggccgugagcgagagauuccugcuggagcuggagcacagaauggaggagaacaucgugaucagcgacgugugcgacaucguguacagauacgccgccgaccacuucagcguguacaucaccuacgugagcaaccagaccuaccaggagagaaccuacaagcagcugcugcaggagaaggccgccuucagagagcugaucgcccagcuggagcuggaccccaagugcagaggccugcccuucagcagcuuccugauccugcccuuccagagaaucaccagacugaagcugcuggugcagaacauccugaagagaguggaggagagaagcgagagagagugcaccgcccuggacgcccacaaggagcuggagaugguggugaaggccugcaacgagggcgugagaaagaugagcagaaccgagcagaugaucagcauccagaagaagauggaguucaagaucaagagcgugcccaucaucagccacagcagauggcugcugaagcagggcgagcugcagcagaugagcggccccaagaccagcagaacccugagaaccaagaagcuguuccacgagaucuaccuguuccuguucaacgaccugcuggugaucugcagacagauccccggcgacaaguaccagguguucgacagcgcccccagaggccugcugagaguggaggagcuggaggaccagggccagacccuggccaacguguucauccugagacugcuggagaacgccgacgacagagaggccaccuacaugcugaaggccagcagccagagcgagaugaagagauggaugaccagccuggcccccaacagaagaaccaaguucgugagcuucaccagcagacugcuggacugcccccaggugcagugcgugcaccccuacguggcccagcagcccgacgagcugacccuggagcuggccgacauccugaacauccuggacaagaccgacgacggcuggaucuucggcgagagacugcacgaccaggagagaggcugguuccccagcagcaugaccgaggagauccugaaccccaagaucagaagccagaaccugaaggagugcuucagagugcacaagauggacgacccccagagaagccagaacaaggacagaagaaagcugggcagcagaaacagacaguaa

SEQ ID NO: 20517 - RNA, 891 nt, Artificial Sequence
  NGF__Homo_sapiens__XP_011539820
auggccagcagcaacggccacuucaacgaggugcuggccagcggcagagccgugcagggcgccggcuggcacgccggccccaagcugagcagcgccagcggccccaacaacagcuucaccaagggcgccgccuucuaccccggccacaccgaggugcacagcgugaugagcaugcuguucuacacccugaucaccgccuuccugaucggcauccaggccgagccccacagcgagagcaacgugcccgccggccacaccaucccccaggcccacuggaccaagcugcagcacagccuggacaccgcccugagaagagccagaagcgcccccgccgccgccaucgccgccagaguggccggccagaccagaaacaucaccguggaccccagacuguucaagaagagaagacugagaagccccagagugcuguucagcacccagccccccagagaggccgccgacacccaggaccuggacuucgaggugggcggcgccgcccccuucaacagaacccacagaagcaagagaagcagcagccaccccaucuuccacagaggcgaguucagcgugugcgacagcgugagcgugugggugggcgacaagaccaccgccaccgacaucaagggcaaggaggugauggugcugggcgaggugaacaucaacaacagcguguucaagcaguacuucuucgagaccaagugcagagaccccaaccccguggacagcggcugcagaggcaucgacagcaagcacuggaacagcuacugcaccaccacccacaccuucgugaaggcccugaccauggacggcaagcaggccgccuggagauucaucagaaucgacaccgccugcgugugcgugcugagcagaaaggccgugagaagagccuaa

SEQ ID NO: 20518 - RNA, 576 nt, Artificial Sequence
  NGFRAP1__Homo_sapiens__NP_001269603
auggccguggccggcggcggcaagggcgagauccugcugcacuggccccccaagcugggcggcgagcugggcggcgacgccagacccagcagagaccccgagcugcagagcgacgccgccuucggcgccguggugaccagaguguggcugcccgcccccagaugccccgagcugggcggccuggccuucggccccggcaagagcggcgccgagaagcagcccgagaagaagaaccugaucauggccaacauccaccaggagaacgaggagauggagcagcccaugcagaacggcgaggaggacagaccccugggcggcggcgagggccaccagcccgccggcaacagaagaggccaggccagaagacuggcccccaacuucagaugggccauccccaacagacagaucaacgacggcaugggcggcgacggcgacgacauggagaucuucauggaggagaugagagagaucagaagaaagcugagagagcugcagcugagaaacugccugagaauccugaugggcgagcugagcaaccaccacgaccaccacgacgaguucugccugaugcccuaa

SEQ ID NO: 20519 - RNA, 1284 nt, Artificial Sequence
  NGFR__Homo_sapiens__NP_002498
augggcgccggcgccaccggcagagccauggacggccccagacugcugcugcugcugcugcugggcgugagccugggcggcgccaaggaggccugccccaccggccuguacacccacagcggcgagugcugcaaggccugcaaccugggcgagggcguggcccagcccugcggcgccaaccagaccgugugcgagcccugccuggacagcgugaccuucagcgacguggugagcgccaccgagcccugcaagcccugcaccgagugcgugggccugcagagcaugagcgcccccugcguggaggccgacgacgccgugugcagaugcgccuacggcuacuaccaggacgagaccaccggcagaugcgaggccugcagagugugcgaggccggcagcggccugguguucagcugccaggacaagcagaacaccgugugcgaggagugccccgacggcaccuacagcgacgaggccaaccacguggaccccugccugcccugcaccgugugcgaggacaccgagagacagcugagagagugcaccagaugggccgacgccgagugcgaggagauccccggcagauggaucaccagaagcaccccccccgagggcagcgacagcaccgcccccagcacccaggagcccgaggccccccccgagcaggaccugaucgccagcaccguggccggcguggugaccaccgugaugggcagcagccagcccguggugaccagaggcaccaccgacaaccugauccccguguacugcagcauccuggccgccgugguggugggccugguggccuacaucgccuucaagagauggaacagcugcaagcagaacaagcagggcgccaacagcagacccgugaaccagacccccccccccgagggcgagaagcugcacagcgacagcggcaucagcguggacagccagagccugcacgaccagcagccccacacccagaccgccagcggccaggcccugaagggcgacggcggccuguacagcagccugccccccgccaagagagaggagguggagaagcugcugaacggcagcgccggcgacaccuggagacaccuggccggcgagcugggcuaccagcccgagcacaucgacagcuucacccacgaggccugccccgugagagcccugcuggccagcugggccacccaggacagcgccacccuggacgcccugcuggccgcccugagaagaauccagagagccgaccugguggagagccugugcagcgagagcaccgccaccagccccguguaa

SEQ ID NO: 20520 - RNA, 1911 nt, Artificial Sequence
  NGLY1__Homo_sapiens__NP_001138765
auggccgccgccgcccugggcagcagcagcggcagcgccagccccgccguggccgagcugugccagaacacccccgagaccuuccuggaggccagcaagcugcugcugaccuacgccgacaacauccugagaaaccccaacgacgagaaguacagaagcaucagaaucggcaacaccgccuucagcaccagacugcugcccgugagaggcgccguggagugccuguucgagaugggcuucgaggagggcgagacccaccugaucuuccccaagaaggccagcguggagcagcugcagaagaucagagaccugaucgccaucgagagaagcagcagacuggacggcagcaacaagagccacaaggugaagagcagccagcagcccgccgccagcacccagcugcccaccacccccagcagcaaccccagcggccugaaccagcacaccagaaacagacagggccagagcagcgacccccccagcgccagcaccguggccgccgacagcgccauccuggaggugcugcagagcaacauccagcacgugcugguguacgagaaccccgcccugcaggagaaggcccuggccugcauccccgugcaggagcugaagagaaagagccaggagaagcugagcagagccagaaagcuggacaagggcaucaacaucagcgacgaggacuuccugcugcuggagcugcugcacugguucaaggaggaguucuuccacugggugaacaacgugcugugcagcaagugcggcggccagaccagaagcagagacagaagccugcugcccagcgacgacgagcugaaguggggcgccaaggagguggaggaccacuacugcgacgccugccaguucagcaacagauuccccagauacaacaaccccgagaagcugcuggagaccagaugcggcagaugcggcgagugggccaacugcuucacccugugcugcagagccgugggcuucgaggccagauacgugugggacuacaccgagcugcagagaacccugagccugaagcugaccacccugaaggagaucggcaagaccuuccugagaaucagcaagagacagaagcugauccaggugguggacgugaccuggagauacagcugcaagcacgaggaggugaucgccagaagaaccaaggugaaggaggcccugcugagagacaccaucaacggccugaacaagcagagacagcuguuccugagcgagaacagaagaaaggagcugcugcagagaaucaucguggagcugguggaguucaucagccccaagacccccaagcccggcgagcugggcggcagaaucagcggcagcguggccuggagaguggccagaggcgagaugggccugcagagaaaggagacccuguucauccccugcgagaacgagaagaucagcaagcagcugcaccugugcuacaacaucgugaaggacagauacgugagagugagcaacaacaaccagaccaucagcggcugggagaacggcguguggaagauggagagcaucuucagaaagguggagaccgacuggcacaugguguaccuggccagaaaggagggcagcagcuucgccuacaucagcuggaaguucgagugcggcagcgugggccugaagguggacagcaucagcaucagaaccagcagccagaccuuccagaccggcaccguggaguggaagcugagaagcgacaccgcccagguggagcugaccggcgacaacagccugcacagcuacgccgacuucagcggcgccaccgaggugauccuggaggccgagcugagcagaggcgacggcgacguggccuggcagcacacccagcuguucagacagagccugaacgaccacgaggagaacugccuggagaucaucaucaaguucagcgaccuguaa

SEQ ID NO: 20521 - RNA, 900 nt, Artificial Sequence
  NHEJ1__Homo_sapiens__NP_079058
auggaggagcuggagcagggccugcugaugcagcccugggccuggcugcagcuggccgagaacagccugcuggccaagguguucaucaccaagcagggcuacgcccugcuggugagcgaccugcagcagguguggcacgagcagguggacaccagcguggugagccagagagccaaggagcugaacaagagacugaccgccccccccgccgccuuccugugccaccuggacaaccugcugagaccccugcugaaggacgccgcccaccccagcgaggccaccuucagcugcgacugcguggccgacgcccugauccugagagugagaagcgagcugagcggccugcccuucuacuggaacuuccacugcaugcuggccagccccagccuggugagccagcaccugaucagaccccugaugggcaugagccuggcccugcagugccaggugagagagcuggccacccugcugcacaugaaggaccuggagauccaggacuaccaggagagcggcgccacccugaucagagacagacugaagaccgagcccuucgaggagaacagcuuccuggagcaguucaugaucgagaagcugcccgaggccugcagcaucggcgacggcaagcccuucgugaugaaccugcaggaccuguacauggccgugaccacccaggaggugcaggugggccagaagcaccagggcgccggcgacccccacaccagcaacagcgccagccugcagggcaucgacagccagugcgugaaccagcccgagcagcuggugagcagcgcccccacccugagcgcccccgagaaggagagcaccggcaccagcggcccccugcagagaccccagcugagcaaggugaagagaaagaagcccagaggccuguucagcuaa

SEQ ID NO: 20522 - RNA, 402 nt, Artificial Sequence
  NHLH1__Homo_sapiens__NP_005589
augaugcugaacagcgacaccauggagcuggaccugccccccacccacagcgagaccgagagcggcuucagcgacugcggcggcggcgccggccccgacggcgccggccccggcggccccggcggcggccaggccagaggccccgagcccggcgagcccggcagaaaggaccugcagcaccugagcagagaggagagaagaagaagaagaagagccaccgccaaguacagaaccgcccacgccaccagagagagaaucagaguggaggccuucaaccuggccuucgccgagcugagaaagcugcugcccacccugccccccgacaagaagcugagcaagaucgagauccugagacuggccaucugcuacaucagcuaccugaaccacgugcuggacguguaa

SEQ ID NO: 20523 - RNA, 1188 nt, Artificial Sequence
  NHLRC1__Homo_sapiens__NP_940988
auggccgccgaggccagcgagagcggccccgcccugcacgagcugaugagagaggccgagaucagccugcuggagugcaaggugugcuucgagaaguucggccacagacagcagagaagacccagaaaccugagcugcggccacguggugugccuggccugcguggccgcccuggcccaccccagaacccuggcccuggagugccccuucugcagaagagccugcagaggcugcgacaccagcgacugccugcccgugcugcaccugaucgagcugcugggcagcgcccugagacagagccccgccgcccacagagccgcccccagcgcccccggcgcccugaccugccaccacaccuucggcggcuggggcacccuggugaaccccaccggccuggcccugugccccaagaccggcagaguggugguggugcacgacggcagaagaagagugaagaucuucgacagcggcggcggcugcgcccaccaguucggcgagaagggcgacgccgcccaggacaucagauaccccguggacgugaccaucaccaacgacugccacgugguggugaccgacgccggcgacagaagcaucaagguguucgacuucuucggccagaucaagcuggugaucggcggccaguucagccugcccuggggcguggagaccaccccccagaacggcaucguggugaccgacgccgaggccggcagccugcaccugcuggacguggacuucgccgagggcgugcugagaagaaccgagagacugcaggcccaccugugcaaccccagaggcguggccgugagcuggcugaccggcgccaucgccgugcuggagcacccccuggcccugggcaccggcgugugcagcaccagagugaagguguucagcagcagcaugcagcuggugggccagguggacaccuucggccugagccuguacuuccccagcaagaucaccgccagcgccgugaccuucgaccaccagggcaacgugaucguggccgacaccagcggccccgccauccugugccugggcaagcccgaggaguuccccgugcccaagcccauggugacccacggccugagccaccccguggcccugaccuucaccaaggagaacagccugcuggugcuggacaccgccagccacagcaucaagguguacaagguggacuggggcuaa

SEQ ID NO: 20524 - RNA, 1044 nt, Artificial Sequence
  NHLRC3__Homo_sapiens__NP_001012772
auggccagauucugggugugcguggccggcgccggcuucuuccuggccuuccuggugcugcacagcagauucugcggcagccccgugcugagaaacuucaccuucgccgugagcuggagaaccgagaagauccuguacagacuggacgugggcuggcccaagcaccccgaguacuucaccggcaccaccuucugcguggccguggacagccugaacggccugguguacaucggccagagaggcgacaacauccccaagauccugguguucaccgaggacggcuacuuccugagagccuggaacuacaccguggacaccccccacggcaucuucgccgccagcacccuguacgagcagagcguguggaucaccgacgugggcagcggcuucuucggccacaccgugaagaaguacagcagcuucggcgaccuggugcaggugcugggcacccccggcaagaagggcaccagccugaacccccugcaguucgacaaccccgccgagcuguacguggaggacaccggcgacaucuacaucguggacggcgacggcggccugaacaacagacugaucaagcugagccaggacuucaugauccuguggcugcacggcgagaacggcaccggccccgccaaguucaacaucccccacagcgugacccuggacagcgccggcagaguguggguggccgacagaggcaacaagagaauccagguguucgacaaggacaccggcgaguggcugggcgccuggaacaacugcuucaccgaggagggccccagcagcgugagauucacccccgacggcaaguaccugaucguggcccagcugaaccugagcagacugagcgugguggccgccccccccgugggcagcaucggcgagugcagcgugaucagcaccauccagcuggccgaccaggugcugccccaccugcuggagguggacagaaagaccggcgccguguacguggccgagaucggcgccaagcaggugcagaaguacgugccccugaacagcuacgugcccagcuucggcagcuaa

SEQ ID NO: 20525 - RNA, 273 nt, Artificial Sequence
  NHP2__Homo_sapiens__NP_001030005
augaccaagaucaaggccgaccccgacggccccgaggcccaggccgaggccugcagcggcgagagaaccuaccaggagcugcuggugaaccagaaccccaucgcccagccccuggccagcagaagacugaccagaaagcuguacaagugcaucaagaaggccgugaagcagaagcagaucagaagaggcgugaaggaggugcagaaguucgugaacaagggcgagaagggcaccugggugcagccccaggcccccagcgccccccccguguaa

SEQ ID NO: 20526 - RNA, 387 nt, Artificial Sequence
  NHP2L1__Homo_sapiens__NP_004999
augaccgaggccgacgugaaccccaaggccuacccccuggccgacgcccaccugaccaagaagcugcuggaccuggugcagcagagcugcaacuacaagcagcugagaaagggcgccaacgaggccaccaagacccugaacagaggcaucagcgaguucaucgugauggccgccgacgccgagccccuggagaucauccugcaccugccccugcugugcgaggacaagaacgugcccuacguguucgugagaagcaagcaggcccugggcagagccugcggcgugagcagacccgugaucgccugcagcgugaccaucaaggagggcagccagcugaagcagcagauccagagcauccagcagagcaucgagagacugcugguguaa

SEQ ID NO: 20527 - RNA, 4425 nt, Artificial Sequence
  NHS__Homo_sapiens__NP_001129496
auggcccuggccugcugcaugcccaagaacgccgccgugagcaaccuggacaucgagagcaagcugagcguguacuacagagcccccuggcaccagcagagaaacaucuuccugcccgccaccagaccccccugcguggaggagcugcacagacacgccagacagagccugcaggcccugagaagagagcacagaagcagaagcgacagaagagagcagagagccgccgccccccugagcaucgccgcccccccccugcccgccuacccccccgcccacagccagagaagaagagaguucaaggacagacacuuccugaccuucaacagcaccagaagccccagccccaccgagugcugccacaugacccccuggagcagaaagagccacccccccgaggacgaggacaccgacgugaugcugggccagagacccaagaaccccauccacaacauccccagcacccuggacaagcagaccaacuggagcaaggcccugccccugcccacccccgaggagaagaugaagcaggacgcccaggugaucagcagcugcaucauccccaucaacgugaccggcgugggcuucgacagagaggccagcaucagaugcagccuggugcacagccagagcgugcugcagagaagaagaaagcugagaagaagaaagaccaucagcggcauccccagaagagugcagcaggagaucgacagcgacgagagccccguggccagagagagaaacgugaucgugcacaccaaccccgaccccagcaacaccgugaacagaaucagcggcaccagagacagcgagugccagaccgaggacauccugaucgccgcccccagcagaagaagaaucagagcccagagaggccagagcaucgccgccagccugagccacagcgccggcaacaucagcgcccuggccgacaagggcgacaccauguucacccccgccgugagcagcagaaccagaagcagaagccugcccagagagggcaacagaggcggcgacgccgagcccaaggugggcgccaagcccagcgccuacgaggagggcgagagcuucgugggcgaccacgagagaacccccaacgacuucagcgaggcccccagcagccccagcgcccaggaccaccagcccacccugggccuggccugcagccagcaccugcacagcccccagcacaagcugagcgagagaggcagaagcagacugagcagaauggccgccgacagcggcagcugcgacaucagcagcaacagcgacaccuucggcagccccauccacugcaucagcaccgccggcgugcugcugagcagccacauggaccagaaggacgaccaccagagcagcagcggcaacuggagcggcagcagcagcaccugccccagccagaccagcgagaccaucccccccgccgccagccccccccugaccggcagcagccacugcgacagcgagcugagccugaacaccgccccccacgccaacgaggacgccagcguguucgugaccgagcaguacaacgaccaccuggacaaggugagaggccacagagccaacagcuucaccagcaccguggccgaccugcuggacgaccccaacaacagcaacaccagcgacagcgaguggaacuaccugcaccaccaccacgacgccagcugcagacaggacuucagccccgagagacccaaggccgacagccugggcugccccagcuucaccagcauggccaccuacgacagcuuccuggagaagagccccagcgacaaggccgacaccagcagccacuucagcguggacaccgagggcuacuacaccagcaugcacuucgacugcggccugaagggcaacaagagcuacgugugccacuacgccgcccugggccccgagaacggccagggcgugggcgccagccccggccugcccgacugcgccuggcaggacuaccuggaccacaagagacagggcagacccagcaucagcuucagaaagcccaaggccaagcccaccccccccaagagaagcagcagccugagaaagagcgacggcaacgccgacaucagcgagaagaaggagcccaagaucagcagcggccagcaccugccccacagcagcagagagaugaagcugccccuggacuucgccaacacccccagcagaauggagaacgccaaccugcccaccaagcaggagcccagcuggaucaaccagagcgagcagggcaucaaggagccccagcuggacgccagcgacaucccccccuucaaggacgagguggccgagagcacccacuacgccgaccuguggcugcugaacgaccugaagaccaacgaccccuacagaagccugagcaacagcagcaccgccaccggcaccaccgugaucgagugcaucaagagccccgagagcagcgagagccagaccagccagagcgagagcagagccaccacccccagccugcccagcguggacaacgaguucaagcuggccagccccgagaagcuggccggccuggccagccccagcagcggcuacagcagccagagcgagacccccaccagcagcuuccccaccgccuucuucagcggcccccugagccccggcggcagcaagagaaagcccaaggugcccgagagaaagagcagccugcagcagcccagccugaaggacggcaccaucagccugagcaaggaccuggagcugcccaucaucccccccacccaccuggaccugagcgcccugcacaacgugcugaacaagcccuuccaccacagacacccccugcacguguucacccacaacaagcagaacaccgugggcgagacccugagaagcaaccccccccccagccuggccaucacccccaccauccugaagagcgugaaccugagaagcaucaacaagagcgaggaggugaagcagaaggaggagaacaacaccgaccugcccuaccuggaggagagcacccugaccaccgccgcccugagccccagcaagaucagaccccacaccgccaacaagagcgugagcagacaguacagcaccgaggacaccauccugagcuuccuggacagcagcgccguggagaugggccccgacaagcugcaccuggagaagaacagcaccuucgacgugaagaacagaugcgaccccgagaccaucaccagcgccggcagcagccugcuggacagcaacgugaccaaggaccaggugagaaccgagaccgagcccauccccgagaacacccccaccaagaacugcgccuuccccaccgagggcuuccagagagugagcgccgccagacccaacgaccuggacggcaagaucauccaguacggccccggccccgacgagacccuggagcaggugcagaaggcccccagcgccggccuggaggagguggcccagcccgagagcguggacgugaucaccagccagagcgacagccccaccagagccaccgacgugagcaaccaguucaagcaccaguucgugaugagcagacaccacgacaaggugcccggcaccaucagcuacgagagcgagaucaccagcgugaacagcuuccccgagaagugcagcaagcaggagaacaucgccagcggcaucagcgccaagagcgccagcgacaacagcaaggccgaggagacccagggcaacguggacgaggccagccugaaggagagcagccccagcgacgacagcaucaucagcccccugagcgaggacagccaggccgaggccgagggcguguucgugagccccaacaagcccagaaccaccgaggaccuguucgccgugauccacagaagcaagagaaaggugcugggcagaaaggacagcggcgacaugagcgugagaagcaagagcagagccccccugagcagcagcagcagcagcgccagcagcaucaccagccccagcagcaacgugaccacccccaacagccagagaagccccggccugaucuacagaaacgccaagaagagcaacaccagcaacgaggaguucaagcugcugcugcugaagaagggcagcagaagcgacagcagcuacagaaugagcgccaccgagauccugaagagccccauccugcccaagccccccggcgagcugaccgccgagagcccccagagcaccgacgacgcccaccagggcagccagggcgccgaggcccugagcccccugagccccugcagccccagagugaacgccgagggcuucagcagcaagagcuucgccaccagcgccagcgccagagugggcagaagcagagccccccccgccgccagcagcagcagauacagcgugagaugcagacuguacaacacccccaugcaggccaucagcgagggcgagaccgagaacagcgacggcagcccccacgacgacagaagcagccagagcagcaccuaa

SEQ ID NO: 20528 - RNA, 4821 nt, Artificial Sequence
  NHSL1__Homo_sapiens__NP_001137532
auggugguguucaucaacgccaagaucaagagccugaucaagcuguucaagaagaagaccgugagcaaccuggacgaggagagcagauggaccgugcacuacaccgcccccuggcaccagcaggagaacguguuccugcccaccaccagaccccccugcguggaggaccugcacagacaggccaagcugaaccugaagagcgugcugagagagugcgacaagcugagacacgacggcuacagaagcagccaguacuacagccagggccccaccuucgccgccaacgccagccccuucugcgacgacuaccaggacgaggacgaggagaccgaccagaagugcagccugagcagcagcgaggaggagagauucaucagcaucagaagacccaagacccccgccagcagcgacuucagcgaccugaacacccagaccaacuggaccaagagccugccccugcccacccccgaggagaagaugagacagcaggcccagaccgugcaggccgacguggugcccaucaacaucaccggcgagaacuucgacagacaggccagccugagaagaagccugaucuacaccgacacccuggugagaagacccaagaaggugaagagaagaaagaccaucaccggcgugcccgacaacauccagaaggagcuggccagcggcaccggccaggacgacgccgacggccacagcguguacacccccgaccacuacagcacccugggcagauucaacagcugcagaagcgccggccagagaagcgagaccagagacagcagcugccagaccgaggacgugaagguggugccccccagcaugagaagaaucagagcccagaagggccagggcaucgccgcccagaugggccacuucagcggcagcagcggcaacaugagcgugcugagcgacagcgccggcaucguguuccccagcagacuggacagcgacgccggcuuccacagccugcccagaagcggcgccagagccaacauccagagccuggagcccagacugggcgcccugggccccgccggcgacaugaacggcaccuuccuguaccagagaggccacccccaggccgacgagaaccugggccaccugggcggcgccagcggcaccggcacccugcugagacccaagagccaggagcugagacacuucgagagcgagaacaucaugagccccgccugcguggugagcccccacgccaccuacagcaccagcaucauccccaacgccacccugagcagcagcagcgaggugaucgccauccccaccgcccagagcgccggccagagagagagcaagagcagcggcagcagccacgccagaaucaagagcagagaccaccugaucagcagacacgccgugaagggcgacccccagagccccggcagacacuggaacgagggccacgccaccauccugagccaggaccuggacccccacagccccggcgagcccgcccugcugagccugugcgacagcgccgugccccugaacgcccccgccaacagagagaacggcagccaggccaugcccuacaacugcagaaacaaccuggccuuccccgcccacccccaggacguggacggcaagagcgagagcagcuacagcggcggcggcggccacagcagcagcgagcccugggaguacaagagcagcggcaacggcagagccagcccccugaagccccaccuggccacccccggcuacagcacccccaccagcaacaugagcagcugcagccuggaccagaccagcaacaaggaggacgccggcagccuguacagcgaggaccacgacggcuacugcgccagcgugcacaccgacagcggccacggcagcggcaaccugugcaacagcagcgacggcuucggcaaccccagacacagcgugaucaacguguucgugggcagagcccagaagaaccagggcgacagaagcaacuaccaggacaagagccugagcagaaacaucagccugaagaaggccaagaagcccccccugccccccagcagaaccgacagccugagaagaauccccaagaagagcagccagugcaacggccaggugcugaacgagagccugaucgccacccugcagcacagccugcagcugagccugcccggcaagagcggcagcagccccagccagagccccugcagcgaccuggaggagcccuggcugcccagaagcagaagccagagcaccgugagcgccggcagcagcaugaccagcgccaccacccccaacguguacagccugugcggcgccacccccagccagagcgacaccagcagcgugaagagcgaguacaccgaccccuggggcuacuacaucgacuacaccggcaugcaggaggaccccggcaaccccgccggcggcugcagcaccagcagcggcgugcccaccggcaacggccccgugagacacgugcaggagggcagcagagccaccaugccccaggugcccggcggcagcgugaagcccaagaucaugagccccgagaagagccacagagugaucagccccagcagcggcuacagcagccagagcaacacccccaccgcccugacccccgugcccguguuccugaagagcgugagccccgccaacggcaagggcaagcccaagcccaaggugcccgagagaaagagcagccugaucagcagcgugagcaucagcagcagcagcaccagccugagcagcagcaccagcaccgagggcagcggcaccaugaagaagcuggaccccgccgugggcagcccccccgcccccccccccccccccgugcccagcccccccuuccccugccccgccgacagaagccccuuccugcccccccccccccccgugaccgacugcagccagggcagcccccugccccacagccccguguuccccccccccccccccgaggcccugauccccuucugcagcccccccgacuggugccugagcccccccagacccgcccugagccccauccugcccgacagccccgugagccugccccugccccccccccugcugcccagcagcgagcccccccccgcccccccccuggaccccaaguucaugaaggacaccagaccccccuucaccaacagcggccagcccgagagcagcagaggcagccugagaccccccagcaccaaggaggagaccagcagaccccccaugccccugaucaccaccgaggcccugcagauggugcagcugagacccgugagaaagaacagcggcgccgaggccgcccagcugagcgagagaaccgcccaggagcagagaacccccguggccccccaguaccaccugaagcccagcgccuuccugaagagcagaaacagcaccaacgagauggagagcgagagccagcccgccagcgugaccagcagccugcccacccccgccaagagcagcagccagggcgaccacggcagcgccgccgagagaggcggccccgugagcagaagccccggcgcccccagcgccggcgaggccgaggccagacccagccccagcaccaccccccugcccgacagcagccccagcagaaagcccccccccaucagcaagaagcccaagcuguuccugguggugccccccccccagaaggacuucgccguggagcccgccgagaacgugagcgaggcccugagagccgugcccagccccaccaccggcgaggagggcagcgugcacagcagagaggccaaggagagcagcgccgcccaggccggcagccacgccacccaccccggcaccagcgugcuggagggcggcgccgccggcagcaugagccccagcagaguggaggccaacgugcccauggugcagcccgacgugagccccgcccccaagcaggaggagcccgccgagaacagcgccgacaccggcggcgacggcgagagcugccugagccagcaggacggcgccgccggcgugcccgagaccaacgccgccggcagcagcagcgaggccugcgacuuccugaaggaggacggcaacgacgaggugaugacccccagcagacccagaaccaccgaggaccuguucgccgccauccacagaagcaagagaaaggugcugggcagaagagacagcgacgacgaccacagcagaaaccacagccccagcccccccgugacccccaccggcgccgcccccagccuggccagccccaagcaggugggcagcauccagagaagcaucagaaagagcagcaccagcagcgacaacuucaaggcccugcugcugaagaagggcagcagaagcgacaccagcgccagaaugagcgccgccgagaugcugaagaacaccgaccccagauuccagagaagcagaagcgagcccagccccgacgcccccgagagccccagcagcugcagccccagcaagaacagaagagcccaggaggagugggccaagaacgagggccugaugcccagaagccugagcuucagcggccccagauacggcagaagcagaaccccccccagcgccgccagcagcagauacagcaugagaaacagaauccagagcagccccaugaccgugaucagcgagggcgagggcgaggccguggagcccguggacagcaucgccagaggcgcccugggcgccgccgagggcugcagccuggacggccuggccagagaggagauggacgagggcggccugcugugcggcgagggccccgccgccagccugcagccccaggcccccggccccguggacggcaccgccagcgccgagggcagagagcccagcccccagugcggcggcagccugagcgaggagagcuaa

SEQ ID NO: 20529 - RNA, 642 nt, Artificial Sequence
  NICN1__Homo_sapiens__NP_115692
augagcagagugcuggugcccugccacgugaagggcagcguggcccugcaggugggcgacgugagaaccagccagggcagacccggcgugcuggugaucgacgugaccuuccccagcguggcccccuucgagcugcaggagaucaccuucaagaacuacuacaccgccuuccugagcaucagagugagacaguacaccagcgcccacacccccgccaagugggugaccugccugagagacuacugccugaugcccgacccccacagcgaggagggcgcccaggaguacgugagccuguucaagcaccagaugcugugcgacauggccagaaucagcgagcugagacugauccugagacagcccagcccccuguggcugagcuucaccguggaggagcugcagaucuaccagcagggccccaagagccccagcgugaccuuccccaaguggcugagccaccccgugcccugcgagcagcccgcccugcugagagagggccugcccgaccccagcagagugagcagcgaggugcagcagaugugggcccugaccgagaugaucagagccagccacaccagcgccagaaucggcagauucgacguggacggcugcuacgaccugaaccugcugagcuacaccuaa

SEQ ID NO: 20530 - RNA, 3744 nt, Artificial Sequence
  NID1__Homo_sapiens__NP_002499
augcuggccagcagcagcagaaucagagccgccuggaccagagcccugcugcugccccugcugcuggccggccccgugggcugccugagcagacaggagcuguuccccuucggccccggccagggcgaccuggagcuggaggacggcgacgacuucgugagccccgcccuggagcugagcggcgcccugagauucuacgacagaagcgacaucgacgccguguacgugaccaccaacggcaucaucgccaccagcgagccccccgccaaggagagccaccccggccuguucccccccaccuucggcgccguggcccccuuccuggccgaccuggacaccaccgacggccugggcaagguguacuacagagaggaccugagccccagcaucacccagagagccgccgagugcgugcacagaggcuuccccgagaucagcuuccagcccagcagcgccgugguggugaccugggagagcguggcccccuaccagggccccagcagagaccccgaccagaagggcaagagaaacaccuuccaggccgugcuggccagcagcgacagcagcagcuacgccaucuuccuguaccccgaggacggccugcaguuccacaccaccuucagcaagaaggagaacaaccaggugcccgccgugguggccuucagccagggcagcgugggcuuccuguggaagagcaacggcgccuacaacaucuucgccaacgacagagagagcguggagaaccuggccaagagcagcaacagcggccagcagggcguguggguguucgagaucggcagccccgccaccaccaacggcguggugcccgccgacgugauccugggcaccgaggacggcgccgaguacgacgacgaggacgaggacuacgaccuggccaccaccagacugggccuggaggacgugggcaccacccccuucagcuacaaggcccugagaagaggcggcgccgacaccuacagcgugcccagcgugcugagccccagaagagccgccaccgagagaccccugggcccccccaccgagagaaccagaagcuuccagcuggccguggagaccuuccaccagcagcacccccaggugaucgacguggacgagguggaggagaccggcgugguguucagcuacaacaccgacagcagacagaccugcgccaacaacagacaccagugcagcgugcacgccgagugcagagacuacgccaccggcuucugcugcagcugcguggccggcuacaccggcaacggcagacagugcguggccgagggcagcccccagagagugaacggcaaggugaagggcagaaucuucgugggcagcagccaggugcccaucguguucgagaacaccgaccugcacagcuacguggugaugaaccacggcagaagcuacaccgccaucagcaccauccccgagaccgugggcuacagccugcugccccuggcccccgugggcggcaucaucggcuggauguucgccguggagcaggacggcuucaagaacggcuucagcaucaccggcggcgaguucaccagacaggccgaggugaccuucgugggccaccccggcaaccuggugaucaagcagagauucagcggcaucgacgagcacggccaccugaccaucgacaccgagcuggagggcagagugccccagauccccuucggcagcagcgugcacaucgagcccuacaccgagcuguaccacuacagcaccagcgugaucaccagcagcagcaccagagaguacaccgugaccgagcccgagagagacggcgccagccccagcagaaucuacaccuaccaguggagacagaccaucaccuuccaggagugcgugcacgacgacagcagacccgcccugcccagcacccagcagcugagcguggacagcguguucgugcuguacaaccaggaggagaagauccugagauacgcccugagcaacagcaucggccccgugagagagggcagccccgacgcccugcagaaccccugcuacaucggcacccacggcugcgacaccaacgccgccugcagacccggccccagaacccaguucaccugcgagugcagcaucggcuucagaggcgacggcagaaccugcuacgacaucgacgagugcagcgagcagcccagcgugugcggcagccacaccaucugcaacaaccaccccggcaccuucagaugcgagugcguggagggcuaccaguucagcgacgagggcaccugcguggccgugguggaccagagacccaucaacuacugcgagaccggccugcacaacugcgacaucccccagagagcccagugcaucuacaccggcggcagcagcuacaccugcagcugccugcccggcuucagcggcgacggccaggccugccaggacguggacgagugccagcccagcagaugccaccccgacgccuucugcuacaacacccccggcagcuucaccugccagugcaagcccggcuaccagggcgacggcuucagaugcgugcccggcgagguggagaagaccagaugccagcacgagagagagcacauccugggcgccgccggcgccaccgacccccagagacccaucccccccggccuguucgugcccgagugcgacgcccacggccacuacgcccccacccagugccacggcagcaccggcuacugcuggugcguggacagagacggcagagagguggagggcaccagaaccagacccggcaugaccccccccugccugagcaccguggccccccccauccaccagggccccgccgugcccaccgccgugaucccccugccccccggcacccaccugcuguucgcccagaccggcaagaucgagagacugccccuggagggcaacaccaugagaaagaccgaggccaaggccuuccugcacgugcccgccaaggugaucaucggccuggccuucgacugcguggacaagaugguguacuggaccgacaucaccgagcccagcaucggcagagccagccugcacggcggcgagcccaccaccaucaucagacaggaccugggcagccccgagggcaucgccguggaccaccugggcagaaacaucuucuggaccgacagcaaccuggacagaaucgagguggccaagcuggacggcacccagagaagagugcuguucgagaccgaccuggugaaccccagaggcaucgugaccgacagcgugagaggcaaccuguacuggaccgacuggaacagagacaaccccaagaucgagaccagcuacauggacggcaccaacagaagaauccuggugcaggacgaccugggccugcccaacggccugaccuucgacgccuucagcagccagcugugcuggguggacgccggcaccaacagagccgagugccugaaccccagccagcccagcagaagaaaggcccuggagggccugcaguaccccuucgccgugaccagcuacggcaagaaccuguacuucaccgacuggaagaugaacagcgugguggcccuggaccuggccaucagcaaggagaccgacgccuuccagccccacaagcagaccagacuguacggcaucaccaccgcccugagccagugcccccagggccacaacuacugcagcgugaacaacggcggcugcacccaccugugccuggccacccccggcagcagaaccugcagaugccccgacaacacccugggcguggacugcaucgagcagaaguaa

SEQ ID NO: 20531 - RNA, 4128 nt, Artificial Sequence
  NID2__Homo_sapiens__NP_031387
auggagggcgacagaguggccggcagacccgugcugagcagccugcccgugcugcugcugcugccccugcugaugcugagagccgccgcccugcaccccgacgagcuguucccccacggcgagagcuggggcgaccagcugcugcaggagggcgacgacgagagcagcgccguggugaagcuggccaacccccugcacuucuacgaggccagauucagcaaccuguacgugggcaccaacggcaucaucagcacccaggacuuccccagagagacccaguacguggacuacgacuuccccaccgacuuccccgccaucgcccccuuccuggccgacaucgacaccagccacggcagaggcagagugcuguacagagaggacaccagccccgccgugcugggccuggccgccagauacgugagagccggcuuccccagaagcgccagauucacccccacccacgccuuccuggccaccugggagcaggugggcgccuacgaggaggugaagagaggcgcccugcccagcggcgagcugaacaccuuccaggccgugcuggccagcgacggcagcgacagcuacgcccuguuccuguaccccgccaacggccugcaguuccugggcaccagacccaaggagagcuacaacgugcagcugcagcugcccgccagagugggcuucugcagaggcgaggccgacgaccugaagagcgagggccccuacuucagccugaccagcaccgagcagagcgugaagaaccuguaccagcugagcaaccugggcauccccggcgugugggccuuccacaucggcagcaccagcccccuggacaacgugagacccgccgccgugggcgaccugagcgccgcccacagcagcgugccccugggcagaagcuucagccacgccaccgcccuggagagcgacuacaacgaggacaaccuggacuacuacgacgugaacgaggaggaggccgaguaccugcccggcgagcccgaggaggcccugaacggccacagcagcaucgacgugagcuuccagagcaagguggacaccaagccccuggaggagagcagcacccuggacccccacaccaaggagggcaccagccugggcgaggugggcggccccgaccugaagggccagguggagcccugggacgagagagagaccagaagccccgccccccccgagguggacagagacagccuggcccccagcugggagacccccccccccuaccccgagaacggcagcauccagcccuaccccgacggcggccccgugcccagcgagauggacgugccccccgcccaccccgaggaggagaucgugcugagaagcuaccccgccagcggccacaccaccccccugagcagaggcaccuacgaggugggccuggaggacaacaucggcagcaacaccgagguguucaccuacaacgccgccaacaaggagaccugcgagcacaaccacagacagugcagcagacacgccuucugcaccgacuacgccaccggcuucugcugccacugccagagcaaguucuacggcaacggcaagcacugccugcccgagggcgccccccacagagugaacggcaaggugagcggccaccugcacgugggccacacccccgugcacuucaccgacguggaccugcacgccuacaucgugggcaacgacggcagagccuacaccgccaucagccacaucccccagcccgccgcccaggcccugcugccccugacccccaucggcggccuguucggcuggcuguucgcccuggagaagcccggcagcgagaacggcuucagccuggccggcgccgccuucacccacgacauggaggugaccuucuaccccggcgaggagaccgugagaaucacccagaccgccgagggccuggaccccgagaacuaccugagcaucaagaccaacauccagggccaggugcccuacgugagcgccaacuucaccgcccacaucagccccuacaaggagcuguaccacuacagcgacagcaccgugaccagcaccagcagcagagacuacagccugaccuucggcgccaucaaccagaccuggagcuacagaauccaccagaacaucaccuaccaggugugcagacacgcccccagacaccccagcuuccccaccacccagcagcugaacguggacagaguguucgcccuguacaacgacgaggagagagugcugagauucgccgugaccaaccagaucggccccgugaaggaggacagcgaccccacccccggcaaccccugcuacgacggcagccacaugugcgacaccaccgccagaugccaccccggcaccggcguggacuacaccugcgagugcgccagcggcuaccagggcgacggcagaaacugcguggacgagaacgagugcgccaccggcuuccacagaugcggccccaacagcgugugcaucaaccugcccggcagcuacagaugcgagugcagaagcggcuacgaguucgccgacgacagacacaccugcauccugaucaccccccccgccaaccccugcgaggacggcagccacaccugcgcccccgccggccaggccagaugcgugcaccacggcggcagcaccuucagcugcgccugccugcccggcuacgccggcgacggccaccagugcaccgacguggacgagugcagcgagaacagaugccaccccgccgccaccugcuacaacacccccggcagcuucagcugcagaugccagcccggcuacuacggcgacggcuuccagugcauccccgacagcaccagcagccugacccccugcgagcagcagcagagacacgcccaggcccaguacgccuaccccggcgccagauuccacaucccccagugcgacgagcagggcaacuuccugccccugcagugccacggcagcaccggcuucugcuggugcguggaccccgacggccacgaggugcccggcacccagaccccccccggcagcacccccccccacugcggccccagccccgagcccacccagagaccccccaccaucugcgagagauggagagagaaccugcuggagcacuacggcggcacccccagagacgaccaguacgugccccagugcgacgaccugggccacuucaucccccugcagugccacggcaagagcgacuucugcuggugcguggacaaggacggcagagaggugcagggcaccagaagccagcccggcaccacccccgccugcauccccaccguggccccccccauggugagacccacccccagacccgacgugaccccccccagcgugggcaccuuccugcuguacacccagggccagcagaucggcuaccugccccugaacggcaccagacugcagaaggacgccgccaagacccugcugagccugcacggcagcaucaucgugggcaucgacuacgacugcagagagagaaugguguacuggaccgacguggccggcagaaccaucagcagagccggccuggagcugggcgccgagcccgagaccaucgugaacagcggccugaucagccccgagggccuggccaucgaccacaucagaagaaccauguacuggaccgacagcgugcuggacaagaucgagagcgcccugcuggacggcagcgagagaaaggugcuguucuacaccgaccuggugaaccccagagccaucgccguggaccccaucagaggcaaccuguacuggaccgacuggaacagagaggcccccaagaucgagaccagcagccuggacggcgagaacagaagaauccugaucaacaccgacaucggccugcccaacggccugaccuucgaccccuucagcaagcugcugugcugggccgacgccggcaccaagaagcuggagugcacccugcccgacggcaccggcagaagagugauccagaacaaccugaaguaccccuucagcaucgugagcuacgccgaccacuucuaccacaccgacuggagaagagacggcguggugagcgugaacaagcacagcggccaguucaccgacgaguaccugcccgagcagagaagccaccuguacggcaucaccgccguguaccccuacugccccaccggcagaaaguaa

SEQ ID NO: 20532 - RNA, 1134 nt, Artificial Sequence
  NIF3L1__Homo_sapiens__NP_001129511
augcugagcagcugcgugagacccgugcccaccaccgugagauucguggacagccugaucugcaacagcagcagaagcuucauggaccugaaggcccugcugagcagccugaacgacuucgccagccugagcuucgccgagagcugggacaacgugggccugcugguggagcccagccccccccacaccgugaacacccuguuccugaccaacgaccugaccgaggaggugauggaggaggugcugcagaagaaggccgaccugauccugagcuaccacccccccaucuucagacccaugaagagaaucaccuggaacaccuggaaggagagacuggugaucagagcccuggagaacagagugggcaucuacagcccccacaccgccuacgacgccgccccccagggcgugaacaacuggcuggccaagggccugggcgccugcaccagcagacccauccaccccagcaaggcccccaacuaccccaccgagggcaaccacagaguggaguucaacgugaacuacacccaggaccuggacaaggugaugagcgccgugaagggcaucgacggcgugagcgugaccagcuucagcgccagaaccggcaacgaggagcagaccagaaucaaccugaacugcacccagaaggcccugaugcaggugguggacuuccugagcagaaacaagcagcuguaccagaagaccgagauccugagccuggagaagccccugcugcugcacaccggcaugggcagacugugcacccuggacgagagcgugagccuggccaccaugaucgacagaaucaagagacaccugaagcugagccacaucagacuggcccugggcgugggcagaacccuggagagccaggugaaggugguggcccugugcgccggcagcggcagcagcgugcugcagggcguggaggccgaccuguaccugaccggcgagaugagccaccacgacacccuggacgccgccagccagggcaucaacgugauccugugcgagcacagcaacaccgagagaggcuuccugagcgaccugagagacaugcuggacagccaccuggagaacaagaucaacaucauccugagcgagaccgacagagacccccugcaggugguguaa

SEQ ID NO: 20533 - RNA, 1311 nt, Artificial Sequence
  NIM1K__Homo_sapiens__XP_006714513
augaccgccguguacaugaacggcggcggccuggugaacccccacuacgccagaugggacagaagagacagcguggagagcggcugccagaccgagagcagcaaggagggcgaggagggccagcccagacagcugacccccuucgagaagcugacccaggacaugagccaggacgagaagguggugagagagaucacccugggcaagagaaucggcuucuacagaaucagaggcgagaucggcagcggcaacuucagccaggugaagcugggcauccacagccugaccaaggagaagguggccaucaagauccuggacaagaccaagcuggaccagaagacccagagacugcugagcagagagaucagcagcauggagaagcugcaccaccccaacaucaucagacuguacgaggugguggagacccugagcaagcugcaccuggugauggaguacgccggcggcggcgagcuguucggcaagaucagcaccgagggcaagcugagcgagcccgagagcaagcugaucuucagccagaucgugagcgccgugaagcacaugcacgagaaccagaucauccacagagaccugaaggccgagaacguguucuacaccagcaacaccugcgugaaggugggcgacuucggcuucagcaccgugagcaagaagggcgagaugcugaacaccuucugcggcagcccccccuacgccgcccccgagcuguucagagacgagcacuacaucggcaucuacguggacaucugggcccugggcgugcugcuguacuucauggugaccggcaccaugcccuucagagccgagaccguggccaagcugaagaagagcauccuggagggcaccuacagcgugcccccccacgugagcgagcccugccacagacugaucagaggcgugcugcagcagauccccaccgagagauacggcaucgacugcaucaugaacgacgaguggaugcagggcgugcccuaccccaccccccuggagcccuuccagcuggaccccaagcaccugagcgagaccagcacccugaaggaggaggagaacgaggugaagagcacccuggagcaccugggcaucaccgaggagcacaucagaaacaaccagggcagagacgccagaagcagcaucaccggcguguacagaaucauccugcacagagugcagagaaagaaggcccuggagagcgugcccgugaugaugcugcccgaccccaaggagagagaccugaagaagggcagcagaguguacagaggcaucagacacaccagcaaguucugcagcauccuguaa

SEQ ID NO: 20534 - RNA, 4134 nt, Artificial Sequence
  NIN__Homo_sapiens__NP_057434
auggacgagguggagcaggaccagcacgaggccagacugaaggagcuguucgacagcuucgacaccaccggcaccggcagccugggccaggaggagcugaccgaccugugccacaugcugagccuggaggagguggcccccgugcugcagcagacccugcugcaggacaaccugcugggcagagugcacuucgaccaguucaaggaggcccugauccugauccugagcagaacccugagcaacgaggagcacuuccaggagcccgacugcagccuggaggcccagcccaaguacgugagaggcggcaagagauacggcagaagaagccugcccgaguuccaggagagcguggaggaguuccccgaggugaccgugaucgagccccuggacgaggaggccagacccagccacauccccgccggcgacugcagcgagcacuggaagacccagagaagcgaggaguacgaggccgagggccagcugagauucuggaaccccgacgaccugaacgccagccagagcggcagcagccccccccaggacuggaucgaggagaagcugcaggaggugugcgaggaccugggcaucaccagagacggccaccugaacagaaagaagcuggugagcaucugcgagcaguacggccugcagaacguggacggcgagaugcuggaggagguguuccacaaccuggaccccgacggcaccaugagcguggaggacuucuucuacggccuguucaagaacggcaagagccugacccccagcgccagcacccccuacagacagcugaagagacaccugagcaugcagagcuucgacgagagcggcagaagaaccaccaccagcagcgccaugaccagcaccaucggcuucagaguguucagcugccuggacgacggcaugggccacgccagcguggagagaauccuggacaccuggcaggaggagggcaucgagaacagccaggagauccugaaggcccuggacuucagccuggacggcaacaucaaccugaccgagcugacccuggcccuggagaacgagcugcuggugaccaagaacagcauccaccaggccgcccuggccagcuucaaggccgagaucagacaccugcuggagagaguggaccagguggugagagagaaggagaagcugagaagcgaccuggacaaggccgagaagcugaagagccugauggccagcgagguggacgaccaccacgccgccaucgagagaagaaacgaguacaaccugagaaagcuggacgaggaguacaaggagagaaucgccgcccugaagaacgagcugagaaaggagagagagcagauccugcagcaggccggcaagcagagacuggagcuggagcaggagaucgagaaggccaagaccgaggagaacuacaucagagacagacuggcccugagccugaaggagaacagcagacuggagaacgagcugcuggagaacgccgagaagcuggccgaguacgagaaccugaccaacaagcugcagagaaaccuggagaacgugcuggccgagaaguucggcgaccuggaccccagcagcgccgaguucuuccugcaggaggagagacugacccagaugagaaacgaguacgagagacagugcagagugcugcaggaccagguggacgagcugcagagcgagcuggaggaguacagagcccagggcagagugcugagacugccccugaagaacagccccagcgaggagguggaggccaacagcggcggcaucgagcccgagcacggccugggcagcgaggagugcaacccccugaacaugagcaucgaggccgagcuggugaucgagcagaugaaggagcagcaccacagagacaucugcugccugagacuggagcuggaggacaaggugagacacuacgagaagcagcuggacgagaccguggugagcugcaagaaggcccaggagaacaugaagcagagacacgagaacgagacccacacccuggagaagcagaucagcgaccugaagaacgagaucgccgagcugcagggccaggccgccgugcugaaggaggcccaccacgaggccaccugcagacacgaggaggagaagaagcagcugcaggugaagcuggaggaggagaagacccaccugcaggagaagcugagacugcagcacgagauggagcugaaggccagacugacccaggcccaggccagcuucgagagagagagagagggccugcagagcagcgccuggaccgaggagaaggugagaggccugacccaggagcuggagcaguuccaccaggagcagcugaccagccugguggagaagcacacccuggagaaggaggagcugagaaaggagcugcuggagaagcaccagagagagcugcaggagggcagauacgagagcgagaagcugcagcaggagaacagcauccugagaaacgagaucaccacccugaacgaggaggacagcaucagcaaccugaagcugggcacccugaacggcagccaggaggagauguggcagaagaccgagaccgugaagcaggagaacgccgccgugcagaagaugguggagaaccugaagaagcagaucagcgagcugaagaucaagaaccagcagcuggaccuggagaacaccgagcugagccagaagaacagccagaaccaggagaagcugcaggagcugaaccagagacugaccgagaugcugugccagaaggagaaggagcccggcaacagcgcccuggaggagagagagcaggagaaguucaaccugaaggaggagcuggagagaugcaaggugcagagcagcacccuggugagcagccuggaggccgagcugagcgaggugaagauccagacccacaucgugcagcaggagaaccaccugcugaaggacgagcuggagaagaugaagcagcugcacagaugccccgaccugagcgacuuccagcagaagaucagcagcgugcugagcuacaacgagaagcugcugaaggagaaggaggcccugagcgaggagcugaacagcugcguggacaagcuggccaagagcagccugcuggagcacagaaucgccaccaugaagcaggagcagaagagcugggagcaccagagcgccagccugaagagccagcugguggccagccaggagaaggugcagaaccuggaggacaccgugcagaacgugaaccugcagaugagcagaaugaagagcgaccugagagugacccagcaggagaaggaggcccugaagcaggaggugaugagccugcacaagcagcugcagaacgccggcggcaagagcugggcccccgagaucgccacccaccccagcggccugcacaaccagcagaagagacugagcugggacaagcuggaccaccugaugaacgaggagcagcagcugcuguggcaggagaacgagagacugcagaccauggugcagaacaccaaggccgagcugacccacagcagagagaaggugagacagcuggagagcaaccugcugcccaagcaccagaagcaccugaaccccagcggcaccaugaaccccaccgagcaggagaagcugagccugaagagagagugcgaccaguuccagaaggagcagagccccgccaacagaaaggugagccagaugaacagccuggagcaggagcuggagaccauccaccuggagaacgagggccugaagaagaagcaggugaagcuggacgagcagcugauggagaugcagcaccugagaagcaccgccacccccagccccagcccccacgccugggaccugcagcugcugcagcagcaggccugccccauggugcccagagagcaguuccugcagcugcagagacagcugcugcaggccgagagaaucaaccagcaccugcaggaggagcuggagaacagaaccagcgagaccaacaccccccagggcaaccaggagcagcuggugaccgugauggaggagagaaugaucgagguggagcagaagcugaagcuggugaagagacugcugcaggagaaggugaaccagcugaaggagcaggugagccugcccggccaccugugcagccccaccagccacagcagcuucaacagcagcuucaccagccuguacugccacuaa

SEQ ID NO: 20535 - RNA, 459 nt, Artificial Sequence
  NINJ1__Homo_sapiens__NP_004139
auggacagcggcaccgaggaguacgagcugaacggcggccugccccccggcacccccggcagccccgacgccagccccgccagauggggcuggagacacggccccaucaacgugaaccacuacgccagcaagaagagcgccgccgagagcaugcuggacaucgcccugcugauggccaacgccagccagcugaaggccgugguggagcagggccccagcuucgccuucuacgugccccugguggugcugaucagcaucagccuggugcugcagaucggcgugggcgugcugcugaucuuccuggugaaguacgaccugaacaaccccgccaagcacgccaagcuggacuuccugaacaaccuggccaccggccugguguucaucaucgugguggugaacaucuucaucaccgccuucggcgugcagaagccccugauggacauggccccccagcaguaa

SEQ ID NO: 20536 - RNA, 408 nt, Artificial Sequence
  NINJ2__Homo_sapiens__NP_001281274
augauguacaugcccggcagcagcgaccccagaagccagcccaucaaccugaaccacuacgccaccaagaagagcguggccgagagcaugcuggacguggcccuguucaugagcaacgccaugagacugaaggccgugcuggagcagggccccagcagccacuacuacaccacccuggugacccugaucagccugagccugcugcugcagguggugaucggcgugcugcugguggugaucgccagacugaaccugaacgagguggagaagcaguggagacugaaccagcugaacaacgccgccaccauccugguguucuucaccguggugaucaacguguucaucaccgccuucggcgcccacaagaccggcuuccuggccgccagagccagcagaaacccccuguaa

SEQ ID NO: 20537 - RNA, 4149 nt, Artificial Sequence
  NINL__Homo_sapiens__NP_079452
auggacgaggaggagaaccacuacgugagccagcugagagagguguacagcagcugcgacaccaccggcaccggcuuccuggacagacaggagcugacccagcugugccugaagcugcaccuggagcagcagcugcccgugcugcugcagacccugcugggcaacgaccacuucgccagagugaacuucgaggaguucaaggagggcuucguggccgugcugagcagcaacgccggcgugagacccagcgacgaggacagcagcagccuggagagcgccgccagcagcgccaucccccccaaguacgugaacggcagcaagugguacggcagaagaagcagacccgagcugugcgacgccgccaccgaggccagaagagugcccgagcagcagacccaggccagccugaagagccaccuguggagaagcgccagccuggagagcguggagagccccaagagcgacgaggaggccgagagcaccaaggaggcccagaacgagcuguucgaggcccagggccagcugcagaccugggacagcgaggacuucggcagcccccagaagagcugcagccccagcuucgacacccccgagagccagaucagaggcgugugggaggagcugggcgugggcagcagcggccaccugagcgagcaggagcuggccguggugugccagagcgugggccugcagggccuggagaaggaggagcuggaggaccuguucaacaagcuggaccaggacggcgacggcaaggugagccuggaggaguuccagcugggccuguucagccacgagcccgcccugcugcuggagagcagcaccagagugaagcccagcaaggccuggagccacuaccaggugcccgaggagagcggcugccacaccaccaccaccagcagccuggugagccugugcagcagccugagacuguucagcagcaucgacgacggcagcggcuucgccuuccccgaccaggugcuggccauguggacccaggagggcauccagaacggcagagagauccugcagagccuggacuucagcguggacgagaaggugaaccugcuggagcugaccugggcccuggacaacgagcugaugaccguggacagcgccgugcagcaggccgcccuggccugcuaccaccaggagcugagcuaccagcagggccagguggagcagcuggccagagagagagacaaggccagacaggaccuggagagagccgagaagagaaaccuggaguucgugaaggagauggacgacugccacagcacccuggagcagcugaccgagaagaagaucaagcaccuggagcagggcuacagagagagacugagccugcugagaagcgagguggaggccgagagagagcuguucugggagcaggcccacagacagagagccgcccuggagugggacgugggcagacugcaggccgaggaggccggccugagagagaagcugacccuggcccugaaggagaacagcagacugcagaaggagaucguggaggugguggagaagcugagcgacagcgagagacuggcccugaagcugcagaaggaccuggaguucgugcugaaggacaagcuggagccccagagcgccgagcugcuggcccaggaggagagauucgccgccgugcugaaggaguacgagcugaagugcagagaccugcaggacagaaacgacgagcugcaggccgagcuggagggccugugggccagacugcccaagaacagacacagccccagcuggagccccgacggcagaagaagacagcugcccggccugggccccgccggcaucagcuuccugggcaacagcgcccccgugagcaucgagaccgagcugaugauggagcaggugaaggagcacuaccaggaccugagaacccagcuggagaccaaggugaacuacuacgagagagagaucgccgcccugaagagaaacuucgagaaggagagaaaggacauggagcaggccagaagaagagaggugagcgugcuggagggccagaaggccgaccuggaggagcugcacgagaagagccaggaggugaucuggggccugcaggagcagcugcaggacaccgccagaggccccgagcccgagcagaugggccuggcccccugcugcacccaggcccugugcggccuggcccugagacaccacagccaccugcagcagaucagaagagaggccgaggccgagcugagcggcgagcugagcggccugggcgcccugcccgccagaagagaccugacccuggagcuggaggagcccccccagggcccccugcccagaggcagccagagaagcgagcagcuggagcuggagagagcccugaagcugcagcccugcgccagcgagaagagagcccagaugugcgugagccuggcccuggaggaggaggagcuggagcuggccagaggcaagagaguggacggccccagccuggaggccgagaugcaggcccugcccaaggacggccugguggccggcagcggccaggagggcaccagaggccugcugccccugagacccggcugcggcgagagaccccuggccuggcuggcccccggcgacggcagagagagcgaggaggccgccggcgccggccccagaagaagacaggcccaggacaccgaggccacccagagccccgcccccgcccccgcccccgccagccacggccccagcgagagauggagcagaaugcagcccugcggcguggacggcgacaucgugcccaaggagcccgagcccuucggcgccagcgccgccggccuggagcagcccggcgccagagagcugccccugcugggcaccgagagagacgccagccagacccagcccagaaugugggagcccccccugagacccgccgccagcugcagaggccaggccgagagacugcaggccauccaggaggagagagccagaagcuggagcagaggcacccaggagcaggccagcgagcagcaggccagagccgagggcgcccuggagcccggcugccacaagcacagcguggagguggccagaagaggcagccugcccagccaccugcagcuggccgacccccagggcagcuggcaggagcagcuggccgcccccgaggagggcgagaccaagaucgcccuggagagagagaaggacgacauggagaccaagcugcugcaccuggaggacguggugagagcccuggagaagcacguggaccugagagagaacgacagacuggaguuccacagacugagcgaggagaacacccugcugaagaacgaccugggcagagugagacaggagcuggaggccgccgagagcacccacgacgcccagagaaaggagaucgaggugcugaagaaggacaaggagaaggccugcagcgagauggaggugcugaacagacagaaccagaacuacaaggaccagcugagccagcugaacgugagagugcugcagcugggccaggaggccagcacccaccaggcccagaacgaggagcacagagugaccauccagaugcugacccagagccuggaggagguggugagaagcggccagcagcagagcgaccagauccagaagcugagaguggagcuggagugccugaaccaggagcaccagagccugcagcugcccuggagcgagcugacccagacccuggaggagagccaggaccaggugcagggcgcccaccugagacugagacaggcccaggcccagcaccugcaggaggugagacuggugccccaggacagaguggccgagcugcacagacugcugagccugcagggcgagcaggccagaagaagacuggacgcccagagagaggagcacgagaagcagcugaaggccaccgaggagagaguggaggaggccgagaugauccugaagaacauggagaugcugcugcaggagaagguggacaagcugaaggagcaguucgagaagaacaccaagagcgaccugcugcugaaggagcuguacguggagaacgcccaccuggugagagcccugcaggccaccgaggagaagcagagaggcgccgagaagcagagcagacugcuggaggagaaggugagagcccugaacaagcuggugagcagaaucgcccccgccgcccugagcguguaa

SEQ ID NO: 20538 - RNA, 765 nt, Artificial Sequence
  NIPA1__Homo_sapiens__NP_001135747
auggccgugggccagaucggcaacuuccuggccuacaccgccgugcccaccgugcuggugaccccccugggcgcccugggcgugcccuucggcagcauccuggccagcuaccugcugaaggagaagcugaacauccugggcaagcugggcugccugcugagcugcgccggcagcguggugcugaucauccacagccccaagagcgagagcgugaccacccaggccgagcuggaggagaagcugaccaaccccguguucgugggcuaccugugcaucgugcugcugaugcugcugcugcugaucuucuggaucgcccccgcccacggccccaccaacaucaugguguacaucagcaucugcagccugcugggcagcuucaccgugcccagcaccaagggcaucggccuggccgcccaggacauccugcacaacaaccccagcagccagagagcccugugccugugccuggugcugcuggccgugcugggcugcagcaucaucgugcaguucagauacaucaacaaggcccuggagugcuucgacagcagcguguucggcgccaucuacuacgugguguucaccacccuggugcugcuggccagcgccauccuguucagagaguggagcaacgugggccugguggacuuccugggcauggccugcggcuucaccaccgugagcgugggcaucgugcugauccagguguucaaggaguucaacuucaaccugggcgagaugaacaagagcaacaugaagaccgacuaa

SEQ ID NO: 20539 - RNA, 1083 nt, Artificial Sequence
  NIPA2__Homo_sapiens__NP_001008892
augagccagggcagaggcaaguacgacuucuacaucggccugggccuggccaugagcagcagcaucuucaucggcggcagcuucauccugaagaagaagggccugcugagacuggccagaaagggcagcaugagagccggccagggcggccacgccuaccugaaggaguggcuguggugggccggccugcugagcaugggcgccggcgagguggccaacuucgccgccuacgccuucgcccccgccacccuggugaccccccugggcgcccugagcgugcuggugagcgccauccugagcagcuacuuccugaacgagagacugaaccugcacggcaagaucggcugccugcugagcauccugggcagcaccgugauggugauccacgcccccaaggaggaggagaucgagacccugaacgagaugagccacaagcugggcgaccccggcuucgugguguucgccacccugguggugaucguggcccugauccugaucuucguggugggccccagacacggccagaccaacauccugguguacaucaccaucugcagcgugaucggcgccuucagcgugagcugcgugaagggccugggcaucgccaucaaggagcuguucgccggcaagcccgugcugagacacccccuggccuggauccugcugcugagccugaucgugugcgugagcacccagaucaacuaccugaacagagcccuggacaucuucaacaccagcaucgugacccccaucuacuacguguucuucaccaccagcgugcugaccugcagcgccauccuguucaaggaguggcaggacaugcccguggacgacgugaucggcacccugagcggcuucuucaccaucaucgugggcaucuuccugcugcacgccuucaaggacgugagcuucagccuggccagccugcccgugagcuucagaaaggacgagaaggccaugaacggcaaccugagcaacauguacgaggugcugaacaacaacgaggagagccugaccugcggcaucgagcagcacaccggcgagaacgugagcagaagaaacggcaaccugaccgccuucuaa

SEQ ID NO: 20540 - RNA, 1179 nt, Artificial Sequence
  NIPAL3__Homo_sapiens__XP_011540110
auggcccccaccggccugaccuucgccagcccccccagcgccgugagagaggagaaccugaucggcgcccugcuggccaucuucggccaccugguggugagcaucgcccugaaccugcagaaguacugccacaucagacuggccggcagcaaggaccccagagccuacuucaagaccaagaccugguggcugggccuguuccugaugcugcugggcgagcugggcguguucgccagcuacgccuucgccccccugagccugaucgugccccugagcgccgugagcgugaucgccagcgccaucaucggcaucaucuucaucaaggagaaguggaagcccaaggacuuccugagaagauacgugcugagcuucgugggcugcggccuggccguggugggcaccuaccugcuggugaccuucgcccccaacagccacgagaagaugaccggcgagaacgugaccagacaccuggugagcuggcccuuccugcuguacaugcugguggagaucauccuguucugccugcugcuguacuucuacaaggagaagaacgccaacaacaucguggugauccugcugcugguggcccugcugggcagcaugaccguggugaccgugaaggccguggccggcaugcuggugcugagcauccagggcaaccugcagcuggacuaccccaucuucuacgugauguucgugugcaugguggccaccgccguguaccaggccgccuuccugagccaggccagccagauguacgacagcagccugaucgccagcgugggcuacauccugagcaccaccaucgccaucaccgccggcgccaucuucuaccuggacuucaucggcgaggacgugcugcacaucugcauguucgcccugggcugccugaucgccuuccugggcguguuccugaucaccagaaacagaaagaagcccauccccuucgagcccuacaucagcauggacgccaugcccggcaugcagaacaugcacgacaagggcaugaccgugcagcccgagcugaaggccagcuucagcuacggcgcccuggagaacaacgacaacaucagcgagaucuacgcccccgccacccugcccgugaugcaggaggagcacggcagcagaagcgccagcggcgugcccuacagagugcuggagcacaccaagaaggaguaa

SEQ ID NO: 20541 - RNA, 1401 nt, Artificial Sequence
  NIPAL4__Homo_sapiens__NP_001092757
augcccggcgacagcagccccggcacccugccccugugggacgccagccugagccccccccugggccccgaccccggcggcuucagcagagccagccacgccggcgacaagagcagaccccccgcccccgagcugggcagccccggcgccgugagacccagagugggcagcugcgcccccggccccauggagcugagagugagcaacaccagcugcgagaacggcagccugcugcaccuguacugcagcagccaggaggugcugugccagaucgugaacgaccugagccccgaggugcccagcaacgccaccuuccacagcuggcaggagagaaucagacagaacuacggcuucuacaucggccugggccuggccuuccugagcagcuuccugaucggcagcagcgugauccugaagaagaagggccugcugagacugguggccaccggcgccaccagagccguggacggcggcuucggcuaccugaaggacgccauguggugggccggcuuccugaccauggccgccggcgagguggccaacuucggcgccuacgccuucgcccccgccaccguggugaccccccugggcgcccugagcgugcugaucagcgccauccugagcagcuacuuccugagagagagccugaaccugcugggcaagcugggcugcgugaucugcguggccggcagcaccgugauggugauccacgcccccgaggaggagaaggugaccaccaucauggagauggccagcaagaugaaggacaccggcuucaucguguucgccgugcugcugcuggugagcugccugauccugaucuucgugaucgcccccagauacggccagagaaacauccugaucuacaucaucaucugcagcgugaucggcgccuucagcguggccgccgugaagggccugggcaucaccaucaagaacuucuuccagggccugcccguggugagacacccccugcccuacauccugagccugauccuggcccugagccugagcacccaggugaacuuccugaacagagcccuggacaucuucaacaccagccugguguuccccaucuacuacguguucuucaccaccgugguggugaccagcagcaucauccuguucaaggagugguacagcaugagcgccguggacaucgccggcacccugagcggcuucgugaccaucauccugggcguguucaugcugcacgccuucaaggaccuggacaucagcugcgccagccugccccacaugcacaagaaccccccccccagccccgcccccgagcccaccgugaucagacuggaggacaagaacgugcugguggacaacaucgagcuggccagcaccagcagccccgaggagaagcccaagguguucaucauccacagcuaa

SEQ ID NO: 20542 - RNA, 8094 nt, Artificial Sequence
  NIPBL__Homo_sapiens__NP_056199
augaacggcgacaugccccacgugcccaucaccacccuggccggcaucgccagccugaccgaccugcugaaccagcugccccugcccagcccccugcccgccaccaccaccaagagccugcuguucaacgccagaaucgccgaggaggugaacugccugcuggccugcagagacgacaaccuggugagccagcuggugcacagccugaaccaggugagcaccgaccacaucgagcugaaggacaaccugggcagcgacgaccccgagggcgacauccccgugcugcugcaggccgugcuggccagaagccccaacguguucagagagaagagcaugcagaacagauacgugcagagcggcaugaugaugagccaguacaagcugagccagaacagcaugcacagcagccccgccagcagcaacuaccagcagaccaccaucagccacagccccagcagcagauucgugcccccccagaccagcagcggcaacagauucaugccccagcagaacagccccgugcccagccccuacgccccccagagccccgccggcuacaugcccuacagccaccccagcagcuacaccacccacccccagaugcagcaggccagcgugagcagccccaucguggccggcggccugagaaacauccacgacaacaaggugagcggcccccugagcggcaacagcgccaaccaccacgccgacaaccccagacacggcagcagcgaggacuaccugcacauggugcacagacugagcagcgacgacggcgacagcagcaccaugagaaacgccgccagcuucccccugagaagcccccagcccgugugcagccccgccggcagcgagggcacccccaagggcagcagacccccccugauccugcagagccagagccugcccugcagcagccccagagacgugccccccgacauccugcuggacagccccgagagaaagcagaagaagcagaagaagaugaagcugggcaaggacgagaaggagcagagcgagaaggccgccauguacgacaucaucagcagccccagcaaggacagcaccaagcugacccugagacugagcagagugagaagcagcgacauggaccagcaggaggacaugaucagcggcguggagaacagcaacgugagcgagaacgacauccccuucaacgugcaguaccccggccagaccagcaagacccccaucaccccccaggacaucaacagaccccugaacgccgcccagugccugagccagcaggagcagaccgccuuccugcccgccaaccaggugcccgugcugcagcagaacaccagcguggccgccaagcagccccagaccagcguggugcagaaccagcagcagaucagccagcagggccccaucuacgacgagguggagcuggacgcccuggccgagaucgagagaaucgagagagagagcgccaucgagagagagagauucagcaaggaggugcaggacaaggacaagccccugaagaagagaaagcaggacagcuacccccaggaggccggcggcgccaccggcggcaacagacccgccagccaggagaccggcagcaccggcaacggcagcagacccgcccugauggugagcaucgaccugcaccaggccggcagaguggacagccaggccagcaucacccaggacagcgacagcaucaagaagcccgaggagaucaagcagugcaacgacgcccccgugagcgugcugcaggaggacaucgugggcagccugaagagcacccccgagaaccaccccgagacccccaagaagaagagcgaccccgagcugagcaagagcgagaugaagcagagcgagagcagacuggccgagagcaagcccaacgagaacagacugguggagaccaagagcagcgagaacaagcuggagaccaagguggagacccagaccgaggagcugaagcagaacgagagcagaaccaccgagugcaagcagaacgagagcaccaucguggagcccaagcagaacgagaacagacugagcgacaccaagcccaacgacaacaagcagaacaacggcagaagcgagaccaccaagagcagacccgagacccccaagcagaagggcgagagcagacccgagacccccaagcagaagagcgacggccaccccgagacccccaagcagaagggcgacggcagacccgagacccccaagcagaagggcgagagcagacccgagacccccaagcagaagaacgagggcagacccgagacccccaagcacagacacgacaacagaagagacagcggcaagcccagcaccgagaagaagcccgaggugagcaagcacaagcaggacaccaagagcgacagccccagacugaagagcgagagagccgaggcccugaagcagagacccgacggcagaagcgugagcgagagccugagaagagaccacgacaacaagcagaagagcgacgacagaggcgagagcgagagacacagaggcgaccagagcagagugagaagacccgagacccugagaagcagcagcagaaacgagcacggcaucaagagcgacagcagcaagaccgacaagcuggagagaaagcacagacacgagagcggcgacagcagagagagacccagcagcggcgagcagaagagcagacccgacagccccagagugaagcagggcgacagcaacaagagcagaagcgacaagcugggcuucaagagccccaccagcaaggacgacaagagaaccgagggcaacaagagcaagguggacaccaacaaggcccaccccgacaacaaggccgaguuccccagcuaccugcugggcggcagaagcggcgcccugaagaacuucgugauccccaagaucaagagagacaaggacggcaacgugacccaggagaccaagaagauggagaugaagggcgagcccaaggacaagguggagaagaucggccugguggaggaccugaacaagggcgccaagcccgugguggugcugcagaagcugagccuggacgacgugcagaagcugaucaaggacagagaggacaagagcagaagcagccugaagcccaucaagaacaagcccagcaagagcaacaagggcagcaucgaccagagcgugcugaaggagcugccccccgagcugcuggccgagaucgagagcaccaugccccugugcgagagagugaagaugaacaagagaaagagaagcaccgugaacgagaagcccaaguacgccgagaucagcagcgacgaggacaacgacagcgacgaggccuucgagagcagcagaaagagacacaagaaggacgacgacaaggccugggaguacgaggagagagacagaagaagcagcggcgaccacagaagaagcggccacagccacgagggcagaagaagcagcggcggcggcagauacagaaacagaagccccagcgacagcgacauggaggacuacagccccccccccagccugagcgagguggccagaaagaugaagaagaaggagaagcagaagaagagaaaggccuacgagcccaagcugacccccgaggagaugauggacagcagcaccuucaagagauucaccgccagcaucgagaacauccuggacaaccuggaggacauggacuucaccgccuucggcgacgacgacgagaucccccaggagcugcugcugggcaagcaccagcugaacgagcugggcagcgagagcgccaagaucaaggccaugggcaucauggacaagcugagcaccgacaagaccgugaaggugcugaacauccuggagaagaacauccaggacggcagcaagcugagcacccugcugaaccacaacaacgacaccgaggaggaggagagacuguggagagaccugaucauggagagagugaccaagagcgccgacgccugccugaccaccaucaacaucaugaccagccccaacaugcccaaggccguguacaucgaggacgugaucgagagagugauccaguacaccaaguuccaccugcagaacacccuguacccccaguacgaccccguguacagacuggacccccacggcggcggccugcugagcagcaaggccaagagagccaagugcagcacccacaagcagagagugaucgugaugcuguacaacaaggugugcgacaucgugagcagccugagcgagcugcuggagauccagcugcugaccgacaccaccauccugcaggugagcagcaugggcaucacccccuucuucguggagaacgugagcgagcugcagcugugcgccaucaagcuggugaccgccguguucagcagauacgagaagcacagacagcugauccuggaggagaucuucaccagccuggccagacugcccaccagcaagagaagccugagaaacuucagacugaacagcagcgacauggacggcgagcccauguacauccagauggugaccgcccuggugcugcagcugauccagugcguggugcaccugcccagcagcgagaaggacagcaacgccgaggaggacagcaacaagaagaucgaccaggacguggugaucaccaacagcuacgagaccgccaugagaaccgcccagaacuuccugagcaucuuccugaagaagugcggcagcaagcagggcgaggaggacuacagaccccuguucgagaacuucgugcaggaccugcugagcaccgugaacaagcccgaguggcccgccgccgagcugcugcugagccugcugggcagacugcuggugcaccaguucagcaacaagagcaccgagauggcccugagaguggccagccuggacuaccugggcaccguggccgccagacugagaaaggacgccgugaccagcaagauggaccagggcagcaucgagagaauccugaagcaggugagcggcggcgaggacgagauccagcagcugcagaaggcccugcuggacuaccuggacgagaacaccgagaccgaccccagccugguguucagcagaaaguucuacaucgcccagugguucagagacaccacccuggagaccgagaaggccaugaagagccagaaggacgaggagagcagcgagggcacccaccacgccaaggagaucgagaccaccggccagaucaugcacagagccgagaacagaaagaaguuccugagaagcaucaucaagaccacccccagccaguucagcacccugaagaugaacagcgacaccguggacuacgacgacgccugccugaucgugagauaccuggccagcaugagacccuucgcccagagcuucgacaucuaccugacccagauccugagagugcugggcgagaacgccaucgccgugagaaccaaggccaugaagugccugagcgaggugguggccguggaccccagcauccuggccagacuggacaugcagagaggcgugcacggcagacugauggacaacagcaccagcgugagagaggccgccguggagcugcugggcagauucgugcugugcagaccccagcuggccgagcaguacuacgacaugcugaucgagagaauccuggacaccggcaucagcgugagaaagagagugaucaagauccugagagacaucugcaucgagcagcccaccuuccccaagaucaccgagaugugcgugaagaugaucagaagagugaacgacgaggagggcaucaagaagcuggugaacgagaccuuccagaagcugugguucacccccaccccccacaacgacaaggaggccaugaccagaaagauccugaacaucaccgacgugguggccgccugcagagacaccggcuacgacugguucgagcagcugcugcagaaccugcugaagagcgaggaggacagcagcuacaagcccgugaagaaggccugcacccagcugguggacaaccugguggagcacauccugaaguacgaggagagccuggccgacagcgacaacaagggcgugaacagcggcagacugguggccugcaucaccacccuguuccuguucagcaagaucagaccccagcugauggugaagcacgccaugaccaugcagcccuaccugaccaccaagugcagcacccagaacgacuucauggugaucugcaacguggccaagauccuggagcugguggugccccugauggagcaccccagcgagaccuuccuggccaccaucgaggaggaccugaugaagcugaucaucaaguacggcaugaccguggugcagcacugcgugagcugccugggcgccguggugaacaaggugacccagaacuucaaguucgugugggccugcuucaacagauacuacggcgccaucagcaagcugaagagccagcaccaggaggaccccaacaacaccagccugcugaccaacaagcccgcccugcugagaagccuguucaccgugggcgcccugugcagacacuucgacuucgaccuggaggacuucaagggcaacagcaaggugaacaucaaggacaaggugcuggagcugcugauguacuucaccaagcacagcgacgaggaggugcagaccaaggccaucaucggccugggcuucgccuucauccagcaccccagccugauguucgagcaggaggugaagaaccuguacaacaacauccugagcgacaagaacagcagcgugaaccugaagauccaggugcugaagaaccugcagaccuaccugcaggaggaggacaccagaaugcagcaggccgacagagacuggaagaagguggccaagcaggaggaccugaaggagaugggcgacgugagcagcggcaugagcagcagcaucaugcagcuguaccugaagcaggugcuggaggccuucuuccacacccagagcagcgugagacacuucgcccugaacgugaucgcccugacccugaaccagggccugauccaccccgugcagugcgugcccuaccugaucgccaugggcaccgaccccgagcccgccaugagaaacaaggccgaccagcagcugguggagaucgacaagaaguacgccggcuucauccacaugaaggccguggccggcaugaagaugagcuaccaggugcagcaggccaucaacaccugccugaaggaccccgugagaggcuucagacaggacgagagcagcagcgcccugugcagccaccuguacagcaugaucagaggcaacagacagcacagaagagccuuccugaucagccugcugaaccuguucgacgacaccgccaagaccgacgugaccaugcugcuguacaucgccgacaaccuggccugcuuccccuaccagacccaggaggagccccuguucaucaugcaccacaucgacaucacccugagcgugagcggcagcaaccugcugcagagcuucaaggagagcauggugaaggacaagagaaaggagagaaagagcagccccagcaaggagaacgagagcagcgacagcgaggaggaggugagcagacccagaaagagcagaaagagaguggacagcgacagcgacagcgacagcgaggacgacaucaacagcgugaugaagugccugcccgagaacagcgccccccugaucgaguucgccaacgugagccagggcauccugcugcugcugaugcugaagcagcaccugaagaaccugugcggcuucagcgacagcaagauccagaaguacagccccagcgagagcgccaagguguacgacaaggccaucaacagaaagaccggcgugcacuuccaccccaagcagacccuggacuuccugagaagcgacauggccaacagcaagaucaccgaggaggugaagagaagcaucgugaagcaguaccuggacuucaagcugcugauggagcaccuggaccccgacgaggaggaggaggagggcgaggugagcgccagcaccaacgccagaaacaaggccaucaccagccugcugggcggcggcagccccaagaacaacaccgccgccgagaccgaggacgacgagagcgacggcgaggacagaggcggcggcaccagcggcgugagaagaagaagaagccagagaaucagccagagaaucaccuaa

SEQ ID NO: 20543 - RNA, 855 nt, Artificial Sequence
  NIPSNAP1__Homo_sapiens__NP_003625
auggcccccagacugugcagcaucagcgugaccgccagaagacugcugggcggccccggccccagagccggcgacguggccagcgccgccgccgccagauucuacagcaaggacaacgagggcagcugguucagaagccuguucgugcacaagguggaccccagaaaggacgcccacagcacccugcugagcaagaaggagaccagcaaccuguacaagauccaguuccacaacgugaagcccgaguaccuggacgccuacaacagccugaccgaggccgugcugcccaagcugcaccuggacgaggacuaccccugcagccuggugggcaacuggaacaccugguacggcgagcaggaccaggccgugcaccuguggagauucagcggcggcuaccccgcccugauggacugcaugaacaagcugaagaacaacaaggaguaccuggaguucagaagagagagaagccagaugcugcugagcagaagaaaccagcugcugcuggaguucagcuucuggaacgagccccagcccagaaugggccccaacaucuacgagcugagaaccuacaagcugaagcccggcaccaugaucgaguggggcaacaacugggccagagccaucaaguacagacaggagaaccaggaggccgugggcggcuucuucagccagaucggcgagcuguacguggugcaccaccugugggccuacaaggaccugcagagcagagaggagaccagaaacgccgccuggagaaagagaggcugggacgagaacguguacuacaccgugccccuggugagacacauggagagcagaaucaugaucccccugaagaucagcccccugcaguaa

SEQ ID NO: 20544 - RNA, 744 nt, Artificial Sequence
  NIPSNAP3B__Homo_sapiens__NP_060846
augcuggugcugagaagcggccugaccaaggcccuggccagcagaacccuggccccccaggugugcagcagcuucgccaccggccccagacaguacgacggcaccuucuacgaguucagaaccuacuaccugaagcccagcaacaugaacgccuucauggagaaccugaagaagaacauccaccugagaaccagcuacagcgagcuggugggcuucuggagcguggaguucggcggcagaaccaacaagguguuccacaucuggaaguacgacaacuucgcccacagagccgaggugagaaaggcccuggccaacugcaaggaguggcaggagcagagcaucauccccaaccuggccagaaucgacaagcaggagaccgagaucaccuaccugauccccuggagcaagcuggagaagccccccaaggagggcguguacgagcuggccguguuccagaugaagcccggcggccccgcccuguggggcgacgccuucgagagagccaucaacgcccacgugaaccugggcuacaccaagguggugggcguguuccacaccgaguacggcgagcugaacagagugcacgugcugugguggaacgagagcgccgacagcagagccgccggcagacacaagagccacgaggaccccagagugguggccgccgugagagagagcgugaacuaccuggugagccagcagaacaugcugcugauccccgccagcuucagcccccugaaguaa

SEQ ID NO: 20545 - RNA, 1752 nt, Artificial Sequence
  NISCH__Homo_sapiens__NP_001263222
auggccaccgccagaaccuucggccccgagagagaggccgagcccgccaaggaggccagaguggugggcagcgagcugguggacaccuacaccguguacaucauccaggugaccgacggcagccacgaguggaccgugaagcacagauacagcgacuuccacgaccugcacgagaagcugguggccgagagaaagaucgacaagaaccugcugccccccaagaagaucaucggcaagaacagcagaagccugguggagaagagagagaaggaccuggagguguaccugcagaagcugcuggccgccuuccccggcgugacccccagagugcuggcccacuuccugcacuuccacuucuacgagaucaacggcaucaccgccgcccuggccgaggagcuguucgagaagggcgagcagcugcugggcgccggcgagguguucgccaucggcccccugcagcuguacgccgugaccgagcagcugcagcagggcaagcccaccugcgccagcggcgacgccaagaccgaccugggccacauccuggacuucaccugcagacugaaguaccugaaggugagcggcaccgagggccccuucggcaccagcaacauccaggagcagcugcugcccuucgaccugagcaucuucaagagccugcaccagguggagaucagccacugcgacgccaagcacaucagaggccugguggccagcaagcccacccuggccacccugagcgugagauucagcgccaccagcaugaaggaggugcuggugcccgaggccagcgaguucgacgagugggagcccgagggcaccacccuggagggccccgugaccgccgugauccccaccuggcaggcccugaccacccuggaccugagccacaacagcaucagcgagaucgacgagagcgugaagcugauccccaagaucgaguuccuggaccugagccacaacggccugcuggugguggacaaccugcagcaccuguacaaccuggugcaccuggaccugagcuacaacaagcugagcagccuggagggccugcacaccaagcugggcaacaucaagacccugaaccuggccggcaaccugcuggagagccugagcggccugcacaagcuguacagccuggugaaccuggaccugagagacaacagaaucgagcagauggaggaggugagaagcaucggcagccugcccugccuggagcacgugagccugcugaacaacccccugagcaucauccccgacuacagaaccaaggugcuggcccaguucggcgagagagccagcgaggugugccuggacgacaccgugaccaccgagaaggagcuggacaccguggaggugcugaaggccauccagaaggccaaggaggugaagagcaagcugagcaaccccgagaagaagggcggcgaggacagcagacugagcgccgcccccugcaucagacccagcagcagcccccccaccguggcccccgccagcgccagccugccccagcccauccugagcaaccagggcaacagagugugcauccugcugcugguggagccccacagccccgccugggcccccuggcugggcuggggcuggggcagaggcgccagcaccugcuuccagcagggccagacccagggcggccagugccugcugcaggccggccccagaggcggcacccacggcagaggcgccuggcccgacgccagcugcugccugcugggcgaggacagccagcugcuguaa

SEQ ID NO: 20546 - RNA, 732 nt, Artificial Sequence
  NIT1__Homo_sapiens__NP_001172021
augcugggcuucaucaccagacccccccacagauuccugagccugcugugccccggccugagaaucccccagcugagcgugcugugcgcccagcccagacccagagccauggccaucagcagcagcagcugcgagcugccccugguggccgugugccaggugaccagcacccccgacaagcagcagaacuucaagaccugcgccgagcuggugagagaggccgccagacugggcgccugccuggccuuccugcccgaggccuucgacuucaucgccagagaccccgccgagacccugcaccugagcgagccccugggcggcaagcugcuggaggaguacacccagcuggccagagagugcggccuguggcugagccugggcggcuuccacgagagaggccaggacugggagcagacccagaagaucuacaacugccacgugcugcugaacagcaagggcgccgugguggccaccuacagaaagacccaccugugcgacguggagauccccggccagggccccaugugcgagagcaacagcaccaugcccggccccagccuggagagccccgugagcacccccgccggcaagaucggccuggccgugugcuacgacaugagauuccccgagcugagccuggcccuggcccaggccggcgccgagauccugaccuaccccagcgccuucggcagcaucaccggccccgcccacugggagcccgugagcagcuaa

SEQ ID NO: 20547 - RNA, 831 nt, Artificial Sequence
  NIT2__Homo_sapiens__NP_064587
augaccagcuucagacuggcccugauccagcugcagaucagcagcaucaagagcgacaacgugaccagagccugcagcuucaucagagaggccgccacccagggcgccaagaucgugagccugcccgagugcuucaacagccccuacggcgccaaguacuuccccgaguacgccgagaagauccccggcgagagcacccagaagcugagcgagguggccaaggagugcagcaucuaccugaucggcggcagcauccccgaggaggacgccggcaagcuguacaacaccugcgccguguucggccccgacggcacccugcuggccaaguacagaaagauccaccuguucgacaucgacgugcccggcaagaucaccuuccaggagagcaagacccugagccccggcgacagcuucagcaccuucgacacccccuacugcagagugggccugggcaucugcuacgacaugagauucgccgagcuggcccagaucuacgcccagagaggcugccagcugcugguguaccccggcgccuucaaccugaccaccggccccgcccacugggagcugcugcagagaagcagagccguggacaaccagguguacguggccaccgccagccccgccagagacgacaaggccagcuacguggccuggggccacagcaccguggugaaccccuggggcgaggugcuggccaaggccggcaccgaggaggccaucguguacagcgacaucgaccugaagaagcuggccgagaucagacagcagauccccguguucagacagaagagaagcgaccuguacgccguggagaugaagaagcccuaa

SEQ ID NO: 20548 - RNA, 627 nt, Artificial Sequence
  NKAIN2__Homo_sapiens__NP_001035304
augggcuacugcagcggcagaugcacccugaucuucaucugcggcaugcagcuggugugcgugcuggagagacagaucuucgacuuccugggcuaccagugggcccccauccuggccaacuucgugcacaucaucaucgugauccugggccuguucggcaccauccaguacagacccagauacaucaccggcuacgccguguggcuggugcugugggugaccuggaacguguucgugaucugcuucuaccuggaggccggcgaccugagcaaggagaccgaccugauccugaccuucaacaucagcaugcacagaagcugguggauggagaacggccccggcugcaccgugaccagcgugacccccgcccccgacugggcccccgaggaccacagauacaucaccgugagcggcugccugcuggaguaccaguacaucgagguggcccacagcagccugcagaucgugcuggcccuggccggcuucaucuacgccugcuacguggugaagugcaucaccgaggaggaggacagcuucgacuucaucggcggcuucgacagcuacggcuaccagggcccccagaagaccagccaccugcagcugcagcccauguacaugagcaaguaa

SEQ ID NO: 20549 - RNA, 657 nt, Artificial Sequence
  NKAIN3__Homo_sapiens__NP_001291462
augggcugcugcaccggcagaugcagccugaucugccugugcgcccugcagcuggugagcgcccuggagagacagaucuucgacuuccugggcuuccagugggcccccauccugggcaacuuccugcacaucaucguggugauccugggccuguucggcaccauccaguacagacccagauacaucaugguguacaccguguggaccgcccugugggugaccuggaacguguucaucaucugcuucuaccuggaggugggcggccugagcaaggacaccgaccugaugaccuucaacaucagcgugcacagaagcugguggagagagcacggccccggcugcgugagaagagugcugccccccagcgcccacggcaugauggacgacuacaccuacgugagcgugaccggcugcaucguggacuuccaguaccuggaggugauccacagcgccgugcagauccugcugagccuggugggcuucguguacgccugcuacgugaucagcaucagcauggaggaggaggacaccuucgacuucaucggcggccuggacacccacagcuacuaccaggaccacguggagcugaagcccgugaagcccguggagaucagcaacgacaucgagcccgagaugagacugcugaaccugaccuaa

SEQ ID NO: 20550 - RNA, 1248 nt, Artificial Sequence
  NKAP__Homo_sapiens__NP_078804
auggcccccgugagcggcagcagaagccccgacagagaggccagcggcagcggcggcagaagaagaagcagcagcaagagccccaagcccagcaagagcgccagaagccccagaggcagaagaagcagaagccacagcugcagcagaagcggcgacagaaacggccugacccaccagcugggcggccugagccagggcagcagaaaccagagcuacagaagcagaagcagaagcagaagcagagagagacccagcgcccccagaggcauccccuucgccagcgccagcagcagcguguacuacggcagcuacagcagacccuacggcagcgacaagcccuggcccagccugcuggacaaggagagagaggagagccugagacagaagagacugagcgagagagagagaaucggcgagcugggcgcccccgagguguggggccugagccccaagaaccccgagcccgacagcgacgagcacacccccguggaggacgaggagcccaagaagagcaccaccagcgccagcaccagcgaggaggagaagaagaagaagagcagcagaagcaaggagagaagcaagaagagaagaaagaagaagagcagcaagagaaagcacaagaaguacagcgaggacagcgacagcgacagcgacagcgagaccgacagcagcgacgaggacaacaagagaagagccaagaaggccaagaagaaggagaagaagaagaagcacagaagcaagaaguacaagaagaagagaagcaagaagagcagaaaggagagcagcgacagcagcagcaaggagagccaggaggaguuccuggagaaccccuggaaggacagaaccaaggccgaggagcccagcgaccugaucggccccgaggcccccaagacccugaccagccaggacgacaagccccugaacuacggccacgcccugcugcccggcgagggcgccgccauggccgaguacgugaaggccggcaagagaauccccagaagaggcgagaucggccugaccagcgaggagaucgccagcuucgagugcagcggcuacgugaugagcggcagcagacacagaagaauggaggccgugagacugagaaaggagaaccagaucuacagcgccgacgagaagagagcccuggccagcuucaaccaggaggagagaagaaagagagagaacaagauccuggccagcuucagagagaugguguacagaaagaccaagggcaaggacgacaaguaa

SEQ ID NO: 20551 - RNA, 1413 nt, Artificial Sequence
  NKD1__Homo_sapiens__NP_149110
augggcaagcugcacagcaagcccgccgccgugugcaagagaagagagagccccgagggcgacagcuucgccgugagcgccgccugggccagaaagggcaucgaggaguggaucggcagacagagaugccccggcggcgugagcggccccagacagcugagacuggccggcaccaucggcagaagcaccagagagcuggugggcgacgugcugagagacacccugagcgaggaggaggaggacgacuucagacuggagguggcccugccccccgagaagaccgacggccugggcagcggcgacgagaagaagauggagagagugagcgagcccugccccggcagcaagaagcagcugaaguucgaggagcugcagugcgacgugagcauggaggaggacagcagacaggaguggaccuucacccuguacgacuucgacaacaacggcaaggugaccagagaggacaucaccagccugcugcacaccaucuacgaggugguggacagcagcgugaaccacagccccaccagcagcaagaugcugagagugaagcugaccguggcccccgacggcagccagagcaagagaagcgugcuggugaaccaggccgaccugcagagcgccagacccagagccgagaccaagcccaccgaggaccugagaagcugggagaagaagcagagagccccccugagauuccagggcgacagcagacuggagcagagcggcugcuaccaccacugcguggacgagaacaucgagagaagaaaccacuaccuggaccuggccggcaucgagaacuacaccagccaguucggccccggcagccccagcguggcccagaagagcgagcugccccccagaaccagcaaccccaccagaagcagaagccacgagcccgaggccauccacaucccccacagaaagccccagggcguggaccccgccagcuuccacuuccuggacacccccaucgccaaggugagcgagcugcagcagagacugagaggcacccaggacggcagcaagcacuucgugagaagccccaaggcccagggcaagagcgugggcgugggccacguggccagaggcgccagaaacaagcccccccugggccccgccauccccgccgugagccccagcgcccaccuggccgccagccccgcccugcugcccagccuggccccccugggccacaagaagcacaagcacagagccaaggagagccagcagggcugcagaggccugcaggccccccuggccagcggcggccccgugcugggcagagagcaccugagagagcugcccgcccuggugguguacgagagccaggccggccagcccgugcagagacacgagcaccaccaccaccacgagcaccaccaccacuaccaccacuucuaccagaccuaa

SEQ ID NO: 20552 - RNA, 936 nt, Artificial Sequence
  NKD2__Homo_sapiens__NP_001258011
augggcaagcugcagagcaagcacgccgccgccgccagaaagagaagagagagccccgagggcgacagcuucguggccagcgccuacgccagcggcagaaagggcgccgaggaggccgagagaagagccagagacaagcaggagcugcccaacggcgaccccaaggagggccccuucagagaggaccagugcccccugcagguggcccugcccgccgagaaggccgagggcagagagcaccccggccagcugcugagcgccgacgacggcgagagagccgccaacagagagggccccagaggccccggcggccagagacugaacaucgacgcccugcagugcgacgugagcguggaggaggacgacagacaggaguggaccuucacccuguacgacuucgacaacugcggcaaggugaccagagaggacaugagcagccugaugcacaccaucuacgaggugguggacgccagcgugaaccacagcagcggcagcagcaagacccugagagugaagcugaccgugagccccgagcccagcagcaagagaaaggagggcccccccgccggccaggacagagagcccaccagaugcagaauggagggcgagcuggccgaggagcccagaguggccgacagaagacugagcgcccacgugagaagacccagcaccgacccccagcccugcagcgagagaggccccuacugcguggacgagaacaccgagagaagaaaccacuaccuggaccuggccggcaucgagaacuacaccagcagauucggccccggcagccagcugugcgagaagagaagcagcgcccccagaacccacagcggcgacaaggccagaggcgugggccugugcagagagcuguggagccaggccggccacccccaguggcccggccccuuccccagcggccugguggccguguaa

SEQ ID NO: 20553 - RNA, 498 nt, Artificial Sequence
  NKG7__Homo_sapiens__NP_005592
auggagcugugcagaagccuggcccugcugggcggcagccugggccugauguucugccugaucgcccugagcaccgacuucugguucgaggccgugggccccacccacagcgcccacagcggccuguggcccaccggccacggcgacaucaucagcggcuacauccacgugacccagaccuucagcaucauggccgugcugugggcccuggugagcgugagcuuccuggugcugagcugcuuccccagccuguucccccccggccacggcccccuggugagcaccaccgccgccuucgccgccgccaucagcauggugguggccauggccguguacaccagcgagagaugggaccagcccccccacccccagauccagaccuucuucagcuggagcuucuaccugggcugggugagcgccauccugcugcugugcaccggcgcccugagccugggcgcccacugcggcggccccagacccggcuacgagacccuguaa

SEQ ID NO: 20554 - RNA, 579 nt, Artificial Sequence
  NKIRAS1__Homo_sapiens__NP_065078
augggcaagggcugcaaggugguggugugcggccugcugagcgugggcaagaccgccauccuggagcagcugcuguacggcaaccacaccaucggcauggaggacugcgagaccauggaggacguguacauggccagcguggagaccgacagaggcgugaaggagcagcugcaccuguacgacaccagaggccugcaggagggcguggagcugcccaagcacuacuucagcuucgccgacggcuucgugcugguguacagcgugaacaaccuggagagcuuccagagaguggagcugcugaagaaggagaucgacaaguucaaggacaagaaggagguggccaucguggugcugggcaacaagaucgaccugagcgagcagagacagguggacgccgagguggcccagcagugggccaagagcgagaaggugagacugugggaggugaccgugaccgacagaaagacccugaucgagcccuucacccugcuggccagcaagcugagccagccccagagcaagagcagcuucccccugcccggcagaaagaacaagggcaacagcaacagcgagaacuaa

SEQ ID NO: 20555 - RNA, 408 nt, Artificial Sequence
  NKIRAS2__Homo_sapiens__NP_001138400
augggcaagagcugcaaggugguggugugcggccaggccagcgugggcaagaccagcauccuggagcagcugcuguacggcaaccacguggugggcagcgagaugaucgagacccaggaggacaucuacgugggcagcaucgagaccgacagaggcgugagagagcaggugaccaucguggugcugggcaacaagugcgaccugcaggagcagagaagaguggaccccgacguggcccagcacugggccaagagcgagaaggugaagcugugggaggugagcguggccgacagaagaagccugcuggagcccuucguguaccuggccagcaagaugacccagccccagagcaagagcgccuucccccugagcagaaagaacaagggcagcggcagccuggacggcuaa

SEQ ID NO: 20556 - RNA, 2118 nt, Artificial Sequence
  NKRF__Homo_sapiens__NP_001166958
augggcuucaugcugccccugaucuucagauacagccccagacugauggagaagauccugcagauggccgagggcaucgacaucggcgagaugcccagcuacgaccuggugcugagcaagcccagcaagggccagaagagacaccugagcaccugcgacggccagaacccccccaagaagcaggccggcagcaaguuccacgccagacccagauucgagcccgugcacuucguggccagcagcagcaaggacgagagacaggaggaccccuacggcccccagaccaaggaggugaacgagcagacccacuucgccagcaugcccagagacaucuaccaggacuacacccaggacagcuucagcauccaggacggcaacagccaguacugcgacagcagcggcuucauccugaccaaggaccagcccgugaccgccaacauguacuucgacagcggcaaccccgcccccagcaccaccagccagcaggccaacagccagagcacccccgagcccagccccagccagaccuuccccgagagcgugguggccgagaagcaguacuucaucgagaagcugaccgccaccaucuggaagaaccugagcaaccccgagaugaccagcggcagcgacaagaucaacuacaccuacaugcugaccagaugcauccaggccugcaagaccaaccccgaguacaucuacgccccccugaaggagaucccccccgccgacauccccaagaacaagaagcugcugaccgacggcuacgccugcgaggugagaugccagaacaucuaccugaccaccggcuacgccggcagcaagaacggcagcagagacagagccaccgagcuggccgugaagcugcugcagaagagaaucgaggugagaguggugagaagaaaguucaagcacaccuucggcgaggaccugguggugugccagaucggcaugagcagcuacgaguucccccccgcccugaagccccccgaggaccugguggugcugggcaaggacgccagcggccagcccaucuucaacgccagcgccaagcacuggaccaacuucgugaucaccgagaacgccaacgacgccaucggcauccugaacaacagcgccagcuucaacaagaugagcaucgaguacaaguacgagaugaugcccaacagaaccuggagaugcagaguguuccugcaggaccacugccuggccgagggcuacggcaccaagaagaccagcaagcacgccgccgccgacgaggcccugaagauccugcagaagacccagcccaccuaccccagcgugaagagcagccagugccacaccggcagcagccccagaggcagcggcaagaagaaggacaucaaggaccuggugguguacgagaacagcagcaaccccgugugcacccugaacgacaccgcccaguucaacagaaugaccguggaguacguguacgagagaaugaccggccugagauggaagugcaaggugauccuggagagcgaggugaucgccgaggccgugggcgugaagaagaccgugaaguacgaggccgccggcgaggccgugaagacccugaagaagacccagcccaccgugaucaacaaccugaagaagggcgccguggaggacgugaucagcagaaacgagauccagggcagaagcgccgaggaggccuacaagcagcagaucaaggaggacaacaucggcaaccagcugcugagaaagaugggcuggaccggcggcggccugggcaagagcggcgagggcaucagagagcccaucagcgugaaggagcagcacaagagagagggccugggccuggacguggagagagugaacaagaucgccaagagagacaucgagcagaucaucagaaacuacgccagaagcgagagccacaccgaccugaccuucagcagagagcugaccaacgacgagagaaagcagauccaccagaucgcccagaaguacggccugaagagcaagagccacggcgugggccacgacagauaccugguggugggcagaaagagaagaaaggaggaccugcuggaccagcugaagcaggagggccaggugggccacuacgagcuggugaugccccaggccaacuaa

SEQ ID NO: 20557 - RNA, 4389 nt, Artificial Sequence
  NKTR__Homo_sapiens__NP_005376
augggcgcccaggacagaccccagugccacuucgacaucgagaucaacagagagcccgugggcagaaucauguuccagcuguucagcgacaucugccccaagaccugcaagaacuuccugugccugugcagcggcgagaagggccugggcaagaccaccggcaagaagcugugcuacaagggcagcaccuuccacagaguggugaagaacuucaugauccagggcggcgacuucagcgagggcaacggcaagggcggcgagagcaucuacggcggcuacuucaaggacgagaacuucauccugaagcacgacagagccuuccugcugagcauggccaacagaggcaagcacaccaacggcagccaguucuucaucaccaccaagcccgccccccaccuggacggcgugcacgugguguucggccuggugaucagcggcuucgaggugaucgagcagaucgagaaccugaagaccgacgccgccagcagacccuacgccgacgugagagugaucgacugcggcgugcuggccaccaagagcaucaaggacguguucgagaagaagagaaagaagcccacccacagcgagggcagcgacagcagcagcaacagcagcagcagcagcgagagcagcagcgagagcgagcuggagcacgagagaagcagaagaagaaagcacaagagaagacccaaggugaagagaagcaagaagagaagaaaggaggccagcagcagcgaggagcccagaaacaagcacgccaugaaccccaagggccacagcgagagaagcgacaccaacgagaagagaagcguggacagcagcgccaagagagagaagcccguggugagacccgaggagaucccccccgugcccgagaacagauuccugcugagaagagacaugcccguggugaccgccgagcccgagcccaagauccccgacguggcccccaucgugagcgaccagaagcccagcgugagcaagagcggcagaaagaucaagggcagaggcaccaucagauaccacaccccccccagaagcagaagcugcagcgagagcgacgacgacgacagcagcgagacccccccccacuggaaggaggagaugcagagacugagagccuacagaccccccagcggcgagaaguggagcaagggcgacaagcugagcgaccccugcagcagcagaugggacgagagaagccugagccagagaagcagaagcuggagcuacaacggcuacuacagcgaccugagcaccgccagacacagcggccaccacaagaagagaagaaaggagaagaaggugaagcacaagaagaagggcaagaagcagaagcacugcagaagacacaagcagaccaagaagagaagaauccugauccccagcgacaucgagagcagcaagagcagcaccagaagaaugaagagcagcugcgacagagagagaagcagcagaagcagcagccugagcagccaccacagcagcaagagagacuggagcaagagcgacaaggacgugcagagcagccugacccacagcagcagagacagcuacagaagcaagagccacagccagagcuacagcagaggcagcagcagaagcagaaccgccagcaagagcagcagccacagcagaagcagaagcaagagcagaagcagcagcaagagcggccacagaaagagagccagcaagagccccagaaagaccgccagccagcugagcgagaacaagcccgugaagaccgagccccugagagccaccauggcccagaacgagaacgugguggugcagcccgugguggccgagaacauccccgugaucccccugagcgacagccccccccccagcagauggaagcccggccagaagcccuggaagcccagcuacgagagaauccaggagaugaaggccaagaccacccaccugcugcccauccagagcaccuacagccuggccaacaucaaggagaccggcagcagcagcagcuaccacaagagagagaagaacagcgagagcgaccagagcaccuacagcaaguacagcgacagaagcagcgagagcagccccagaagcagaagcagaagcagcagaagcagaagcuacagcagaagcuacaccagaagcagaagccuggccagcagccacagcagaagcagaagccccagcagcagaagccacagcagaaacaaguacagcgaccacagccagugcagcagaagcagcagcuacaccagcaucagcagcgacgacggcagaagagccaagagaagacugagaagcagcggcaagaagaacagcgugagccacaagaagcacagcagcagcagcgagaagacccugcacagcaaguacgugaagggcagagacagaagcagcugcgugagaaaguacagcgagagcagaagcagccuggacuacagcagcgacagcgagcagagcagcgugcaggccacccagagcgcccaggagaaggagaagcagggccagauggagagaacccacaacaagcaggagaagaacagaggcgaggagaagagcaagagcgagagagagugcccccacagcaagaagagaacccugaaggagaaccugagcgaccaccugagaaacggcagcaagcccaagagaaagaacuacgccggcagcaagugggacagcgagagcaacagcgagagagacgugaccaagaacagcaagaacgacagccaccccagcagcgacaaggaggagggcgaggccaccagcgacagcgagagcgaggugagcgagauccacaucaaggugaagcccaccaccaagagcagcaccaacaccagccugcccgacgacaacggcgccuggaagagcagcaagcagagaaccagcaccagcgacagcgagggcagcugcagcaacagcgagaacaacagaggcaagccccagaagcacaagcacggcagcaaggagaaccugaagagagagcacaccaagaaggugaaggagaagcugaagggcaagaaggacaagaagcacaaggcccccaagagaaagcaggccuuccacuggcagcccccccuggaguucggcgaggaggaggaggaggagaucgacgacaagcaggugacccaggagagcaaggagaagaaggugagcgagaacaacgagaccaucaaggacaacauccugaagaccgagaagagcagcgaggaggaccugagcggcaagcacgacaccgugaccgugagcagcgaccuggaccaguucaccaaggacgacagcaagcugagcaucagccccaccgcccugaacaccgaggagaacguggccugccugcagaacauccagcacguggaggagagcgugcccaacggcguggaggacgugcugcagaccgacgacaacauggagaucugcacccccgacagaagcagccccgccaagguggaggagaccagcccccugggcaacgccagacuggacacccccgacaucaacaucgugcugaagcaggacauggccaccgagcacccccaggccgagguggugaagcaggagagcagcaugagcgagagcaaggugcugggcgaggugggcaagcaggacagcagcagcgccagccuggccagcgccggcgagagcaccggcaagaaggagguggccgagaagagccagaucaaccugaucgacaagaaguggaagccccugcagggcgugggcaaccuggccgcccccaacgccgccaccagcagcgccguggaggugaaggugcugaccaccgugcccgagaugaagccccagggccugagaaucgagaucaagagcaagaacaaggugagacccggcagccuguucgacgaggugagaaagaccgccagacugaacagaagacccagaaaccaggagagcagcagcgacgagcagacccccagcagagacgacgacagccagagcagaagccccagcagaagcagaagcaagagcgagaccaagagcagacacagaaccagaagcgugagcuacagccacagcagaagcagaagcagaagcagcaccagcagcuacagaagcagaagcuacagcagaagcagaagcagaggcugguacagcagaggcagaaccagaagcagaagcagcagcuacagaagcuacaagagccacagaaccagcagcagaagcagaagcagaagcagcagcuacgacccccacagcagaagcagaagcuacaccuacgacagcuacuacagcagaagcagaagcagaagcagaagccagagaagcgacagcuaccacagaggcagaagcuacaacagaagaagcagaagcugcagaagcuacggcagcgacagcgagagcgacagaagcuacagccaccacagaagccccagcgagagcagcagauacagcuaa

SEQ ID NO: 20558 - RNA, 1347 nt, Artificial Sequence
  NKX1-1__Homo_sapiens__NP_001277008
augagcgccagcggccccgaggcccccggcgacauccccgcccugcccccccccccccagcccggcagcggccccgccccccccgcccccgccgccgccgcccaggaggccauggacggcagagccgagcugcccgccuuccccagagccggcgcccccccccuggccgccagcgacaccgugcccgccgcccccgagggcgccggcgccgccagacccgccgccccccugagacccaccagcuucagcgugcuggacauccuggaccccaacaaguucaacagcagaagaagaagaugcgugcugcugggccccguggcccccgccgccugcgcccccugcgccagcgcccccugcgcccccgcccccgccgccagcggcagaccccccagagccgaggagcuggagagaagagcccuggccggcgccggcggcgugggcgccgccggcgccgagccccccaacgccggcgaccccuucaaggccggcgaggccgagaccaacgacaccaacggcuacagcagcggcggcggcggccacagccccagcgccgacagcggcgacgaggugcccgacgacgaggacgacgacgaggacgaggcccccgagaccgaggccgccagaggcgccgaggaggccagaggcggcggcggcggccugggcgccagaggcagcggcugccagggcgccgccgagaccgacgccagccccggcgccaccguggacgaggccgccgcccccggccccagagagaacagccccguggcccagggcccccccggcggcgccgccgcccccggcggcgccggcaccaccccccagggcaccgccaccgccgccaagcccaagagaaagagaaccggcagcgacagcaagagcggcaagcccagaagagccagaaccgccuucaccuacgagcagcugguggcccuggagaacaaguucaaggccaccagauaccugagcgugugcgagagacugaaccuggcccugagccugagccugaccgagacccaggugaagaucugguuccagaacagaagaaccaaguggaagaagcagaaccccggcgccgacaccagcgcccccaccggcggcggcggcggccccggccccggcgccggccccggcaccggccugcccggcggccugagcccccugagccccagcccccccaugggcgccccccugggcaugcacggccccgccggcuaccccgcccacggccccggcggccuggugugcgccgcccagcugcccuuccugagcagccccgccgugcugagccccuucgugcugggcagccagaccuacggcgcccccgccuucuacgccccccaccuguaa

SEQ ID NO: 20559 - RNA, 933 nt, Artificial Sequence
  NKX1-2__Homo_sapiens__NP_001139812
augcuggccuggcaggacggcggcgccaaggccgcccccagccaccacaagaucagcuucagcgugcuggacauccuggacccccagaaguucaccagagccgcccugcccgccgugagacccgcccccagagaggccagaaagagccuggccgagguggaggccggcaaggacgccagcagcagagaccccgugagacagcuggagacccccgacgccgccggccccggcgccggccaggccagcccccuggagggcagcgaggccgaggaggaggaggacgccgaggaccccagaagacccagacugagagagagagccgccagacugcugcccggccuggccagaagccccgacgcccccgccggcgcccuggccagcggcgagcccugcgaggacggcggcggcggccccgugagaagcccccccggcagccccggcagccccagacccagaagaagaagacuggagcccaacugcgccaagcccagaagagccagaaccgccuucaccuacgagcagcugguggcccuggagaacaaguucagagccaccagauaccugagcgugugcgagagacugaaccuggcccugagccugagccugaccgagacccaggugaagaucugguuccagaacagaagaaccaaguggaagaagcagaaccccggcgccgacggcgccgcccaggugggcggcggcgccccccagcccggcgccgccggcggcggcggcggcggcggcagcggcggcagccccggcccccccggcaccggcgcccugcacuuccagaccuuccccagcuacagcgccgccaacgugcuguuccccagcgccgccagcuucccccugaccgccgccgcccccggcagccccuucgcccccuuccugggccccagcuaccugacccccuucuacgcccccagacuguaa

SEQ ID NO: 20560 - RNA, 1206 nt, Artificial Sequence
  NKX2-1__Homo_sapiens__NP_001073136
auguggagcggcggcagcggcaaggccagaggcugggaggccgccgccggcggcagaagcagccccggcagacugagcagaagaagaaucaugagcaugagccccaagcacaccacccccuucagcgugagcgacauccugagcccccuggaggagagcuacaagaaggugggcauggagggcggcggccugggcgccccccuggccgccuacagacagggccaggccgccccccccaccgccgccaugcagcagcacgccgugggccaccacggcgccgugaccgccgccuaccacaugaccgccgccggcgugccccagcugagccacagcgccgugggcggcuacugcaacggcaaccugggcaacaugagcgagcugccccccuaccaggacaccaugagaaacagcgccagcggccccggcugguacggcgccaaccccgaccccagauuccccgccaucagcagauucaugggccccgccagcggcaugaacaugagcggcaugggcggccugggcagccugggcgacgugagcaagaacauggccccccugcccagcgcccccagaagaaagagaagagugcuguucagccaggcccagguguacgagcuggagagaagauucaagcagcagaaguaccugagcgcccccgagagagagcaccuggccagcaugauccaccugacccccacccaggugaagaucugguuccagaaccacagauacaagaugaagagacaggccaaggacaaggccgcccagcagcagcugcagcaggacagcggcggcggcggcggcggcggcggcaccggcugcccccagcagcagcaggcccagcagcagagccccagaagaguggccgugcccgugcuggugaaggacggcaagcccugccaggccggcgcccccgcccccggcgccgccagccugcagggccacgcccagcagcaggcccagcaccaggcccaggccgcccaggccgccgccgccgccaucagcgugggcagcggcggcgccggccugggcgcccaccccggccaccagcccggcagcgccggccagagccccgaccuggcccaccacgccgccagccccgccgcccugcagggccaggugagcagccugagccaccugaacagcagcggcagcgacuacggcaccaugagcugcagcacccugcuguacggcagaaccugguaa

SEQ ID NO: 20561 - RNA, 822 nt, Artificial Sequence
  NKX2-2__Homo_sapiens__NP_002500
augagccugaccaacaccaagaccggcuucagcgugaaggacauccuggaccugcccgacaccaacgacgaggagggcagcguggccgagggccccgaggaggagaacgagggccccgagcccgccaagagagccggcccccugggccagggcgcccuggacgccgugcagagccugccccugaagaaccccuucuacgacagcagcgacaaccccuacaccagauggcuggccagcaccgagggccugcaguacagccugcacggccuggccgccggcgcccccccccaggacagcagcagcaagagccccgagcccagcgccgacgagagccccgacaacgacaaggagacccccggcggcggcggcgacgccggcaagaagagaaagagaagagugcuguucagcaaggcccagaccuacgagcuggagagaagauucagacagcagagauaccugagcgcccccgagagagagcaccuggccagccugaucagacugacccccacccaggugaagaucugguuccagaaccacagauacaagaugaagagagccagagccgagaagggcauggaggugaccccccugcccagccccagaagaguggccgugcccgugcuggugagagacggcaagcccugccacgcccugaaggcccaggaccuggccgccgccaccuuccaggccggcauccccuucagcgccuacagcgcccagagccugcagcacaugcaguacaacgcccaguacagcagcgccagcaccccccaguaccccaccgcccacccccuggugcaggcccagcaguggaccugguaa

SEQ ID NO: 20562 - RNA, 1095 nt, Artificial Sequence
  NKX2-3__Homo_sapiens__NP_660328
augaugcugcccagccccgugaccagcacccccuucagcgugaaggacauccugaaccuggagcagcagcaccagcacuuccacggcgcccaccugcaggccgaccuggagcaccacuuccacagcgcccccugcaugcuggccgccgccgagggcacccaguucagcgacggcggcgaggaggacgaggaggacgagggcgagaagcugagcuaccugaacagccuggccgccgccgacggccacggcgacagcggccugugcccccagggcuacgugcacaccgugcugagagacagcugcagcgagcccaaggagcacgaggaggagcccgagguggugagagacagaagccagaagagcugccagcugaagaagagccuggagaccgccggcgacugcaaggccgccgaggagagcgagagacccaagcccagaagcagaagaaagcccagagugcuguucagccaggcccagguguucgagcuggagagaagauucaagcagcagagauaccugagcgcccccgagagagagcaccuggccagcagccugaagcugaccagcacccaggugaagaucugguuccagaacagaagauacaagugcaagagacagagacaggacaagagccuggagcugggcgcccacgcccccccccccccccccagaagaguggccgugcccgugcuggugagagacggcaagcccugcgugacccccagcgcccaggccuacggcgcccccuacagcgugggcgccagcgccuacagcuacaacagcuuccccgccuacggcuacggcaacagcgccgccgccgccgccgccgccgccgccgccgccgccgccgccgccgccuacagcagcagcuacggcugcgccuaccccgccggcggcggcggcggcggcggcggcaccagcgccgccaccaccgccaugcagcccgccugcagcgccgccggcggcggccccuucgugaacgugagcaaccugggcggcuucggcagcggcggcagcgcccagccccugcaccagggcaccgccgccggcgccgccugcgcccagggcacccugcagggcaucagagccugguaa

SEQ ID NO: 20563 - RNA, 339 nt, Artificial Sequence
  NKX2-5__Homo_sapiens__NP_001159647
auguuccccagccccgcccugacccccacccccuucagcgugaaggacauccugaaccuggagcagcagcagagaagccuggccgccgccggcgagcugagcgccagacuggaggccacccuggcccccagcagcugcaugcuggccgccuucaagcccgaggccuacgccggccccgaggccgccgcccccggccugcccgagcugagagccgagcugggcagagcccccagccccgccaagugcgccagcgccuuccccgccgcccccgccuucuaccccagagccuacagcgaccccgaccccgccaaggaccccagagccgagaagaaggccuaa

SEQ ID NO: 20564 - RNA, 906 nt, Artificial Sequence
  NKX2-6__Homo_sapiens__NP_001129743
augcugcugagccccgugaccagcacccccuucagcgugaaggacauccugagacuggagagagagagaagcugccccgccgccagcccccaccccagagugagaaagagccccgagaacuuccaguaccugagaauggacgccgagcccagaggcagcgaggugcacaacgccggcggcggcggcggcgacagaaagcuggacggcagcgagccccccggcggccccugcgaggccgugcuggagauggacgccgagagaaugggcgagccccagcccggccugaacgccgccagcccccugggcggcggcaccagagugcccgagagaggcgugggcaacagcggcgacagcgugagaggcggcagaagcgagcagcccaaggccagacagagaagaaagcccagagugcuguucagccaggcccaggugcuggcccuggagagaagauucaagcagcagagauaccugagcgcccccgagagagagcaccuggccagcgcccugcagcugaccagcacccaggugaagaucugguuccagaacagaagauacaagugcaagagacagagacaggacaagagccuggagcuggccggccacccccugacccccagaagaguggccgugcccgugcuggugagagacggcaagcccugccugggccccggccccggcgcccccgccuuccccagccccuacagcgccgccgugagccccuacagcugcuacggcggcuacagcggcgcccccuacggcgccggcuacggcaccugcuacgccggcgcccccagcggccccgccccccacaccccccuggccagcgccggcuucggccacggcggccagaacgccaccccccagggccaccuggccgccacccugcagggcgugagagccugguaa

SEQ ID NO: 20565 - RNA, 720 nt, Artificial Sequence
  NKX2-8__Homo_sapiens__NP_055175
auggccaccagcggcagacugagcuucaccgugagaagccugcuggaccugcccgagcaggacgcccagcaccugcccagaagagagcccgagcccagagccccccagcccgaccccugcgccgccuggcuggacagcgagagaggccacuaccccagcagcgacgagagcagccuggagaccagcccccccgacagcagccagagacccagcgccagacccgccagccccggcagcgacgccgagaagagaaagaagagaagagugcuguucagcaaggcccagacccuggagcuggagagaagauucagacagcagagauaccugagcgcccccgagagagagcagcuggccagccugcugagacugacccccacccaggugaagaucugguuccagaaccacagauacaagcugaagagagccagagcccccggcgccgccgagagccccgaccuggccgccagcgccgagcugcacgccgcccccggccugcugagaagagugguggugcccgugcuggugagagacggccagcccugcggcggcggcggcggcggcgaggugggcaccgccgccgcccaggagaagugcggcgccccccccgccgccgccugcccccugcccggcuaccccgccuucggccccggcagcgcccugggccuguuccccgccuaccagcaccuggccagccccgcccuggugagcuggaacugguaa

SEQ ID NO: 20566 - RNA, 480 nt, Artificial Sequence
  NKX3-1__Homo_sapiens__NP_001243268
augcugagagugcccgagcccagacccggcgaggccgagacccuggccgagaccgagcccgagagacaccugggcagcuaccugcuggacagcgagaacaccagcggcgcccugcccagacugccccagacccccaagcagccccagaagagaagcagagccgccuucagccacacccaggugaucgagcuggagagaaaguucagccaccagaaguaccugagcgcccccgagagagcccaccuggccaagaaccugaagcugaccgagacccaggugaagaucugguuccagaacagaagauacaagaccaagagaaagcagcugagcagcgagcugggcgaccuggagaagcacagcagccugcccgcccugaaggaggaggccuucagcagagccagccuggugagcguguacaacagcuaccccuacuaccccuaccuguacugcgugggcagcuggagccccgccuucugguaa

SEQ ID NO: 20567 - RNA, 1104 nt, Artificial Sequence
  NKX6-1__Homo_sapiens__XP_006714293
augcuggccgugggcgccauggagggcaccagacagagcgccuuccugcugagcagccccccccuggccgcccugcacagcauggccgagaugaagaccccccuguaccccgccgccuaccccccccugcccgccggcccccccagcagcagcagcagcagcagcagcagcagcagccccagccccccccugggcacccacaaccccggcggccugaagccccccgccaccggcggccugagcagccugggcagccccccccagcagcugagcgccgccaccccccacggcaucaacgacauccugagcagacccagcaugcccguggccagcggcgccgcccugcccagcgccagccccagcggcagcagcagcagcagcagcagcagcgccagcgccagcagcgccagcgccgccgccgccgccgccgccgccgccgccgccgccgccagcagccccgccggccugcuggccggccugcccagauucagcagccugagcccccccccccccccccccggccuguacuucagccccagcgccgccgccguggccgccgugggcagauaccccaagccccuggccgagcugcccggcagaacccccaucuucuggcccggcgugaugcagagcccccccuggagagacgccagacuggccugcaccccccaccagggcagcauccugcuggacaaggacggcaagagaaagcacaccagacccaccuucagcggccagcagaucuucgcccuggagaagaccuucgagcagaccaaguaccuggccggccccgagagagccagacuggccuacagccugggcaugaccgagagccaggugaaggugugguuccagaacagaagaaccaaguggagaaagaagcacgccgccgagauggccaccgccaagaagaagcaggacagcgagaccgagagacugaagggcgccagcgagaacgaggaggaggacgacgacuacaacaagccccuggaccccaacagcgacgacgagaagaucacccagcugcugaagaagcacaagagcagcagcggcggcggcggcggccugcugcugcacgccagcgagcccgagagcagcagcuaa

SEQ ID NO: 20568 - RNA, 834 nt, Artificial Sequence
  NKX6-2__Homo_sapiens__NP_796374
auggacaccaacagacccggcgccuucgugcugagcagcgccccccuggccgcccugcacaacauggccgagaugaagaccagccuguuccccuacgcccugcagggccccgccggcuucaaggcccccgcccugggcggccugggcgcccagcugccccugggcaccccccacggcaucagcgacauccugggcagacccgugggcgccgccggcggcggccugcugggcggccugcccagacugaacggccuggccagcagcgccggcguguacuucggccccgccgccgccguggccagaggcuaccccaagccccuggccgagcugcccggcagaccccccaucuucuggcccggcguggugcagggcgcccccuggagagaccccagacuggccggccccgcccccgccggcggcgugcuggacaaggacggcaagaagaagcacagcagacccaccuucagcggccagcagaucuucgcccuggagaagaccuucgagcagaccaaguaccuggccggccccgagagagccagacuggccuacagccugggcaugaccgagagccaggugaaggugugguuccagaacagaagaaccaaguggagaaagagacacgccgccgagauggccagcgccaagaagaagcaggacagcgacgccgagaagcugaaggugggcggcagcgacgccgaggacgacgacgaguacaacagaccccuggaccccaacagcgacgacgagaagaucaccagacugcugaagaagcacaagcccagcaaccuggcccuggugagccccugcggcggcggcgccggcgacgcccuguaa

SEQ ID NO: 20569 - RNA, 582 nt, Artificial Sequence
  NLE1__Homo_sapiens__NP_001014445
auggcccugagcaccgacuacgcccugagaaccggcgccuucgagcccgccgaggccagcgugaacccccaggaccugcagggcagccugcaggagcugaaggagagagcccugagcagauacaaccuggugagaggccagggccccgagagacuggugagcggcagcgacgacuucacccuguuccuguggagccccgccgaggacaagaagccccugaccagaaugaccggccaccaggcccugaucaaccaggugcuguucagccccgacagcagaaucguggccagcgccagcuucgacaagagcaucaagcugugggacggcagaaccggcaaguaccuggccagccugagaggccacguggccgccguguaccagaucgccuggagcgccgacagcagacugcuggugagcggcagcagcgacagcacccugaaggugugggacgugaaggcccagaagcuggccauggaccugcccggccacgccgacgagguguacgccguggacuggagccccgacggccagagaguggccagcggcggcaaggacaagugccugagaaucuggagaagauaa

SEQ ID NO: 20570 - RNA, 2472 nt, Artificial Sequence
  NLGN1__Homo_sapiens__NP_055747
auggcccugcccagaugcaccuggcccaacuacguguggagagccgugauggccugccuggugcacagaggccugggcgccccccugacccugugcaugcugggcugccugcugcaggccggccacgugcugagccagaagcuggacgacguggacccccugguggccaccaacuucggcaagaucagaggcaucaagaaggagcugaacaacgagauccugggccccgugauccaguuccugggcgugcccuacgccgccccccccaccggcgagagaagauuccagccccccgagccccccagccccuggagcgacaucagaaacgccacccaguucgcccccgugugcccccagaacaucaucgacggcagacugcccgaggugaugcugcccgugugguucaccaacaaccuggacguggugagcagcuacgugcaggaccagagcgaggacugccuguaccugaacaucuacgugcccaccgaggacgacaucagagacagcggcggccccaagcccgugaugguguacauccacggcggcagcuacauggagggcaccggcaaccuguacgacggcagcgugcuggccagcuacggcaacgugaucgugaucaccgugaacuacagacugggcgugcugggcuuccugagcaccggcgaccaggccgccaagggcaacuacggccugcuggaccugauccaggcccugagauggaccagcgagaacaucggcuucuucggcggcgacccccugagaaucaccguguucggcagcggcgccggcggcagcugcgugaaccugcugacccugagccacuacagcgagggcaacagauggagcaacagcaccaagggccuguuccagagagccaucgcccagagcggcaccgcccugagcagcugggccgugagcuuccagcccgccaaguacgccagaaugcuggccaccaaggugggcugcaacgugagcgacaccguggagcugguggagugccugcagaagaagcccuacaaggagcugguggaccaggacauccagcccgccagauaccacaucgccuucggccccgugaucgacggcgacgugauccccgacgacccccagauccugauggagcagggcgaguuccugaacuacgacaucaugcugggcgugaaccagggcgagggccugaaguucguggagaacaucguggacagcgacgacggcaucagcgccagcgacuucgacuucgccgugagcaacuucguggacaaccuguacggcuaccccgagggcaaggacgugcugagagagaccaucaaguucauguacaccgacugggccgacagacacaaccccgagaccagaagaaagacccugcuggcccuguucaccgaccaccaguggguggcccccgccguggccaccgccgaccugcacagcaacuucggcagccccaccuacuucuacgccuucuaccaccacugccagaccgaccaggugcccgccugggccgacgccgcccacggcgacgaggugcccuacgugcugggcauccccaugaucggccccaccgagcuguuccccugcaacuucagcaagaacgacgugaugcugagcgccguggugaugaccuacuggaccaacuucgccaagaccggcgaccccaaccagcccgugccccaggacaccaaguucauccacaccaagcccaacagauucgaggagguggccuggaccagauacagccagaaggaccagcuguaccugcacaucggccugaagcccagagugaaggagcacuacagagccaacaaggugaaccuguggcuggagcuggugccccaccugcacaaccugaacgacaucagccaguacaccagcaccaccaccaaggugcccagcaccgacaucaccuucagacccaccagaaagaacagcgugcccgugaccagcgccuuccccaccgccaagcaggacgaccccaagcagcagcccagccccuucagcguggaccagagagacuacagcaccgagcugagcgugaccaucgccgugggcgccagccugcuguuccugaacauccuggccuucgccgcccuguacuacaagaaggacaagagaagacacgacgugcacagaagaugcagcccccagagaaccaccaccaacgaccugacccacgcccaggaggaggagaucaugagccugcagaugaagcacaccgaccuggaccacgagugcgagagcauccacccccacgagguggugcugagaaccgccugcccccccgacuacacccuggccaugagaagaagccccgacgacgugccccugaugacccccaacaccaucaccaugauccccaacaccauccccggcauccagccccugcacaccuucaacaccuucaccggcggccagaacaacacccugccccacccccacccccacccccacagccacagcaccaccagaguguaa

SEQ ID NO: 20571 - RNA, 2508 nt, Artificial Sequence
  NLGN2__Homo_sapiens__NP_065846
auguggcugcuggcccugugccuggugggccuggccggcgcccagagaggcggcggcggccccggcggcggcgcccccggcggccccggccugggccugggcagccugggcgaggagagauuccccguggugaacaccgccuacggcagagugagaggcgugagaagagagcugaacaacgagauccugggccccguggugcaguuccugggcgugcccuacgccacccccccccugggcgccagaagauuccagccccccgaggcccccgccagcuggcccggcgugagaaacgccaccacccugccccccgccugcccccagaaccugcacggcgcccugcccgccaucaugcugcccgugugguucaccgacaaccuggaggccgccgccaccuacgugcagaaccagagcgaggacugccuguaccugaaccuguacgugcccaccgaggacggcccccugaccaagaagagagacgaggccacccugaacccccccgacaccgacaucagagaccccggcaagaagcccgugaugcuguuccugcacggcggcagcuacauggagggcaccggcaacauguucgacggcagcgugcuggccgccuacggcaacgugaucguggccacccugaacuacagacugggcgugcugggcuuccugagcaccggcgaccaggccgccaagggcaacuacggccugcuggaccagauccaggcccugagauggcugagcgagaacaucgcccacuucggcggcgaccccgagagaaucaccaucuucggcagcggcgccggcgccagcugcgugaaccugcugauccugagccaccacagcgagggccuguuccagaaggccaucgcccagagcggcaccgccaucagcagcuggagcgugaacuaccagccccugaaguacaccagacugcuggccgccaaggugggcugcgacagagaggacagcgccgaggccguggagugccugagaagaaagcccagcagagagcugguggaccaggacgugcagcccgccagauaccacaucgccuucggccccgugguggacggcgacguggugcccgacgaccccgagauccugaugcagcagggcgaguuccugaacuacgacaugcugaucggcgugaaccagggcgagggccugaaguucguggaggacagcgccgagagcgaggacggcgugagcgccagcgccuucgacuucaccgugagcaacuucguggacaaccuguacggcuaccccgagggcaaggacgugcugagagagaccaucaaguucauguacaccgacugggccgacagagacaacggcgagaugagaagaaagacccugcuggcccuguucaccgaccaccaguggguggcccccgccguggccaccgccaagcugcacgccgacuaccagagccccguguacuucuacaccuucuaccaccacugccaggccgagggcagacccgagugggccgacgccgcccacggcgacgagcugcccuacguguucggcgugcccauggugggcgccaccgaccuguuccccugcaacuucagcaagaacgacgugaugcugagcgccguggugaugaccuacuggaccaacuucgccaagaccggcgaccccaaccagcccgugccccaggacaccaaguucauccacaccaagcccaacagauucgaggaggugguguggagcaaguucaacagcaaggagaagcaguaccugcacaucggccugaagcccagagugagagacaacuacagagccaacaagguggccuucuggcuggagcuggugccccaccugcacaaccugcacaccgagcuguucaccaccaccaccagacugccccccuacgccaccagauggccccccagaccccccgccggcgcccccggcaccagaagaccccccccccccgccacccugccccccgagcccgagcccgagcccggccccagagccuacgacagauuccccggcgacagcagagacuacagcaccgagcugagcgugaccguggccgugggcgccagccugcuguuccugaacauccuggccuucgccgcccuguacuacaagagagacagaagacaggagcugagaugcagaagacugagcccccccggcggcagcggcagcggcgugcccggcggcggcccccugcugcccgccgccggcagagagcugccccccgaggaggagcuggugagccugcagcugaagagaggcggcggcgugggcgccgaccccgccgaggcccugagacccgccugcccccccgacuacacccuggcccugagaagagcccccgacgacgugccccugcuggcccccggcgcccugacccugcugcccagcggccugggcccccccccccccccccccccccccagccugcaccccuucggccccuuccccccccccccccccaccgccaccagccacaacaacacccugccccacccccacagcaccaccagaguguaa

SEQ ID NO: 20572 - RNA, 2427 nt, Artificial Sequence
  NLGN3__Homo_sapiens__NP_001160132
auguggcugagacugggcccccccagccugagccugagccccaagcccaccgugggcagaagccugugccugacccugugguuccugagccuggcccugagagccagcacccaggcccccgcccccaccgugaacacccacuucggcaagcugagaggcgccagagugccccugcccagcgagauccugggccccguggaccaguaccugggcgugcccuacgccgccccccccaucggcgagaagagauuccugccccccgagcccccccccagcuggagcggcaucagaaacgccacccacuucccccccgugugcccccagaacauccacaccgccgugcccgaggugaugcugcccgugugguucaccgccaaccuggacaucguggccaccuacauccaggagcccaacgaggacugccuguaccugaacguguacgugcccaccgaggacgacaucagagacagcggcgccaagcccgugaugguguacauccacggcggcagcuacauggagggcaccggcaacaugaucgacggcagcauccuggccagcuacggcaacgugaucgugaucacccugaacuacagagugggcgugcugggcuuccugagcaccggcgaccaggccgccaagggcaacuacggccugcuggaccagauccaggcccugagaugggugagcgagaacaucgccuucuucggcggcgaccccagaagaaucaccguguucggcagcggcaucggcgccagcugcgugagccugcugacccugagccaccacagcgagggccuguuccagagagccaucauccagagcggcagcgcccugagcagcugggccgugaacuaccagcccgugaaguacaccagccugcuggccgacaaggugggcugcaacgugcuggacaccguggacaugguggacugccugagacagaagagcgccaaggagcugguggagcaggacauccagcccgccagauaccacguggccuucggccccgugaucgacggcgacgugauccccgacgaccccgagauccugauggagcagggcgaguuccugaacuacgacaucaugcugggcgugaaccagggcgagggccugaaguucguggagggcgugguggaccccgaggacggcgugagcggcaccgacuucgacuacagcgugagcaacuucguggacaaccuguacggcuaccccgagggcaaggacacccugagagagaccaucaaguucauguacaccgacugggccgacagagacaaccccgagaccagaagaaagacccugguggcccuguucaccgaccaccaguggguggagcccagcguggugaccgccgaccugcacgccagauacggcagccccaccuacuucuacgccuucuaccaccacugccagagccugaugaagcccgccuggagcgacgccgcccacggcgacgaggugcccuacguguucggcgugcccauggugggccccaccgaccuguuccccugcaacuucagcaagaacgacgugaugcugagcgccguggugaugaccuacuggaccaacuucgccaagaccggcgaccccaacaagcccgugccccaggacaccaaguucauccacaccaaggccaacagauucgaggagguggccuggagcaaguacaaccccagagaccagcuguaccugcacaucggccugaagcccagagugagagaccacuacagagccaccaagguggccuucuggaagcaccuggugccccaccuguacaaccugcacgacauguuccacuacaccagcaccaccaccaaggugcccccccccgacaccacccacagcagccacaucaccagaagacccaacggcaagaccuggagcaccaagagacccgccaucagccccgccuacagcaacgagaacgcccagggcagcuggaacggcgaccaggacgccggcccccugcugguggagaaccccagagacuacagcaccgagcugagcgugaccaucgccgugggcgccagccugcuguuccugaacgugcuggccuucgccgcccuguacuacagaaaggacaagagaagacaggagccccugagacagcccagcccccagagaggcgccggcgcccccgagcugggcgccgcccccgaggaggagcuggccgcccugcagcugggccccacccaccacgagugcgaggccggccccccccacgacacccugagacugaccgcccugcccgacuacacccugacccugagaagaagccccgacgacaucccccugaugacccccaacaccaucaccaugauccccaacagccuggugggccugcagacccugcaccccuacaacaccuucgccgccggcuucaacagcaccggccugccccacagccacagcaccaccagaguguaa

SEQ ID NO: 20573 - RNA, 2451 nt, Artificial Sequence
  NLGN4X__Homo_sapiens__NP_001269075
augagcagaccccagggccugcuguggcugccccugcuguucacccccgugugcgugaugcugaacagcaacgugcugcuguggcugaccgcccuggccaucaaguucacccugaucgacagccaggcccaguaccccguggugaacaccaacuacggcaagaucagaggccugagaaccccccugcccaacgagauccugggccccguggagcaguaccugggcgugcccuacgccagcccccccaccggcgagagaagauuccagccccccgagccccccagcagcuggaccggcaucagaaacaccacccaguucgccgccgugugcccccagcaccuggacgagagaagccugcugcacgacaugcugcccaucugguucaccgccaaccuggacacccugaugaccuacgugcaggaccagaacgaggacugccuguaccugaacaucuacgugcccaccgaggacgacauccacgaccagaacagcaagaagcccgugaugguguacauccacggcggcagcuacauggagggcaccggcaacaugaucgacggcagcauccuggccagcuacggcaacgugaucgugaucaccaucaacuacagacugggcauccugggcuuccugagcaccggcgaccaggccgccaagggcaacuacggccugcuggaccagauccaggcccugagauggaucgaggagaacgugggcgccuucggcggcgaccccaagagagugaccaucuucggcagcggcgccggcgccagcugcgugagccugcugacccugagccacuacagcgagggccuguuccagaaggccaucauccagagcggcaccgcccugagcagcugggccgugaacuaccagcccgccaaguacaccagaauccuggccgacaaggugggcugcaacaugcuggacaccaccgacaugguggagugccugagaaacaagaacuacaaggagcugauccagcagaccaucacccccgccaccuaccacaucgccuucggccccgugaucgacggcgacgugauccccgacgacccccagauccugauggagcagggcgaguuccugaacuacgacaucaugcugggcgugaaccagggcgagggccugaaguucguggacggcaucguggacaacgaggacggcgugacccccaacgacuucgacuucagcgugagcaacuucguggacaaccuguacggcuaccccgagggcaaggacacccugagagagaccaucaaguucauguacaccgacugggccgacaaggagaaccccgagaccagaagaaagacccugguggcccuguucaccgaccaccaguggguggcccccgccguggccaccgccgaccugcacgcccaguacggcagccccaccuacuucuacgccuucuaccaccacugccagagcgagaugaagcccagcugggccgacagcgcccacggcgacgaggugcccuacguguucggcauccccaugaucggccccaccgagcuguucagcugcaacuucagcaagaacgacgugaugcugagcgccguggugaugaccuacuggaccaacuucgccaagaccggcgaccccaaccagcccgugccccaggacaccaaguucauccacaccaagcccaacagauucgaggagguggccuggagcaaguacaaccccaaggaccagcuguaccugcacaucggccugaagcccagagugagagaccacuacagagccaccaagguggccuucuggcuggagcuggugccccaccugcacaaccugaacgagaucuuccaguacgugagcaccaccaccaaggugcccccccccgacaugaccagcuuccccuacggcaccagaagaagccccgccaagaucuggcccaccaccaagagacccgccaucacccccgccaacaaccccaagcacagcaaggacccccacaagaccggccccgaggacaccaccgugcugaucgagaccaagagagacuacagcaccgagcugagcgugaccaucgccgugggcgccagccugcuguuccugaacauccuggccuucgccgcccuguacuacaagaaggacaagagaagacacgagacccacagaagacccagcccccagagaaacaccaccaacgacaucgcccacauccagaacgaggagaucaugagccugcagaugaagcagcuggagcacgaccacgagugcgagagccugcaggcccacgacacccugagacugaccugcccccccgacuacacccugacccugagaagaagccccgacgacaucccccugaugacccccaacaccaucaccaugauccccaacacccugaccggcaugcagccccugcacaccuucaacaccuucagcggcggccagaacagcaccaaccugccccacggccacagcaccaccagaguguaa

SEQ ID NO: 20574 - RNA, 1947 nt, Artificial Sequence
  NLGN4Y__Homo_sapiens__NP_001193779
augguguacauccacggcggcagcuacauggagggcaccggcaacaugaucgacggcagcauccuggccagcuacggcaacgugaucgugaucaccaucaacuacagacugggcauccugggcuuccugagcaccggcgaccaggccgccaagggcaacuacggccugcuggaccagauccaggcccugagauggaucgaggagaacgugggcgccuucggcggcgaccccaagagagugaccaucuucggcagcggcgccggcgccagcugcgugagccugcugacccugagccacuacagcgagggccuguuccagaaggccaucauccagagcggcaccgcccugagcagcugggccgugaacuaccagcccgccaaguacaccagaauccuggccgacaaggugggcugcaacaugcuggacaccaccgacaugguggagugccugaagaacaagaacuacaaggagcugauccagcagaccaucacccccgccaccuaccacaucgccuucggccccgugaucgacggcgacgugauccccgacgacccccagauccugauggagcagggcgaguuccugaacuacgacaucaugcugggcgugaaccagggcgagggccugaaguucguggacggcaucguggacaacgaggacggcgugacccccaacgacuucgacuucagcgugagcaacuucguggacaaccuguacggcuaccccgagggcaaggacacccugagagagaccaucaaguucauguacaccgacugggccgacaaggagaaccccgagaccagaagaaagacccugguggcccuguucaccgaccaccaguggguggcccccgccguggccaccgccgaccugcacgcccaguacggcagccccaccuacuucuacgccuucuaccaccacugccagagcgagaugaagcccagcugggccgacagcgcccacggcgacgaggugcccuacguguucggcauccccaugaucggccccaccgagcuguucagcugcaacuucagcaagaacgacgugaugcugagcgccguggugaugaccuacuggaccaacuucgccaagaccggcgaccccaaccagcccgugccccaggacaccaaguucauccacaccaagcccaacagauucgaggagguggccuggagcaaguacaaccccaaggaccagcuguaccugcacaucggccugaagcccagagugagagaccacuacagagccaccaagguggccuucuggcuggagcuggugccccaccugcacaaccugaacgagaucuuccaguacgugagcaccaccaccaaggugcccccccccgacaugaccagcuuccccuacggcaccagaagaagccccgccaagaucuggcccaccaccaagagacccgccaucacccccgccaacaaccccaagcacagcaaggacccccacaagaccggccccgaggacaccaccgugcugaucgagaccaagagagacuacagcaccgagcugagcgugaccaucgccgugggcgccagccugcuguuccugaacauccuggccuucgccgcccuguacuacaagaaggacaagagaagacacgagacccacagacaccccagcccccagagaaacaccaccaacgacaucacccacauccagaacgaggagaucaugagccugcagaugaagcagcuggagcacgaccacgagugcgagagccugcaggcccacgacacccugagacugaccugcccccccgacuacacccugacccugagaagaagccccgacgacauccccuucaugacccccaacaccaucaccaugauccccaacacccugaugggcaugcagccccugcacaccuucaagaccuucagcggcggccagaacagcaccaaccugccccacggccacagcaccaccagaguguaa

SEQ ID NO: 20575 - RNA, 1584 nt, Artificial Sequence
  NLK__Homo_sapiens__NP_057315
augagccugugcggcgccagagccaacgccaagaugauggccgccuacaacggcggcaccagcgccgccgccgccggccaccaccaccaccaccaccaccaccugccccaccugccccccccccaccugcaccaccaccaccacccccagcaccaccugcaccccggcagcgccgccgccgugcaccccgugcagcagcacaccagcagcgccgccgccgccgccgccgccgccgccgccgccgccgccaugcugaaccccggccagcagcagcccuacuuccccagccccgcccccggccaggcccccggccccgccgccgccgcccccgcccaggugcaggccgccgccgccgccaccgugaaggcccaccaccaccagcacagccaccacccccagcagcagcuggacaucgagcccgacagacccaucggcuacggcgccuucggcgugguguggagcgugaccgaccccagagacggcaagagaguggcccugaagaagaugcccaacguguuccagaaccuggugagcugcaagagaguguucagagagcugaagaugcugugcuucuucaagcacgacaacgugcugagcgcccuggacauccugcagcccccccacaucgacuacuucgaggagaucuacguggugaccgagcugaugcagagcgaccugcacaagaucaucgugagcccccagccccugagcagcgaccacgugaagguguuccuguaccagauccugagaggccugaaguaccugcacagcgccggcauccugcacagagacaucaagcccggcaaccugcuggugaacagcaacugcgugcugaagaucugcgacuucggccuggccagaguggaggagcuggacgagagcagacacaugacccaggagguggugacccaguacuacagagcccccgagauccugaugggcagcagacacuacagcaacgccaucgacaucuggagcgugggcugcaucuucgccgagcugcugggcagaagaauccuguuccaggcccagagccccauccagcagcuggaccugaucaccgaccugcugggcacccccagccuggaggccaugagaaccgccugcgagggcgccaaggcccacauccugagaggcccccacaagcagcccagccugcccgugcuguacacccugagcagccaggccacccacgaggccgugcaccugcugugcagaaugcugguguucgaccccagcaagagaaucagcgccaaggacgcccuggcccaccccuaccuggacgagggcagacugagauaccacaccugcaugugcaagugcugcuucagcaccagcaccggcagaguguacaccagcgacuucgagcccgugaccaaccccaaguucgacgacaccuucgagaagaaccugagcagcgugagacaggugaaggagaucauccaccaguucauccuggagcagcagaagggcaacagagugccccugugcaucaacccccagagcgccgccuucaagagcuucaucagcagcaccguggcccagcccagcgagaugccccccagcccccuggugugggaguaa

SEQ ID NO: 20576 - RNA, 2115 nt, Artificial Sequence
  NLN__Homo_sapiens__NP_065777
augaucgccagaugccugcuggccgugagaagccugagaagagugggcggcagcagaauccugcugagaaugacccugggcagagaggugaugagcccccugcaggccaugagcagcuacaccguggccggcagaaacgugcugagaugggaccugagccccgagcagaucaagaccagaaccgaggagcugaucgugcagaccaagcagguguacgacgccgugggcaugcugggcaucgaggaggugaccuacgagaacugccugcaggcccuggccgacguggaggugaaguacaucguggagagaaccaugcuggacuucccccagcacgugagcagcgacaaggaggugagagccgccagcaccgaggccgacaagagacugagcagauucgacaucgagaugagcaugagaggcgacaucuucgagagaaucgugcaccugcaggagaccugcgaccugggcaagaucaagcccgaggccagaagauaccuggagaagagcaucaagaugggcaagagaaacggccugcaccugcccgagcaggugcagaacgagaucaagagcaugaagaagagaaugagcgagcugugcaucgacuucaacaagaaccugaacgaggacgacaccuuccugguguucagcaaggccgagcugggcgcccugcccgacgacuucaucgacagccuggagaagaccgacgacgacaaguacaagaucacccugaaguacccccacuacuuccccgugaugaagaagugcugcauccccgagaccagaagaagaauggagauggccuucaacaccagaugcaaggaggagaacaccaucauccugcagcagcugcugccccugagaaccaagguggccaagcugcugggcuacagcacccacgccgacuucgugcuggagaugaacaccgccaagagcaccagcagagugaccgccuuccuggacgaccugagccagaagcugaagccccugggcgaggccgagagagaguucauccugaaccugaagaagaaggagugcaaggacagaggcuucgaguacgacggcaagaucaacgccugggaccuguacuacuacaugacccagaccgaggagcugaaguacagcaucgaccaggaguuccugaaggaguacuuccccaucgagguggugaccgagggccugcugaacaccuaccaggagcugcugggccugagcuucgagcagaugaccgacgcccacguguggaacaagagcgugacccuguacaccgugaaggacaaggccaccggcgaggugcugggccaguucuaccuggaccuguaccccagagagggcaaguacaaccacgccgccugcuucggccugcagcccggcugccugcugcccgacggcagcagaaugauggccguggccgcccugguggugaacuucagccagcccguggccggcagacccagccugcugagacacgacgaggugagaaccuacuuccacgaguucggccacgugaugcaccagaucugcgcccagaccgacuucgccagauucagcggcaccaacguggagaccgacuucguggaggugcccagccagaugcuggagaacugggugugggacguggacagccugagaagacugagcaagcacuacaaggacggcagccccaucgccgacgaccugcuggagaagcugguggccagcagacuggugaacaccggccugcugacccugagacagaucgugcugagcaagguggaccagagccugcacaccaacaccagccuggacgccgccagcgaguacgccaaguacugcagcgagauccugggcguggccgccacccccggcaccaacaugcccgccaccuucggccaccuggccggcggcuacgacggccaguacuacggcuaccuguggagcgagguguucagcauggacauguucuacagcugcuucaagaaggagggcaucaugaaccccgaggugggcaugaaguacagaaaccugauccugaagcccggcggcagccuggacggcauggacaugcugcacaacuuccugaagagagagcccaaccagaaggccuuccugaugagcagaggccugcacgcccccuaa

SEQ ID NO: 20577 - RNA, 3198 nt, Artificial Sequence
  NLRC3__Homo_sapiens__NP_849172
augagaaagcaggaggugagaaccggcagagaggccggccagggccacggcaccggcagccccgccgagcaggugaaggcccugauggaccugcuggccggcaagggcagccagggcagccaggccccccaggcccuggacagaacccccgacgccccccugggccccugcagcaacgacagcagaauccagagacacagaaaggcccugcugagcaaggugggcggcggccccgagcugggcggccccuggcacagacuggccagccugcugcugguggagggccugaccgaccugcagcugagagagcacgacuucacccagguggaggccaccagaggcggcggccaccccgccagaaccguggcccuggacagacuguuccugccccugagcagagugagcgugccccccagagugagcaucaccaucggcguggccggcaugggcaagaccacccuggugagacacuucgugagacugugggcccacggccaggugggcaaggacuucagccuggugcugccccugaccuucagagaccugaacacccacgagaagcugugcgccgacagacugaucugcagcguguucccccacgugggcgagcccagccuggccguggccgugcccgccagagcccugcugauccuggacggccuggacgagugcagaaccccccuggacuucagcaacaccguggccugcaccgaccccaagaaggagauccccguggaccaccugaucaccaacaucaucagaggcaaccuguuccccgaggugagcaucuggaucaccagcagacccagcgccagcggccagauccccggcggccugguggacagaaugaccgagaucagaggcuucaacgaggaggagaucaaggugugccuggagcagauguuccccgaggaccaggcccugcugggcuggaugcugagccaggugcaggccgacagagcccuguaccugaugugcaccgugcccgccuucugcagacugaccggcauggcccugggccaccuguggagaagcagaaccggcccccaggacgccgagcuguggccccccagaacccugugcgagcuguacagcugguacuucagaauggcccugagcggcgagggccaggagaagggcaaggccagccccagaaucgagcagguggcccacggcggcagaaagauggugggcacccugggcagacuggccuuccacggccugcugaagaagaaguacguguucuacgagcaggacaugaaggccuucggcguggaccuggcccugcugcagggcgcccccugcagcugcuuccugcagagagaggagacccuggccagcagcguggccuacugcuucacccaccugagccugcaggaguucguggccgccgccuacuacuacggcgccagcagaagagccaucuucgaccuguucaccgagagcggcgugagcuggcccagacugggcuuccugacccacuucagaagcgccgcccagagagccaugcaggccgaggacggcagacuggacguguuccugagauuccugagcggccugcugagccccagagugaacgcccugcuggccggcagccugcuggcccagggcgagcaccaggccuacagaacccagguggccgagcugcugcagggcugccugagacccgacgccgccgugugcgccagagccaucaacgugcugcacugccugcacgagcugcagcacaccgagcuggccagaagcguggaggaggccauggagagcggcgcccuggccagacugaccggccccgcccacagagccgcccuggccuaccugcugcaggugagcgacgccugcgcccaggaggccaaccugagccugagccugagccagggcgugcugcagagccugcugccccagcugcuguacugcagaaagcugagacuggacaccaaccaguuccaggaccccgugauggagcugcugggcagcgugcugagcggcaaggacugcagaauccagaagaucagccuggccgagaaccagaucagcaacaagggcgccaaggcccuggccagaagccugcuggugaacagaagccugaccagccuggaccugagaggcaacagcaucggcccccagggcgccaaggcccuggccgacgcccugaagaucaacagaacccugaccagccugagccugcagggcaacaccgugagagacgacggcgccagaagcauggccgaggcccuggccagcaacagaacccugagcaugcugcaccugcagaagaacagcaucggccccaugggcgcccagagaauggccgacgcccugaagcagaacagaagccugaaggagcugauguucagcagcaacagcaucggcgacggcggcgccaaggcccuggccgaggcccugaaggugaaccagggccuggagagccuggaccugcagagcaacagcaucagcgacgccggcguggccgcccugaugggcgcccugugcaccaaccagacccugcugagccugagccugagagagaacagcaucagccccgagggcgcccaggccaucgcccacgcccugugcgccaacagcacccugaagaaccuggaccugaccgccaaccugcugcacgaccagggcgccagagccaucgccguggccgugagagagaacagaacccugaccagccugcaccugcaguggaacuucauccaggccggcgccgcccaggcccugggccaggcccugcagcugaacagaagccugaccagccuggaccugcaggagaacgccaucggcgacgacggcgccugcgccguggccagagcccugaaggugaacaccgcccugaccgcccuguaccugcagguggccagcaucggcgccagcggcgcccaggugcugggcgaggcccuggccgugaacagaacccuggagauccuggaccugagaggcaacgccaucggcguggccggcgccaaggcccuggccaacgcccugaaggugaacagcagccugagaagacugaaccugcaggagaacagccugggcauggacggcgccaucugcaucgccaccgcccugagcggcaaccacagacugcagcacaucaaccugcagggcaaccacaucggcgacagcggcgccagaaugaucagcgaggccaucaagaccaacgcccccaccugcaccguggagauguaa

SEQ ID NO: 20578 - RNA, 3075 nt, Artificial Sequence
  NLRC4__Homo_sapiens__NP_001186068
augaacuucaucaaggacaacagcagagcccugauccagagaaugggcaugaccgugaucaagcagaucaccgacgaccuguucguguggaacgugcugaacagagaggaggugaacaucaucugcugcgagaagguggagcaggacgccgccagaggcaucauccacaugauccugaagaagggcagcgagagcugcaaccuguuccugaagagccugaaggaguggaacuacccccuguuccaggaccugaacggccagagccuguuccaccagaccagcgagggcgaccuggacgaccuggcccaggaccugaaggaccuguaccacacccccagcuuccugaacuucuacccccugggcgaggacaucgacaucaucuucaaccugaagagcaccuucaccgagcccgugcuguggagaaaggaccagcaccaccacagaguggagcagcugacccugaacggccugcugcaggcccugcagagccccugcaucaucgagggcgagagcggcaagggcaagagcacccugcugcagagaaucgccaugcuguggggcagcggcaagugcaaggcccugaccaaguucaaguucguguucuuccugagacugagcagagcccagggcggccuguucgagacccugugcgaccagcugcuggacauccccggcaccaucagaaagcagaccuucauggccaugcugcugaagcugagacagagagugcuguuccugcuggacggcuacaacgaguucaagccccagaacugccccgagaucgaggcccugaucaaggagaaccacagauucaagaacauggugaucgugaccaccaccaccgagugccugagacacaucagacaguucggcgcccugaccgccgaggugggcgacaugaccgaggacagcgcccaggcccugaucagagaggugcugaucaaggagcuggccgagggccugcugcugcagauccagaagagcagaugccugagaaaccugaugaagaccccccuguucguggugaucaccugcgccauccagaugggcgagagcgaguuccacagccacacccagaccacccuguuccacaccuucuacgaccugcugauccagaagaacaagcacaagcacaagggcguggccgccagcgacuucaucagaagccuggaccacugcggcgaccuggcccuggagggcguguucagccacaaguucgacuucgagcugcaggacgugagcagcgugaacgaggacgugcugcugaccaccggccugcugugcaaguacaccgcccagagauucaagcccaaguacaaguucuuccacaagagcuuccaggaguacaccgccggcagaagacugagcagccugcugaccagccacgagcccgaggaggugaccaagggcaacggcuaccugcagaagauggugagcaucagcgacaucaccagcaccuacagcagccugcugagauacaccugcggcagcagcguggaggccaccagagccgugaugaagcaccuggccgccguguaccagcacggcugccugcugggccugagcaucgccaagagaccccuguggagacaggagagccugcagagcgugaagaacaccaccgagcaggagauccugaaggccaucaacaucaacagcuucguggagugcggcauccaccuguaccaggagagcaccagcaagagcgcccugagccaggaguucgaggccuucuuccagggcaagagccuguacaucaacagcggcaacauccccgacuaccuguucgacuucuucgagcaccugcccaacugcgccagcgcccuggacuucaucaagcuggacuucuacggcggcgccauggccagcugggagaaggccgccgaggacaccggcggcauccacauggaggaggcccccgagaccuacauccccagcagagccgugagccuguucuucaacuggaagcaggaguucagaacccuggaggugacccugagagacuucagcaagcugaacaagcaggacaucagauaccugggcaagaucuucagcagcgccaccagccugagacugcagaucaagagaugcgccggcguggccggcagccugagccuggugcugagcaccugcaagaacaucuacagccugaugguggaggccagcccccugaccaucgaggacgagagacacaucaccagcgugaccaaccugaagacccugagcauccacgaccugcagaaccagagacugcccggcggccugaccgacagccugggcaaccugaagaaccugaccaagcugaucauggacaacaucaagaugaacgaggaggacgccaucaagcuggccgagggccugaagaaccugaagaagaugugccuguuccaccugacccaccugagcgacaucggcgagggcauggacuacaucgugaagagccugagcagcgagcccugcgaccuggaggagauccagcuggugagcugcugccugagcgccaacgccgugaagauccuggcccagaaccugcacaaccuggugaagcugagcauccuggaccugagcgagaacuaccuggagaaggacggcaacgaggcccugcacgagcugaucgacagaaugaacgugcuggagcagcugaccgcccugaugcugcccuggggcugcgacgugcagggcagccugagcagccugcugaagcaccuggaggaggugccccagcuggugaagcugggccugaagaacuggagacugaccgacaccgagaucagaauccugggcgccuucuucggcaagaacccccugaagaacuuccagcagcugaaccuggccggcaacagagugagcagcgacggcuggcuggccuucaugggcguguucgagaaccugaagcagcugguguucuucgacuucagcaccaaggaguuccugcccgaccccgcccuggugagaaagcugagccaggugcugagcaagcugaccuuccugcaggaggccagacuggugggcuggcaguucgacgacgacgaccugagcgugaucaccggcgccuucaagcuggugaccgccuaa

SEQ ID NO: 20579 - RNA, 5601 nt, Artificial Sequence
  NLRC5__Homo_sapiens__XP_005256251
auggaccccgugggccugcagcugggcaacaagaaccuguggagcugccuggugagacugcugaccaaggaccccgaguggcugaacgccaagaugaaguucuuccugcccaacaccgaccuggacagcagaaacgagacccuggaccccgagcagagagugauccugcagcugaacaagcugcacgugcagggcagcgacaccuggcagagcuucauccacugcgugugcaugcagcuggaggugccccuggaccuggaggugcugcugcugagcaccuucggcuacgacgacggcuucaccagccagcugggcgccgagggcaagagccagcccgagagccagcugcaccacggccugaagagaccccaccagagcugcggcagcagccccagaagaaagcagugcaagaagcagcagcuggagcuggccaagaaguaccugcagcugcugagaaccagcgcccagcagagauacagaagccagauccccggcagcggccagccccacgccuuccaccagguguacgugccccccauccugagaagagccaccgccagccuggacacccccgagggcgccaucaugggcgacgugaagguggaggacggcgccgacgugagcaucagcgaccuguucaacaccagagugaacaagggccccagagugaccgugcugcugggcaaggccggcaugggcaagaccacccuggcccacagacugugccagaagugggccgagggccaccugaacugcuuccaggcccuguuccuguucgaguucagacagcugaaccugaucaccagauuccugacccccagcgagcugcuguucgaccuguaccugagccccgagagcgaccacgacaccguguuccaguaccuggagaagaacgccgaccaggugcugcugaucuucgacggccuggacgaggcccugcagcccaugggccccgacggccccggccccgugcugacccuguucagccaccugugcaacggcacccugcugcccggcugcagagugauggccaccagcagacccggcaagcugcccgccugccugcccgccgaggccgccauggugcacaugcugggcuucgacggccccagaguggaggaguacgugaaccacuucuucagcgcccagcccagcagagagggcgcccugguggagcugcagaccaacggcagacugagaagccugugcgccgugcccgcccugugccagguggccugccugugccugcaccaccugcugcccgaccacgcccccggccagagcguggcccugcugcccaacaugacccagcuguacaugcagauggugcuggcccugagcccccccggccaccugcccaccagcagccugcuggaccugggcgagguggcccugagaggccuggagaccggcaaggugaucuucuacgccaaggacaucgcccccccccugaucgccuucggcgccacccacagccugcugaccagcuucugcgugugcaccggccccggccaccagcagaccggcuacgccuucacccaccugagccugcaggaguuccuggccgcccugcaccugauggccagccccaaggugaacaaggacacccugacccaguacgugacccugcacagcagaugggugcagagaaccaaggccagacugggccugagcgaccaccugcccaccuuccuggccggccuggccagcugcaccugcagacccuuccugagccaccuggcccagggcaacgaggacugcgugggcgccaagcaggccgccguggugcaggugcugaagaagcuggccaccagaaagcugaccggccccaaggugguggagcugugccacugcguggacgagacccaggagcccgagcuggccagccugaccgcccagagccugcccuaccagcugcccuuccacaacuucccccugaccugcaccgaccuggccacccugaccaacauccuggagcacagagaggcccccauccaccuggacuucgacggcugcccccuggagccccacugccccgaggcccuggugggcugcggccagaucgagaaccugagcuucaagagcagaaagugcggcgacgccuucgccgaggcccugagcagaagccugcccaccaugggcagacugcagaugcugggccuggccggcagcaagaucaccgccagaggcaucagccaccuggugaaggcccugccccugugcccccagcugaaggaggugagcuucagagacaaccagcugagcgaccagguggugcugaacaucguggaggugcugccccaccugcccagacugagaaagcuggaccugagcagcaacagcaucugcgugagcacccugcugugccuggccagaguggccgugaccugccccaccgugagaaugcugcaggccagagaggccgaccugaucuuccugcugagcccccccaccgagaccaccgccgagcugcagagagcccccgaccugcaggagagcgacggccagagaaagggcgcccagagcagaagccugacccugagacugcagaagugccagcugcaggugcacgacgccgaggcccugaucgcccugcugcaggagggcccccaccuggaggagguggaccugagcggcaaccagcuggaggacgagggcugcagacugauggccgaggccgccagccagcugcacaucgccagaaagcuggaccugagcaacaacggccugagcguggccggcgugcacugcgugcugagagccgugagcgccugcuggacccuggccgagcugcacaucagccugcagcacaagaccgugaucuucauguucgcccaggagcccgaggagcagaagggcccccaggagagagccgccuuccuggacagccugaugcugcagaugcccagcgagcugccccugagcagcagaagaaugagacugacccacugcggccugcaggagaagcaccuggagcagcugugcaaggcccugggcggcagcugccaccugggccaccugcaccuggacuucagcggcaacgcccugggcgacgagggcgccgccagacuggcccagcugcugcccggccugggcgcccugcagagccugaaccugagcgagaacggccugagccuggacgccgugcugggccuggugagaugcuucagcacccugcaguggcuguucagacuggacaucagcuucgagagccagcacauccugcugagaggcgacaagaccagcagagacaugugggccaccggcagccugcccgacuuccccgccgccgccaaguuccugggcuucagacagagaugcauccccagaagccugugccugagcgagugcccccuggagccccccagccugaccagacugugcgccacccugaaggacugccccggcccccuggagcugcagcugagcugcgaguuccugagcgaccagagccuggagacccugcuggacugccugccccagcugccccagcugagccugcugcagcugagccagaccggccugagccccaagagccccuuccugcuggccaacacccugagccugugccccagagugaagaagguggaccugagaagccugcaccacgccacccugcacuucagaagcaacgaggaggaggagggcgugugcugcggcagauucaccggcugcagccugagccaggagcacguggagagccugugcuggcugcugagcaagugcaaggaccugagccagguggaccugagcgccaaccugcugggcgacagcggccugagaugccugcuggagugccugccccaggugcccaucagcggccugcuggaccugagccacaacagcaucagccaggagagcgcccuguaccugcuggagacccugcccagcugccccagagugagagaggccagcgugaaccugggcagcgagcagagcuucagaauccacuucagcagagaggaccaggccggcaagacccugagacugagcgagugcagcuucagacccgagcacgugagcagacuggccaccggccugagcaagagccugcagcugaccgagcugacccugacccagugcugccugggccagaagcagcuggccauccugcugagccuggugggcagacccgccggccuguucagccugagagugcaggagcccugggccgacagagccagagugcugagccugcuggaggugugcgcccaggccagcggcagcgugaccgagaucagcaucagcgagacccagcagcagcugugcgugcagcuggaguuccccagacaggaggagaaccccgaggccguggcccugagacuggcccacugcgaccugggcgcccaccacagccugcuggugggccagcugauggagaccugcgccagacugcagcagcugagccugagccaggugaaccugugcgaggacgacgacgccagcagccugcugcugcagagccugcugcugagccugagcgagcugaagaccuucagacugaccagcagcugcgugagcaccgagggccuggcccaccuggccagcggccugggccacugccaccaccuggaggagcuggaccugagcaacaaccaguucgacgaggagggcaccaaggcccugaugagagcccuggagggcaaguggaugcugaagagacuggaccugagccaccugcugcugaacagcagcacccuggcccugcugacccacagacugagccagaugaccugccugcagagccugagacugaacagaaacagcaucggcgacgugggcugcugccaccugagcgaggcccugagagccgccaccagccuggaggagcuggaccugagccacaaccagaucggcgacgccggcgugcagcaccuggccaccauccugcccggccugcccgagcugagaaagaucgaccugagcggcaacagcaucagcagcgccggcggcgugcagcuggccgagagccuggugcugugcagaagacuggaggagcugaugcugggcugcaacgcccugggcgaccccaccgcccugggccuggcccaggagcugccccagcaccugagagugcugcaccugcccuucagccaccugggccccggcggcgcccugagccuggcccaggcccuggacggcagcccccaccuggaggagaucagccuggccgagaacaaccuggccggcggcgugcugagauucugcauggagcugccccugcugagacagaucgaccuggugagcugcaagaucgacaaccagaccgccaagcugcugaccagcagcuucaccagcugccccgcccuggaggugauccugcugagcuggaaccugcugggcgacgaggccgccgccgagcuggcccaggugcugccccagaugggcagacugaagagaguggaccuggagaagaaccagaucaccgcccugggcgccuggcugcuggccgagggccuggcccagggcagcagcauccaggugaucagacuguggaacaaccccauccccugcgacauggcccagcaccugaagagccaggagcccagacuggacuucgccuucuucgacaaccagccccaggcccccuggggcaccuaa

SEQ ID NO: 20580 - RNA, 1968 nt, Artificial Sequence
  NLRP10__Homo_sapiens__XP_011518345
auggccauggccaaggccagaaagcccagagaggcccugcugugggcccugagcgaccuggaggagaacgacuucaagaagcugaaguucuaccugagagacaugacccugagcgagggccagcccccccuggccagaggcgagcuggagggccugauccccguggaccuggccgagcugcugaucagcaaguacggcgagaaggaggccgugaagguggugcugaagggccugaaggugaugaaccugcuggagcugguggaccagcugagccacaucugccugcacgacuacagagagguguacagagagcacgugagaugccuggaggaguggcaggaggccggcgugaacggcagauacaaccaggugcugcugguggccaagcccagcagcgagagccccgagagccuggccugccccuuccccgagcaggagcuggagagcgugaccguggaggcccuguucgacagcggcgagaagcccagccuggcccccagccugguggugcugcagggcagcgccggcaccggcaagaccacccuggccagaaagauggugcuggacugggccaccggcacccuguaccccggcagauucgacuacguguucuacgugagcugcaaggagguggugcugcugcuggagagcaagcuggagcagcugcuguucuggugcugcggcgacaaccaggcccccgugaccgagauccugagacagcccgagagacugcuguucauccuggacggcuucgacgagcugcagagacccuucgaggagaagcugaagaagagaggccugagccccaaggagagccugcugcaccugcugaucagaagacacacccugcccaccugcagccugcugaucaccaccagaccccuggcccugagaaaccuggagccccugcugaagcaggccagacacgugcacauccugggcuucagcgaggaggagagagccagauacuucagcagcuacuucaccgacgagaagcaggccgacagagccuucgacaucgugcagaagaacgacauccuguacaaggccugccaggugcccggcaucugcuggguggugugcagcuggcugcagggccagauggagagaggcaagguggugcuggagacccccagaaacagcaccgacaucuucauggccuacgugagcaccuuccugccccccgacgacgacggcggcugcagcgagcugagcagacacagagugcugagaagccugugcagccuggccgccgagggcauccagcaccagagauuccuguucgaggaggccgagcugagaaagcacaaccuggacggccccagacuggccgccuuccugagcagcaacgacuaccagcugggccuggccaucaagaaguucuacagcuucagacacaucagcuuccaggacuucuuccacgccaugagcuaccuggugaaggaggaccagagcagacugggcaaggagagcagaagagaggugcagagacugcuggaggugaaggagcaggagggcaacgacgagaugacccugaccaugcaguuccugcuggacaucagcaagaaggacagcuucagcaaccuggagcugaaguucugcuucagaaucagccccugccuggcccaggaccugaagcacuucaaggagcagauggagagcaugaagcacaacagaaccugggaccuggaguucagccuguacgaggccaagaucaagaaccuggugaagggcauccagaugaacaacgugagcuucaagaucaagcacagcaacgagaagaagagccagagccagaaccuguucagcgugaagagcagccugagccacggccccaaggaggagcagaagugccccagcgugcacggccagaaggagggcaaggacaacaucgccggcacccagaaggaggccagcaccggcaagggcagaggcaccgaggagacccccaagaacaccuacaucuaa

SEQ ID NO: 20581 - RNA, 3102 nt, Artificial Sequence
  NLRP11__Homo_sapiens__NP_659444
auggccgagagcgacagcaccgacuucgaccugcugugguaccuggagaaccugagcgacaaggaguuccagagcuucaagaaguaccuggccagaaagauccuggacuucaagcugccccaguucccccugauccagaugaccaaggaggagcuggccaacgugcugcccaucagcuacgagggccaguacaucuggaacaugcuguucagcaucuucagcaugaugagaaaggaggaccugugcagaaagaucaucggcagaagaaacagaaaccaggaggccugcaaggccgugaugagaagaaaguucaugcugcagugggagagccacaccuucggcaaguuccacuacaaguucuucagagacgugagcagcgacguguucuacauccugcagcuggccuacgacagcaccagcuacuacagcgccaacaaccugaacguguuccugaugggcgagagagccagcggcaagaccaucgugaucaaccuggccgugcugagauggaucaagggcgagauguggcagaacaugaucagcuacguggugcaccugaccgcccacgagaucaaccagaugaccaacagcagccuggccgagcugaucgccaaggacuggcccgacggccaggcccccaucgccgacauccugagcgaccccaagaagcugcuguucauccuggaggaccuggacaacaucagauucgagcugaacgugaacgagagcgcccugugcagcaacagcacccagaaggugcccauccccgugcugcuggugagccugcugaagagaaagauggcccccggcugcugguuccugaucagcagcagacccaccagaggcaacaacgugaagaccuuccugaaggagguggacugcugcaccacccugcagcugagcaacggcaagagagagaucuacuucaacagcuucuucaaggacagacagagagccagcgccgcccugcagcuggugcacgaggacgagauccuggugggccugugcagaguggccauccugugcuggaucaccugcaccgugcugaagagacagauggacaagggcagagacuuccagcugugcugccagacccccaccgaccugcacgcccacuuccuggccgacgcccugaccagcgaggccggccugaccgccaaccaguaccaccugggccugcugaagagacugugccugcuggccgccggcggccuguuccugagcacccugaacuucagcggcgaggaccugagaugcgugggcuucaccgaggccgacgugagcgugcugcaggccgccaacauccugcugcccagcaacacccacaaggacagauacaaguucauccaccugaacgugcaggaguucugcaccgccaucgccuuccugauggccgugcccaacuaccugauccccagcggcagcagagaguacaaggagaagagagagcaguacagcgacuucaaccagguguucaccuucaucuucggccugcugaacgccaacagaagaaagauccuggagaccagcuucggcuaccagcugcccaugguggacagcuucaagugguacagcgugggcuacaugaagcaccuggacagagaccccgagaagcugacccaccacaugccccuguucuacugccuguacgagaacagagaggaggaguucgugaagaccaucguggacgcccugauggaggugaccguguaccugcagagcgacaaggacaugauggugagccuguacugccuggacuacugcugccaccugagaacccugaagcugagcgugcagagaaucuuccagaacaaggagccccugaucagacccaccgccagccagaugaagagccugguguacuggagagagaucugcagccuguucuacaccauggagagccugagagagcugcacaucuucgacaacgaccugaacggcaucagcgagagaauccugagcaaggcccuggagcacagcagcugcaagcugagaacccugaagcugagcuacgugagcaccgccagcggcuucgaggaccugcugaaggcccuggccagaaacagaagccugaccuaccugagcaucaacugcaccagcaucagccugaacauguucagccugcugcacgacauccugcacgagcccaccugccagaucagccaccugagccugaugaagugcgaccugagagccagcgagugcgaggagaucgccagccugcugaucagcggcggcagccugagaaagcugacccugagcagcaacccccugagaagcgacggcaugaacauccugugcgacgcccugcugcaccccaacugcacccugaucagccuggugcugguguucugcugccugaccgagaacugcugcagcgcccugggcagagugcugcuguucagccccacccugagacagcuggaccugugcgugaacagacugaagaacuacggcgugcugcacgugaccuucccccugcuguuccccaccugccagcuggaggagcugcaccugagcggcugcuucuucagcagcgacaucugccaguacaucgccaucgugaucgccaccaacgagaagcugagaagccuggagaucggcagcaacaagaucgaggacgccggcaugcagcugcugugcggcggccugagacaccccaacugcaugcuggugaacaucggccuggaggagugcaugcugaccagcgccugcugcagaagccuggccagcgugcugaccaccaacaagacccuggagagacugaaccugcugcagaaccaccugggcaacgacggcguggccaagcugcuggagagccugaucagccccgacugcgugcugaagguggugggccugccccugaccggccugaacacccagacccagcagcugcugaugaccgugaaggagagaaagcccagccugaucuuccugagcgagaccuggagccugaaggagggcagagagaucggcgugacccccgccagccagcccggcagcaucauccccaacagcaaccuggacuacauguucuucaaguuccccagaaugagcgccgccaugagaaccagcaacaccgccagcagacagccccuguaa

SEQ ID NO: 20582 - RNA, 3189 nt, Artificial Sequence
  NLRP12__Homo_sapiens__NP_001264055
augcugagaaccgccggcagagacggccugugcagacugagcaccuaccuggaggagcuggaggccguggagcugaagaaguucaagcuguaccugggcaccgccaccgagcugggcgagggcaagauccccuggggcagcauggagaaggccggcccccuggagauggcccagcugcugaucacccacuucggccccgaggaggccuggagacuggcccugagcaccuucgagagaaucaacagaaaggaccugugggagagaggccagagagaggaccuggugagagacaccccccccggcggccccagcagccugggcaaccagagcaccugccugcuggaggugagccuggugacccccagaaaggacccccaggagaccuacagagacuacgugagaagaaaguucagacugauggaggacagaaacgccagacugggcgagugcgugaaccugagccacagauacaccagacugcugcuggugaaggagcacagcaaccccaugcaggugcagcagcagcugcuggacaccggcagaggccacgccagaaccgugggccaccaggccagccccaucaagaucgagacccuguucgagcccgacgaggagagacccgagccccccagaaccguggugaugcagggcgccgccggcaucggcaagagcaugcuggcccacaaggugaugcuggacugggccgacggcaagcuguuccagggcagauucgacuaccuguucuacaucaacugcagagagaugaaccagagcgccaccgagugcagcaugcaggaccugaucuucagcugcuggcccgagcccagcgccccccugcaggagcugaucagagugcccgagagacugcuguucaucaucgacggcuucgacgagcugaagcccagcuuccacgacccccagggccccuggugccugugcugggaggagaagagacccaccgagcugcugcugaacagccugaucagaaagaagcugcugcccgagcugagccugcugaucaccaccagacccaccgcccuggagaagcugcacagacugcuggagcaccccagacacguggagauccugggcuucagcgaggccgagagaaaggaguacuucuacaaguacuuccacaacgccgagcaggccggccagguguucaacuacgugagagacaacgagccccuguucaccaugugcuucgugccccuggugugcuggguggugugcaccugccugcagcagcagcuggagggcggcggccugcugagacagaccagcagaaccaccaccgccguguacaugcuguaccugcugagccugaugcagcccaagcccggcgcccccagacugcagcccccccccaaccagagaggccugugcagccuggccgccgacggccuguggaaccagaagauccuguucgaggagcaggaccugagaaagcacggccuggacggcgaggacgugagcgccuuccugaacaugaacaucuuccagaaggacaucaacugcgagagauacuacagcuucauccaccugagcuuccaggaguucuucgccgccauguacuacauccuggacgagggcgagggcggcgccggccccgaccaggacgugaccagacugcugaccgaguacgccuucagcgagagaagcuuccuggcccugaccagcagauuccuguucggccugcugaacgaggagaccagaagccaccuggagaagagccugugcuggaaggugagcccccacaucaagauggaccugcugcaguggauccagagcaaggcccagagcgacggcagcacccugcagcagggcagccuggaguucuucagcugccuguacgagauccaggaggaggaguucauccagcaggcccugagccacuuccaggugaucguggugagcaacaucgccagcaagauggagcacauggugagcagcuucugccugaagagaugcagaagcgcccaggugcugcaccuguacggcgccaccuacagcgccgacggcgaggacagagccagaugcagcgccggcgcccacacccugcuggugcagcugagacccgagagaaccgugcugcuggacgccuacagcgagcaccuggccgccgcccugugcaccaaccccaaccugaucgagcugagccuguacagaaacgcccugggcagcagaggcgugaagcugcugugccagggccugagacaccccaacugcaagcugcagaaccugagacugaagagaugcagaaucagcagcagcgccugcgaggaccugagcgccgcccugaucgccaacaagaaccugaccagaauggaccugagcggcaacggcgugggcuuccccggcaugaugcugcugugcgagggccugagacacccccagugcagacugcagaugauccagcugagaaagugccagcuggagagcggcgccugccaggagauggccagcgugcugggcaccaacccccaccugguggagcuggaccugaccggcaacgcccuggaggaccugggccugagacugcugugccagggccugagacaccccgugugcagacugagaacccuguggcugaagaucugcagacugaccgccgccgccugcgacgagcuggccagcacccugagcgugaaccagagccugagagagcuggaccugagccugaacgagcugggcgaccugggcgugcugcugcugugcgagggccugagacaccccaccugcaagcugcagacccugagacugggcaucugcagacugggcagcgccgccugcgagggccugagcguggugcugcaggccaaccacaaccugagagagcuggaccugagcuucaacgaccugggcgacuggggccuguggcugcuggccgagggccugcagcaccccgccugcagacugcagaagcuguggcuggacagcugcggccugaccgccaaggccugcgagaaccuguacuucacccugggcaucaaccagacccugaccgaccuguaccugaccaacaacgcccugggcgacaccggcgugagacugcugugcaagagacugagccaccccggcugcaagcugagagugcuguggcuguucggcauggaccugaacaagaugacccacagcagacuggccgcccugagagugaccaagcccuaccuggacaucggcugcuaa

SEQ ID NO: 20583 - RNA, 3132 nt, Artificial Sequence
  NLRP13__Homo_sapiens__NP_789780
augaacuucagcgugaucaccugccccaacggcggcaccaaccagggccugcugcccuaccugauggcccuggaccaguaccagcuggaggaguucaagcugugccuggagccccagcagcugauggacuucuggagcgccccccagggccacuuccccagaauccccugggccaaccugagagccgccgacccccugaaccugagcuuccugcuggacgagcacuuccccaagggccaggccuggaagguggugcugggcaucuuccagaccaugaaccugaccagccugugcgagaaggugagagccgagaugaaggagaacgugcagacccaggagcugcaggaccccacccaggaggaccuggagaugcuggaggccgccgccggcaacaugcagacccagggcugccaggaccccaaccaggaggagcuggacgagcuggaggaggagaccggcaacgugcaggcccagggcugccaggaccccaaccaggaggagcccgagaugcuggaggaggccgaccacagaagaaaguacagagagaacaugaaggccgagcugcuggagaccugggacaacaucagcuggcccaaggaccacguguacaucagaaacaccagcaaggacgagcacgaggagcugcagagacugcuggaccccaacagaaccagagcccaggcccagaccaucgugcuggugggcagagccggcgugggcaagaccacccuggccaugcaggccaugcugcacugggccaacggcgugcuguuccagcagagauucagcuacguguucuaccugagcugccacaagaucagauacaugaaggagaccaccuucgccgagcugaucagccuggacuggcccgacuucgacgcccccaucgaggaguucaugagccagcccgagaagcugcuguucaucaucgacggcuucgaggagaucaucaucagcgagagcagaagcgagagccuggacgacggcagccccugcaccgacugguaccaggagcugcccgugaccaagauccugcacagccugcugaagaaggagcuggugccccuggccacccugcugaucaccaucaagaccugguucgugagagaccugaaggccagccuggugaaccccugcuucgugcagaucaccggcuucaccggcgacgaccugagaguguacuucaugagacacuucgacgacagcagcgagguggagaagauccugcagcagcugagaaagaacgagacccuguuccacagcugcagcgcccccauggugugcuggaccgugugcagcugccugaagcagcccaaggugagauacuacgaccugcagagcaucacccagaccaccaccagccuguacgccuacuucuucagcaaccuguucagcaccgccgagguggaccuggccgacgacagcuggcccggccaguggagagcccugugcagccuggccaucgagggccuguggagcaugaacuucaccuucaacaaggaggacaccgagaucgagggccuggaggugcccuucaucgacagccuguacgaguucaacauccugcagaagaucaacgacugcggcggcugcaccaccuucacccaccugagcuuccaggaguucuucgccgccaugagcuucgugcuggaggagcccagagaguuccccccccacagcaccaagccccaggagaugaagaugcugcugcagcacgugcugcuggacaaggaggccuacuggacccccguggugcuguucuucuucggccugcugaacaagaacaucgccagagagcuggaggacacccugcacugcaagaucagccccagagugauggaggagcugcugaaguggggcgaggagcugggcaaggccgagagcgccagccugcaguuccacauccugagacuguuccacugccugcacgagagccaggaggaggacuucaccaagaagaugcugggcagaaucuucgagguggaccugaacauccuggaggacgaggagcugcaggccagcagcuucugccugaagcacugcaagagacugaacaagcugagacugagcgugagcagccacauccuggagagagaccuggagauccuggagaccagcaaguucgacagcagaaugcacgccuggaacagcaucugcagcacccuggugaccaacgagaaccugcacgagcuggaccugagcaacagcaagcugcacgccagcagcgugaagggccugugccuggcccugaagaaccccagaugcaaggugcagaagcugaccugcaagagcgugacccccgagugggugcugcaggaccugaucaucgcccugcagggcaacagcaagcugacccaccugaacuucagcagcaacaagcugggcaugaccgugccccugauccugaaggcccugagacacagcgccugcaaccugaaguaccugugccuggagaagugcaaccugagcgccgccagcugccaggaccuggcccuguuccugaccagcauccagcacgugaccagacugugccugggcuucaacagacugcaggacgacggcaucaagcugcugugcgccgcccugacccaccccaagugcgcccuggagagacuggagcugugguucugccagcuggccgcccccgccugcaagcaccugagcgacgcccugcugcagaacagaagccugacccaccugaaccugagcaagaacagccugagagacgagggcgugaaguuccugugcgaggcccugggcagacccgacggcaaccugcagagccugaaccugagcggcugcagcuucaccagagagggcugcggcgagcuggccaacgcccugagccacaaccacaacgugaagauccuggaccugggcgagaacgaccugcaggacgacggcgugaagcugcugugcgaggcccugaagccccacagagcccugcacacccugggccuggccaagugcaaccugaccaccgccugcugccagcaccuguucagcgugcugagcagcagcaagagccuggugaaccugaaccugcugggcaacgagcuggacaccgacggcgugaagaugcugugcaaggcccugaagaagagcaccugcagacugcagaagcugggcuaa

SEQ ID NO: 20584 - RNA, 3282 nt, Artificial Sequence
  NLRP14__Homo_sapiens__NP_789792
auggccgacagcagcagcagcagcuucuuccccgacuucggccugcugcuguaccuggaggagcugaacaaggaggagcugaacaccuucaagcuguuccugaaggagaccauggagcccgagcacggccugacccccuggaacgaggugaagaaggccagaagagaggaccuggccaaccugaugaagaaguacuaccccggcgagaaggccuggagcgugagccugaagaucuucggcaagaugaaccugaaggaccugugcgagagagccaaggaggagaucaacuggagcgcccagaccaucggccccgacgacgccaaggccggcgagacccaggaggaccaggaggccgugcugggcgacggcaccgaguacagaaacagaaucaaggagaaguucugcaucaccugggacaagaagagccuggccggcaagcccgaggacuuccaccacggcaucgccgagaaggacagaaagcugcuggagcaccuguucgacguggacgugaagaccggcgcccagccccagaucguggugcugcagggcgccgccggcgugggcaagaccacccuggugagaaaggccaugcuggacugggccgagggcagccuguaccagcagagauucaaguacguguucuaccugaacggcagagagaucaaccagcugaaggagagaagcuucgcccagcugaucagcaaggacuggcccagcaccgagggccccaucgaggagaucauguaccagcccagcagccugcuguucaucaucgacagcuucgacgagcugaacuucgccuucgaggagcccgaguucgcccugugcgaggacuggacccaggagcaccccgugagcuuccugaugagcagccugcugagaaaggugaugcugcccgaggccagccugcuggugaccaccagacugaccaccagcaagagacugaagcagcugcugaagaaccaccacuacguggagcugcugggcaugagcgaggacgccagagaggaguacaucuaccaguucuucgaggacaagagaugggccaugaagguguucagcagccugaagagcaacgagaugcuguucagcaugugccaggugccccuggugugcugggccgccugcaccugccugaagcagcagauggagaagggcggcgacgugacccugaccugccagaccaccaccgcccuguucaccugcuacaucagcagccuguucacccccguggacggcggcagccccagccugcccaaccaggcccagcugagaagacugugccagguggccgccaagggcaucuggaccaugaccuacguguucuacagagagaaccugagaagacugggccugacccagagcgacgugagcagcuucauggacagcaacaucauccagaaggacgccgaguacgagaacugcuacguguucacccaccugcacgugcaggaguucuucgccgccauguucuacaugcugaagggcagcugggaggccggcaaccccagcugccagcccuucgaggaccugaagagccugcugcagagcaccagcuacaaggacccccaccugacccagaugaagugcuuccuguucggccugcugaacgaggacagagugaagcagcuggagagaaccuucaacugcaagaugagccugaagaucaagagcaagcugcugcagugcauggaggugcugggcaacagcgacuacagccccagccagcugggcuuccuggagcuguuccacugccuguacgagacccaggacaaggccuucaucagccaggccaugagaugcuuccccaagguggccaucaacaucugcgagaagauccaccugcuggugagcagcuucugccugaagcacugcagaugccugagaaccaucagacugagcgugaccgugguguucgagaagaagauccugaagaccagccugcccaccaacaccugggacggcgacagaaucacccacugcuggcaggaccugugcagcgugcugcacaccaacgagcaccugagagagcuggaccuguaccacagcaaccuggacaagagcgccaugaacauccugcaccacgagcugagacaccccaacugcaagcugcagaagcugcugcugaaguucaucaccuuccccgacggcugccaggacaucagcaccagccugauccacaacaagaaccugaugcaccuggaccugaagggcagcgacaucggcgacaacggcgugaagagccugugcgaggcccugaagcaccccgagugcaagcugcagacccugagacuggagagcugcaaccugaccguguucugcugccugaacaucagcaacgcccugaucagaagccagagccugaucuuccugaaccugagcaccaacaaccugcuggacgacggcgugcagcugcugugcgaggcccugagacaccccaagugcuaccuggagagacugagccuggagagcugcggccugaccgaggccggcugcgaguaccugagccuggcccugaucagcaacaagagacugacccaccugugccuggccgacaacgugcugggcgacggcggcgugaagcugaugagcgacgcccugcagcacgcccagugcacccugaagagccuggugcugagaagaugccacuucaccagccugagcagcgaguaccugagcaccagccugcugcacaacaagagccugacccaccuggaccugggcagcaacuggcugcaggacaacggcgugaagcugcugugcgacguguucagacaccccagcugcaaccugcaggaccuggagcugaugggcugcgugcugaccaacgccugcugccuggaccuggccagcgugauccugaacaaccccaaccugagaagccuggaccugggcaacaacgaccugcaggacgacggcgugaagauccugugcgacgcccugagauaccccaacugcaacauccagagacugggccuggaguacugcggccugaccagccugugcugccaggaccugagcagcgcccugaucugcaacaagagacugaucaagaugaaccugacccagaacacccugggcuacgagggcaucgugaagcuguacaaggugcugaagagccccaagugcaagcugcaggugcugggccugugcaaggaggccuucgacgaggaggcccagaagcugcuggaggccgugggcgugagcaacccccaccugaucaucaagcccgacugcaacuaccacaacgaggaggacgugagcuggugguggugcuucuaa

SEQ ID NO: 20585 - RNA, 4128 nt, Artificial Sequence
  NLRP1__Homo_sapiens__NP_001028225
auggccggcggcgccuggggcagacuggccugcuaccuggaguuccugaagaaggaggagcugaaggaguuccagcugcugcuggccaacaaggcccacagcagaagcagcagcggcgagacccccgcccagcccgagaagaccagcggcauggagguggccagcuaccugguggcccaguacggcgagcagagagccugggaccuggcccugcacaccugggagcagaugggccugagaagccugugcgcccaggcccaggagggcgccggccacagccccagcuuccccuacagccccagcgagccccaccugggcagccccagccagcccaccagcaccgccgugcugaugcccuggauccacgagcugcccgccggcugcacccagggcagcgagagaagagugcugagacagcugcccgacaccagcggcagaagauggagagagaucagcgccagccugcuguaccaggcccugcccagcagccccgaccacgagagccccagccaggagagccccaacgcccccaccagcaccgccgugcugggcagcuggggcagccccccccagcccagccuggcccccagagagcaggaggcccccggcacccaguggccccuggacgagaccagcggcaucuacuacaccgagaucagagagagagagagagagaagagcgagaagggcagaccccccugggccgccguggugggcacccccccccaggcccacaccagccugcagccccaccaccaccccugggagcccagcgugagagagagccugugcagcaccuggcccuggaagaacgaggacuucaaccagaaguucacccagcugcugcugcugcagagaccccaccccagaagccaggacccccuggugaagagaagcuggcccgacuacguggaggagaacagaggccaccugaucgagaucagagaccuguucggccccggccuggacacccaggagcccagaaucgugauccugcagggcgccgccggcaucggcaagagcacccuggccagacaggugaaggaggccuggggcagaggccagcuguacggcgacagauuccagcacguguucuacuucagcugcagagagcuggcccagagcaagguggugagccuggccgagcugaucggcaaggacggcaccgccacccccgcccccaucagacagauccugagcagacccgagagacugcuguucauccuggacggcguggacgagcccggcugggugcugcaggagcccagcagcgagcugugccugcacuggagccagccccagcccgccgacgcccugcugggcagccugcugggcaagaccauccugcccgaggccagcuuccugaucaccgccagaaccaccgcccugcagaaccugauccccagccuggagcaggccagauggguggaggugcugggcuucagcgagagcagcagaaaggaguacuucuacagauacuucaccgacgagagacaggccaucagagccuucagacuggugaagagcaacaaggagcugugggcccugugccuggugcccugggugagcuggcuggccugcaccugccugaugcagcagaugaagagaaaggagaagcugacccugaccagcaagaccaccaccacccugugccugcacuaccuggcccaggcccugcaggcccagccccugggcccccagcugagagaccugugcagccuggccgccgagggcaucuggcagaagaagacccuguucagccccgacgaccugagaaagcacggccuggacggcgccaucaucagcaccuuccugaagaugggcauccugcaggagcaccccaucccccugagcuacagcuucauccaccugugcuuccaggaguucuucgccgccaugagcuacgugcuggaggacgagaagggcagaggcaagcacagcaacugcaucaucgaccuggagaagacccuggaggccuacggcauccacggccuguucggcgccagcaccaccagauuccugcugggccugcugagcgacgagggcgagagagagauggagaacaucuuccacugcagacugagccagggcagaaaccugaugcagugggugcccagccugcagcugcugcugcagccccacagccuggagagccugcacugccuguacgagaccagaaacaagaccuuccugacccaggugauggcccacuucgaggagaugggcaugugcguggagaccgacauggagcugcuggugugcaccuucugcaucaaguucagcagacacgugaagaagcugcagcugaucgagggcagacagcacagaagcaccuggagccccaccaugguggugcuguucagaugggugcccgugaccgacgccuacuggcagauccuguucagcgugcugaaggugaccagaaaccugaaggagcuggaccugagcggcaacagccugagccacagcgccgugaagagccugugcaagacccugagaagacccagaugccugcuggagacccugagacuggccggcugcggccugaccgccgaggacugcaaggaccuggccuucggccugagagccaaccagacccugaccgagcuggaccugagcuucaacgugcugaccgacgccggcgccaagcaccugugccagagacugagacagcccagcugcaagcugcagagacugcagcuggugagcugcggccugaccagcgacugcugccaggaccuggccagcgugcugagcgccagccccagccugaaggagcuggaccugcagcagaacaaccuggacgacgugggcgugagacugcugugcgagggccugagacaccccgccugcaagcugaucagacugggccuggaccagaccacccugagcgacgagaugagacaggagcugagagcccuggagcaggagaagccccagcugcugaucuucagcagaagaaagcccagcgugaugacccccaccgagggccuggacaccggcgagaugagcaacagcaccagcagccugaagagacagagacugggcagcgagagagccgccagccacguggcccaggccaaccugaagcugcuggacgugagcaagaucuuccccaucgccgagaucgccggcaagagccacgaggagagcagccccgagguggugcccguggagcugcugugcgugcccagccccgccagccagggcgaccugcacaccaagccccugggcaccgacgacgacuucuggggccccaccggccccguggccaccgaggugguggacaaggagaagaaccuguacagagugcacuuccccguggccggcagcuacagauggcccaacaccggccugugcuucgugaugagagaggccgugaccguggagaucgaguucugcgugugggaccaguuccugggcgagaucaacccccagcacagcuggaugguggccggcccccugcuggacaucaaggccgagcccggcgccguggaggccgugcaccugccccacuucguggcccugcagggcggccacguggacaccagccuguuccagauggcccacuucaaggaggagggcaugcugcuggagaagcccgccagaguggagcugcaccacaucgugcuggagaaccccagcuucagcccccugggcgugcugcugaagaugauccacaacgcccugagauucauccccgugaccagcguggugcugcuguaccacagagugcaccccgaggaggugaccuuccaccuguaccugauccccagcgacugcagcaucagaaaggccaucgacgaccuggagaugaaguuccaguucgugagaauccacaagccccccccccugaccccccuguacaugggcugcagauacaccgugagcggcagcggcagcggcaugcuggagauccugcccaaggagcuggagcugugcuacagaagccccggcgaggaccagcuguucagcgaguucuacgugggccaccugggcagcggcaucagacugcaggugaaggacaagaaggacgagacccuggugugggaggcccuggugaagcccggcagaaacaccagccagcccuggaaccugagaugcaacagagacgccagaagauacuaa

SEQ ID NO: 20586 - RNA, 3189 nt, Artificial Sequence
  NLRP2__Homo_sapiens__NP_001167552
auggugagcagcgcccagaugggcuucaaccugcaggcccugcuggagcagcugagccaggacgagcugagcaaguucaaguaccugaucaccaccuucagccuggcccacgagcugcagaagaucccccacaaggagguggacaaggccgacggcaagcagcugguggagauccugaccacccacugcgacagcuacuggguggagauggccagccugcagguguucgagaagaugcacagaauggaccugagcgagagagccaaggacgaggugagagaggccgcccugaagagcuucaacaagagaaagccccugagccugggcaucaccagaaaggagagacccccccuggacguggacgagaugcuggagagauucaagaccgaggcccaggccuucaccgagaccaagggcaacgugaucugccugggcaaggagguguucaagggcaagaagcccgacaaggacaacagaugcagauacauccugaagaccaaguucagagagauguggaagagcuggcccggcgacagcaaggaggugcaggugauggccgagagauacaagaugcugauccccuucagcaaccccagagugcugcccggccccuucagcuacaccguggugcuguacggccccgccggccugggcaagaccacccuggcccagaagcugaugcuggacugggccgaggacaaccugauccacaaguucaaguacgccuucuaccugagcugcagagagcugagcagacugggccccugcagcuucgccgagcugguguucagagacuggcccgagcugcaggacgacaucccccacauccuggcccaggccagaaagauccuguucgugaucgacggcuucgacgagcugggcgccgcccccggcgcccugaucgaggacaucugcggcgacugggagaagaagaagcccgugcccgugcugcugggcagccugcugaacagagugaugcugcccaaggccgcccugcuggugaccaccagacccagagcccugagagaccugagaauccuggccgaggagcccaucuacaucagaguggagggcuuccuggaggaggacagaagagccuacuuccugagacacuucggcgacgaggaccaggccaugagagccuucgagcugaugagaagcaacgccgcccuguuccagcugggcagcgcccccgccgugugcuggaucgugugcaccacccugaagcugcagauggagaagggcgaggaccccgugcccaccugccugaccagaaccggccuguuccugagauuccugugcagcagauucccccagggcgcccagcugagaggcgcccugagaacccugagccugcuggccgcccagggccugugggcccagaccagcgugcugcacagagaggaccuggagagacugggcgugcaggagagcgaccugagacuguuccuggacggcgacauccugagacaggacagagugagcaagggcugcuacagcuucauccaccugagcuuccagcaguuccugaccgcccuguucuacacccuggagaaggaggaggaggaggacagagacggccacaccugggacaucggcgacgugcagaagcugcugagcggcguggagagacugagaaaccccgaccugauccaggccggcuacuacagcuucggccuggccaacgagaagagagccaaggagcuggaggccaccuucggcugcagaaugagccccgacaucaagcaggagcugcugagaugcgacaucagcugcaagggcggccacagcaccgugaccgaccugcaggagcugcugggcugccuguacgagagccaggaggaggagcuggugaaggaggugauggcccaguucaaggagaucagccugcaccugaacgccguggacguggugcccagcagcuucugcgugaagcacugcagaaaccugcagaagaugagccugcaggugaucaaggagaaccugcccgagaacgugaccgccagcgagagcgacgccgagguggagagaagccaggacgaccagcacaugcugcccuucuggaccgaccugugcagcaucuucggcagcaacaaggaccugaugggccuggccaucaacgacagcuuccugagcgccagccuggugagaauccugugcgagcagaucgccagcgacaccugccaccugcagagagugguguucaagaacaucagccccgccgacgcccacagaaaccugugccuggcccugagaggccacaagaccgugaccuaccugacccugcagggcaacgaccaggacgacauguuccccgcccugugcgaggugcugagacaccccgagugcaaccugagauaccugggccuggugagcugcagcgccaccacccagcagugggccgaccugagccuggcccuggaggugaaccagagccugaccugcgugaaccugagcgacaacgagcugcuggacgagggcgccaagcugcuguacaccacccugagacaccccaagugcuuccugcagagacugagccuggagaacugccaccugaccgaggccaacugcaaggaccuggccgccgugcugguggugagcagagagcugacccaccugugccuggccaagaaccccaucggcaacaccggcgugaaguuccugugcgagggccugagauaccccgagugcaagcugcagacccuggugcuguggaacugcgacaucaccagcgacggcugcugcgaccugaccaagcugcugcaggagaagagcagccugcugugccuggaccugggccugaaccacaucggcgugaagggcaugaaguuccugugcgaggcccugagaaagccccugugcaaccugagaugccuguggcuguggggcugcagcaucccccccuucagcugcgaggaccugugcagcgcccugagcugcaaccagagccuggugacccuggaccugggccagaacccccugggcagcagcggcgugaagaugcuguucgagacccugaccugcagcagcggcacccugagaacccugagacugaagaucgacgacuucaacgacgagcugaacaagcugcuggaggagaucgaggagaagaacccccagcugaucaucgacaccgagaagcaccaccccugggccgagagacccagcagccacgacuucaugaucuaa

SEQ ID NO: 20587 - RNA, 2940 nt, Artificial Sequence
  NLRP3__Homo_sapiens__NP_001120933
augaagauggccagcaccagaugcaagcuggccagauaccuggaggaccuggaggacguggaccugaagaaguucaagaugcaccuggaggacuaccccccccagaagggcugcaucccccugcccagaggccagaccgagaaggccgaccacguggaccuggccacccugaugaucgacuucaacggcgaggagaaggccugggccauggccguguggaucuucgccgccaucaacagaagagaccuguacgagaaggccaagagagacgagcccaaguggggcagcgacaacgccagagugagcaaccccaccgugaucugccaggaggacagcaucgaggaggaguggaugggccugcuggaguaccugagcagaaucagcaucugcaagaugaagaaggacuacagaaagaaguacagaaaguacgugagaagcagauuccagugcaucgaggacagaaacgccagacugggcgagagcgugagccugaacaagagauacaccagacugagacugaucaaggagcacagaagccagcaggagagagagcaggagcugcuggccaucggcaagaccaagaccugcgagagccccgugagccccaucaagauggagcugcuguucgaccccgacgacgagcacagcgagcccgugcacaccgugguguuccagggcgccgccggcaucggcaagaccauccuggccagaaagaugaugcuggacugggccagcggcacccuguaccaggacagauucgacuaccuguucuacauccacugcagagaggugagccuggugacccagagaagccugggcgaccugaucaugagcugcugccccgaccccaacccccccauccacaagaucgugagaaagcccagcagaauccuguuccugauggacggcuucgacgagcugcagggcgccuucgacgagcacaucggcccccugugcaccgacuggcagaaggccgagagaggcgacauccugcugagcagccugaucagaaagaagcugcugcccgaggccagccugcugaucaccaccagacccguggcccuggagaagcugcagcaccugcuggaccaccccagacacguggagauccugggcuucagcgaggccaagagaaaggaguacuucuucaaguacuucagcgacgaggcccaggccagagccgccuucagccugauccaggagaacgaggugcuguucaccaugugcuucaucccccuggugugcuggaucgugugcaccggccugaagcagcagauggagagcggcaagagccuggcccagaccagcaagaccaccaccgccguguacguguucuuccugagcagccugcugcagcccagaggcggcagccaggagcacggccugugcgcccaccuguggggccugugcagccuggccgccgacggcaucuggaaccagaagauccuguucgaggagagcgaccugagaaaccacggccugcagaaggccgacgugagcgccuuccugagaaugaaccuguuccagaaggagguggacugcgagaaguucuacagcuucauccacaugaccuuccaggaguucuucgccgccauguacuaccugcuggaggaggagaaggagggcagaaccaacgugcccggcagcagacugaagcugcccagcagagacgugaccgugcugcuggagaacuacggcaaguucgagaagggcuaccugaucuucguggugagauuccuguucggccuggugaaccaggagagaaccagcuaccuggagaagaagcugagcugcaagaucagccagcagaucagacuggagcugcugaaguggaucgaggugaaggccaaggccaagaagcugcagauccagcccagccagcuggagcuguucuacugccuguacgagaugcaggaggaggacuucgugcagagagccauggacuacuuccccaagaucgagaucaaccugagcaccagaauggaccacauggugagcagcuucugcaucgagaacugccacagaguggagagccugagccugggcuuccugcacaacaugcccaaggaggaggaggaggaggagaaggagggcagacaccuggacauggugcagugcgugcugcccagcagcagccacgccgccugcagccacggccuggugaacagccaccugaccagcagcuucugcagaggccuguucagcgugcugagcaccagccagagccugaccgagcuggaccugagcgacaacagccugggcgaccccggcaugagagugcugugcgagacccugcagcaccccggcugcaacaucagaagacuguggcugggcagaugcggccugagccacgagugcugcuucgacaucagccuggugcugagcagcaaccagaagcugguggagcuggaccugagcgacaacgcccugggcgacuucggcaucagacugcugugcgugggccugaagcaccugcugugcaaccugaagaagcuguggcuggugaacagcggccugaccagcgugugcugcagcgcccugagcagcgugcugagcaccaaccagaaccugacccaccuguaccugagaggcaacacccugggcgacaagggcaucaagcugcugugcgagggccugcugcaccccgacugcaagcugcaggugcuggagcuggacaacugcaaccugaccagccacugcugcugggaccugagcacccugcugaccagcagccagagccugagaaagcugagccugggcaacaacgaccugggcgaccugggcgugaugauguucugcgaggugcugaagcagcagagcugccugcugcagaaccugggccugagcgagauguacuucaacuacgagaccaagagcgcccuggagacccugcaggaggagaagcccgagcugaccgugguguucgagcccagcugguaa

SEQ ID NO: 20588 - RNA, 3087 nt, Artificial Sequence
  NLRP4__Homo_sapiens__XP_006723105
augagcagagccaucaacggcauggacgaggaguucggcuucaucuaccugcuguuccuggugaccgugagccugagaaucggcaucagcgcccccgagaagauggccgccagcuucuucagcgacuucggccugaugugguaccuggaggagcugaagaaggaggaguucagaaaguucaaggagcaccugaagcagaugacccugcagcuggagcugaagcagauccccuggaccgaggugaagaaggccagcagagaggagcuggccaaccugcugaucaagcacuacgaggagcagcaggccuggaacaucacccugagaaucuuccagaagauggacagaaaggaccugugcaugaaggugaugagagagagaaccggcuacaccaagaccuaccaggcccacgccaagcagaaguucagcagacuguggagcagcaagagcgugaccgagauccaccuguacuucgaggaggaggugaagcaggaggagugcgaccaccuggacagacuguucgcccccaaggaggccggcaagcagcccagaaccgugaucauccagggcccccagggcaucggcaagaccacccugcugaugaagcugaugauggccuggagcgacaacaagaucuucagagacagauuccuguacaccuucuacuucugcugcagagagcugagagagcugccccccaccagccuggccgaccugaucagcagagaguggcccgaccccgccgcccccaucaccgagaucgugagccagcccgagagacugcuguucgugaucgacagcuucgaggagcugcagggcggccugaacgagcccgacagcgaccugugcggcgaccugauggagaagagacccgugcaggugcugcugagcagccugcugagaaagaagaugcugcccgaggccagccugcugaucgccaucaagcccgugugccccaaggagcugagagaccaggugaccaucagcgagaucuaccagcccagaggcuucaacgagagcgacagacugguguacuucugcugcuucuucaaggaccccaagagagccauggaggccuucaaccuggugagagagagcgagcagcuguucagcaucugccagaucccccugcugugcuggauccugugcaccagccugaagcaggagaugcagaagggcaaggaccuggcccugaccugccagagcaccaccagcguguacagcagcuucguguucaaccuguucacccccgagggcgccgagggccccaccccccagacccagcaccagcugaaggcccugugcagccuggccgccgagggcauguggaccgacaccuucgaguucugcgaggacgaccugagaagaaacggcgugguggacgccgacauccccgcccugcugggcaccaagauccugcugaaguacggcgagagagagagcagcuacguguuccugcacgugugcauccaggaguucugcgccgcccuguucuaccugcugaagagccaccuggaccacccccaccccgccgugagaugcgugcaggagcugcugguggccaacuucgagaaggccagaagagcccacuggaucuuccugggcugcuuccugaccggccugcugaacaagaaggagcaggagaagcuggacgccuucuucggcuuccagcugagccaggagaucaagcagcagauccaccagugccugaagagccugggcgagagaggcaacccccagggccagguggacagccuggccaucuucuacugccuguucgagaugcaggaccccgccuucgugaagcaggccgugaaccugcugcaggaggccaacuuccacaucaucgacaacguggaccugguggugagcgccuacugccugaaguacugcagcagccugagaaagcugugcuucagcgugcagaacguguucaagaaggaggacgagcacagcagcaccagcgacuacagccugaucugcuggcaccacaucugcagcgugcugaccaccagcggccaccugagagagcugcaggugcaggacagcacccugagcgagagcaccuucgugaccuggugcaaccagcugagacaccccagcugcagacugcagaagcugggcaucaacaacgugagcuucagcggccagagcgugcugcuguucgaggugcuguucuaccagcccgaccugaaguaccugagcuucacccugaccaagcugagcagagacgacaucagaagccugugcgacgcccugaacuaccccgccggcaacgugaaggagcuggcccuggugaacugccaccugagccccaucgacugcgaggugcuggccggccugcugaccaacaacaagaagcugaccuaccugaacgugagcugcaaccagcuggacaccggcgugccccugcugugcgaggcccugugcagccccgacaccgugcugguguaccugaugcuggccuucugccaccugagcgagcagugcugcgaguacaucagcgagaugcugcugagaaacaagagcgugagauaccuggaccugagcgccaacgugcugaaggacgagggccugaagacccugugcgaggcccugaagcaccccgacugcugccuggacagccugugccuggugaagugcuucaucaccgccgccggcugcgaggaccuggccagcgcccugaucagcaaccagaaccugaagauccugcagaucggcugcaacgagaucggcgacgugggcgugcagcugcugugcagagcccugacccacaccgacugcagacuggagauccugggccuggaggagugcggccugaccagcaccugcugcaaggaccuggccagcgugcugaccugcagcaagacccugcagcagcugaaccugacccugaacacccuggaccacaccggcgugguggugcugugcgaggcccugagacaccccgagugcgcccugcaggugcugggccugagaaagaccgacuucgacgaggagacccaggcccugcugaccgccgaggaggagagaaaccccaaccugaccaucaccgacgacugcgacaccaucaccagaguggagaucuaa

SEQ ID NO: 20589 - RNA, 3603 nt, Artificial Sequence
  NLRP5__Homo_sapiens__NP_703148
augaagguggccggcggccuggagcugggcgccgccgcccugcugagcgccagccccagagcccuggugacccugagcaccggccccaccugcagcauccugcccaagaacccccuguucccccagaaccugagcagccagcccugcaucaagauggagggcgacaagagccugaccuucagcagcuacggccugcaguggugccuguacgagcuggacaaggaggaguuccagaccuucaaggagcugcugaagaagaagagcagcgagagcaccaccugcagcaucccccaguucgagaucgagaacgccaacguggagugccuggcccugcugcugcacgaguacuacggcgccagccuggccugggccaccagcaucagcaucuucgagaacaugaaccugagaacccugagcgagaaggccagagacgacaugaagagacacagccccgaggaccccgaggccaccaugaccgaccagggccccagcaaggagaaggugcccggcaucagccaggccgugcagcaggacagcgccaccgccgccgagaccaaggagcaggagaucagccaggccauggagcaggagggcgccaccgccgccgagaccgaggagcaggagaucagccaggccauggagcaggagggcgccaccgccgccgagaccgaggagcagggccacggcggcgacaccugggacuacaagagccacgugaugaccaaguucgccgaggaggaggacgugagaagaagcuucgagaacaccgccgccgacuggcccgagaugcagacccuggccggcgccuucgacagcgacagauggggcuucagacccagaaccguggugcugcacggcaagagcggcaucggcaagagcgcccuggccagaagaaucgugcugugcugggcccagggcggccuguaccagggcauguucagcuacguguucuuccugcccgugagagagaugcagagaaagaaggagagcagcgugaccgaguucaucagcagagaguggcccgacagccaggcccccgugaccgagaucaugagcagacccgagagacugcuguucaucaucgacggcuucgacgaccugggcagcgugcugaacaacgacaccaagcugugcaaggacugggccgagaagcagccccccuucacccugaucagaagccugcugagaaaggugcugcugcccgagagcuuccugaucgugaccgugagagacgugggcaccgagaagcugaagagcgagguggugagccccagauaccugcuggugagaggcaucagcggcgagcagagaauccaccugcugcuggagagaggcaucggcgagcaccagaagacccagggccugagagccaucaugaacaacagagagcugcuggaccagugccaggugcccgccgugggcagccugaucugcguggcccugcagcugcaggacguggugggcgagagcguggcccccuucaaccagacccugaccggccugcacgccgccuucguguuccaccagcugacccccagaggcguggugagaagaugccugaaccuggaggagagaguggugcugaagagauucugcagaauggccguggagggcguguggaacagaaagagcguguucgacggcgacgaccugauggugcagggccugggcgagagcgagcugagagcccuguuccacaugaacauccugcugcccgacagccacugcgaggaguacuacaccuucuuccaccugagccugcaggacuucugcgccgcccuguacuacgugcuggagggccuggagaucgagcccgcccugugcccccuguacguggagaagaccaagagaagcauggagcugaagcaggccggcuuccacauccacagccuguggaugaagagauuccuguucggccuggugagcgaggacgugagaagaccccuggaggugcugcugggcugccccgugccccugggcgugaagcagaagcugcugcacugggugagccugcugggccagcagcccaacgccaccacccccggcgacacccuggacgccuuccacugccuguucgagacccaggacaaggaguucgugagacuggcccugaacagcuuccaggagguguggcugcccaucaaccagaaccuggaccugaucgccagcagcuucugccugcagcacugccccuaccugagaaagaucagaguggacgugaagggcaucuuccccagagacgagagcgccgaggccugccccguggugccccuguggaugagagacaagacccugaucgaggagcagugggaggacuucugcagcaugcugggcacccacccccaccugagacagcuggaccugggcagcagcauccugaccgagagagccaugaagacccugugcgccaagcugagacaccccaccugcaagauccagacccugauguucagaaacgcccagaucacccccggcgugcagcaccuguggagaaucgugauggccaacagaaaccugagaagccugaaccugggcggcacccaccugaaggaggaggacgugagaauggccugcgaggcccugaagcaccccaagugccugcuggagagccugagacuggacugcugcggccugacccacgccugcuaccugaagaucagccagauccugaccaccagccccagccugaagagccugagccuggccggcaacaaggugaccgaccagggcgugaugccccugagcgacgcccugagagugagccagugcgcccugcagaagcugauccuggaggacugcggcaucaccgccaccggcugccagagccuggccagcgcccuggugagcaacagaagccugacccaccugugccugagcaacaacagccugggcaacgagggcgugaaccugcugugcagaagcaugagacugccccacugcagccugcagagacugaugcugaaccagugccaccuggacaccgccggcugcggcuuccuggcccuggcccugaugggcaacagcuggcugacccaccugagccugagcaugaaccccguggaggacaacggcgugaagcugcugugcgaggugaugagagagcccagcugccaccugcaggaccuggagcuggugaagugccaccugaccgccgccugcugcgagagccugagcugcgugaucagcagaagcagacaccugaagagccuggaccugaccgacaacgcccugggcgacggcggcguggccgcccugugcgagggccugaagcagaagaacagcgugcuggccagacugggccugaaggccugcggccugaccagcgacugcugcgaggcccugagccuggcccugagcugcaacagacaccugaccagccugaaccuggugcagaacaacuucagccccaagggcaugaugaagcugugcagcgccuucgccugccccaccagcaaccugcagaucaucggccuguggaaguggcaguaccccgugcagaucagaaagcugcuggaggaggugcagcugcugaagcccagaguggugaucgacggcagcuggcacagcuucgacgaggacgacagauacugguggaagaacuaa

SEQ ID NO: 20590 - RNA, 2676 nt, Artificial Sequence
  NLRP6__Homo_sapiens__NP_001263629
auggaccagcccgaggcccccugcagcagcaccggccccagacuggccguggccagagagcugcugcuggccgcccuggaggagcugagccaggagcagcugaagagauucagacacaagcugagagacgugggccccgacggcagaagcauccccuggggcagacuggagagagccgacgccguggaccuggccgagcagcuggcccaguucuacggccccgagcccgcccuggagguggccagaaagacccugaagagagccgacgccagagacguggccgcccagcugcaggagagaagacugcagagacugggccugggcagcggcacccugcugagcgugagcgaguacaagaagaaguacagagagcacgugcugcagcugcacgccagagugaaggagagaaacgccagaagcgugaagaucaccaagagauucaccaagcugcugaucgcccccgagagcgccgcccccgaggaggccaugggccccgccgaggagcccgagcccggcagagccagaagaagcgacacccacaccuucaacagacuguucagaagagacgaggagggcagaagaccccugaccguggugcugcagggccccgccggcaucggcaagaccauggccgccaagaagauccuguacgacugggccgccggcaagcuguaccagggccagguggacuucgccuucuucaugcccugcggcgagcugcuggagagacccggcaccagaagccuggccgaccugauccuggaccagugccccgacagaggcgcccccgugccccagaugcuggcccagccccagagacugcuguucauccuggacggcgccgacgagcugcccgcccugggcggccccgaggccgcccccugcaccgaccccuucgaggccgccagcggcgccagagugcugggcggccugcugagcaaggcccugcugcccaccgcccugcugcuggugaccaccagagccgccgcccccggcagacugcagggcagacugugcagcccccagugcgccgaggugagaggcuucagcgacaaggacaagaagaaguacuucuacaaguacuucagagacgagagaagagccgagagagccuacagauucgugaaggagaacgagacccuguucgcccugugcuucgugcccuucgugugcuggaucgugugcaccgugcugagacagcagcuggagcugggcagagaccugagcagaaccagcaagaccaccaccagcguguaccugcuguucaucaccagcgugcugagcagcgcccccguggccgacggccccagacugcagggcgaccugagaaaccugugcagacuggccagagagggcgugcugggcagaagagcccaguucgccgagaaggagcuggagcagcuggagcugagaggcagcaaggugcagacccuguuccugagcaagaaggagcugcccggcgugcuggagaccgaggugaccuaccaguucaucgaccagagcuuccaggaguuccuggccgcccugagcuaccugcuggaggacggcggcgugcccagaaccgccgccggcggcgugggcacccugcugagaggcgacgcccagccccacagccaccuggugcugaccaccagauuccuguucggccugcugagcgccgagagaaugagagacaucgagagacacuucggcugcauggugagcgagagagugaagcaggaggcccugagaugggugcagggccagggccagggcugccccggcguggcccccgaggugaccgagggcgccaagggccuggaggacaccgaggagcccgaggaggaggaggagggcgaggagcccaacuacccccuggagcugcuguacugccuguacgagacccaggaggacgccuucgugagacaggcccugugcagauuccccgagcuggcccugcagagagugagauucugcagaauggacguggccgugcugagcuacugcgugagaugcugccccgccggccaggcccugagacugaucagcugcagacugguggccgcccaggagaagaagaagaagagccugggcaagagacugcaggccagccugggcggcggcagcagccagggcaccaccaagcagcugcccgccagccugcugcacccccuguuccaggccaugaccgacccccugugccaccugagcagccugacccugagccacugcaagcugcccgacgccgugugcagagaccugagcgaggcccugagagccgcccccgcccugaccgagcugggccugcugcacaacagacugagcgaggccggccugagaaugcugagcgagggccuggccuggccccagugcagagugcagaccgugagagugcagcugcccgacccccagagaggccugcaguaccuggugggcaugcugagacagagccccgcccugaccacccuggaccugagcggcugccagcugcccgcccccauggugaccuaccugugcgccgugcugcagcaccagggcugcggccugcagacccugagccuggccagcguggagcugagcgagcagagccugcaggagcugcaggccgugaagagagccaagcccgaccuggugaucacccaccccgcccuggacggccacccccagccccccaaggagcugaucagcaccuucuaa

SEQ ID NO: 20591 - RNA, 3030 nt, Artificial Sequence
  NLRP7__Homo_sapiens__NP_631915
augaccagcccccagcuggaguggacccugcagacccugcuggagcagcugaacgaggacgagcugaagagcuucaagagccugcugugggccuucccccuggaggacgugcugcagaagacccccuggagcgagguggaggaggccgacggcaagaagcuggccgagauccuggugaacaccagcagcgagaacuggaucagaaacgccaccgugaacauccuggaggagaugaaccugaccgagcugugcaagauggccaaggccgagaugauggaggacggccaggugcaggagaucgacaaccccgagcugggcgacgccgaggaggacagcgagcuggccaagcccggcgagaaggagggcuggagaaacagcauggagaagcagagccugguguggaagaacaccuucuggcagggcgacaucgacaacuuccacgacgacgugacccugagaaaccagagauucauccccuuccugaaccccagaacccccagaaagcugacccccuacaccguggugcugcacggccccgccggcgugggcaagaccacccuggccaagaagugcaugcuggacuggaccgacugcaaccugagccccacccugagauacgccuucuaccugagcugcaaggagcugagcagaaugggccccugcagcuucgccgagcugaucagcaaggacuggcccgagcugcaggacgacauccccagcauccuggcccaggcccagagaauccuguucgugguggacggccuggacgagcugaaggugccccccggcgcccugauccaggacaucugcggcgacugggagaagaagaagcccgugcccgugcugcugggcagccugcugaagagaaagaugcugcccagagccgcccugcuggugaccaccagacccagagcccugagagaccugcagcugcuggcccagcagcccaucuacgugagaguggagggcuuccuggaggaggacagaagagccuacuuccugagacacuucggcgacgaggaccaggccaugagagccuucgagcugaugagaagcaacgccgcccuguuccagcugggcagcgcccccgccgugugcuggaucgugugcaccacccugaagcugcagauggagaagggcgaggaccccgugcccaccugccugaccagaaccggccuguuccugagauuccugugcagcagauucccccagggcgcccagcugagaggcgcccugagaacccugagccugcuggccgcccagggccugugggcccagaugagcguguuccacagagaggaccuggagagacugggcgugcaggagagcgaccugagacuguuccuggacggcgacauccugagacaggacagagugagcaagggcugcuacagcuucauccaccugagcuuccagcaguuccugaccgcccuguucuacgcccuggagaaggaggagggcgaggacagagacggccacgccugggacaucggcgacgugcagaagcugcugagcggcgaggagagacugaagaaccccgaccugauccaggugggccacuuccuguucggccuggccaacgagaagagagccaaggagcuggaggccaccuucggcugcagaaugagccccgacaucaagcaggagcugcugcagugcaaggcccaccugcacgccaacaagccccugagcgugaccgaccugaaggaggugcugggcugccuguacgagagccaggaggaggagcuggccaagguggugguggcccccuucaaggagaucagcauccaccugaccaacaccagcgaggugaugcacugcagcuucagccugaagcacugccaggaccugcagaagcugagccugcagguggccaagggcguguuccuggagaacuacauggacuucgagcuggacaucgaguucgagagcagcaacagcaaccugaaguuccuggaggugaagcagagcuuccugagcgacagcagcgugagaauccugugcgaccacgugaccagaagcaccugccaccugcagaagguggagaucaagaacgugacccccgacaccgccuacagagacuucugccuggccuucaucggcaagaagacccugacccaccugacccuggccggccacaucgagugggagagaaccaugaugcugaugcugugcgaccugcugagaaaccacaagugcaaccugcaguaccugagacugggcggccacugcgccacccccgagcagugggccgaguucuucuacgugcugaaggccaaccagagccugaagcaccugagacugagcgccaacgugcugcuggacgagggcgccaugcugcuguacaagaccaugaccagacccaagcacuuccugcagaugcugagccuggagaacugcagacugaccgaggccagcugcaaggaccuggccgccgugcugguggugagcaagaagcugacccaccugugccuggccaagaaccccaucggcgacaccggcgugaaguuccugugcgagggccugagcuaccccgacugcaagcugcagacccuggugcugcagcagugcagcaucaccaagcugggcugcagauaccugagcgaggcccugcaggaggccugcagccugaccaaccuggaccugagcaucaaccagaucgccagaggccuguggauccugugccaggcccuggagaaccccaacugcaaccugaagcaccugagacuguggagcugcagccugaugcccuucuacugccagcaccugggcagcgcccugcugagcaaccagaagcuggagacccuggaccugggccagaaccaccuguggaagagcggcaucaucaagcuguucggcgugcugagacagagaaccggcagccugaagauccugagacugaagaccuacgagaccaaccuggagaucaagaagcugcuggaggaggugaaggagaagaaccccaagcugaccaucgacugcaacgccagcggcgccaccgccccccccugcugcgacuucuucugcuaa

SEQ ID NO: 20592 - RNA, 3147 nt, Artificial Sequence
  NLRP8__Homo_sapiens__NP_789781
augagcgacgugaacccccccagcgacacccccauccccuucagcagcagcagcacccacagcagccacaucccccccuggaccuucagcugcuaccccggcagccccugcgagaacggcgugaugcuguacaugagaaacgugagccacgaggagcugcagagauucaagcagcugcugcugaccgagcugagcaccggcaccaugcccaucaccugggaccagguggagaccgccagcugggccgagguggugcaccugcugaucgagagauuccccggcagaagagccugggacgugaccagcaacaucuucgccaucaugaacugcgacaagaugugcgugguggugagaagagagaucaacgccauccugcccacccuggagcccgaggaccugaacgugggcgagacccaggugaaccuggaggagggcgagagcggcaagaucagaagauacaagagcaacgugauggagaaguucuuccccaucugggacaucaccaccuggcccggcaaccagagagacuucuucuaccagggcgugcacagacacgaggaguaccugcccugccugcugcugcccaagagaccccagggcagacagcccaagaccguggccauccagggcgcccccggcaucggcaagaccauccuggccaagaaggugauguucgagugggccagaaacaaguucuacgcccacaagagauggugcgccuucuacuuccacugccaggaggugaaccagaccaccgaccagagcuucagcgagcugaucgagcagaaguggcccggcagccaggaccuggugagcaagaucaugagcaagcccgaccagcugcugcugcugcuggacggcuucgaggagcugaccagcacccugaucgacagacuggaggaccugagcgaggacuggagacagaagcugcccggcagcgugcugcugagcagccugcugagcaagaccaugcugcccgaggccacccugcugaucaugaucagauucaccagcuggcagaccugcaagccccugcugaagugccccagccuggugacccugcccggcuucaacaccauggagaagaucaaguacuuccagauguacuucggccacaccgaggagggcgaccaggugcugagcuucgccauggagaacaccauccuguucagcaugugcagagugcccguggugugcuggauggugugcagcggccugaagcagcagauggagagaggcaacaaccugacccagagcugccccaacgccaccagcguguucgugagauacaucagcagccuguuccccaccagagccgagaacuucagcagaaagauccaccaggcccagcuggagggccugugccaccuggccgccgacagcauguggcacagaaagugggugcugggcaaggaggaccuggaggaggccaagcuggaccagaccggcgugaccgccuuccugggcaugagcauccugagaagaaucgccggcgaggaggaccacuacguguucacccuggugaccuuccaggaguucuucgccgcccuguucuacgugcugugcuucccccagagacugaagaacuuccacgugcugagccacgugaacauccagagacugaucgccagccccagaggcagcaagagcuaccugagccacaugggccuguuccuguucggcuuccugaacgaggccugcgccagcgccguggagcagagcuuccagugcaaggugagcuucggcaacaagagaaagcugcugaaggugaucccccugcugcacaagugcgacccccccagccccggcagcggcgugccccagcuguucuacugccugcacgagaucagagaggaggccuucgugagccaggcccugaacgacuaccacaagguggugcugagaaucggcaacaacaaggaggugcaggugagcgccuucugccugaagagaugccaguaccugcacgagguggagcugaccgugacccugaacuucaugaacguguggaagcugagcagcagcagccaccccggcagcgaggcccccgagagcaacggccugcacagaugguggcaggaccugugcagcguguucgccaccaacgacaagcuggaggugcugaccaugaccaacagcgugcugggcccccccuuccugaaggcccuggccgccgcccugagacacccccagugcaagcugcagaagcugcugcugagaagagugaacagcaccaugcugaaccaggaccugaucggcgugcugaccggcaaccagcaccugagauaccuggagauccagcacguggagguggagagcaaggccgugaagcugcugugcagagugcugagaagccccagaugcagacugcagugccugagacuggaggacugccuggccacccccagaaucuggaccgaccugggcaacaaccugcagggcaacggccaccugaagacccugauccugagaaagaacagccuggagaacugcggcgccuacuaccugagcguggcccagcuggagagacugagcaucgagaacugcaaccugacccagcugaccugcgagagccuggccagcugccugagacagagcaagaugcugacccaccugagccuggccgagaacgcccugaaggacgagggcgccaagcacaucuggaacgcccugccccaccugagaugcccccugcagagacuggugcugagaaagugcgaccugaccuucaacugcugccaggacaugaucagcgcccugugcaagaacaagacccugaagagccuggaccugagcuucaacagccugaaggacgacggcgugauccugcugugcgaggcccugaagaaccccgacugcacccugcagauccuggagcuggagaacugccuguucaccagcaucugcugccaggccauggccagcaugcugagaaagaaccagcaccugagacaccuggaccugagcaagaacgccaucggcguguacggcauccugacccugugcgaggccuucagcagccagaagaagagagaggaggugaucuucugcauccccgccuggaccagaaucaccagcuucagccccaccccccacccccccgacuucaccggcaagagcgacugccugagccagaucaaccccuaa

SEQ ID NO: 20593 - RNA, 2976 nt, Artificial Sequence
  NLRP9__Homo_sapiens__XP_011525195
auggccgagagcuucuucagcgacuucggccugcugugguaccugaaggagcugagaaaggaggaguucuggaaguucaaggagcugcugaagcagccccuggagaaguucgagcugaagcccauccccugggccgagcugaagaaggccagcaaggaggacguggccaagcugcuggacaagcacuaccccggcaagcaggccugggaggugacccugaaccuguuccugcagaucaacagaaaggaccuguggaccaaggcccaggaggagaugagaaacaagcugaaccccuacagaaagcacaugaaggagaccuuccagcugaucugggagaaggagaccugccugcacgugcccgagcacuucuacaaggagaccaugaagaacgaguacaaggagcugaacgacgccuacaccgccgccgccagaagacacaccguggugcuggagggccccgacggcaucggcaagaccacccugcugagaaaggugaugcuggacugggccgagggcaaccuguggaaggacagauucaccuucguguucuuccugaacgugugcgagaugaacggcaucgccgagaccagccugcuggagcugcugagcagagacuggcccgagagcagcgagaagaucgaggacaucuucagccagcccgagagaauccuguucaucauggacggcuucgagcagcugaaguucaaccugcagcugaaggccgaccugagcgacgacuggagacagagacagcccaugcccaucauccugagcagccugcugcagaagaagaugcugcccgagagcagccugcugaucgcccugggcaagcuggccaugcagaagcacuacuucaugcugagacaccccaagcugaucaagcugcugggcuucagcgagagcgagaagaagagcuacuucagcuacuucuucggcgagaagagcaaggcccugaagguguucaacuucgugagagacaacggcccccuguucauccugugccacaaccccuucaccugcuggcuggugugcaccugcgugaagcagagacuggagagaggcgaggaccuggagaucaacagccagaacaccaccuaccuguacgccagcuuccugaccaccguguucaaggccggcagccagagcuucccccccaaggugaacagagccagacugaagagccugugcgcccuggccgccgagggcaucuggaccuacaccuucguguucagccacggcgaccugagaagaaacggccugagcgagagcgagggcgugaugugggugggcaugagacugcugcagagaagaggcgacugcuucgccuucaugcaccugugcauccaggaguucugcgccgccauguucuaccugcugaagagacccaaggacgaccccaaccccgccaucggcagcaucacccagcuggugagagccagcguggugcagccccagacccugcugacccaggugggcaucuucauguucggcaucagcaccgaggagaucgugagcaugcuggagaccagcuucggcuucccccugagcaaggaccugaagcaggagaucacccagugccuggagagccugagccagugcgaggccgacagagaggccaucgccuuccaggagcuguucaucggccuguucgagacccaggagaaggaguucgugaccaaggugaugaacuucuucgaggagguguucaucuacaucggcaacaucgagcaccuggugaucgccagcuucugccugaagcacugccagcaccugaccacccugagaaugugcguggagaacaucuuccccgacgacagcggcugcaucagcgacuacaacgagaagcugguguacuggagagagcugugcagcauguucaucaccaacaagaacuuccagauccuggacauggagaacaccagccuggacgaccccagccuggccauccugugcaaggcccuggcccagcccgugugcaagcugagaaagcugaucuucaccagcguguacuucggccacgacagcgagcuguucaaggccgugcugcacaacccccaccugaagcugcugagccuguacggcaccagccugagccagagcgacaucagacaccugugcgagacccugaagcaccccaugugcaagaucgaggagcugauccugggcaagugcgacaucagcagcgaggugugcgaggacaucgccagcgugcuggccugcaacagcaagcugaagcaccugagccugguggagaacccccugagagacgagggcaugacccugcugugcgaggcccugaagcacagccacugcgcccuggagagacugaugcugauguacugcugccugaccagcgugagcugcgacagcaucagcgaggugcugcugugcagcaagagccugagccugcuggaccugggcagcaacgcccuggaggacaacggcguggccagccugugcgccgcccugaagcaccccggcugcagcaucagagagcuguggcugaugggcugcuuccugaccagcgacagcugcaaggacaucgccgccgugcugaucugcaacggcaagcugaagacccugaagcugggccacaacgagaucggcgacaccggcgugagacagcugugcgccgcccugcagcacccccacugcaagcuggagugccugggccugcagaccugccccaucaccagagccugcugcgacgacaucgccgccgcccugaucgccugcaagacccugagaagccugaaccuggacuggaucgcccuggacgccgacgccgugguggugcugugcgaggcccugagccaccccgacugcgcccugcagaugcugggccugcacaagagcggcuucgacgaggagacccagaagauccugaugagcguggaggagaagaucccccaccugaccaucagccacggccccuggaucgacgaggaguacaagaucagaggcgugcugcuguaa

SEQ ID NO: 20594 - RNA, 366 nt, Artificial Sequence
  NMB__Homo_sapiens__NP_066563
auggccagaagagccggcggcgccagaauguucggcagccugcugcuguucgcccugcuggccgccggcguggccccccugagcugggaccugcccgagcccagaagcagagccagcaagaucagagugcacagcagaggcaaccugugggccaccggccacuucaugggcaagaagagccuggagcccagcagccccagcccccugggcaccgccccccacaccagccugagagaccagagacugcagcugagccacgaccugcugggcauccugcugcugaagaaggcccugggcgugagccugagcagacccgccccccagauccaguacagaagacugcuggugcagauccugcagaaguaa

SEQ ID NO: 20595 - RNA, 1173 nt, Artificial Sequence
  NMBR__Homo_sapiens__NP_002502
augcccagcaagagccugagcaaccugagcgugaccaccggcgccaacgagagcggcagcgugcccgagggcugggagagagacuuccugcccgccagcgacggcaccaccaccgagcuggugaucagaugcgugauccccagccuguaccugcugaucaucaccgugggccugcugggcaacaucaugcuggugaagaucuucaucaccaacagcgccaugagaagcgugcccaacaucuucaucagcaaccuggccgccggcgaccugcugcugcugcugaccugcgugcccguggacgccagcagauacuucuucgacgaguggauguucggcaaggugggcugcaagcugauccccgugauccagcugaccagcgugggcgugagcguguucacccugaccgcccugagcgccgacagauacagagccaucgugaaccccauggacaugcagaccagcggcgcccugcugagaaccugcgugaaggccaugggcaucuggguggugagcgugcugcuggccgugcccgaggccguguucagcgagguggccagaaucagcagccuggacaacagcagcuucaccgccugcauccccuacccccagaccgacgagcugcaccccaagauccacagcgugcugaucuuccugguguacuuccugaucccccuggccaucaucagcaucuacuacuaccacaucgccaagacccugaucaagagcgcccacaaccugcccggcgaguacaacgagcacaccaagaagcagauggagaccagaaagagacuggccaagaucgugcugguguucgugggcugcuucaucuucugcugguuccccaaccacauccuguacauguacagaagcuucaacuacaacgagaucgaccccagccugggccacaugaucgugacccugguggccagagugcugagcuucggcaacagcugcgugaaccccuucgcccuguaccugcugagcgagagcuucagaagacacuucaacagccagcugugcugcggcagaaagagcuaccaggagagaggcaccagcuaccugcugagcagcagcgccgugagaaugaccagccugaagagcaacgccaagaacauggugaccaacagcgugcugcugaacggccacagcaugaagcaggagauggcccuguaa

SEQ ID NO: 20596 - RNA, 459 nt, Artificial Sequence
  NME1__Homo_sapiens__NP_000260
auggccaacugcgagagaaccuucaucgccaucaagcccgacggcgugcagagaggccuggugggcgagaucaucaagagauucgagcagaagggcuucagacuggugggccugaaguucaugcaggccagcgaggaccugcugaaggagcacuacguggaccugaaggacagacccuucuucgccggccuggugaaguacaugcacagcggccccgugguggccauggugugggagggccugaacguggugaagaccggcagagugaugcugggcgagaccaaccccgccgacagcaagcccggcaccaucagaggcgacuucugcauccaggugggcagaaacaucauccacggcagcgacagcguggagagcgccgagaaggagaucggccugugguuccaccccgaggagcugguggacuacaccagcugcgcccagaacuggaucuacgaguaa

SEQ ID NO: 20597 - RNA, 804 nt, Artificial Sequence
  NME1-NME2__Homo_sapiens__NP_001018146
auggccaacugcgagagaaccuucaucgccaucaagcccgacggcgugcagagaggccuggugggcgagaucaucaagagauucgagcagaagggcuucagacuggugggccugaaguucaugcaggccagcgaggaccugcugaaggagcacuacguggaccugaaggacagacccuucuucgccggccuggugaaguacaugcacagcggccccgugguggccauggugugggagggccugaacguggugaagaccggcagagugaugcugggcgagaccaaccccgccgacagcaagcccggcaccaucagaggcgacuucugcauccaggugggcagaaccauggccaaccuggagagaaccuucaucgccaucaagcccgacggcgugcagagaggccuggugggcgagaucaucaagagauucgagcagaagggcuucagacugguggccaugaaguuccugagagccagcgaggagcaccugaagcagcacuacaucgaccugaaggacagacccuucuuccccggccuggugaaguacaugaacagcggccccgugguggccauggugugggagggccugaacguggugaagaccggcagagugaugcugggcgagaccaaccccgccgacagcaagcccggcaccaucagaggcgacuucugcauccaggugggcagaaacaucauccacggcagcgacagcgugaagagcgccgagaaggagaucagccugugguucaagcccgaggagcugguggacuacaagagcugcgcccacgacuggguguacgaguaa

SEQ ID NO: 20598 - RNA, 459 nt, Artificial Sequence
  NME2__Homo_sapiens__NP_001018148
auggccaaccuggagagaaccuucaucgccaucaagcccgacggcgugcagagaggccuggugggcgagaucaucaagagauucgagcagaagggcuucagacugguggccaugaaguuccugagagccagcgaggagcaccugaagcagcacuacaucgaccugaaggacagacccuucuuccccggccuggugaaguacaugaacagcggccccgugguggccauggugugggagggccugaacguggugaagaccggcagagugaugcugggcgagaccaaccccgccgacagcaagcccggcaccaucagaggcgacuucugcauccaggugggcagaaacaucauccacggcagcgacagcgugaagagcgccgagaaggagaucagccugugguucaagcccgaggagcugguggacuacaagagcugcgcccacgacuggguguacgaguaa

SEQ ID NO: 20599 - RNA, 510 nt, Artificial Sequence
  NME3__Homo_sapiens__NP_002504
augaucugccuggugcugaccaucuucgccaaccuguuccccgccgccugcaccggcgcccacgagagaaccuuccuggccgugaagcccgacggcgugcagagaagacuggugggcgagaucgugagaagauucgagagaaagggcuucaagcugguggcccugaagcuggugcaggccagcgaggagcugcugagagagcacuacgccgagcugagagagagacccuucuacggcagacuggugaaguacauggccagcggccccgugguggccaugguguggcagggccuggacguggugagaaccagcagagcccugaucggcgccaccaaccccgccgacgccccccccggcaccaucagaggcgacuucugcaucgaggugggcaagaaccugauccacggcagcgacagcguggagagcgccagaagagagaucgcccugugguucagagccgacgagcugcugugcugggaggacagcgccggccacuggcuguacgaguaa

SEQ ID NO: 20600 - RNA, 522 nt, Artificial Sequence
  NME4__Homo_sapiens__NP_001273364
augggcggccuguucuggagaagcgcccugagaggccugagaugcggccccagagcccccggccccagccugcuggugagacacggcagcggcggccccagcuggaccagagagagaacccugguggccgugaagcccgacggcgugcagagaagacuggugggcgacgugauccagagauucgagagaagaggcuucacccuggugggcaugaagaugcugcaggcccccgagagcgugcuggccgagcacuaccaggaccugagaagaaagcccuucuaccccgcccugaucagauacaugagcagcggccccgugguggccauggugugggagggcuacaacguggugagagccagcagagccaugaucggccacaccgacagcgccgaggccgcccccggcaccaucagaggcgacuucagcgugcacaucagcagccacagacuggccccccuggacagaggccagagagagcagcagauggugcccggcaucccccagggcgcccacgaggccuaa

SEQ ID NO: 20601 - RNA, 639 nt, Artificial Sequence
  NME5__Homo_sapiens__NP_003542
auggagaucagcaugccccccccccagaucuacguggagaagacccuggccaucaucaagcccgacaucguggacaaggaggaggagauccaggacaucauccugagaagcggcuucaccaucgugcagagaagaaagcugagacugagccccgagcagugcagcaacuucuacguggagaaguacggcaagauguucuuccccaaccugaccgccuacaugagcagcggcccccugguggccaugauccuggccagacacaaggccaucagcuacuggcuggagcugcugggccccaacaacagccugguggccaaggagacccaccccgacagccugagagccaucuacggcaccgacgaccugagaaacgcccugcacggcagcaacgacuucgccgccgccgagagagagaucagauucauguuccccgaggugaucguggagcccauccccaucggccaggccgccaaggacuaccugaaccugcacaucaugcccacccugcuggagggccugaccgagcugugcaagcagaagcccgccgacccccugaucuggcuggccgacuggcugcugaagaacaaccccaacaagcccaagcugugccaccaccccaucguggaggagcccuacuaa

SEQ ID NO: 20602 - RNA, 585 nt, Artificial Sequence
  NME6__Homo_sapiens__NP_005784
augacccagaaccugggcagcgagauggccagcauccugagaagcccccaggcccugcagcugacccuggcccugaucaagcccgacgccguggcccacccccugauccuggaggccgugcaccagcagauccugagcaacaaguuccugaucgugagaaugagagagcugcuguggagaaaggaggacugccagagauucuacagagagcacgagggcagauucuucuaccagagacugguggaguucauggccagcggccccaucagagccuacauccuggcccacaaggacgccauccagcuguggagaacccugaugggccccaccagaguguucagagccagacacguggcccccgacagcaucagaggcagcuucggccugaccgacaccagaaacaccacccacggcagcgacagcguggugagcgccagcagagagaucgccgccuucuuccccgacuucagcgagcagagaugguacgaggaggaggagccccagcugagaugcggccccgugugcuacagccccgagggcggcgugcacuacguggccggcaccggcggccugggccccgccuaa

SEQ ID NO: 20603 - RNA, 1131 nt, Artificial Sequence
  NME7__Homo_sapiens__NP_037462
augaaccacagcgagagauucguguucaucgccgagugguacgaccccaacgccagccugcugagaagauacgagcugcuguucuaccccggcgacggcagcguggagaugcacgacgugaagaaccacagaaccuuccugaagagaaccaaguacgacaaccugcaccuggaggaccuguucaucggcaacaaggugaacguguucagcagacagcuggugcugaucgacuacggcgaccaguacaccgccagacagcugggcagcagaaaggagaagacccuggcccugaucaagcccgacgccaucagcaaggccggcgagaucaucgagaucaucaacaaggccggcuucaccaucaccaagcugaagaugaugaugcugagcagaaaggaggcccuggacuuccacguggaccaccagagcagacccuucuucaacgagcugauccaguucaucaccaccggccccaucaucgccauggagauccugagagacgacgccaucugcgaguggaagagacugcugggccccgccaacagcggcguggccagaaccgacgccagcgagagcaucagagcccuguucggcaccgacggcaucagaaacgccgcccacggccccgacagcuucgccagcgccgccagagagauggagcuguucuuccccagcagcggcggcugcggccccgccaacaccgccaaguucaccaacugcaccugcugcaucgugaagccccacgccgugagcgagggccugcugggcaagauccugauggccaucagagacgccggcuucgagaucagcgccaugcagauguucaacauggacagagugaacguggaggaguucuacgagguguacaagggcguggugaccgaguaccacgacauggugaccgagauguacagcggccccugcguggccauggagauccagcagaacaacgccaccaagaccuucagagaguucugcggccccgccgaccccgagaucgccagacaccugagacccggcacccugagagccaucuucggcaagaccaagauccagaacgccgugcacugcaccgaccugcccgaggacggccugcuggaggugcaguacuucuucaagauccuggacaacuaa

SEQ ID NO: 20604 - RNA, 1767 nt, Artificial Sequence
  NME8__Homo_sapiens__NP_057700
auggccagcaagaagagagaggugcagcugcagaccgugaucaacaaccagagccugugggacgagaugcugcagaacaagggccugaccgugaucgacguguaccaggccuggugcggccccugcagagccaugcagccccuguucagaaagcugaagaacgagcugaacgaggacgagauccugcacuucgccguggccgaggccgacaacaucgugacccugcagcccuucagagacaagugcgagcccguguuccuguucagcgugaacggcaagaucaucgagaagauccagggcgccaacgccccccuggugaacaagaaggugaucaaccugaucgacgaggagagaaagaucgccgccggcgagauggccagaccccaguaccccgagaucccccugguggacagcgacagcgaggugagcgaggagagccccugcgagagcgugcaggagcuguacagcaucgccaucaucaagcccgacgccgugaucagcaagaaggugcuggagaucaagagaaagaucaccaaggccggcuucaucaucgaggccgagcacaagaccgugcugaccgaggagcagguggugaacuucuacagcagaaucgccgaccagugcgacuucgaggaguucgugagcuucaugaccagcggccugagcuacauccugguggugagccagggcagcaagcacaacccccccagcgaggagaccgagccccagaccgacaccgagcccaacgagagaagcgaggaccagcccgagguggaggcccaggugacccccggcaugaugaagaacaagcaggacagccugcaggaguaccuggagagacagcaccuggcccagcugugcgacaucgaggaggacgccgccaacguggccaaguucauggacgccuucuuccccgacuucaagaagaugaagagcaugaagcuggagaagacccuggcccugcugagacccaaccuguuccacgagagaaaggacgacgugcugagaaucaucaaggacgaggacuucaagauccuggagcagagacagguggugcugagcgagaaggaggcccaggcccugugcaaggaguacgagaacgaggacuacuucaacaagcugaucgagaacaugaccagcggccccagccuggcccuggugcugcugagagacaacggccugcaguacuggaagcagcugcugggccccagaaccguggaggaggccaucgaguacuuccccgagagccugugcgcccaguucgccauggacagccugcccgugaaccagcuguacggcagcgacagccuggagaccgccgagagagagauccagcacuucuucccccugcagagcacccugggccugaucaagccccacgccaccagcgagcagagagagcagauccugaagaucgugaaggaggccggcuucgaccugacccaggugaagaagauguuccugacccccgagcagaucgagaagaucuaccccaaggugaccggcaaggacuucuacaaggaccugcuggagaugcugagcgugggccccagcauggugaugauccugaccaaguggaacgccguggccgaguggagaagacugaugggccccaccgaccccgaggaggccaagcugcugagccccgacagcaucagagcccaguucggcaucagcaagcugaagaacaucgugcacggcgccagcaacgccuacgaggccaaggagguggugaacagacuguucgaggaccccgaggagaacuaa

SEQ ID NO: 20605 - RNA, 792 nt, Artificial Sequence
  NME9__Homo_sapiens__NP_835231
augcugagcagcaagggccugaccgugguggacguguaccagggcuggugcggccccugcaagcccguggugagccuguuccagaagaugagaaucgaggugggccuggaccugcugcacuucgcccuggccgaggccgacagacuggacgugcuggagaaguacagaggcaagugcgagcccaccuuccuguucuacgccaucaaggacgaggcccugagcgacgaggacgagugcgugagccacggcaagaacaacggcgaggacgaggacauggugagcagcgagagaaccugcacccuggccaucaucaagcccgacgccguggcccacggcaagaccgacgagaucaucaugaagauccaggaggccggcuucgagauccugaccaacgaggagagaaccaugaccgaggccgaggugagacuguucuaccagcacaaggccggcgaggaggccuucgagaagcuggugcaccacaugugcagcggccccagccaccugcugauccugaccagaaccgagggcuucgaggacguggugaccaccuggagaaccgugaugggccccagagaccccaacguggccagaagagagcagcccgagagccugagagcccaguacggcaccgagaugcccuucaacgccgugcacggcagcagagacagagaggacgccgacagagagcuggcccugcuguuccccagccugaaguucagcgacaaggacaccgaggccccccagggcgagagcagcacccagcccagacugaagaucaccgaccuggacuaa

SEQ ID NO: 20606 - RNA, 924 nt, Artificial Sequence
  NMI__Homo_sapiens__NP_004679
auggaggccgacaaggacgacacccagcagauccugaaggagcacagccccgacgaguucaucaaggacgagcagaacaagggccugaucgacgagaucaccaagaagaacauccagcugaagaaggagauccagaagcuggagaccgagcugcaggaggccaccaaggaguuccagaucaaggaggacauccccgagaccaagaugaaguuccugagcguggagacccccgagaacgacagccagcugagcaacaucagcugcagcuuccaggugagcagcaaggugcccuacgagauccagaagggccaggcccugaucaccuucgagaaggaggagguggcccagaacguggugagcaugagcaagcaccacgugcagaucaaggacgugaaccuggaggugaccgccaagcccgugccccugaacagcggcgugagauuccagguguacguggaggugagcaagaugaagaucaacgugaccgagauccccgacacccugagagaggaccagaugagagacaagcuggagcugagcuucagcaagagcagaaacggcggcggcgagguggacagaguggacuacgacagacagagcggcagcgccgugaucaccuucguggagaucggcguggccgacaagauccugaagaagaaggaguacccccuguacaucaaccagaccugccacagagugaccgugagccccuacaccgagauccaccugaagaaguaccagaucuucagcggcaccagcaagagaaccgugcugcugaccggcauggagggcauccagauggacgaggagaucguggaggaccugaucaacauccacuuccagagagccaagaacggcggcggcgagguggacguggugaagugcagccugggccagccccacaucgccuacuucgaggaguaa

SEQ ID NO: 20607 - RNA, 840 nt, Artificial Sequence
  NMNAT1__Homo_sapiens__NP_001284707
auggagaacagcgagaagaccgagguggugcugcuggccugcggcagcuucaaccccaucaccaacaugcaccugagacuguucgagcuggccaaggacuacaugaacggcaccggcagauacaccguggugaagggcaucaucagccccgugggcgacgccuacaagaagaagggccugauccccgccuaccacagagugaucauggccgagcuggccaccaagaacagcaaguggguggagguggacaccugggagagccugcagaaggaguggaaggagacccugaaggugcugagacaccaccaggagaagcuggaggccagcgacugcgaccaccagcagaacagccccacccuggagagacccggcagaaagagaaaguggaccgagacccaggacagcagccagaagaagagccuggagcccaagaccaaggccgugcccaaggugaagcugcugugcggcgccgaccugcuggagagcuucgccgugcccaaccuguggaagagcgaggacaucacccagaucguggccaacuacggccugaucugcgugaccagagccggcaacgacgcccagaaguucaucuacgagagcgacgugcuguggaagcacagaagcaacauccacguggugaacgaguggaucgccaacgacaucagcagcaccaagaucagaagagcccugagaagaggccagagcaucagauaccuggugcccgaccuggugcaggaguacaucgagaagcacaaccuguacagcagcgagagcgaggacagaaacgccggcgugauccuggccccccugcagagaaacaccgccgaggccaagaccuaa

SEQ ID NO: 20608 - RNA, 924 nt, Artificial Sequence
  NMNAT2__Homo_sapiens__NP_055854
augaccgagaccaccaagacccacgugauccugcuggccugcggcagcuucaaccccaucaccaagggccacauccagauguucgagagagccagagacuaccugcacaagaccggcagauucaucgugaucggcggcaucgugagccccgugcacgacagcuacggcaagcagggccuggugagcagcagacacagacugaucaugugccagcuggccgugcagaacagcgacuggaucagaguggaccccugggagugcuaccaggacaccuggcagaccaccugcagcgugcuggagcaccacagagaccugaugaagagagugaccggcugcauccugagcaacgugaacacccccagcaugacccccgugaucggccagccccagaacgagaccccccagcccaucuaccagaacagcaacguggccaccaagcccaccgccgccaagauccugggcaaggugggcgagagccugagcagaaucugcugcgugagaccccccguggagagauucaccuucguggacgagaacgccaaccugggcaccgugaugagauacgaggagaucgagcugagaauccugcugcugugcggcagcgaccugcuggagagcuucugcauccccggccuguggaacgaggccgacauggaggugaucgugggcgacuucggcaucgugguggugcccagagacgccgccgacaccgacagaaucaugaaccacagcagcauccugagaaaguacaagaacaacaucaugguggugaaggacgacaucaaccaccccaugagcguggugagcagcaccaagagcagacuggcccugcagcacggcgacggccacgugguggacuaccugagccagcccgugaucgacuacauccugaagagccagcuguacaucaacgccagcggcuaa

SEQ ID NO: 20609 - RNA, 492 nt, Artificial Sequence
  NMNAT3__Homo_sapiens__NP_001186976
augaagagcagaauccccguggugcugcuggccugcggcagcuucaaccccaucaccaacaugcaccugagaauguucgagguggccagagaccaccugcaccagaccgccgugcccgagcugaagcugcugugcggcgccgacgugcugaagaccuuccagacccccaaccuguggaaggacgcccacauccaggagaucguggagaaguucggccuggugugcgugggcagagugggccacgaccccaagggcuacaucgccgagagccccauccugagaaugcaccagcacaacauccaccuggccaaggagcccgugcagaacgagaucagcgccaccuacaucagaagagcccugggccagggccagagcgugaaguaccugauccccgacgccgugaucaccuacaucaaggaccacggccuguacaccaagggcagcaccuggaagggcaagagcacccagagcaccgagggcaagaccagcuaa

SEQ ID NO: 20610 - RNA, 462 nt, Artificial Sequence
  NMS__Homo_sapiens__NP_001011717
augaagcaccugagaccccaguucccccugauccuggccaucuacugcuucugcaugcugcagauccccagcagcggcuucccccagccccuggccgaccccagcgacggccuggacaucgugcagcuggagcagcuggccuacugccugagccagugggccccccugagcagacagcccaaggacaaccaggacaucuacaagagauuccuguuccacuacagcagaacccaggaggccacccaccccgugaagaccggcuucccccccgugcacccccugaugcaccuggccgccaagcuggccaacagaagaaugaagagaauccugcagagaggcagcggcaccgccgccguggacuucaccaagaaggaccacaccgccaccuggggcagacccuucuuccuguucagacccagaaacggcagaaacaucgaggacgaggcccagauccagugguaa

SEQ ID NO: 20611 - RNA, 1491 nt, Artificial Sequence
  NMT1__Homo_sapiens__NP_066565
auggccgacgagagcgagaccgccgugaagccccccgcccccccccugccccagaugauggagggcaacggcaacggccacgagcacugcagcgacugcgagaacgaggaggacaacagcuacaacagaggcggccugagccccgccaacgacaccggcgccaagaagaagaagaagaagcagaagaagaagaaggagaagggcagcgagaccgacagcgcccaggaccagcccgugaagaugaacagccugcccgccgagagaauccaggagauccagaaggccaucgagcuguucagcgugggccagggccccgccaagaccauggaggaggccagcaagagaagcuaccaguucugggacacccagcccgugcccaagcugggcgagguggugaacacccacggccccguggagcccgacaaggacaacaucagacaggagcccuacacccugccccagggcuucaccugggacgcccuggaccugggcgacagaggcgugcugaaggagcuguacacccugcugaacgagaacuacguggaggacgacgacaacauguucagauucgacuacagccccgaguuccugcugugggcccugagaccccccggcuggcugccccaguggcacugcggcgugagaguggugagcagcagaaagcuggugggcuucaucagcgccauccccgccaacauccacaucuacgacaccgagaagaagaugguggagaucaacuuccugugcgugcacaagaagcugagaagcaagagaguggcccccgugcugaucagagagaucaccagaagagugcaccuggagggcaucuuccaggccguguacaccgccggcguggugcugcccaagcccgugggcaccugcagauacuggcacagaagccugaaccccagaaagcugaucgaggugaaguucagccaccugagcagaaacaugaccaugcagagaaccaugaagcuguacagacugcccgagacccccaagaccgccggccugagacccauggagaccaaggacauccccguggugcaccagcugcugaccagauaccugaagcaguuccaccugacccccgugaugagccaggaggagguggagcacugguucuacccccaggagaacaucaucgacaccuucgugguggagaacgccaacggcgaggugaccgacuuccugagcuucuacacccugcccagcaccaucaugaaccaccccacccacaagagccugaaggccgccuacagcuucuacaacgugcacacccagaccccccugcuggaccugaugagcgacgcccuggugcuggccaagaugaagggcuucgacguguucaacgcccuggaccugauggagaacaagaccuuccuggagaagcugaaguucggcaucggcgacggcaaccugcaguacuaccuguacaacuggaagugccccagcaugggcgccgagaaggugggccuggugcugcaguaa

SEQ ID NO: 20612 - RNA, 1497 nt, Artificial Sequence
  NMT2__Homo_sapiens__NP_004799
auggccgaggacagcgagagcgccgccagccagcagagccuggagcuggacgaccaggacaccugcggcaucgacggcgacaacgaggaggagaccgagcacgccaagggcagccccggcggcuaccugggcgccaagaagaagaagaagaagcagaagagaaagaaggagaagcccaacagcggcggcaccaagagcgacagcgccagcgacagccaggagaucaagauccagcagcccagcaagaaccccagcgugcccaugcagaagcugcaggacauccagagagccauggagcugcugagcgccugccagggccccgccagaaacaucgacgaggccgccaagcacagauaccaguucugggacacccagcccgugcccaagcuggacgaggugaucaccagccacggcgccaucgagcccgacaaggacaacgugagacaggagcccuacagccugccccagggcuucaugugggacacccuggaccugagcgacgccgaggugcugaaggagcuguacacccugcugaacgagaacuacguggaggacgacgacaacauguucagauucgacuacagccccgaguuccugcugugggcccugagaccccccggcuggcugcugcaguggcacugcggcgugagagugagcagcaacaagaagcuggugggcuucaucagcgccauccccgccaacaucagaaucuacgacagcgugaagaagaugguggagaucaacuuccugugcgugcacaagaagcugagaagcaagagaguggcccccgugcugaucagagagaucaccagaagagugaaccuggagggcaucuuccaggccguguacaccgccggcguggugcugcccaagcccaucgccaccugcagauacuggcacagaagccugaaccccagaaagcugguggaggugaaguucagccaccugagcagaaacaugacccugcagagaaccaugaagcuguacagacugcccgacgugaccaagaccagcggccugagacccauggagcccaaggacaucaagagcgugagagagcugaucaacaccuaccugaagcaguuccaccuggcccccgugauggacgaggaggagguggcccacugguuccugcccagagagcacaucaucgacaccuucgugguggagagccccaacggcaagcugaccgacuuccugagcuucuacacccugcccagcaccgugaugcaccaccccgcccacaagagccugaaggccgccuacagcuucuacaacauccacaccgagaccccccugcuggaccugaugagcgacgcccugauccuggccaagagcaagggcuucgacguguucaacgcccuggaccugauggagaacaagaccuuccuggagaagcugaaguucggcaucggcgacggcaaccugcaguacuaccuguacaacuggagaugccccggcaccgacagcgagaaggugggccuggugcugcaguaa

SEQ ID NO: 20613 - RNA, 525 nt, Artificial Sequence
  NMU__Homo_sapiens__NP_006672
augcugagaaccgagagcugcagacccagaagccccgccggccagguggccgccgccagcccccugcugcugcugcugcugcugcuggccuggugcgccggcgccugcagaggcgcccccauccugccccagggccugcagcccgagcagcagcugcagcuguggaacgagaucgacgacaccugcagcagcuuccugagcaucgacagccagccccaggccagcaacgcccuggaggagcugugcuucaugaucaugggcaugcugcccaagccccaggagcaggacgagaaggacaacaccaagagauuccuguuccacuacagcaagacccagaagcugggcaagagcaacguggugagcagcguggugcacccccugcugcagcuggugccccaccugcacgagagaagaaugaagagauucagaguggacgaggaguuccagagccccuucgccagccagagcagaggcuacuuccuguucagacccagaaacggcagaagaagcgccggcuucaucuaa

SEQ ID NO: 20614 - RNA, 1281 nt, Artificial Sequence
  NMUR1__Homo_sapiens__NP_006047
augaccccccugugccugaacugcagcgugcugcccggcgaccuguaccccggcggcgccagaaaccccauggccugcaacggcagcgccgccagaggccacuucgaccccgaggaccugaaccugaccgacgaggcccugagacugaaguaccugggcccccagcagaccgagcuguucaugcccaucugcgccaccuaccugcugaucuucguggugggcgccgugggcaacggccugaccugccuggugauccugagacacaaggccaugagaacccccaccaacuacuaccuguucagccuggccgugagcgaccugcuggugcugcuggugggccugccccuggagcuguacgagauguggcacaacuaccccuuccugcugggcgugggcggcugcuacuucagaacccugcuguucgagauggugugccuggccagcgugcugaacgugaccgcccugagcguggagagauacguggccguggugcacccccugcaggccagaagcauggugaccagagcccacgugagaagagugcugggcgccguguggggccuggccaugcugugcagccugcccaacaccagccugcacggcaucagacagcugcacgugcccugcagaggccccgugcccgacagcgccgugugcaugcuggugagacccagagcccuguacaacaugguggugcagaccaccgcccugcuguucuucugccugcccauggccaucaugagcgugcuguaccugcugaucggccugagacugagaagagagagacugcugcugaugcaggaggccaagggcagaggcagcgccgccgccagaagcagauacaccugcagacugcagcagcacgacagaggcagaagacaggugaccaagaugcuguucgugcugguggugguguucggcaucugcugggcccccuuccacgccgacagagugauguggagcguggugagccaguggaccgacggccugcaccuggccuuccagcacgugcacgugaucagcggcaucuucuucuaccugggcagcgccgccaaccccgugcuguacagccugaugagcagcagauucagagagaccuuccaggaggcccugugccugggcgccugcugccacagacugagacccagacacagcagccacagccugagcagaaugaccaccggcagcacccugugcgacgugggcagccugggcagcugggugcacccccuggccggcaacgacggccccgaggcccagcaggagaccgaccccagcuaa

SEQ ID NO: 20615 - RNA, 1248 nt, Artificial Sequence
  NMUR2__Homo_sapiens__NP_064552
augagcggcauggagaagcugcagaacgccagcuggaucuaccagcagaagcuggaggaccccuuccagaagcaccugaacagcaccgaggaguaccuggccuuccugugcggccccagaagaagccacuucuuccugcccgugagcgugguguacgugcccaucuucguggugggcgugaucggcaacgugcuggugugccuggugauccugcagcaccaggccaugaagacccccaccaacuacuaccuguucagccuggccgugagcgaccugcuggugcugcugcugggcaugccccuggagguguacgagauguggagaaacuaccccuuccuguucggccccgugggcugcuacuucaagaccgcccuguucgagaccgugugcuucgccagcauccugagcaucaccaccgugagcguggagagauacguggccauccugcaccccuucagagccaagcugcagagcaccagaagaagagcccugagaauccugggcaucguguggggcuucagcgugcuguucagccugcccaacaccagcauccacggcaucaaguuccacuacuuccccaacggcagccuggugcccggcagcgccaccugcaccgugaucaagcccauguggaucuacaacuucaucauccaggugaccagcuuccuguucuaccugcugcccaugaccgugaucagcgugcuguacuaccugauggcccugagacugaagaaggacaagagccuggaggccgacgagggcaacgccaacauccagagacccugcagaaagagcgugaacaagaugcuguucgugcuggugcugguguucgccaucugcugggcccccuuccacaucgacagacuguucuucagcuucguggaggaguggagcgagagccuggccgccguguucaaccuggugcacguggugagcggcguguucuucuaccugagcagcgccgugaaccccaucaucuacaaccugcugagcagaagauuccaggccgccuuccagaacgugaucagcagcuuccacaagcaguggcacagccagcacgacccccagcugccccccgcccagagaaacaucuuccugaccgagugccacuucguggagcugaccgaggacaucggcccccaguuccccugccagagcagcaugcacaacagccaccugcccgccgcccugagcagcgagcagaugagcagaaccaacuaccagagcuuccacuucaacaagaccuaa

SEQ ID NO: 20616 - RNA, 246 nt, Artificial Sequence
  NNAT__Homo_sapiens__NP_005377
auggccgccguggccgccgccagcgccgagcugcugaucaucggcugguacaucuucagagugcugcugcagguguuccuggagugcugcaucuacugggugggcuucgccuucagaaacccccccggcacccagcccaucgccagaagcgagguguucagauacagccugcagaagcuggccuacaccgugagcagaaccggcagacaggugcugggcgagagaagacagagagcccccaacuaa

SEQ ID NO: 20617 - RNA, 795 nt, Artificial Sequence
  NNMT__Homo_sapiens__NP_006160
auggagagcggcuucaccagcaaggacaccuaccugagccacuucaaccccagagacuaccuggagaaguacuacaaguucggcagcagacacagcgccgagagccagauccugaagcaccugcugaagaaccuguucaagaucuucugccuggacggcgugaagggcgaccugcugaucgacaucggcagcggccccaccaucuaccagcugcugagcgccugcgagagcuucaaggagaucguggugaccgacuacagcgaccagaaccugcaggagcuggagaaguggcugaagaaggagcccgaggccuucgacuggagccccguggugaccuacgugugcgaccuggagggcaacagagugaagggccccgagaaggaggagaagcugagacaggccgugaagcaggugcugaagugcgacgugacccagagccagccccugggcgccgugccccugccccccgccgacugcgugcugagcacccugugccuggacgccgccugccccgaccugcccaccuacugcagagcccugagaaaccugggcagccugcugaagcccggcggcuuccuggugaucauggacgcccugaagagcagcuacuacaugaucggcgagcagaaguucagcagccugccccugggcagagaggccguggaggccgccgugaaggaggccggcuacaccaucgagugguucgaggugaucagccagagcuacagcagcaccauggccaacaacgagggccuguucagccugguggccagaaagcugagcagaccccuguaa

SEQ ID NO: 20618 - RNA, 2868 nt, Artificial Sequence
  NNT__Homo_sapiens__XP_006714524
auggugaaccccacccugggcgugcacgaggccgaccugcugaagaccagcggcacccugaucagcuucaucuaccccgcccagaaccccgagcugcugaacaagcugagccagagaaagaccaccgugcuggccauggaccaggugcccagagugaccaucgcccagggcuacgacgcccugagcagcauggccaacaucgccggcuacaaggccguggugcuggccgccaaccacuucggcagauucuucaccggccagaucaccgccgccggcaaggugccccccgccaagauccugaucgugggcggcggcguggccggccuggccagcgccggcgccgccaagagcaugggcgccaucgugagaggcuucgacaccagagccgccgcccuggagcaguucaagagccugggcgccgagccccuggagguggaccugaaggagagcggcgagggccagggcggcuacgccaaggagaugagcaaggaguucaucgaggccgagaugaagcuguucgcccagcagugcaaggagguggacauccugaucagcaccgcccugauccccggcaagaaggcccccgugcuguucaacaaggagaugaucgagagcaugaaggagggcagcguggugguggaccuggccgccgaggccggcggcaacuucgagaccaccaagcccggcgagcuguacauccacaagggcaucacccacaucggcuacaccgaccugcccagcagaauggccacccaggccagcacccuguacagcaacaacaucaccaagcugcugaaggccaucagccccgacaaggacaacuucuacuucgacgugaaggacgacuucgacuucggcaccaugggccacgugaucagaggcaccguggugaugaaggacggcaaggugaucuuccccgcccccacccccaagaacaucccccagggcgcccccgugaagcagaagaccguggccgagcuggaggccgagaaggccgccaccaucacccccuucagaaagaccaugagcaccgccagcgccuacaccgccggccugaccggcauccugggccugggcaucgccgcccccaaccuggccuucagccagauggugaccaccuucggccuggccggcaucgugggcuaccacaccguguggggcgugacccccgcccugcacagcccccugaugagcgugaccaacgccaucagcggccugaccgccgugggcggccuggcccugaugggcggccaccuguaccccagcaccaccagccagggccuggccgcccuggccgccuucaucagcagcgugaacaucgccggcggcuuccuggugacccagagaaugcuggacauguucaagagacccaccgacccccccgaguacaacuaccuguaccugcugcccgccggcaccuucgugggcggcuaccuggccgcccuguacagcggcuacaacaucgagcagaucauguaccugggcagcggccugugcugcgugggcgcccuggccggccugagcacccagggcaccgccagacugggcaacgcccugggcaugaucggcguggccggcggccuggccgccacccugggcgugcugaagcccggccccgagcugcuggcccagaugagcggcgccauggcccugggcggcaccaucggccugaccaucgccaagagaauccagaucagcgaccugccccagcugguggccgccuuccacagccuggugggccuggccgccgugcugaccugcaucgccgaguacaucaucgaguacccccacuucgccaccgacgccgccgccaaccugaccaagaucguggccuaccugggcaccuacaucggcggcgugaccuucagcggcagccugaucgccuacggcaagcugcagggccugcugaagagcgccccccugcugcugcccggcagacaccugcugaacgccggccugcuggccgccagcgugggcggcaucauccccuucaugguggaccccagcuucaccaccggcaucaccugccugggcagcgugagcgcccugagcgccgugaugggcgugacccugaccgccgccaucggcggcgccgacaugcccguggugaucaccgugcugaacagcuacagcggcugggcccugugcgccgagggcuuccugcugaacaacaaccugcugaccaucgugggcgcccugaucggcagcagcggcgccauccugagcuacaucaugugcguggccaugaacagaagccuggccaacgugauccugggcggcuacggcaccaccagcaccgccggcggcaagcccauggagaucagcggcacccacaccgagaucaaccuggacaacgccaucgacaugaucagagaggccaacagcaucaucaucacccccggcuacggccugugcgccgccaaggcccaguaccccaucgccgaccuggugaagaugcugaccgagcagggcaagaaggugagauucggcauccaccccguggccggcagaaugcccggccagcugaacgugcugcuggccgaggccggcgugcccuacgacaucgugcuggagauggacgagaucaaccacgacuuccccgacaccgaccuggugcuggugaucggcgccaacgacaccgugaacagcgccgcccaggaggaccccaacagcaucaucgccggcaugcccgugcuggagguguggaagagcaagcaggugaucgugaugaagagaagccugggcgugggcuacgccgccguggacaaccccaucuucuacaagcccaacaccgccaugcugcugggcgacgccaagaagaccugcgacgcccugcaggccaaggugagagagagcuaccagaaguaa

SEQ ID NO: 20619 - RNA, 2097 nt, Artificial Sequence
  NOA1__Homo_sapiens__NP_115689
augcugcccgccagacugcccuucagacugcugagccuguuccugagaggcagcgcccccaccgccgccagacacggccugagagagccccugcuggagagaagaugcgccgccgccagcagcuuccagcacagcagcagccugggcagagagcugcccuacgaccccguggacaccgagggcuucggcgagggcggcgacaugcaggagagauuccuguuccccgaguacauccuggaccccgagccccagcccaccagagagaagcagcugcaggagcugcagcagcagcaggaggaggaggagagacagagacagcagagaagagaggagagaagacagcagaaccugagagccagaagcagagagcaccccguggugggccaccccgaccccgcccugccccccagcggcgugaacugcagcggcugcggcgccgagcugcacugccaggacgccggcgugcccggcuaccugcccagagagaaguuccugagaaccgccgaggccgacggcggccuggccagaaccgugugccagagaugcuggcugcugagccaccacagaagagcccugagacugcaggugagcagagagcaguaccuggagcuggugagcgccgcccugagaagacccggccccagccuggugcuguacaugguggaccugcuggaccugcccgacgcccugcugcccgaccugcccgcccuggugggccccaagcagcugaucgugcugggcaacaagguggaccugcugccccaggacgcccccggcuacagacagagacugagagagagacugugggaggacugcgccagagccggccugcugcuggcccccggccaccagggcccccagagacccgugaaggacgagccccaggacggcgagaaccccaacccccccaacuggagcagaaccguggugagagacgugagacugaucagcgccaagaccggcuacggcguggaggagcugaucagcgcccugcagagaagcuggagauacagaggcgacguguaccuggugggcgccaccaacgccggcaagagcacccuguucaacacccugcuggagagcgacuacugcaccgccaagggcagcgaggccaucgacagagccaccaucagccccuggcccggcaccacccugaaccugcugaaguuccccaucugcaaccccacccccuacagaauguucaagagacaccagagacugaagaaggacagcacccaggccgaggaggaccugagcgagcaggagcagaaccagcugaacgugcugaagaagcacggcuacguggugggcagagugggcagaaccuuccuguacagcgaggagcagaaggacaacauccccuucgaguucgacgccgacagccuggccuucgacauggagaacgaccccgugaugggcacccacaagagcaccaagcagguggagcugaccgcccaggacgugaaggacgcccacugguucuacgacacccccggcaucaccaaggagaacugcauccugaaccugcugaccgagaaggaggugaacaucgugcugcccacccagagcaucgugcccagaaccuucgugcugaagcccggcauggugcuguuccugggcgccaucggcagaaucgacuuccugcagggcaaccagagcgccugguucaccgugguggccagcaacauccugcccgugcacaucaccagccuggacagagccgacgcccuguaccagaagcacgccggccacacccugcugcagauccccaugggcggcaaggagagaauggccggcuuccccccccugguggccgaggacaucaugcugaaggagggccugggcgccagcgaggccguggccgacaucaaguucagcagcgccggcugggugagcgugacccccaacuucaaggacagacugcaccugagaggcuacacccccgagggcaccgugcugaccgugagacccccccugcugcccuacaucgugaacaucaagggccagagaaucaagaagagcguggccuacaagaccaagaagccccccagccugauguacaacgugagaaagaagaagggcaagaucaacguguaa

SEQ ID NO: 20620 - RNA, 1239 nt, Artificial Sequence
  NOB1__Homo_sapiens__NP_054781
auggcccccguggagcacgugguggccgacgccggcgccuuccugagacacgccgcccugcaggacaucggcaagaacaucuacaccaucagagagguggugaccgagaucagagacaaggccaccagaagaagacuggccgugcugcccuacgagcugagauucaaggagccccugcccgaguacgugagacuggugaccgaguucagcaagaagaccggcgacuaccccagccugagcgccaccgacauccaggugcuggcccugaccuaccagcuggaggccgaguucgugggcgugagccaccugaagcaggagccccagaaggugaaggugagcagcagcauccagcaccccgagaccccccugcacaucagcggcuuccaccugcccuacaagcccaagcccccccaggagaccgagaagggccacagcgccugcgagcccgagaaccuggaguucagcagcuucauguucuggagaaacccccugcccaacaucgaccacgagcugcaggagcugcugaucgacagaggcgaggacgugcccagcgaggaggaggaggaggaggagaacggcuucgaggacagaaaggacgacagcgacgacgacggcggcggcuggaucacccccagcaacaucaagcagauccagcaggagcuggagcagugcgacgugcccgaggacgugagagugggcugccugaccaccgacuucgccaugcagaacgugcugcugcagaugggccugcacgugcuggccgugaacggcaugcugaucagagaggccagaagcuacauccugagaugccacggcugcuucaagaccaccagcgacaugagcagaguguucugcagccacugcggcaacaagacccugaagaaggugagcgugaccgugagcgacgacggcacccugcacaugcacuucagcagaaaccccaaggugcugaaccccagaggccugagauacagccugcccacccccaagggcggcaaguacgccaucaacccccaccugaccgaggaccagagauucccccagcugagacugagccagaaggccagacagaagaccaacguguucgcccccgacuacaucgccggcgugagccccuucguggagaacgacaucagcagcagaagcgccacccugcaggugagagacagcacccugggcgccggcagaagaagacugaaccccaacgccagcagaaagaaguucgugaagaagagauaa

SEQ ID NO: 20621 - RNA, 2076 nt, Artificial Sequence
  NOBOX__Homo_sapiens__NP_001073882
auggcccugcugcugacccugaccagccccgaccuggagggcaccugggacaccagagacaaggacggcuucaaggcccaggagggccccccccuggccgugcccgaguuccccgugugcggccuguacagaaucuacggcgugugcggcagcuucagcagcuucuucaucaucagaugcagccugugcgcccuggagacccugaagagcccccagcacgacccccuggagauccccgagcagagccugaagcugaucccccuggugagcggcaagagagagcugaccagaggccagaaggccggcgagaagccccuggccgccggccccggcgaggaggagcugcugagaggcagcgccccccacgcccaggacacccagagcgaggagcugccccccagcugcaccaucagcggcgagaagaagccccccgccgugagcggcgaggccaccggcgccgacgccggcagacugugccccccccccagaagcagagccccccacaaggacagaacccuggccagaagcagaccccagacccagggcgaggacugcagccugcccgugggcgaggugaagaucggcaagagaagcuacagccccgcccccggcaagcagaagaagcccaacgccaugggccuggcccccaccagcagccccggcgcccccaacagcgccagagccacccacaaccccgugcccugcggcagcggcagaggccccugccaccuggccaaccugcugagcacccuggcccagagcaaccagaacagagaccacaagcagggcccccccgaggugaccugccagaucagaaagaagaccagaacccuguacagaagcgaccagcuggaggagcuggagaagaucuuccaggaggaccacuaccccgacagcgacaagagaagagagaucgcccagaccgugggcgugaccccccagagaaucauggugaagggcgccggcagccugguggccggcuggagcggcggcggccccaccaucgagacccuggagcugcagagcgagagaagcgccguggccugggugugguuccagaacagaagagccaaguggagaaagauggagaagcugaacggcaaggagagcaaggacaaccccgccgcccccggccccgccagcagccagugcagcagcgccgccgagauccugcccgccgugcccauggagcccaagcccgaccccuucccccaggagagcccccuggacaccuuccccgagccccccaugcugcugaccagcgaccagacccuggcccccacccagcccagcgagggcgcccagagaguggugacccccccccuguucagccccccccccgugagaagagccgaccugcccuucccccugggccccgugcacaccccccagcugaugccccugcugauggacguggccggcagcgacagcagccacaaggacggccccugcggcagcuggggcaccagcaucacccugcccccccccugcagcuaccuggaggagcuggagccccaggacuaccagcagagcaaccagcccggccccuuccaguucagccaggccccccagcccccccuguuccagagcccccagcccaagcugcccuaccugcccaccuuccccuucagcaugcccagcagccugacccugcccccccccgaggacagccuguucauguuccccugcggccccagcggcggcaccagccagggcuacugccccggcgccagcagcggccagauccugaugcagccccccgccggcaacaucggcaccgccagcuggagcgaccccugccugcccgagcugcccuuccccggccccuucugcccccaggcccugggccacccccccggcggcgacggcuacuuccccgaccuguuccccacccccugcccccaggcccugggcagacagcccagcagcgcccugagcuggaugcccgagggcgccagacccggcaccggcccccugcugagcaaggccaaggaggagccccccgccgccagccuggaccagcccagcgcccuggaggaggccagaggcgacgacaagaacagccacgugcccuaa

SEQ ID NO: 20622 - RNA, 2403 nt, Artificial Sequence
  NOC3L__Homo_sapiens__NP_071896
augaaggccagaagaaacaagaagcagauccccagcuucagaaagcugaucaagaccagcaaggugaagcuggagaacaagcugaagaacaagcaguucaagcagcagagcacccugaagaaguacagaaaggagcagagaaagcugagacaggccgugaaggacgccgugagcaagaagcccaucccccuggagaaccccaaggagaagagacccggcaagagaaucgagagagaggaggaggaggaggaggaggcccugccccuggacaugauggacgaggacgaccugcagcugaugaaggaccugggccagagagugagcuuccugaccagagaccugagcagcagcgagcccgugcacgccaagaagagaaagcacgagagaaucaucgacaaguacgagaagauccccagaacccugcagaccgcccccgagaaggagcugauccaccugcugcccaucaaggacaagagcggcaucaucccccagaccagagagaagcccgugaccgacagcaacaaggacgaggaggaccaggaggaggagagagagcuggaggaggagaucaucgaggaccccauccaggagcugaccaucgaggagcaccugaucgagagaaagaagaagcugcaggagaagaagaugcacaucgccgcccuggccagcgccauccugagcgaccccgagaacaacaucaagaagcugaaggagcugagaagcaugcugauggagcaggaccccgacguggccgugaccgugagaaagcuggugaucgugagccugauggagcuguucaaggacaucacccccagcuacaagaucagaccccugaccgaggccgagaagagcaccaagaccagaaaggagacccagaagcugagagaguucgaggagggccuggugagccaguacaaguucuaccuggagaaccuggagcagauggugaaggacuggaagcagagaaagcugaagaagagcaacguggugagccugaaggccuacaagggccuggccgagguggccgugaagagccugugcgagcugcugguggcccugccccacuucaacuuccacaacaacaucaucgugcugaucgugccccugaugaacgacaugagcaagcugaucagcgagaugugcugcgaggccgugaagaagcuguucaagcaggacaagcugggccaggccagccugggcgugaucaaggugaucagcggcuucgugaagggcagaaacuacgaggugagacccgagaugcugaagaccuuccugugccugagaaucaaggagguggaggugaagaaggacaccgaggacaucaacaagcccaagaaguucaugaccuucaaggagaagagaaagagccugagcagaaugcagagaaaguggaagaaggccgaggagaagcuggagagagagcugagagaggccgaggccagcgagagcaccgagaagaagcugaagcugcacaccgagacccugaacaucguguucgugaccuacuucagaauccugaagaaggcccagagaagcccccugcugcccgccgugcuggagggccuggccaaguucgcccaccugaucaacguggaguucuucgacgaccugcugguggugcugcacacccugaucgagagcggcgaccugagcuaccaggagagccugcacugcgugcagaccgccuuccacauccugagcggccagggcgacgugcugaacaucgacccccugaaguucuacacccaccuguacaagacccuguucaagcugcacgccggcgccaccaacgagggcguggagaucgugcugcagugccuggacgugaugcugaccaagagaagaaagcaggugagccagcagagagcccuggccuucaucaagagacugugcacccuggcccugcacgugcugcccaacagcagcaucggcauccuggccaccaccagaauccugaugcacaccuuccccaagaccgaccugcugcuggacagcgagagccagggcagcggcguguuccugcccgagcuggacgagcccgaguacugcaacgcccagaacaccgcccugugggagcugcacgcccugagaagacacuaccaccccaucgugcagagauucgccgcccaccugaucgccggcgcccccagcgagggcagcggcgcccugaagcccgagcugagcagaagaagcgccaccgagcuguucgaggccuacagcauggccgagaugaccuucaacccccccguggagagcagcaaccccaagaucaagggcaaguuccugcagggcgacagcuuccugaacgaggaccugaaccagcugaucaagagauacagcagcgagguggccaccgagagcccccuggacuucaccaaguaccugaagaccagccugcacuaa

SEQ ID NO: 20623 - RNA, 2862 nt, Artificial Sequence
  NOD1__Homo_sapiens__NP_006083
auggaggagcagggccacagcgagauggagaucauccccagcgagagccacccccacauccagcugcugaagagcaacagagagcugcuggugacccacaucagaaacacccagugccugguggacaaccugcugaagaacgacuacuucagcgccgaggacgccgagaucgugugcgccugccccacccagcccgacaaggugagaaagauccuggaccuggugcagagcaagggcgaggaggugagcgaguucuuccuguaccugcugcagcagcuggccgacgccuacguggaccugagacccuggcugcuggagaucggcuucagccccagccugcugacccagagcaaggugguggugaacaccgaccccgugagcagauacacccagcagcugagacaccaccugggcagagacagcaaguucgugcugugcuacgcccagaaggaggagcugcugcuggaggagaucuacauggacaccaucauggagcuggugggcuucagcaacgagagccugggcagccugaacagccuggccugccugcuggaccacaccaccggcauccugaacgagcagggcgagaccaucuucauccugggcgacgccggcgugggcaagagcaugcugcugcagagacugcagagccugugggccaccggcagacuggacgccggcgugaaguucuucuuccacuucagaugcagaauguucagcugcuucaaggagagcgacagacugugccugcaggaccugcuguucaagcacuacugcuaccccgagagagaccccgaggagguguucgccuuccugcugagauucccccacguggcccuguucaccuucgacggccuggacgagcugcacagcgaccuggaccugagcagagugcccgacagcagcugccccugggagcccgcccacccccuggugcugcuggccaaccugcugagcggcaagcugcugaagggcgccagcaagcugcugaccgccagaaccggcaucgaggugcccagacaguuccugagaaagaaggugcugcugagaggcuucagccccagccaccugagagccuacgccagaagaauguuccccgagagagcccugcaggacagacugcugagccagcuggaggccaaccccaaccugugcagccugugcagcgugccccuguucugcuggaucaucuucagaugcuuccagcacuucagagccgccuucgagggcagcccccagcugcccgacugcaccaugacccugaccgacguguuccugcuggugaccgaggugcaccugaacagaaugcagcccagcagccuggugcagagaaacaccagaagccccguggagacccugcacgccggcagagacacccugugcagccugggccagguggcccacagaggcauggagaagagccuguucguguucacccaggaggaggugcaggccagcggccugcaggagagagacaugcagcugggcuuccugagagcccugcccgagcugggccccggcggcgaccagcagagcuacgaguucuuccaccugacccugcaggccuucuucaccgccuucuuccuggugcuggacgacagagugggcacccaggagcugcugagauucuuccaggaguggaugccccccgccggcgccgccaccaccagcugcuacccccccuuccugcccuuccagugccugcagggcagcggccccgccagagaggaccuguucaagaacaaggaccacuuccaguucaccaaccuguuccugugcggccugcugagcaaggccaagcagaagcugcugagacaccuggugcccgccgccgcccugagaagaaagagaaaggcccugugggcccaccuguucagcagccugagaggcuaccugaagagccugcccagagugcagguggagagcuucaaccaggugcaggccaugcccaccuucaucuggaugcugagaugcaucuacgagacccagagccagaaggugggccagcuggccgccagaggcaucugcgccaacuaccugaagcugaccuacugcaacgccugcagcgccgacugcagcgcccugagcuucgugcugcaccacuuccccaagagacuggcccuggaccuggacaacaacaaccugaacgacuacggcgugagagagcugcagcccugcuucagcagacugaccgugcugagacugagcgugaaccagaucaccgacggcggcgugaaggugcugagcgaggagcugaccaaguacaagaucgugaccuaccugggccuguacaacaaccagaucaccgacgugggcgccagauacgugaccaagauccuggacgagugcaagggccugacccaccugaagcugggcaagaacaagaucaccagcgagggcggcaaguaccuggcccuggccgugaagaacagcaagagcaucagcgaggugggcauguggggcaaccaggugggcgacgagggcgccaaggccuucgccgaggcccugagaaaccaccccagccugaccacccugagccuggccagcaacggcaucagcaccgagggcggcaagagccuggccagagcccugcagcagaacaccagccuggagauccuguggcugacccagaacgagcugaacgacgagguggccgagagccuggccgagaugcugaaggugaaccagacccugaagcaccuguggcugauccagaaccagaucaccgccaagggcaccgcccagcuggccgacgcccugcagagcaacaccggcaucaccgagaucugccugaacggcaaccugaucaagcccgaggaggccaagguguacgaggacgagaagagaaucaucugcuucuaa

SEQ ID NO: 20624 - RNA, 3123 nt, Artificial Sequence
  NOD2__Homo_sapiens__NP_071445
augggcgaggagggcggcagcgccagccacgacgaggaggagagagccagcgugcugcugggccacagccccggcugcgagaugugcagccaggaggccuuccaggcccagagaagccagcugguggagcugcuggugagcggcagccuggagggcuucgagagcgugcuggacuggcugcugagcugggaggugcugagcugggaggacuacgagggcuuccaccugcugggccagccccugagccaccuggccagaagacugcuggacaccguguggaacaagggcaccugggccugccagaagcugaucgccgccgcccaggaggcccaggccgacagccagagccccaagcugcacggcugcugggacccccacagccugcaccccgccagagaccugcagagccacagacccgccaucgugagaagacugcacagccacguggagaacaugcuggaccuggccugggagagaggcuucgugagccaguacgagugcgacgagaucagacugcccaucuucacccccagccagagagccagaagacugcuggaccuggccaccgugaaggccaacggccuggccgccuuccugcugcagcacgugcaggagcugcccgugccccuggcccugccccuggaggccgccaccugcaagaaguacauggccaagcugagaaccaccgugagcgcccagagcagauuccugagcaccuacgacggcgccgagacccugugccuggaggacaucuacaccgagaacgugcuggaggugugggccgacgugggcauggccggccccccccagaagagccccgccacccugggccuggaggagcuguucagcacccccggccaccugaacgacgacgccgacaccgugcugguggugggcgaggccggcagcggcaagagcacccugcugcagagacugcaccugcugugggccgccggccaggacuuccaggaguuccuguucguguuccccuucagcugcagacagcugcagugcauggccaagccccugagcgugagaacccugcuguucgagcacugcugcuggcccgacgugggccaggaggacaucuuccagcugcugcuggaccaccccgacagagugcugcugaccuucgacggcuucgacgaguucaaguucagauucaccgacagagagagacacugcagccccaccgaccccaccagcgugcagacccugcuguucaaccugcugcagggcaaccugcugaagaacgccagaaagguggugaccagcagacccgccgccgugagcgccuuccugagaaaguacaucagaaccgaguucaaccugaagggcuucagcgagcagggcaucgagcuguaccugagaaagagacaccacgagcccggcguggccgacagacugaucagacugcugcaggagaccagcgcccugcacggccugugccaccugcccguguucagcuggauggugagcaagugccaccaggagcugcugcugcaggagggcggcagccccaagaccaccaccgacauguaccugcugauccugcagcacuuccugcugcacgccaccccccccgacagcgccagccagggccugggccccagccugcugagaggcagacugcccacccugcugcaccugggcagacuggcccuguggggccugggcaugugcugcuacguguucagcgcccagcagcugcaggccgcccaggugagccccgacgacaucagccugggcuuccuggugagagccaagggcguggugcccggcagcaccgccccccuggaguuccugcacaucaccuuccagugcuucuucgccgccuucuaccuggcccugagcgccgacgugccccccgcccugcugagacaccuguucaacugcggcagacccggcaacagccccauggccagacugcugcccaccaugugcauccaggccagcgagggcaaggacagcagcguggccgcccugcugcagaaggccgagccccacaaccugcagaucaccgccgccuuccuggccggccugcugagcagagagcacuggggccugcuggccgagugccagaccagcgagaaggcccugcugagaagacaggccugcgccagauggugccuggccagaagccugagaaagcacuuccacagcaucccccccgccgcccccggcgaggccaagagcgugcacgccaugcccggcuucaucuggcugaucagaagccuguacgagaugcaggaggagagacuggccagaaaggccgccagaggccugaacgugggccaccugaagcugaccuucugcagcgugggccccaccgagugcgccgcccuggccuucgugcugcagcaccugagaagacccguggcccugcagcuggacuacaacagcgugggcgacaucggcguggagcagcugcugcccugccugggcgugugcaaggcccuguaccugagagacaacaacaucagcgacagaggcaucugcaagcugaucgagugcgcccugcacugcgagcagcugcagaagcuggcccuguucaacaacaagcugaccgacggcugcgcccacagcauggccaagcugcuggccugcagacagaacuuccuggcccugagacugggcaacaacuacaucaccgccgccggcgcccaggugcuggccgagggccugagaggcaacaccagccugcaguuccugggcuucuggggcaacagagugggcgacgagggcgcccaggcccuggccgaggcccugggcgaccaccagagccugagauggcugagccuggugggcaacaacaucggcagcgugggcgcccaggcccuggcccugaugcuggccaagaacgugaugcuggaggagcugugccuggaggagaaccaccugcaggacgagggcgugugcagccuggccgagggccugaagaagaacagcagccugaagauccugaagcugagcaacaacugcaucaccuaccugggcgccgaggcccugcugcaggcccuggagagaaacgacaccauccuggagguguggcugagaggcaacaccuucagccuggaggagguggacaagcugggcugcagagacaccagacugcugcuguaa

SEQ ID NO: 20625 - RNA, 1044 nt, Artificial Sequence
  NODAL__Homo_sapiens__NP_060525
augcacgcccacugccugcccuuccugcugcacgccuggugggcccugcugcaggccggcgccgccaccguggccaccgcccugcugagaaccagaggccagcccagcagccccagcccccuggccuacaugcugagccuguacagagacccccugcccagagccgacaucaucagaagccugcaggccgaggacguggccguggacggccagaacuggaccuucgccuucgacuucagcuuccugagccagcaggaggaccuggccugggccgagcugagacugcagcugagcagccccguggaccugcccaccgagggcagccuggccaucgagaucuuccaccagcccaagcccgacaccgagcaggccagcgacagcugccuggagagauuccagauggaccuguucaccgugacccugagccaggugaccuucagccugggcagcauggugcuggaggugaccagaccccugagcaaguggcugaagcaccccggcgcccuggagaagcagaugagcagaguggccggcgagugcuggcccagaccccccaccccccccgccaccaacgugcugcugaugcuguacagcaaccugagccaggagcagagacagcugggcggcagcacccugcugugggaggccgagagcagcuggagagcccaggagggccagcugagcugggaguggggcaagagacacagaagacaccaccugcccgacagaagccagcugugcagaaaggugaaguuccagguggacuucaaccugaucggcuggggcagcuggaucaucuaccccaagcaguacaacgccuacagaugcgagggcgagugccccaaccccgugggcgaggaguuccaccccaccaaccacgccuacauccagagccugcugaagagauaccagccccacagagugcccagcaccugcugcgcccccgugaagaccaagccccugagcaugcuguacguggacaacggcagagugcugcuggaccaccacaaggacaugaucguggaggagugcggcugccuguaa

SEQ ID NO: 20626 - RNA, 699 nt, Artificial Sequence
  NOG__Homo_sapiens__NP_005441
auggagagaugccccagccugggcgugacccuguacgcccuggugguggugcugggccugagagccacccccgccggcggccagcacuaccugcacaucagacccgcccccagcgacaaccugccccugguggaccugaucgagcaccccgaccccaucuucgaccccaaggagaaggaccugaacgagacccugcugagaagccugcugggcggccacuacgaccccggcuucauggccaccagcccccccgaggacagacccggcggcggcggcggcgccgccggcggcgccgaggaccuggccgagcuggaccagcugcugagacagagacccagcggcgccaugcccagcgagaucaagggccuggaguucagcgagggccuggcccagggcaagaagcagagacugagcaagaagcugagaagaaagcugcagauguggcuguggagccagaccuucugccccgugcuguacgccuggaacgaccugggcagcagauucuggcccagauacgugaaggugggcagcugcuucagcaagagaagcugcagcgugcccgagggcauggugugcaagcccagcaagagcgugcaccugaccgugcugagauggagaugccagagaagaggcggccagagaugcggcuggauccccauccaguaccccaucaucagcgagugcaagugcagcugcuaa

SEQ ID NO: 20627 - RNA, 1614 nt, Artificial Sequence
  NOL11__Homo_sapiens__NP_001290201
auguucaacagcagaauccugaccaaguacacccugcugcugggccaggacgagaacagcgugaucaagagcuucaccgccagcguggacagaaaguucaucagccugaugagccugagcagcgacggcugcaucuacgagacccugauccccaucagacccgccgaccccgagaagaaccagagccuggugaagagccugcugcugaaggccguggugagcggcaacgccagaaacggcguggcccugaccgcccuggaccaggaccacguggccgugcugggcagcccccuggccgccagcaaggagugccugagcguguggaacaucaaguuccagacccugcagaccagcaaggagcugccccagggcaccagcggccagcugugguacuacggcgagcaccuguucaugcugcacggcaagagccugaccgugauccccuacaagugcgaggugagcagccuggccggcgcccugggcaagcugaagcacagccaggaccccggcacccacguggugagccacuucgugaacugggagaccccccagggcugcggccugggcuuccagaacagcgagcagagcagaagaauccugagaagaagaaagaucgaggugagccugcagcccgaggugccccccagcaagcagcugcugagcaccaucaugaaggacagcgagaagcacaucgagguggaggugagaaaguuccuggcccugaagcagacccccgacuuccacaccgugaucggcgacaccgugaccggccugcuggagagaugcaaggccgagcccagcuucuaccccagaaacugccugaugcagcugauccagacccacgugcugagcuacagccugugccccgaccugauggagaucgcccugaagaagaaggacgugcagcugcugcagcugugccugcagcaguuccccgacauccccgagagcgugaccugcgccugccugaagaucuuccugagcaucggcgacgacagccugcaggagaccgacgugaacauggagagcguguucgacuacagcaucaacagcgugcacgacgagaagauggaggagcagaccgagauccugcagaacggcuucaaccccgaggaggacaagugcaacaacugcgaccaggagcugaacaagaagccccaggacgagaccaaggagagcaccagcugccccguggugcagaagagagccgcccugcugaacgccauccugcacagcgccuacagcgagaccuuccugcugccccaccugaaggacauccccgcccagcacaucacccuguuccugaaguaccuguacuuccuguaccugaagugcagcgagaacgccaccaugacccugcccggcauccacccccccacccugaaccagaucauggacuggaucugccugcugcuggacgccaacuucaccgugguggugaugaugcccgaggccaagagacugcugaucaaccuguacaagcuggugaagagccagaucagcguguacagcgagcugaacaagaucgaggugagcuucagagagcugcagaagcugaaccaggagaagaacaacagaggccuguacagcaucgaggugcuggagcuguucuaa

SEQ ID NO: 20628 - RNA, 627 nt, Artificial Sequence
  NOL3__Homo_sapiens__NP_001263236
augggcaacgcccaggagagacccagcgagaccaucgacagagagagaaagagacugguggagacccugcaggccgacagcggccugcugcuggacgcccugcuggccagaggcgugcugaccggccccgaguacgaggcccuggacgcccugcccgacgccgagagaagagugagaagacugcugcugcuggugcagggcaagggcgaggccgccugccaggagcugcugagaugcgcccagagaaccgccggcgcccccgaccccgccugggacuggcagcacgugggccccggcuacagagacagaagcuacgacccccccugccccggccacuggacccccgaggcccccggcagcggcaccaccugccccggccugcccagagccagcgaccccgacgaggccggcggccccgagggcagcgaggccgugcagagcggcacccccgaggagcccgagcccgagcuggaggccgaggccagcaaggaggccgagcccgagcccgagcccgagcccgagcuggagcccgaggccgaggccgagcccgagcccgagcuggagcccgagcccgaccccgagcccgagcccgacuucgaggagagagacgagagcgaggacagcuaa

SEQ ID NO: 20629 - RNA, 1725 nt, Artificial Sequence
  NOL4__Homo_sapiens__NP_001185475
auggagagcgagagagacauguacagacaguuccaggacuggugccugagaaccuacggcgacagcggcaagaccaagaccgugaccagaaagaaguacgagagaaucgugcagcugcugaacggcagcgagagcagcagcaccgacaacgccaaguucaaguucugggugaagagcaagggcuuccagcugggccagcccgacgaggugagaggcggcggcggcggcgccaagcaggugcuguacgugcccgugaagaccaccgacggcgugggcguggacgagaagcugagccugagaagaguggccgugguggaggacuucuucgacaucaucuacagcaugcacguggagaccggccccaacggcgagcagaucagaaagcacgccggccagaagagaaccuacaaggccaucagcgagagcuacgccuuccugcccagagaggccgugaccagauuccugaugagcugcagcgagugccagaagagaaugcaccugaaccccgacggcaccgaccacaaggacaacggcaagccccccacccuggugaccagcaugaucgacuacaacaugcccaucaccauggccuacaugaagcacaugaagcugcagcugcugaacagccagcaggacgaggacgagagcagcaucgagagcgacgaguucgacaugagcgacagcaccagaaugagcgccgugaacagcgaccugagcagcaaccuggaggagagaaugcagagcccccagaaccugcacggccagcaggacgacgacagcgccgccgagagcuucaacggcaacgagacccugggccacagcagcaucgccagcggcggcacccacagcagagagaugggcgacagcaacagcgacggcaagaccggccuggagcaggacgagcagccccugaaccugagcgacagcccccugagcgcccagcugaccagcgaguacagaaucgacgaccacaacagcaacggcaagaacaaguacaagaaccugcugaucagcgaccugaagauggagagagaggccagagagaacggcagcaagagccccgcccacagcuacagcagcuacgacagcggcaagaacgagagcguggacagaggcgccgaggaccugagccugaacagaggcgacgaggacgaggacgaccacgaggaccacgacgacagcgagaaggugaacgagaccgacggcguggaggccgagagacugaaggccuucaacagcagacccauccccagccaccugaccagcgccguggccgagagcauccuggccagcgccugcgagagcgagagcagaaacgccgccaagagaaugagacuggagagacagcaggacgagagcgcccccgccgacaagcagugcaagcccgaggccacccaggccaccuacagcaccagcgccgugcccggcagccaggacgugcuguacaucaacggcaacggcaccuacagcuaccacagcuacagaggccugggcggcggccugcugaaccugaacgacgccagcagcagcggccccaccgaccugagcaugaagagacagcuggccaccagcagcggcagcagcagcagcagcaacagcagaccccagcugagccccaccgagaucaacgccgugagacagcugguggccggcuacagagagagcgccgccuuccugcugagaagcgccgacgagcuggagaaccugauccugcagcagaacuaa

SEQ ID NO: 20630 - RNA, 3441 nt, Artificial Sequence
  NOL6__Homo_sapiens__NP_075068
augggccccgcccccgccggcgagcagcugagaggcgccaccggcgagcccgaggugauggagcccgcccuggagggcaccggcaaggagggcaagaaggccagcagcagaaagagaacccuggccgagccccccgccaagggccugcugcagcccgugaagcugagcagagccgagcuguacaaggagcccaccaacgaggagcugaacagacugagagagaccgagauccuguuccacagcagccugcugagacugcagguggaggagcugcugaaggaggugagacugagcgagaagaagaaggacagaaucgacgccuuccugagagaggugaaccagagaguggugagagugcccagcgugcccgagaccgagcugaccgaccaggccuggcugcccgccggcgugagagugccccugcaccaggugcccuacgccgugaagggcugcuucagauuccugccccccgcccaggugaccguggugggcagcuaccugcugggcaccugcaucagacccgacaucaacguggacguggcccugaccaugcccagagagauccugcaggacaaggacggccugaaccagagauacuucagaaagagagcccuguaccuggcccaccuggcccaccaccuggcccaggacccccuguucggcagcgugugcuucagcuacaccaacggcugccaccugaagcccagccugcugcugagacccagaggcaaggacgagagacuggugaccgugagacugcaccccugccccccccccgacuucuucagacccugcagacugcugcccaccaagaacaacgugagaagcgccugguacagaggccagagccccgccggcgacggcagccccgagccccccacccccagauacaacaccugggugcugcaggacaccgugcuggagagccaccugcagcugcugagcaccauccugagcagcgcccagggccugaaggacggcguggcccugcugaagguguggcugagacagagagagcuggacaagggccagggcggcuucaccggcuuccuggugagcaugcuggugguguuccuggugagcaccagaaagauccacaccaccaugagcggcuaccaggugcugagaagcgugcugcaguuccuggccaccaccgaccugaccgugaacggcaucagccugugccugagcagcgaccccagccugcccgcccuggccgacuuccaccaggccuucagcgugguguuccuggacagcagcggccaccugaaccugugcgccgacgugaccgccagcaccuaccaccaggugcagcacgaggccagacugagcaugaugcugcuggacagcagagccgacgacggcuuccaccugcugcugaugacccccaagcccaugaucagagccuucgaccacgugcugcaccugagaccccugagcagacugcaggccgccugccacagacugaagcuguggcccgagcugcaggacaacggcggcgacuacgugagcgccgcccugggcccccugaccacccugcuggagcagggccugggcgccagacugaaccugcuggcccacagcagaccccccgugcccgagugggacaucagccaggacccccccaagcacaaggacagcggcacccugacccugggccugcugcugagacccgagggccugaccagcgugcuggagcugggccccgaggccgaccagcccgaggccgccaaguucagacaguucuggggcagcagaagcgagcugagaagauuccaggacggcgccaucagagaggccguggugugggaggccgccagcaugagccagaagagacugaucccccaccagguggugacccaccugcuggcccugcacgccgacauccccgagaccugcgugcacuacgugggcggcccccuggacgcccugauccagggccugaaggagaccagcagcaccggcgaggaggcccugguggccgccgugagaugcuacgacgaccugagcagacugcuguggggccuggagggccugccccugaccgugagcgccgugcagggcgcccaccccgugcugagauacaccgagguguucccccccacccccgugagacccgccuucagcuucuacgagacccugagagagagaagcagccugcugcccagacuggacaagcccugccccgccuacguggagcccaugaccguggugugccaccuggagggcagcggccaguggccccaggacgccgaggccgugcagagagugagagccgccuuccagcugagacuggccgagcugcugacccagcagcacggccugcagugcagagccaccgccacccacaccgacgugcugaaggacggcuucguguucagaaucagaguggccuaccagagagagccccagauccugaaggaggugcagagccccgagggcaugaucagccugagagacaccgccgccagccugagacuggagagagacaccagacagcugccccugcugaccagcgcccugcacggccugcagcagcagcaccccgccuucagcggcguggccagacuggccaagagaugggugagagcccagcugcugggcgagggcuucgccgacgagagccuggaccugguggccgccgcccuguuccugcaccccgagcccuucaccccccccagcagcccccaggugggcuuccugagauuccuguuccuggugagcaccuucgacuggaagaacaacccccuguucgugaaccugaacaacgagcugaccguggaggagcagguggagaucagaagcggcuuccuggccgccagagcccagcugcccgugauggugaucgugaccccccaggacagaaagaacagcguguggacccaggacggccccagcgcccagauccugcagcagcugguggugcuggccgccgaggcccugcccaugcuggagaagcagcugauggaccccagaggccccggcgacaucagaaccguguucagacccccccuggacaucuacgacgugcugaucagacugagccccagacacauccccagacacagacaggccguggacagccccgccgccagcuucugcagaggccugcugagccagcccggccccagcagccugaugcccgugcugggcuacgaccccccccagcuguaccugacccagcugagagaggccuucggcgaccuggcccuguucuucuacgaccagcacggcggcgaggugaucggcgugcuguggaagcccaccagcuuccagccccagcccuucaaggccagcagcaccaagggcagaauggugaugagcagaggcggcgagcuggugauggugcccaacguggaggccauccuggaggacuucgccgugcugggcgagggccuggugcagaccguggaggccagaagcgagagauggaccguguaa

SEQ ID NO: 20631 - RNA, 3300 nt, Artificial Sequence
  NOL8__Homo_sapiens__NP_001243323
augagcgugcugaacaagaccaaguggaagggcggcacccugcagauccagcuggccaaggagagcuuccugcacagacuggcccaggagagagaggccgccaaggccaagaaggaggagagcaccaccggcaacgccaaccugcuggagaagaccggcggcguggacuuccacaugaaggccgugcccggcaccgaggugcccggccacaagaacuggguggugagcaaguucggcagagugcugcccgugcugcaccugaagaaccagcacaagagaaagaucaucaaguacgaccccagcaaguacugccacaaccugaagaagaucggcgaggacuucagcaacaccauccccaucagcagccugaccugggagcuggagggcggcaacgaccccaugagcaagaagagaagaggcgaguucagcgacuuccacggcccccccaagaagaucaucaaggugcagaaggacgagagcagcaccggcagccuggccaugagcaccagacccagaagagugaucgagagacccccccugacccagcagcaggccgcccagaagagaaccugcgacagcaucacccccagcaagagcagccccgugcccgugagcgacacccagaagcugaagaaccugcccuucaagaccagcggccuggagaccgccaagaagagaaacagcaucagcgacgacgacaccgacagcgaggacgagcugagaaugaugaucgccaaggaggagaaccugcagagaaccacccagcccagcaucaacgagagcgagagcgaccccuucgagguggugagagacgacuucaagagcggcgugcacaagcugcacagccugaucggccugggcaucaagaacagagugagcugccacgacagcgacgacgacaucaugagaaacgacagagaguacgacagcggcgacaccgacgagaucaucgccaugaagaagaacguggccaaggugaagaacagcaccgaguucagccagauggagaagagcaccaagaagaccagcuucaagaacagagagaacugcgagcugagcgaccacugcaucaagcugcagaagagaaagagcaacguggagagcgcccugagccacggccugaagagccugaacagaaagagccccagccacagcagcagcagcgaggacgccgacagcgccagcgagcuggccgacagcgagggcggcgaggaguacaacgccaugaugaagaacugccugagagugaaccugacccuggccgaccuggagcagcuggccggcagcgaccugaaggugcccaacgaggacaccaagagcgacggccccgagaccaccacccagugcaaguucgacagaggcagcaagagccccaagacccccaccggccugagaagaggcagacagugcaucagacccgccgagaucguggccagccugcuggagggcgaggagaacaccugcggcaagcagaagcccaaggagaacaaccugaagcccaaguuccaggccuucaagggcgugggcugccuguacgagaaggagagcaugaagaagagccugaaggacagcguggccagcaacaacaaggaccagaacagcaugaagcacgaggaccccagcaucaucagcauggaggacggcagccccuacgugaacggcagccugggcgaggugacccccugccagcacgccaagaaggccaacggccccaacuacauccagccccagaagagacagaccaccuucgagagccaggacagaaaggccgugagccccagcagcagcgagaagagaagcaagaaccccaucagcagaccccuggagggcaagaagagccugagccugagcgccaagacccacaacaucggcuucgacaaggacagcugccacagcaccaccaagaccgaggccagccaggaggagagaagcgacagcagcggccugaccagccugaagaagagccccaaggugagcagcaaggacaccagagagaucaagaccgacuucagccugagcaucagcaacagcagcgacgugagcgccaaggacaagcacgccgaggacaacgagaagagacuggccgcccuggaggccagacagaaggccaaggaggugcagaagaagcuggugcacaacgcccuggccaaccuggacggccaccccgaggacaagcccacccacaucaucuucggcagcgacagcgagugcgagaccgaggagaccagcacccaggagcagagccaccccggcgaggagugggugaaggagagcaugggcaagaccagcggcaagcuguucgacagcagcgacgacgacgagagcgacagcgaggacgacagcaacagauucaagaucaagccccaguucgagggcagagccggccagaagcugauggaccugcagagccacuucggcaccgacgacagauucagaauggacagcagauuccuggagaccgacagcgaggaggagcaggaggaggugaacgagaagaagaccgccgaggaggaggagcuggccgaggagaagaagaaggcccugaacguggugcagagcgugcugcagaucaaccugagcaacagcaccaacagaggcagcguggccgccaagaaguucaaggacaucauccacuacgaccccaccaagcaggaccacgccaccuacgagagaaagagagacgacaagcccaaggagagcaaggccaagagaaagaagaagagagaggaggccgagaagcugcccgaggugagcaaggagauguacuacaacaucgccauggaccugaaggagaucuuccagaccaccaaguacaccagcgagaaggaggagggcacccccuggaacgaggacugcggcaaggagaagcccgaggagauccaggaccccgccgcccugaccagcgacgccgagcagcccagcggcuucaccuucagcuucuucgacagcgacaccaaggacaucaaggaggagaccuacagaguggagaccgugaagcccggcaagaucguguggcaggaggaccccagacugcaggacagcagcagcgaggaggaggacgugaccgaggagaccgaccacagaaacagcagccccggcgaggccagccugcuggagaaggagaccaccagauucuucuucuucagcaagaacgacgagagacugcagggcagcgaccuguucuggagaggcgugggcagcaacaugagcagaaacagcugggaggccagaaccaccaaccugagaauggacugcagaaagaagcacaaggacgccaagagaaagaugaagcccaaguaa

SEQ ID NO: 20632 - RNA, 2130 nt, Artificial Sequence
  NOLC1__Homo_sapiens__NP_001271317
auggccgacgccggcaucagaagaguggugcccagcgaccuguacccccuggugcugggcuuccugagagacaaccagcugagcgagguggccaacaaguucgccaaggccaccggcgccacccagcaggacgccaacgccagcagccugcuggacaucuacagcuucuggcugaagagcgccaaggugcccgagagaaagcugcaggccaacggccccguggccaagaaggccaagaagaaggccagcagcagcgacagcgaggacagcagcgaggaggaggaggaggugcagggcccccccgccaagaaggccgccgugcccgccaagagagugggccugccccccggcaaggccgccgccaaggccagcgagagcagcagcagcgaggagagcagcgacgacgacgacgaggaggaccagaagaagcagcccgugcagaagggcgugaagccccaggccaaggccgccaaggccccccccaagaaggccaagagcagcgacagcgacagcgacagcagcagcgaggacgagccccccaagaaccagaagcccaagaucacccccgugaccgugaaggcccagaccaaggccccccccaagcccgccagagccgcccccaagaucgccaacggcaaggccgccagcagcagcagcagcagcagcagcagcagcagcagcgacgacagcgaggaggagaaggccgccgccacccccaagaagguguggaccaucaccagcgugagagccgagaccgugcccaagaagcaggugguggccaaggcccccgugaaggccgccaccacccccaccagaaagagcagcagcagcgaggacagcagcagcgacgaggaggaggagcagaagaagcccaugaagaacaagcccggccccuacagcagcgugcccccccccagcgcccccccccccaagaagagccugggcacccagccccccaagaaggccguggagaagcagcagcccguggagagcagcgaggacagcagcgacgagagcgacagcagcagcgaggaggagaagaagccccccaccaaggccguggugagcaaggccaccaccaagcccccccccgccaagaaggccgccgagagcagcagcgacagcagcgacagcgacagcagcgaggacgacgaggcccccagcaagcccgccggcaccaccaagaacagcagcaacaagcccgccgugaccaccaagagccccgccgugaagcccgccgccgcccccaagcagcccgugggcggcggccagaagcugcugaccagaaaggccgacagcagcagcagcgaggaggagagcagcagcagcgaggaggagaagaccaagaagaugguggccaccaccaagcccaaggccaccgccaaggccgcccugagccugcccgccaagcaggccccccagggcagcagagacagcagcagcgacagcgacagcagcagcagcgaggaggaggaggagaagaccagcaagagcgccgugaagaagaagccccagaagguggccggcggcgccgcccccagcaagcccgccagcgccaagaagggcaaggccgagagcagcaacagcagcagcagcgacgacagcagcgaggaggaggaggagaagcugaagggcaagggcagccccagaccccaggcccccaaggccaacggcaccagcgcccugaccgcccagaacggcaaggccgccaagaacagcgaggaggaggaggaggagaagaagaaggccgccgugguggugagcaagagcggcagccugaagaagagaaagcagaacgaggccgccaaggaggccgagaccccccaggccaagaagaucaagcugcagacccccaacaccuuccccaagagaaagaagggcgagaagagagccagcagccccuucagaagagugagagaggaggagaucgagguggacagcagaguggccgacaacagcuucgacgccaagagaggcgccgccggcgacuggggcgagagagccaaccaggugcugaaguucaccaagggcaagagcuucagacacgagaagaccaagaagaagagaggcagcuacagaggcggcagcaucagcgugcaggugaacagcaucaaguucgacagcgaguaa

SEQ ID NO: 20633 - RNA, 2583 nt, Artificial Sequence
  NOM1__Homo_sapiens__NP_612409
auggccgccagcagaagcgccggcgaggccggccccggcggcagccagggcagaguggugagaaugaagagaagaggcggcagaggccccagaagaggccccgccggcggcggcgagaaggcccugaagagacugaagcuggccguggaggaguucgugcacgccaccagcgagggcgaggcccccggcggcugcgagggcagaggcgcccccgugagcuucagacccggcggcagaaagagcagaaaggagcugagaaaggagaagagacaccugagaaaggccagaagacugcagagaaccgccggccccgagcagggccccggccugggcggcagaagcggcgccgaggaggccagcggccacagacaggacaccgaggagagagccagacccgcccccagcagagaccccagcccccccagaaagcccagacccagcagagugaaggccaaggccaccgccgccaccgccaagaccagacccagcgccgccgccaccgccgccgccagaaagagagcccugcuggccgccaacgaggaggaggacagagagaucagaaagcuggagagaugccugggccugaacaagagaaagaagaaggacggcagcagcagcgugccccugagcuucgccagagacggccuggacuacauccugggcgcccuggagagcggcaagaacagcggccuguacgacagcagcggcgaggaggaggaggacgccggccagacccugcccgagagcgaccuggagagcgacagccaggacgagagcgaggaggaggaggagggcgacguggagaaggagaagaaggcccaggaggccgaggcccagagcgaggacgacgacgaggacaccgaggaggagcagggcgaggagaaggagaagggcgcccaggagaagagaagaggcaagagagugagauucgccgaggacgaggagaagagcgagaacagcagcgaggacggcgacaucaccgacaagagccugugcggcagcggcgagaaguacauccccccccacgugagacaggccgaggagaccguggacuucaagaagaaggaggagcuggagagacugaagaagcacgugaagggccugcugaacagacugagcgagcccaacauggccagcaucagcggccagcuggaggagcuguacauggcccacagcagaaaggacaugaacgacacccugaccagcgcccugaugggcgccugcgugaccgccagcgccaugcccagcagacugaugauggagcacgugcugcuggugagcauccugcaccacaccgugggcaucgaggugggcgcccacuuccuggaggccguggugagaaaguucgacgccaucuacaaguacggcagcgagggcaaggagugcgacaaccuguucaccgugaucgcccaccuguacaacuuccacguggugcagagccugcugaucuucgacauccugaagaagcugaucggcaccuucaccgagaaggacaucgagcugauccugcugaugcugaagaacgugggcuucagccugagaaaggacgacgcccugagccugaaggagcugaucaccgaggcccagaccaaggccagcggcgccggcagcgaguuccaggaccagaccagaaucagauucaugcuggagaccaugcuggcccugaagaacaacgacaugagaaagauccccggcuacgaccccgagcccguggagaagcugagaaagcugcagagagcccuggugagaaacgccggcagcggcagcgagacccagcugagagugagcugggacagcgugcugagcgccgagcagaccggcagaugguggaucgugggcagcgccuggagcggcgcccccaugaucgacaacagccaccacacccaccugcagaagcagcuggugggcaccgugagcagcaagauccuggagcuggccagaaagcagagaaugaacaccgacaucagaagaaacaucuucugcaccaucaugaccagcgaggacuuccuggacgccuucgagaagcugcugaagcugggccugaaggaccagcaggagagagagaucauccacgugcugauggacugcugccugcaggagaagaccuacaaccccuucuacgccuuccuggccagcaaguucugcgaguacgagagaagauuccagaugaccuuccaguucagcaucugggacaaguucagagaccuggagaaccugcccgccaccaacuucagcaaccuggugcaccugguggcccaccugcugaagaccaagagccugagccugagcauccugaaggugguggaguucagcgagcuggacaagcccagagugagauuccugagaaaggugcugagcauccugcugauggagaccgagguggaggaccugagccugaucuucaccagagugagcgacaaccccaagcugggcgugcugagagagggccugaagcuguucaucagccacuuccugcugaagaacgcccaggcccacagaagcgccgacgaggccaacgugcugagagagaaggccgaccuggccaccaagugccugcagggcaaggccagccugagaauguaa

SEQ ID NO: 20634 - RNA, 3669 nt, Artificial Sequence
  NOMO1__Homo_sapiens__NP_055102
augcuggugggccagggcgccggcccccugggccccgccguggugaccgccgccguggugcugcugcugagcggcgugggccccgcccacggcagcgaggacaucguggugggcugcggcggcuucgugaagagcgacguggagaucaacuacagccugaucgagaucaagcuguacaccaagcacggcacccugaaguaccagaccgacugcgcccccaacaacggcuacuucaugaucccccuguacgacaagggcgacuucauccugaagaucgagcccccccugggcuggagcuucgagcccaccaccguggagcugcacguggacggcgugagcgacaucugcaccaagggcggcgacaucaacuucguguucaccggcuucagcgugaacggcaaggugcugagcaagggccagccccugggccccgccggcgugcaggugagccugagaaacaccggcaccgaggccaagauccagagcaccgugacccagcccggcggcaaguucgccuucuucaaggugcugcccggcgacuacgagauccuggccacccaccccaccugggcccugaaggaggccagcaccaccgugagagugaccaacagcaacgccaacgccgccagcccccugaucguggccggcuacaacgugagcggcagcgugagaagcgacggcgagcccaugaagggcgugaaguuccugcuguucagcagccuggugaccaaggaggacgugcugggcugcaacgugagccccgugcccggcuuccagccccaggacgagagccugguguaccugugcuacaccgugagcagagaggacggcagcuucagcuucuacagccugcccagcggcggcuacaccgugauccccuucuacagaggcgagagaaucaccuucgacguggcccccagcagacuggacuucaccguggagcacgacagccugaagaucgagcccguguuccacgugaugggcuucagcgugaccggcagagugcugaacggccccgagggcgacggcgugcccgaggccguggugacccugaacaaccagaucaaggugaagaccaaggccgacggcagcuucagacuggagaacaucaccaccggcaccuacaccauccacgcccagaaggagcaccuguacuucgagaccgugaccaucaagaucgcccccaacaccccccagcuggccgacaucaucgccaccggcuucagcgugugcggccagaucagcaucaucagauuccccgacaccgugaagcagaugaacaaguacaagguggugcugagcagccaggacaaggacaagagccuggugaccguggagaccgacgcccacggcagcuucugcuucaaggccaagcccggcaccuacaaggugcaggugauggugcccgaggccgagaccagagccggccugacccugaagccccagaccuucccccugaccgugaccaacagacccaugauggacguggccuucgugcaguuccuggccagcgugagcggcaaggugagcugccuggacaccugcggcgaccugcuggugacccugcagagccugagcagacagggcgagaagagaagccugcagcugagcggcaaggugaacgccaugaccuucaccuucgacaacgugcugcccggcaaguacaagaucagcaucaugcacgaggacuggugcuggaagaacaagagccuggagguggaggugcuggaggacgacaugagcgccguggaguucagacagaccggcuacaugcugagaugcagccugagccacgccaucacccuggaguucuaccaggacggcaacggcagagagaacgugggcaucuacaaccugagcaagggcgugaacagauucugccugagcaagcccggcguguacaaggugacccccagaagcugccacagauucgagcaggccuucuacaccuacgacaccagcagccccagcauccugacccugaccgccaucagacaccacgugcugggcaccaucaccaccgacaagaugauggacgugaccgugaccaucaagagcagcaucgacagcgagcccgcccuggugcugggcccccugaagagcgugcaggagcugagaagagagcagcagcuggccgagaucgaggccagaagacaggagagagagaagaacggcaacgaggagggcgaggagagaaugaccaagccccccgugcaggagaugguggacgagcugcagggccccuucagcuacgacuucagcuacugggccagaagcggcgagaagaucaccgugacccccagcagcaaggagcugcuguucuacccccccagcauggaggccguggugagcggcgagagcugccccggcaagcugaucgagauccacggcaaggccggccuguuccuggagggccagauccaccccgagcuggagggcguggagaucgugaucagcgagaagggcgccagcagcccccugaucaccguguucaccgacgacaagggcgccuacagcgugggcccccugcacagcgaccuggaguacaccgugaccagccagaaggagggcuacgugcugaccgccguggagggcaccaucggcgacuucaaggccuacgcccuggccggcgugagcuucgagaucaaggccgaggacgaccagccccugcccggcgugcugcugagccugagcggcggccuguucagaagcaaccugcugacccaggacaacggcauccugaccuucagcaaccugagccccggccaguacuacuucaagcccaugaugaaggaguucagauucgagcccagcagccagaugaucgaggugcaggagggccagaaccugaagaucaccaucaccggcuacagaaccgccuacagcugcuacggcaccgugagcagccugaacggcgagcccgagcagggcguggccauggaggccgugggccagaacgacugcagcaucuacggcgaggacaccgugaccgacgaggagggcaaguucagacugagaggccugcugcccggcugcguguaccacgugcagcugaaggccgagggcaacgaccacaucgagagagcccugccccaccacagagugaucgaggugggcaacaacgacaucgacgacgugaacaucaucguguucagacagaucaaccaguucgaccugagcggcaacgugaucaccagcagcgaguaccugcccacccugugggugaagcuguacaagagcgagaaccuggacaaccccauccagaccgugagccugggccagagccuguucuuccacuuccccccccugcugagagacggcgagaacuacguggugcugcuggacagcacccugcccagaagccaguacgacuacauccugccccaggugagcuucaccgccgugggcuaccacaagcacaucacccugaucuucaaccccaccagaaagcugcccgagcaggacaucgcccagggcagcuacaucgcccugccccugacccugcuggugcugcuggccggcuacaaccacgacaagcugaucccccugcugcugcagcugaccagcagacugcagggcgugagagcccugggccaggccgccagcgacaacagcggccccgaggacgccaagagacaggccaagaagcagaagaccagaagaaccuaa

SEQ ID NO: 20635 - RNA, 1416 nt, Artificial Sequence
  NONO__Homo_sapiens__NP_001138881
augcagagcaacaagaccuucaaccuggagaagcagaaccacacccccagaaagcaccaccagcaccaccaccagcagcagcaccaccagcagcagcagcagcagcccccccccccccccauccccgccaacggccagcaggccagcagccagaacgagggccugaccaucgaccugaagaacuucagaaagcccggcgagaagaccuucacccagagaagcagacuguucgugggcaaccugccccccgacaucaccgaggaggagaugagaaagcuguucgagaaguacggcaaggccggcgagguguucauccacaaggacaagggcuucggcuucaucagacuggagaccagaacccuggccgagaucgccaagguggagcuggacaacaugccccugagaggcaagcagcugagagugagauucgccugccacagcgccagccugaccgugagaaaccugccccaguacgugagcaacgagcugcuggaggaggccuucagcguguucggccagguggagagagccguggugaucguggacgacagaggcagacccagcggcaagggcaucguggaguucagcggcaagcccgccgccagaaaggcccuggacagaugcagcgagggcagcuuccugcugaccaccuuccccagacccgugaccguggagcccauggaccagcuggacgacgaggagggccugcccgagaagcuggugaucaagaaccagcaguuccacaaggagagagagcagccccccagauucgcccagcccggcagcuucgaguacgaguacgccaugagauggaaggcccugaucgagauggagaagcagcagcaggaccagguggacagaaacaucaaggaggccagagagaagcuggagauggagauggaggccgccagacacgagcaccaggugaugcugaugagacaggaccugaugagaagacaggaggagcugagaagaauggaggagcugcacaaccaggaggugcagaagagaaagcagcuggagcugagacaggaggaggagagaagaagaagagaggaggagaugagaagacagcaggaggagaugaugagaagacagcaggagggcuucaagggcaccuuccccgacgccagagagcaggagaucagaaugggccagauggccaugggcggcgccaugggcaucaacaacagaggcgccaugccccccgcccccgugcccgccggcacccccgccccccccggccccgccaccaugaugcccgacggcacccugggccugaccccccccaccaccgagagauucggccaggccgccaccauggagggcaucggcgccaucggcggcaccccccccgccuucaacagagccgcccccggcgccgaguucgcccccaacaagagaagaagauacuaa

SEQ ID NO: 20636 - RNA, 195 nt, Artificial Sequence
  NOP10__Homo_sapiens__NP_061118
auguuccugcaguacuaccugaacgagcagggcgacagaguguacacccugaagaaguucgaccccaugggccagcagaccugcagcgcccaccccgccagauucagccccgacgacaaguacagcagacacagaaucaccaucaagaagagauucaaggugcugaugacccagcagcccagacccgugcuguaa

SEQ ID NO: 20637 - RNA, 2421 nt, Artificial Sequence
  NOP14__Homo_sapiens__NP_001278908
auggccaaggccaagaaggugggcgccagaagaaaggccagcggcgcccccgccggcgccagaggcggccccgccaaggccaacagcaaccccuucgaggugaaggugaacagacagaaguuccagauccugggcagaaagaccagacacgacgugggccugcccggcgugagcagagccagagcccugagaaagagaacccagacccugcugaaggaguacaaggagagagacaagagcaacguguucagagacaagagauucggcgaguacaacagcaacaugagccccgaggagaagaugaugaagagauucgcccuggagcagcagagacaccacgagaagaagagcaucuacaaccugaacgaggacgaggagcugacccacuacggccagagccuggccgacaucgagaagcacaacgacaucguggacagcgacagcgacgccgaggacagaggcacccugagcgccgagcugaccgccgcccacuucggcggcggcggcggccugcugcacaagaagacccagcaggagggcgaggagagagagaagcccaagagcagaaaggagcugaucgaggagcugaucgccaagagcaagcaggagaagagagagagacaggcccagagagaggacgcccuggagcugaccgagaagcuggaccaggacuggaaggagauccagacccugcugagccacaagacccccaagagcgagaacagagacaagaaggagaagcccaagcccgacgccuacgacaugauggugagagagcugggcuucgagaugaaggcccagcccagcaacagaaugaagaccgaggccgagcuggccaaggaggagcaggagcaccugagaaagcuggaggccgagagacugagaagaaugcugggcaaggacgaggacgagaacgugaagaagcccaagcacaugagcgccgacgaccugaacgacggcuucgugcuggacaaggacgacagaagacugcugagcuacaaggacggcaagaugaacguggaggaggacgugcaggaggagcagagcaaggaggccagcgaccccgagagcaacgaggaggagggcgacagcagcggcggcgaggacaccgaggagagcgacagccccgacagccaccuggaccuggagagcaacguggagagcgaggaggagaacgagaagcccgccaaggagcagagacagacccccggcaagggccugaucagcggcaaggagagagccggcaaggccaccagagacgagcugcccuacaccuucgccgcccccgagagcuacgaggagcugagaagccugcugcugggcagaagcauggaggagcagcugcuggugguggagagaauccagaagugcaaccaccccagccuggccgagggcaacaaggccaagcuggagaagcuguucggcuuccugcuggaguacgugggcgaccuggccaccgacgacccccccgaccugaccgugaucgacaagcugguggugcaccuguaccaccugugccagauguuccccgagagcgccagcgacgccaucaaguucgugcugagagacgccaugcacgagauggaggagaugaucgagaccaagggcagagccgcccugcccggccuggacgugcugaucuaccugaagaucaccggccugcuguuccccaccagcgacuucuggcaccccguggugacccccgcccuggugugccugagccagcugcugaccaagugccccauccugagccugcaggacguggugaagggccuguucgugugcugccuguuccuggaguacguggcccugagccagagauucauccccgagcugaucaacuuccugcugggcauccuguacaucgccacccccaacaaggccagccagggcagcacccuggugcaccccuucagagcccugggcaagaacagcgagcugcugguggugagcgccagagaggacguggccaccuggcagcagagcagccugagccugagaugggccagcagacugagagcccccaccagcaccgaggccaaccacaucagacugagcugccuggccgugggccuggcccugcugaagagaugcgugcugauguacggcagccugcccagcuuccacgccaucaugggcccccugcaggcccugcugaccgaccaccuggccgacugcagccacccccaggagcugcaggagcugugccagagcacccugaccgagauggagagccagaagcagcugugcagaccccugaccugcgagaagagcaagcccgugccccugaagcuguucacccccagacuggugagcaacagcagaccccaggugauccaccugcccuggccccccaacuacagaugcgagccccagcaccccgccaagaaggugaucuucuucagagugaucaugcuguaa

SEQ ID NO: 20638 - RNA, 699 nt, Artificial Sequence
  NOP16__Homo_sapiens__NP_001243468
augcccaaggccaagggcaagaccagaagacagaaguucggcuacagcgugaacagaaagagacugaacagaaacgccagaagaaaggccgcccccagaaucgagugcagccacaucagacacgccugggaccacgccaagagcgugagacagaaccuggccgagaugggccuggccguggaccccaacagagccgugccccugagaaagagaaaggugaaggccauggagguggacaucgaggagagacccaaggagcuggugagaaagcccuacgugcugaacgaccuggaggccgaggccagccugcccgagaagaagggcaacacccugagcagagaccugaucgacuacgugagauacaugguggagaaccacggcgaggacuacaagcagagcggcaagaccagcagcauccugugcagaagaggcagauggagauggagcgacugguucaccagccagcugccccaggccgaggccagccccggccccgugaagcuggagcccggcugcaaggccagaagaugcugcguggcccccgaggagcuggccagaagccacggcaucagaagacugcacacccacgugcacacccccagaagcggcgagggcaccgugcugagaggcagcaaccuguacagcagcggcggcagcagaaagagccagaaccugcuguucagcggcugggugauguaa

SEQ ID NO: 20639 - RNA, 2427 nt, Artificial Sequence
  NOP2__Homo_sapiens__NP_001028886
augggcagaaagcuggaccccaccaaggagaagagaggccccggcagaaaggccagaaagcagaagggcgccgagaccgagcuggugagauuccugcccgccgugagcgacgagaacagcaagagacugagcagcagagccagaaagagagccgccaagagaagacugggcagcguggaggcccccaagaccaacaagagccccgaggccaagccccugcccggcaagcugcccaagggcgccgugcagaccgccggcaagaagggcccccagagccuguucaacgcccccagaggcaagaagagacccgcccccggcagcgacgaggaggaggaggaggaggacagcgaggaggacggcauggugaaccacggcgaccuguggggcagcgaggacgacgccgacaccguggacgacuacggcgccgacagcaacagcgaggacgaggaggagggcgaggcccugcugcccaucgagagagccgccagaaagcagaaggccagagaggccgccgccggcauccaguggagcgaggaggagaccgaggacgaggaggaggagaaggaggugacccccgagagcggcccccccaagguggaggaggccgacggcggccugcagaucaacguggacgaggagcccuucgugcugccccccgccggcgagauggagcaggacgcccaggcccccgaccugcagagagugcacaagagaauccaggacaucgugggcauccugagagacuucggcgcccagagagaggagggcagaagcagaagcgaguaccugaacagacugaagaaggaccuggccaucuacuacagcuacggcgacuuccugcugggcaagcugauggaccuguucccccugagcgagcugguggaguuccuggaggccaacgaggugcccagacccgugacccugagaaccaacacccugaagaccagaagaagagaccuggcccaggcccugaucaacagaggcgugaaccuggacccccugggcaaguggagcaagaccggccuggugguguacgacagcagcgugcccaucggcgccacccccgaguaccuggccggccacuacaugcugcagggcgccagcagcaugcugcccgugauggcccuggccccccaggagcacgagagaauccuggacaugugcugcgcccccggcggcaagaccagcuacauggcccagcugaugaagaacaccggcgugauccuggccaacgacgccaacgccgagagacugaagagcguggugggcaaccugcacagacugggcgugaccaacaccaucaucagccacuacgacggcagacaguuccccaagguggugggcggcuucgacagagugcugcuggacgcccccugcagcggcaccggcgugaucagcaaggaccccgccgugaagaccaacaaggacgagaaggacauccugagaugcgcccaccugcagaaggagcugcugcugagcgccaucgacagcgugaacgccaccagcaagaccggcggcuaccugguguacugcaccugcagcaucaccguggaggagaacgagugggugguggacuacgcccugaagaagagaaacgugagacuggugcccaccggccuggacuucggccaggagggcuucaccagauucagagagagaagauuccaccccagccugagaagcaccagaagauucuacccccacacccacaacauggacggcuucuucaucgccaaguucaagaaguucagcaacagcaucccccagagccagaccggcaacagcgagaccgccacccccaccaacguggaccugccccaggugauccccaagagcgagaacagcagccagcccgccaagaaggccaagggcgccgccaagaccaagcagcagcugcagaagcagcagcaccccaagaaggccagcuuccagaagcugaacggcaucagcaagggcgccgacagcgagcugagcaccgugcccagcgugaccaagacccaggccagcagcagcuuccaggacagcagccagcccgccggcaaggccgagggcaucagagagcccaaggugaccggcaagcugaagcagagaagccccaagcugcagagcagcaagaagguggccuuccugagacagaacgccccccccaagggcaccgacacccagacccccgccgugcugagccccagcaagacccaggccacccugaagcccaaggaccaccaccagccccugggcagagccaagggcguggagaagcagcagcugcccgagcagcccuucgagaaggccgccuuccagaagcagaacgacacccccaagggcccccagccccccaccgugagccccaucagaagcagcagacccccccccgccaagagaaagaagagccagagcagaggcaacagccagcugcugcugagcuaa

SEQ ID NO: 20640 - RNA, 1785 nt, Artificial Sequence
  NOP56__Homo_sapiens__NP_006383
auggugcugcugcacgugcuguucgagcacgccgugggcuacgcccugcuggcccugaaggagguggaggagaucagccugcugcagccccagguggaggagagcgugcugaaccugggcaaguuccacagcaucgugagacugguggccuucugccccuucgccagcagccagguggcccuggagaacgccaacgccgugagcgagggcguggugcacgaggaccugagacugcugcuggagacccaccugcccagcaagaagaagaaggugcugcugggcgugggcgaccccaagaucggcgccgccauccaggaggagcugggcuacaacugccagaccggcggcgugaucgccgagauccugagaggcgugagacugcacuuccacaaccuggugaagggccugaccgaccugagcgccugcaaggcccagcugggccugggccacagcuacagcagagccaaggugaaguucaacgugaacagaguggacaacaugaucauccagagcaucagccugcuggaccagcuggacaaggacaucaacaccuucagcaugagagugagagagugguacggcuaccacuuccccgagcuggugaagaucaucaacgacaacgccaccuacugcagacuggcccaguucaucggcaacagaagagagcugaacgaggacaagcuggagaagcuggaggagcugaccauggacggcgccaaggccaaggccauccuggacgccagcagaagcagcaugggcauggacaucagcgccaucgaccugaucaacaucgagagcuucagcagcagaguggugagccugagcgaguacagacagagccugcacaccuaccugagaagcaagaugagccagguggcccccagccugagcgcccugaucggcgaggccgugggcgccagacugaucgcccacgccggcagccugaccaaccuggccaaguaccccgccagcaccgugcagauccugggcgccgagaaggcccuguucagagcccugaagaccagaggcaacacccccaaguacggccugaucuuccacagcaccuucaucggcagagccgccgccaagaacaagggcagaaucagcagauaccuggccaacaagugcagcaucgccagcagaaucgacugcuucagcgaggugcccaccagcguguucggcgagaagcugagagagcagguggaggagagacugagcuucuacgagaccggcgagauccccagaaagaaccuggacgugaugaaggaggccauggugcaggccgaggaggccgccgccgagaucaccagaaagcuggagaagcaggagaagaagagacugaagaaggagaagaagagacuggccgcccuggcccuggccagcagcgagaacagcagcagcacccccgaggagugcgaggagaugagcgagaagcccaagaagaagaagaagcagaagccccaggaggugccccaggagaacggcauggaggaccccagcaucagcuucagcaagcccaagaagaagaagagcuucagcaaggaggagcugaugagcagcgaccuggaggagaccgccggcagcaccagcauccccaagagaaagaagagcacccccaaggaggagaccgugaacgaccccgaggaggccggccacagaagcggcagcaagaagaagagaaaguucagcaaggaggagcccgugagcagcggccccgaggaggccgugggcaagagcagcagcaagaagaagaagaaguuccacaaggccagccaggaggacuaa

SEQ ID NO: 20641 - RNA, 1911 nt, Artificial Sequence
  NOP9__Homo_sapiens__NP_777573
augggccagggccccagaagcccccacaaggugggcagaagauuccccgccggcggcaagagaggcagaggcgccaagggcagcggcagaccccugcccggcagaaagagacagcccuggcccccccccgacggcagaagcgagcccgcccccgacagccacccccaccugagccccgaggcccugggcuacuucagaagagcccugagcgcccugaaggaggcccccgagaccggcgaggagagagaccugauggugcacaacaucaugaaggagguggagacccaggcccuggcccugagcaccaacagaaccggcagcgagaugcugcaggagcugcugggcuucagcccccugaagccccugugcagagugugggccgcccugagaagcaaccugagaaccguggccugccacagaugcggcgugcacgugcugcagagcgcccugcugcagcugcccagacugcugggcagcgccgccgaggaggaggaggaggaggaggaggacggcaaggacggccccaccgagacccuggaggagcuggugcugggccuggccgccgaggugugcgacgacuuccugguguacugcggcgacacccacggcagcuucguggugagaacccugcugcaggugcugggcggcaccauccuggagagcgagagagccagacccagaggcagccagagcagcgaggcccagaagacccccgcccaggagugcaagcccgccgacuucgaggugcccgagaccuuccugaacagacugcaggaccugagcagcagcuuccugaaggacaucgccguguucaucaccgacaagaucagcagcuucugccugcagguggcccugcaggugcugcacagaaagcugccccaguucugcgcccaccugugcaacgccgugaucggcuaccugagcaccagaggcagcagcguggacggcagcccccugcugcuguuccugagagaccagaccagcagcagacugcuggagcaggugcugcuggugcuggagccccccagacugcagagccuguucgaggagcaccugcagggccagcugcagacccuggccgcccaccccaucgccaacuucccccugcagagacugcuggacgccgugaccacccccgagcugcugagccccguguucgaggagcugagccccgugcuggaggccgugcuggcccagggccaccccggcguggugaucgcccuggugggcgccugcagaagagugggcgccuaccaggccaaggugcugcagcugcugcuggaggccuuccacugcgccgagcccagcagcagacagguggccugcgugccccuguucgccacccugauggccuacgagguguacuacggccugaccgaggaggagggcgccgugcccgccgagcaccagguggccauggccgccgccagagcccugggcgacgugaccgugcugggcagccugcugcugcagcaccugcugcacuucagcacccccggccuggugcugagaagccugggcgcccugaccggcccccagcugcugagccuggcccagagccccgccggcagccacgugcuggacgccauccugaccagccccagcgugaccagaaagcugagaagaagagugcugcagaaccugaagggccaguacguggcccuggccugcagcagacacggcagcagagugcuggacgccaucuggagcggcgccgcccugagagccagaaaggagaucgccgccgagcugggcgagcagaaccaggagcugaucagagaccccuucggccaccacguggccagaaacguggcccugaccaccuuccugaagagaagagaggccugggagcagcagcagggcgccguggccaagagaagaagagcccugaacagcauccuggaggacuaa

SEQ ID NO: 20642 - RNA, 636 nt, Artificial Sequence
  NOS1AP__Homo_sapiens__NP_001119532
augagccugagcagccugugccccguguucagcgccgccgccagcagccugcaggugcaccugcugaaggaccagcuggccgccgaggccgccgccagacuggaggcccaggccagagugcaccagcugcugcugcagaacaaggacaugcugcagcacaucagccugcuggugaagcaggugcaggagcuggagcugaagcugagcggccagaacgccaugggcagccaggacagccugcuggagaucaccuucagaagcggcgcccugcccgugcugugcgaccccaccacccccaagcccgaggaccugcacagccccccccugggcgccggccuggccgacuucgcccaccccgccggcagcccccugggcagaagagacugccuggugaagcuggagugcuucagauuccugccccccgaggacacccccccccccgcccagggcgaggcccugcugggcggccuggagcugaucaaguucagagagagcggcaucgccagcgaguacgagagcaacaccgacgagagcgaggagagagacagcuggagccaggaggagcugcccagacugcugaacgugcugcagagacaggagcugggcgacggccuggacgacgagaucgccguguaa

SEQ ID NO: 20643 - RNA, 4305 nt, Artificial Sequence
  NOS1__Homo_sapiens__NP_000611
auggaggaccacauguucggcgugcagcagauccagcccaacgugaucagcgugagacuguucaagagaaaggugggcggccugggcuuccuggugaaggagagagugagcaagccccccgugaucaucagcgaccugaucagaggcggcgccgccgagcagagcggccugauccaggccggcgacaucauccuggccgugaacggcagaccccugguggaccugagcuacgacagcgcccuggaggugcugagaggcaucgccagcgagacccacguggugcugauccugagaggccccgagggcuucaccacccaccuggagaccaccuucaccggcgacggcacccccaagaccaucagagugacccagccccugggcccccccaccaaggccguggaccugagccaccagccccccgccggcaaggagcagccccuggccguggacggcgccagcggccccggcaacggcccccagcacgccuacgacgacggccaggaggccggcagccugccccacgccaacggccuggcccccagaccccccggccaggaccccgccaagaaggccaccagagugagccugcagggcagaggcgagaacaacgagcugcugaaggagaucgagcccgugcugagccugcugaccagcggcagcagaggcgugaagggcggcgcccccgccaaggccgagaugaaggacaugggcauccagguggacagagaccuggacggcaagagccacaagccccugccccugggcguggagaacgacagaguguucaacgaccuguggggcaagggcaacgugcccguggugcugaacaaccccuacagcgagaaggagcagccccccaccagcggcaagcagagccccaccaagaacggcagccccagcaagugccccagauuccugaaggugaagaacugggagaccgagguggugcugaccgacacccugcaccugaagagcacccuggagaccggcugcaccgaguacaucugcaugggcagcaucaugcaccccagccagcacgccagaagacccgaggacgugagaaccaagggccagcuguucccccuggccaaggaguucaucgaccaguacuacagcagcaucaagagauucggcagcaaggcccacauggagagacuggaggaggugaacaaggagaucgacaccaccagcaccuaccagcugaaggacaccgagcugaucuacggcgccaagcacgccuggagaaacgccagcagaugcgugggcagaauccaguggagcaagcugcagguguucgacgccagagacugcaccaccgcccacggcauguucaacuacaucugcaaccacgugaaguacgccaccaacaagggcaaccugagaagcgccaucaccaucuucccccagagaaccgacggcaagcacgacuucagaguguggaacagccagcugaucagauacgccggcuacaagcagcccgacggcagcacccugggcgaccccgccaacgugcaguucaccgagaucugcauccagcagggcuggaagccccccagaggcagauucgacgugcugccccugcugcugcaggccaacggcaacgaccccgagcuguuccagaucccccccgagcuggugcuggaggugcccaucagacaccccaaguucgagugguucaaggaccugggccugaagugguacggccugcccgccgugagcaacaugcugcuggagaucggcggccuggaguucagcgccugccccuucagcggcugguacaugggcaccgagaucggcgugagagacuacugcgacaacagcagauacaacauccuggaggagguggccaagaagaugaaccuggacaugagaaagaccagcagccuguggaaggaccaggcccugguggagaucaacaucgccgugcuguacagcuuccagagcgacaaggugaccaucguggaccaccacagcgccaccgagagcuucaucaagcacauggagaacgaguacagaugcagaggcggcugccccgccgacuggguguggaucgugccccccaugagcggcagcaucacccccguguuccaccaggagaugcugaacuacagacugacccccagcuucgaguaccagcccgaccccuggaacacccacguguggaagggcaccaacggcacccccaccaagagaagagccaucggcuucaagaagcuggccgaggccgugaaguucagcgccaagcugaugggccaggccauggccaagagagugaaggccaccauccuguacgccaccgagaccggcaagagccaggccuacgccaagacccugugcgagaucuucaagcacgccuucgacgccaaggugaugagcauggaggaguacgacaucgugcaccuggagcacgagacccuggugcugguggugaccagcaccuucggcaacggcgacccccccgagaacggcgagaaguucggcugcgcccugauggagaugagacaccccaacagcgugcaggaggagagaaagagcuacaaggugagauucaacagcgugagcagcuacagcgacagccagaagagcagcggcgacggccccgaccugagagacaacuucgagagcgccggcccccuggccaacgugagauucagcguguucggccugggcagcagagccuacccccacuucugcgccuucggccacgccguggacacccugcuggaggagcugggcggcgagagaauccugaagaugagagagggcgacgagcugugcggccaggaggaggccuucagaaccugggccaagaagguguucaaggccgccugcgacguguucugcgugggcgacgacgugaacaucgagaaggccaacaacagccugaucagcaacgacagaagcuggaagagaaacaaguucagacugaccuucguggccgaggcccccgagcugacccagggccugagcaacgugcacaagaagagagugagcgccgccagacugcugagcagacagaaccugcagagccccaagagcagcagaagcaccaucuucgugagacugcacaccaacggcagccaggagcugcaguaccagcccggcgaccaccugggcguguuccccggcaaccacgaggaccuggugaacgcccugaucgagagacuggaggacgccccccccgugaaccagauggugaagguggagcugcuggaggagagaaacaccgcccugggcgugaucagcaacuggaccgacgagcugagacugccccccugcaccaucuuccaggccuucaaguacuaccuggacaucaccaccccccccaccccccugcagcugcagcaguucgccagccuggccaccagcgagaaggagaagcagagacugcuggugcugagcaagggccugcaggaguacgaggaguggaaguggggcaagaaccccaccaucguggaggugcuggaggaguuccccagcauccagaugcccgccacccugcugcugacccagcugagccugcugcagcccagauacuacagcaucagcagcagccccgacauguaccccgacgaggugcaccugaccguggccaucgugagcuacagaaccagagacggcgagggccccauccaccacggcgugugcagcagcuggcugaacagaauccaggccgacgagcuggugcccugcuucgugagaggcgcccccagcuuccaccugcccagaaacccccaggugcccugcauccuggugggccccggcaccggcaucgcccccuucagaagcuucuggcagcagagacaguucgacauccagcacaagggcaugaaccccugccccauggugcugguguucggcugcagacagagcaagaucgaccacaucuacagagaggagacccugcaggccaagaacaagggcguguucagagagcuguacaccgccuacagcagagagcccgacaagcccaagaaguacgugcaggacauccugcaggagcagcuggccgagagcguguacagagcccugaaggagcagggcggccacaucuacgugugcggcgacgugaccauggccgccgacgugcugaaggccauccagagaaucaugacccagcagggcaagcugagcgccgaggacgccggcguguucaucagcagaaugagagacgacaacagauaccacgaggacaucuucggcgugacccugagaaccuacgaggugaccaacagacugagaagcgagagcaucgccuucaucgaggagagcaagaaggacaccgacgagguguucagcagcuaa

SEQ ID NO: 20644 - RNA, 3462 nt, Artificial Sequence
  NOS2__Homo_sapiens__NP_000616
auggccugccccuggaaguuccuguucaagaccaaguuccaccaguacgccaugaacggcgagaaggacaucaacaacaacguggagaaggcccccugcgccaccagcagccccgugacccaggacgaccugcaguaccacaaccugagcaagcagcagaacgagagcccccagccccugguggagaccggcaagaagagccccgagagccuggugaagcuggacgccaccccccugagcagccccagacacgugagaaucaagaacuggggcagcggcaugaccuuccaggacacccugcaccacaaggccaagggcauccugaccugcagaagcaagagcugccugggcagcaucaugacccccaagagccugaccagaggccccagagacaagcccaccccccccgacgagcugcugccccaggccaucgaguucgugaaccaguacuacggcagcuucaaggaggccaagaucgaggagcaccuggccagaguggaggccgugaccaaggagaucgagaccaccggcaccuaccagcugaccggcgacgagcugaucuucgccaccaagcaggccuggagaaacgcccccagaugcaucggcagaauccaguggagcaaccugcagguguucgacgccagaagcugcagcaccgccagagagauguucgagcacaucugcagacacgugagauacagcaccaacaacggcaacaucagaagcgccaucaccguguucccccagagaagcgacggcaagcacgacuucagaguguggaacgcccagcugaucagauacgccggcuaccagaugcccgacggcagcaucagaggcgaccccgccaacguggaguucacccagcugugcaucgaccugggcuggaagcccaaguacggcagauucgacguggugccccuggugcugcaggccaacggcagagaccccgagcuguucgagaucccccccgaccuggugcuggagguggccauggagcaccccaaguacgagugguucagagagcuggagcugaagugguacgcccugcccgccguggccaacaugcugcuggaggugggcggccuggaguuccccggcugccccuucaacggcugguacaugggcaccgagaucggcgugagagacuucugcgacgugcagagauacaacauccuggaggaggugggcagaagaaugggccuggagacccacaagcuggccagccuguggaaggaccaggccgugguggagaucaacaucgccgugcugcacagcuuccagaagcagaacgugaccaucauggaccaccacagcgccgccgagagcuucaugaaguacaugcagaacgaguacagaagcagaggcggcugccccgccgacuggaucuggcuggugccccccaugagcggcagcaucacccccguguuccaccaggagaugcugaacuacgugcugagccccuucuacuacuaccagguggaggccuggaagacccacguguggcaggacgagaagagaagacccaagagaagagagaucccccugaaggugcuggugaaggccgugcuguucgccugcaugcugaugagaaagaccauggccagcagagugagagugaccauccuguucgccaccgagaccggcaagagcgaggcccuggccugggaccugggcgcccuguucagcugcgccuucaaccccaagguggugugcauggacaaguacagacugagcugccuggaggaggagagacugcugcugguggugaccagcaccuucggcaacggcgacugccccggcaacggcgagaagcugaagaagagccuguucaugcugaaggagcugaacaacaaguucagauacgccguguucggccugggcagcagcauguaccccagauucugcgccuucgcccacgacaucgaccagaagcugagccaccugggcgccagccagcugacccccaugggcgagggcgacgagcugagcggccaggaggacgccuucagaagcugggccgugcagaccuucaaggccgccugcgagaccuucgacgugagaggcaagcagcacauccagauccccaagcuguacaccagcaacgugaccugggacccccaccacuacagacuggugcaggacagccagccccuggaccugagcaaggcccugagcagcaugcacgccaagaacguguucaccaugagacugaagagcagacagaaccugcagagccccaccagcagcagagccaccauccugguggagcugagcugcgaggacggccagggccugaacuaccugcccggcgagcaccugggcgugugccccggcaaccagcccgcccuggugcagggcauccuggagagagugguggacggccccaccccccaccagaccgugagacuggaggcccuggacgagagcggcagcuacugggugagcgacaagagacugccccccugcagccugagccaggcccugaccuacuuccuggacaucaccaccccccccacccagcugcugcugcagaagcuggcccagguggccaccgaggagcccgagagacagagacuggaggcccugugccagcccagcgaguacagcaaguggaaguucaccaacagccccaccuuccuggaggugcuggaggaguuccccagccugagagugagcgccggcuuccugcugagccagcugcccauccugaagcccagauucuacagcaucagcagcagcagagaccacacccccaccgagauccaccugaccguggccguggugaccuaccacaccagagacggccagggcccccugcaccacggcgugugcagcaccuggcugaacagccugaagccccaggaccccgugcccugcuucgugagaaacgccagcggcuuccaccugcccgaggaccccagccaccccugcauccugaucggccccggcaccggcaucgcccccuucagaagcuucuggcagcagagacugcacgacagccagcacaagggcgugagaggcggcagaaugacccugguguucggcugcagaagacccgacgaggaccacaucuaccaggaggagaugcuggagauggcccagaagggcgugcugcacgccgugcacaccgccuacagcagacugcccggcaagcccaagguguacgugcaggacauccugagacagcagcuggccagcgaggugcugagagugcugcacaaggagcccggccaccuguacgugugcggcgacgugagaauggccagagacguggcccacacccugaagcagcugguggccgccaagcugaagcugaacgaggagcagguggaggacuacuucuuccagcugaagagccagaagagauaccacgaggacaucuucggcgccguguuccccuacgaggccaagaaggacagaguggccgugcagcccagcagccuggagaugagcgcccuguaa

SEQ ID NO: 20645 - RNA, 3612 nt, Artificial Sequence
  NOS3__Homo_sapiens__NP_000594
augggcaaccugaagagcguggcccaggagcccggcccccccugcggccugggccugggccugggccugggccugugcggcaagcagggccccgccacccccgcccccgagcccagcagagcccccgccagccugcugccccccgcccccgagcacagcccccccagcagcccccugacccagccccccgagggccccaaguuccccagagugaagaacugggaggugggcagcaucaccuacgacacccugagcgcccaggcccagcaggacggccccugcacccccagaagaugccugggcagccugguguuccccagaaagcugcagggcagacccagccccggcccccccgcccccgagcagcugcugagccaggccagagacuucaucaaccaguacuacagcagcaucaagagaagcggcagccaggcccacgagcagagacugcaggagguggaggccgagguggccgccaccggcaccuaccagcugagagagagcgagcugguguucggcgccaagcaggccuggagaaacgcccccagaugcgugggcagaauccaguggggcaagcugcagguguucgacgccagagacugcagaagcgcccaggagauguucaccuacaucugcaaccacaucaaguacgccaccaacagaggcaaccugagaagcgccaucaccguguucccccagagaugccccggcagaggcgacuucagaaucuggaacagccagcuggugagauacgccggcuacagacagcaggacggcagcgugagaggcgaccccgccaacguggagaucaccgagcugugcauccagcacggcuggacccccggcaacggcagauucgacgugcugccccugcugcugcaggcccccgacgacccccccgagcuguuccugcugccccccgagcuggugcuggaggugccccuggagcaccccacccuggagugguucgccgcccugggccugagaugguacgcccugcccgccgugagcaacaugcugcuggagaucggcggccuggaguuccccgccgcccccuucagcggcugguacaugagcaccgagaucggcaccagaaaccugugcgacccccacagauacaacauccuggaggacguggccgugugcauggaccuggacaccagaaccaccagcagccuguggaaggacaaggccgccguggagaucaacguggccgugcugcacagcuaccagcuggccaaggugaccaucguggaccaccacgccgccaccgccagcuucaugaagcaccuggagaacgagcagaaggccagaggcggcugccccgccgacugggccuggaucgugccccccaucagcggcagccugacccccguguuccaccaggagauggugaacuacuuccugagccccgccuucagauaccagcccgaccccuggaagggcagcgccgccaagggcaccggcaucaccagaaagaagaccuucaaggagguggccaacgccgugaagaucagcgccagccugaugggcaccgugauggccaagagagugaaggccaccauccuguacggcagcgagaccggcagagcccagagcuacgcccagcagcugggcagacuguucagaaaggccuucgaccccagagugcugugcauggacgaguacgacguggugagccuggagcacgagacccuggugcugguggugaccagcaccuucggcaacggcgacccccccgagaacggcgagagcuucgccgccgcccugauggagaugagcggccccuacaacagcagccccagacccgagcagcacaagagcuacaagaucagauucaacagcaucagcugcagcgacccccuggugagcagcuggagaagaaagagaaaggagagcagcaacaccgacagcgccggcgcccugggcacccugagauucugcguguucggccugggcagcagagccuacccccacuucugcgccuucgccagagccguggacaccagacuggaggagcugggcggcgagagacugcugcagcugggccagggcgacgagcugugcggccaggaggaggccuucagaggcugggcccaggccgccuuccaggccgccugcgagaccuucugcgugggcgaggacgccaaggccgccgccagagacaucuucagccccaagagaagcuggaagagacagagauacagacugagcgcccaggccgagggccugcagcugcugcccggccugauccacgugcacagaagaaagauguuccaggccaccaucagaagcguggagaaccugcagagcagcaagagcaccagagccaccauccuggugagacuggacaccggcggccaggagggccugcaguaccagcccggcgaccacaucggcgugugcccccccaacagacccggccugguggaggcccugcugagcagaguggaggacccccccgcccccaccgagcccguggccguggagcagcuggagaagggcagccccggcggccccccccccggcugggugagagaccccagacugccccccugcacccugagacaggcccugaccuucuuccuggacaucaccagcccccccagcccccagcugcugagacugcugagcacccuggccgaggagcccagagagcagcaggagcuggaggcccugagccaggaccccagaagauacgaggaguggaagugguucagaugccccacccugcuggaggugcuggagcaguuccccagcguggcccugcccgccccccugcugcugacccagcugccccugcugcagcccagauacuacagcgugagcagcgcccccagcacccaccccggcgagauccaccugaccguggccgugcuggccuacagaacccaggacggccugggcccccugcacuacggcgugugcagcaccuggcugagccagcugaagcccggcgaccccgugcccugcuucaucagaggcgcccccagcuucagacugccccccgaccccagccugcccugcauccuggugggccccggcaccggcaucgcccccuucagaggcuucuggcaggagagacugcacgacaucgagagcaagggccugcagcccacccccaugacccugguguucggcugcagaugcagccagcuggaccaccuguacagagacgaggugcagaacgcccagcagagaggcguguucggcagagugcugaccgccuucagcagagagcccgacaaccccaagaccuacgugcaggacauccugagaaccgagcuggccgccgaggugcacagagugcugugccuggagagaggccacauguucgugugcggcgacgugaccauggccaccaacgugcugcagaccgugcagagaauccuggccaccgagggcgacauggagcuggacgaggccggcgacgugaucggcgugcugagagaccagcagagauaccacgaggacaucuucggccugacccugagaacccaggaggugaccagcagaaucagaacccagagcuucagccugcaggagagacagcugagaggcgccgugcccugggccuucgacccccccggcagcgacaccaacagccccuaa

SEQ ID NO: 20646 - RNA, 906 nt, Artificial Sequence
  NOSIP__Homo_sapiens__NP_057037
augaccagacacggcaagaacugcaccgccggcgccguguacaccuaccacgagaagaagaaggacaccgccgccagcggcuacggcacccagaacaucagacugagcagagacgccgugaaggacuucgacugcugcugccugagccugcagcccugccacgaccccguggugacccccgacggcuaccuguacgagagagaggccauccuggaguacauccugcaccagaagaaggagaucgccagacagaugaaggccuacgagaagcagagaggcaccagaagagaggagcagaaggagcugcagagagccgccagccaggaccacgugagaggcuuccuggagaaggagagcgccaucgugagcagaccccugaaccccuucaccgccaaggcccugagcggcaccagccccgacgacgugcagcccggccccagcgugggcccccccagcaaggacaaggacaaggugcugcccagcuucuggauccccagccugacccccgaggccaaggccaccaagcuggagaagcccagcagaaccgugaccugccccaugagcggcaagccccugagaaugagcgaccugacccccgugcacuucaccccccuggacagcagcguggacagagugggccugaucaccagaagcgagagauacgugugcgccgugaccagagacagccugagcaacgccacccccugcgccgugcugagacccagcggcgccguggugacccuggagugcguggagaagcugaucagaaaggacaugguggaccccgugaccggcgacaagcugaccgacagagacaucaucgugcugcagagaggcggcaccggcuucgccggcagcggcgugaagcugcaggccgagaagagcagacccgugaugcaggccuaa

SEQ ID NO: 20647 - RNA, 1521 nt, Artificial Sequence
  NOSTRIN__Homo_sapiens__NP_001034813
augagagacccccugaccgacugccccuacaacaagguguacaagaaccugaaggaguucagccagaacggcgagaacuucugcaagcaggugaccagcgugcugcagcagagagccaaccuggagaucagcuacgccaagggccugcagaagcuggccagcaagcugagcaaggcccugcagaacaccagaaagagcugcgugagcagcgccugggccugggccagcgagggcaugaagagcaccgccgaccugcaccagaagcugggcaaggccaucgagcuggaggccaucaagcccaccuaccaggugcugaacgugcaggagaagaagagaaagagccuggacaacgagguggagaagaccgccaaccuggugaucagcaacuggaaccagcagaucaaggccaagaagaagcugauggugagcaccaagaagcacgaggcccuguuccagcugguggagagcagcaagcagagcaugaccgagaaggagaagagaaagcugcugaacaagcugaccaagagcaccgagaagcuggagaaggaggacgagaacuacuaccagaagaacauggccggcuacagcaccagacugaagugggagaacacccuggagaacugcuaccagagcauccuggagcuggagaaggagagaauccagcugcugugcaacaaccugaaccaguacagccagcacaucagccuguucggccagacccugaccaccugccacacccagauccacugcgccaucagcaagaucgacaucgagaaggacauccaggccgugauggaggagaccgccauccugagcaccgagaacaagagcgaguuccugcugaccgacuacuucgaggaggaccccaacagcgccauggacaaggagagaagaaagagccugcugaagcccaagcugcugagacugcagagagacaucgagaaggccagcaaggacaaggagggccuggagagaaugcugaagaccuacagcagcaccagcagcuucagcgacgccaagagccagaaggacaccgccgcccugauggacgagaacaaccugaagcuggaccugcuggaggccaacagcuacaagcugagcagcaugcuggccgagcuggagcagagaccccagcccagccaccccugcagcaacagcaucuucagauggagagagaaggagcacacccacagcuacgugaagaucagcagacccuuccugaugaagagacuggagaacaucgugagcaaggccagcagcggcggccagagcaaccccggcagcagcacccccgcccccggcgccgcccagcugagcagcagacugugcaaggcccuguacagcuuccaggccagacaggacgacgagcugaaccuggagaagggcgacaucgugaucauccacgagaagaaggagggcggcuggugguucggcagccugaacggcaagaagggccacuuccccgccgccuacguggaggagcugcccagcaacgccggcaacaccgccaccaaggccuaa

SEQ ID NO: 20648 - RNA, 7668 nt, Artificial Sequence
  NOTCH1__Homo_sapiens__NP_060087
augcccccccugcuggccccccugcugugccuggcccugcugcccgcccuggccgccagaggccccagaugcagccagcccggcgagaccugccugaacggcggcaagugcgaggccgccaacggcaccgaggccugcgugugcggcggcgccuucgugggccccagaugccaggaccccaaccccugccugagcacccccugcaagaacgccggcaccugccacgugguggacagaagaggcguggccgacuacgccugcagcugcgcccugggcuucagcggcccccugugccugaccccccuggacaacgccugccugaccaaccccugcagaaacggcggcaccugcgaccugcugacccugaccgaguacaagugcagaugcccccccggcuggagcggcaagagcugccagcaggccgaccccugcgccagcaaccccugcgccaacggcggccagugccugcccuucgaggccagcuacaucugccacugcccccccagcuuccacggccccaccugcagacaggacgugaacgagugcggccagaagcccggccugugcagacacggcggcaccugccacaacgaggugggcagcuacagaugcgugugcagagccacccacaccggccccaacugcgagagacccuacgugcccugcagccccagccccugccagaacggcggcaccugcagacccaccggcgacgugacccacgagugcgccugccugcccggcuucaccggccagaacugcgaggagaacaucgacgacugccccggcaacaacugcaagaacggcggcgccugcguggacggcgugaacaccuacaacugcagaugcccccccgaguggaccggccaguacugcaccgaggacguggacgagugccagcugaugcccaacgccugccagaacggcggcaccugccacaacacccacggcggcuacaacugcgugugcgugaacggcuggaccggcgaggacugcagcgagaacaucgacgacugcgccagcgccgccugcuuccacggcgccaccugccacgacagaguggccagcuucuacugcgagugcccccacggcagaaccggccugcugugccaccugaacgacgccugcaucagcaaccccugcaacgagggcagcaacugcgacaccaaccccgugaacggcaaggccaucugcaccugccccagcggcuacaccggccccgccugcagccaggacguggacgagugcagccugggcgccaaccccugcgagcacgccggcaagugcaucaacacccugggcagcuucgagugccagugccugcagggcuacaccggccccagaugcgagaucgacgugaacgagugcgugagcaaccccugccagaacgacgccaccugccuggaccagaucggcgaguuccagugcaucugcaugcccggcuacgagggcgugcacugcgaggugaacaccgacgagugcgccagcagccccugccugcacaacggcagaugccuggacaagaucaacgaguuccagugcgagugccccaccggcuucaccggccaccugugccaguacgacguggacgagugcgccagcacccccugcaagaacggcgccaagugccuggacggccccaacaccuacaccugcgugugcaccgagggcuacaccggcacccacugcgagguggacaucgacgagugcgaccccgaccccugccacuacggcagcugcaaggacggcguggccaccuucaccugccugugcagacccggcuacaccggccaccacugcgagaccaacaucaacgagugcagcagccagcccugcagacacggcggcaccugccaggacagagacaacgccuaccugugcuucugccugaagggcaccaccggccccaacugcgagaucaaccuggacgacugcgccagcagccccugcgacagcggcaccugccuggacaagaucgacggcuacgagugcgccugcgagcccggcuacaccggcagcaugugcaacaucaacaucgacgagugcgccggcaaccccugccacaacggcggcaccugcgaggacggcaucaacggcuucaccugcagaugccccgagggcuaccacgaccccaccugccugagcgaggugaacgagugcaacagcaaccccugcgugcacggcgccugcagagacagccugaacggcuacaagugcgacugcgaccccggcuggagcggcaccaacugcgacaucaacaacaacgagugcgagagcaaccccugcgugaacggcggcaccugcaaggacaugaccagcggcuacgugugcaccugcagagagggcuucagcggccccaacugccagaccaacaucaacgagugcgccagcaaccccugccugaaccagggcaccugcaucgacgacguggccggcuacaagugcaacugccugcugcccuacaccggcgccaccugcgagguggugcuggcccccugcgcccccagccccugcagaaacggcggcgagugcagacagagcgaggacuacgagagcuucagcugcgugugccccaccggcuggcagggccagaccugcgagguggacaucaacgagugcgugcugagccccugcagacacggcgccagcugccagaacacccacggcggcuacagaugccacugccaggccggcuacagcggcagaaacugcgagaccgacaucgacgacugcagacccaaccccugccacaacggcggcagcugcaccgacggcaucaacaccgccuucugcgacugccugcccggcuucagaggcaccuucugcgaggaggacaucaacgagugcgccagcgaccccugcagaaacggcgccaacugcaccgacugcguggacagcuacaccugcaccugccccgccggcuucagcggcauccacugcgagaacaacacccccgacugcaccgagagcagcugcuucaacggcggcaccugcguggacggcaucaacagcuucaccugccugugcccccccggcuucaccggcagcuacugccagcacgacgugaacgagugcgacagccagcccugccugcacggcggcaccugccaggacggcugcggcagcuacagaugcaccugcccccagggcuacaccggccccaacugccagaaccuggugcacuggugcgacagcagccccugcaagaacggcggcaagugcuggcagacccacacccaguacagaugcgagugccccagcggcuggaccggccuguacugcgacgugcccagcgugagcugcgagguggccgcccagagacagggcguggacguggccagacugugccagcacggcggccugugcguggacgccggcaacacccaccacugcagaugccaggccggcuacaccggcagcuacugcgaggaccugguggacgagugcagccccagccccugccagaacggcgccaccugcaccgacuaccugggcggcuacagcugcaagugcguggccggcuaccacggcgugaacugcagcgaggagaucgacgagugccugagccaccccugccagaacggcggcaccugccuggaccugcccaacaccuacaagugcagcugccccagaggcacccagggcgugcacugcgagaucaacguggacgacugcaacccccccguggaccccgugagcagaagccccaagugcuucaacaacggcaccugcguggaccaggugggcggcuacagcugcaccugcccccccggcuucgugggcgagagaugcgagggcgacgugaacgagugccugagcaaccccugcgacgccagaggcacccagaacugcgugcagagagugaacgacuuccacugcgagugcagagccggccacaccggcagaagaugcgagagcgugaucaacggcugcaagggcaagcccugcaagaacggcggcaccugcgccguggccagcaacaccgccagaggcuucaucugcaagugccccgccggcuucgagggcgccaccugcgagaacgacgccagaaccugcggcagccugagaugccugaacggcggcaccugcaucagcggccccagaagccccaccugccugugccugggccccuucaccggccccgagugccaguuccccgccagcagccccugccugggcggcaaccccugcuacaaccagggcaccugcgagcccaccagcgagagccccuucuacagaugccugugccccgccaaguucaacggccugcugugccacauccuggacuacagcuucggcggcggcgccggcagagacaucccccccccccugaucgaggaggccugcgagcugcccgagugccaggaggacgccggcaacaaggugugcagccugcagugcaacaaccacgccugcggcugggacggcggcgacugcagccugaacuucaacgaccccuggaagaacugcacccagagccugcagugcuggaaguacuucagcgacggccacugcgacagccagugcaacagcgccggcugccuguucgacggcuucgacugccagagagccgagggccagugcaacccccuguacgaccaguacugcaaggaccacuucagcgacggccacugcgaccagggcugcaacagcgccgagugcgagugggacggccuggacugcgccgagcacgugcccgagagacuggccgccggcacccugguggugguggugcugaugccccccgagcagcugagaaacagcagcuuccacuuccugagagagcugagcagagugcugcacaccaacgugguguucaagagagacgcccacggccagcagaugaucuuccccuacuacggcagagaggaggagcugagaaagcaccccaucaagagagccgccgagggcugggccgcccccgacgcccugcugggccaggugaaggccagccugcugcccggcggcagcgagggcggcagaagaagaagagagcuggaccccauggacgugagaggcagcaucguguaccuggagaucgacaacagacagugcgugcaggccagcagccagugcuuccagagcgccaccgacguggccgccuuccugggcgcccuggccagccugggcagccugaacauccccuacaagaucgaggccgugcagagcgagaccguggagccccccccccccgcccagcugcacuucauguacguggccgccgccgccuucgugcugcuguucuucgugggcugcggcgugcugcugagcagaaagagaagaagacagcacggccagcugugguuccccgagggcuucaaggugagcgaggccagcaagaagaagagaagagagccccugggcgaggacagcgugggccugaagccccugaagaacgccagcgacggcgcccugauggacgacaaccagaacgaguggggcgacgaggaccuggagaccaagaaguucagauucgaggagcccguggugcugcccgaccuggacgaccagaccgaccacagacaguggacccagcagcaccuggacgccgccgaccugagaaugagcgccauggcccccacccccccccagggcgagguggacgccgacugcauggacgugaacgugagaggccccgacggcuucaccccccugaugaucgccagcugcagcggcggcggccuggagaccggcaacagcgaggaggaggaggacgcccccgccgugaucagcgacuucaucuaccagggcgccagccugcacaaccagaccgacagaaccggcgagaccgcccugcaccuggccgccagauacagcagaagcgacgccgccaagagacugcuggaggccagcgccgacgccaacauccaggacaacaugggcagaaccccccugcacgccgccgugagcgccgacgcccagggcguguuccagauccugaucagaaacagagccaccgaccuggacgccagaaugcacgacggcaccaccccccugauccuggccgccagacuggccguggagggcaugcuggaggaccugaucaacagccacgccgacgugaacgccguggacgaccugggcaagagcgcccugcacugggccgccgccgugaacaacguggacgccgccguggugcugcugaagaacggcgccaacaaggacaugcagaacaacagagaggagaccccccuguuccuggccgccagagagggcagcuacgagaccgccaaggugcugcuggaccacuucgccaacagagacaucaccgaccacauggacagacugcccagagacaucgcccaggagagaaugcaccacgacaucgugagacugcuggacgaguacaaccuggugagaagcccccagcugcacggcgccccccugggcggcacccccacccugagccccccccugugcagccccaacggcuaccugggcagccugaagcccggcgugcagggcaagaaggugagaaagcccagcagcaagggccuggccugcggcagcaaggaggccaaggaccugaaggccagaagaaagaagagccaggacggcaagggcugccugcuggacagcagcggcaugcugagccccguggacagccuggagagcccccacggcuaccugagcgacguggccagccccccccugcugcccagccccuuccagcagagccccagcgugccccugaaccaccugcccggcaugcccgacacccaccugggcaucggccaccugaacguggccgccaagcccgagauggccgcccugggcggcggcggcagacuggccuucgagaccggcccccccagacugagccaccugcccguggccagcggcaccagcaccgugcugggcagcagcagcggcggcgcccugaacuucaccgugggcggcagcaccagccugaacggccagugcgaguggcugagcagacugcagagcggcauggugcccaaccaguacaacccccugagaggcagcguggcccccggcccccugagcacccaggcccccagccugcagcacggcauggugggcccccugcacagcagccuggccgccagcgcccugagccagaugaugagcuaccagggccugcccagcaccagacuggccacccagccccaccuggugcagacccagcaggugcagccccagaaccugcagaugcagcagcagaaccugcagcccgccaacauccagcagcagcagagccugcagcccccccccccccccccccagccccaccugggcgugagcagcgccgccagcggccaccugggcagaagcuuccugagcggcgagcccagccaggccgacgugcagccccugggccccagcagccuggccgugcacaccauccugccccaggagagccccgcccugcccaccagccugcccagcagccuggugccccccgugaccgccgcccaguuccugaccccccccagccagcacagcuacagcagccccguggacaacacccccagccaccagcugcaggugcccgagcaccccuuccugacccccagccccgagagccccgaccaguggagcagcagcagcccccacagcaacgugagcgacuggagcgagggcgugagcagcccccccaccagcaugcagagccagaucgccagaauccccgaggccuucaaguaa

SEQ ID NO: 20649 - RNA, 7404 nt, Artificial Sequence
  NOTCH2__Homo_sapiens__XP_011539821
augaacaccuaccuggugagcgccgugagccugagaugcgugagcguggagagauacaaggcccugcagugcagagacggcuacgagcccugcgugaacgagggcaugugcgugaccuaccacaacggcaccggcuacugcaagugccccgagggcuuccugggcgaguacugccagcacagagaccccugcgagaagaacagaugccagaacggcggcaccugcguggcccaggccaugcugggcaaggccaccugcagaugcgccagcggcuucaccggcgaggacugccaguacagcaccagccaccccugcuucgugagcagacccugccugaacggcggcaccugccacaugcugagcagagacaccuacgagugcaccugccaggugggcuucaccggcaaggagugccaguggaccgacgccugccugagccaccccugcgccaacggcagcaccugcaccaccguggccaaccaguucagcugcaagugccugaccggcuucaccggccagaagugcgagaccgacgugaacgagugcgacauccccggccacugccagcacggcggcaccugccugaaccugcccggcagcuaccagugccagugcccccagggcuucaccggccaguacugcgacagccuguacgugcccugcgcccccagccccugcgugaacggcggcaccugcagacagaccggcgacuucaccuucgagugcaacugccugcccggcuucgagggcagcaccugcgagagaaacaucgacgacugccccaaccacagaugccagaacggcggcgugugcguggacggcgugaacaccuacaacugcagaugccccccccaguggaccggccaguucugcaccgaggacguggacgagugccugcugcagcccaacgccugccagaacggcggcaccugcgccaacagaaacggcggcuacggcugcgugugcgugaacggcuggagcggcgacgacugcagcgagaacaucgacgacugcgccuucgccagcugcacccccggcagcaccugcaucgacagaguggccagcuucagcugcaugugccccgagggcaaggccggccugcugugccaccuggacgacgccugcaucagcaaccccugccacaagggcgcccugugcgacaccaacccccugaacggccaguacaucugcaccugcccccagggcuacaagggcgccgacugcaccgaggacguggacgagugcgccauggccaacagcaaccccugcgagcacgccggcaagugcgugaacaccgacggcgccuuccacugcgagugccugaagggcuacgccggccccagaugcgagauggacaucaacgagugccacagcgaccccugccagaacgacgccaccugccuggacaagaucggcggcuucaccugccugugcaugcccggcuucaagggcgugcacugcgagcuggagaucaacgagugccagagcaaccccugcgugaacaacggccagugcguggacaaggugaacagauuccagugccugugcccccccggcuucaccggccccgugugccagaucgacaucgacgacugcagcagcacccccugccugaacggcgccaagugcaucgaccaccccaacggcuacgagugccagugcgccaccggcuucaccggcgugcugugcgaggagaacaucgacaacugcgaccccgaccccugccaccacggccagugccaggacggcaucgacagcuacaccugcaucugcaaccccggcuacaugggcgccaucugcagcgaccagaucgacgagugcuacagcagccccugccugaacgacggcagaugcaucgaccuggugaacggcuaccagugcaacugccagcccggcaccagcggcgugaacugcgagaucaacuucgacgacugcgccagcaaccccugcauccacggcaucugcauggacggcaucaacagauacagcugcgugugcagccccggcuucaccggccagagaugcaacaucgacaucgacgagugcgccagcaaccccugcagaaagggcgccaccugcaucaacggcgugaacggcuucagaugcaucugccccgagggcccccaccaccccagcugcuacagccaggugaacgagugccugagcaaccccugcauccacggcaacugcaccggcggccugagcggcuacaagugccugugcgacgccggcugggugggcaucaacugcgagguggacaagaacgagugccugagcaaccccugccagaacggcggcaccugcgacaaccuggugaacggcuacagaugcaccugcaagaagggcuucaagggcuacaacugccaggugaacaucgacgagugcgccagcaaccccugccugaaccagggcaccugcuucgacgacaucagcggcuacaccugccacugcgugcugcccuacaccggcaagaacugccagaccgugcuggcccccugcagccccaaccccugcgagaacgccgccgugugcaaggagagccccaacuucgagagcuacaccugccugugcgcccccggcuggcagggccagagaugcaccaucgacaucgacgagugcaucagcaagcccugcaugaaccacggccugugccacaacacccagggcagcuacaugugcgagugcccccccggcuucagcggcauggacugcgaggaggacaucgacgacugccuggccaaccccugccagaacggcggcagcugcauggacggcgugaacaccuucagcugccugugccugcccggcuucaccggcgacaagugccagaccgacaugaacgagugccugagcgagcccugcaagaacggcggcaccugcagcgacuacgugaacagcuacaccugcaagugccaggccggcuucgacggcgugcacugcgagaacaacaucaacgagugcaccgagagcagcugcuucaacggcggcaccugcguggacggcaucaacagcuucagcugccugugccccgugggcuucaccggcagcuucugccugcacgagaucaacgagugcagcagccaccccugccugaacgagggcaccugcguggacggccugggcaccuacagaugcagcugcccccugggcuacaccggcaagaacugccagacccuggugaaccugugcagcagaagccccugcaagaacaagggcaccugcgugcagaagaaggccgagagccagugccugugccccagcggcugggccggcgccuacugcgacgugcccaacgugagcugcgacaucgccgccagcagaagaggcgugcugguggagcaccugugccagcacagcggcgugugcaucaacgccggcaacacccacuacugccagugcccccugggcuacaccggcagcuacugcgaggagcagcuggacgagugcgccagcaaccccugccagcacggcgccaccugcagcgacuucaucggcggcuacagaugcgagugcgugcccggcuaccagggcgugaacugcgaguacgagguggacgagugccagaaccagcccugccagaacggcggcaccugcaucgaccuggugaaccacuucaagugcagcugcccccccggcaccagaggccugcugugcgaggagaacaucgacgacugcgccagaggcccccacugccugaacggcggccagugcauggacagaaucggcggcuacagcugcagaugccugcccggcuucgccggcgagagaugcgagggcgacaucaacgagugccugagcaaccccugcagcagcgagggcagccuggacugcauccagcugaccaacgacuaccugugcgugugcagaagcgccuucaccggcagacacugcgagaccuucguggacgugugcccccagaugcccugccugaacggcggcaccugcgccguggccagcaacaugcccgacggcuucaucugcagaugcccccccggcuucagcggcgccagaugccagagcagcugcggccaggugaagugcagaaagggcgagcagugcgugcacaccgccagcggccccagaugcuucugccccagccccagagacugcgagagcggcugcgccagcagccccugccagcacggcggcagcugccacccccagagacagccccccuacuacagcugccagugcgccccccccuucagcggcagcagaugcgagcuguacaccgccccccccagcaccccccccgccaccugccugagccaguacugcgccgacaaggccagagacggcgugugcgacgaggccugcaacagccacgccugccagugggacggcggcgacugcagccugaccauggagaaccccugggccaacugcagcagcccccugcccugcugggacuacaucaacaaccagugcgacgagcugugcaacaccguggagugccuguucgacaacuucgagugccagggcaacagcaagaccugcaaguacgacaaguacugcgccgaccacuucaaggacaaccacugcgaccagggcugcaacagcgaggagugcggcugggacggccuggacugcgccgccgaccagcccgagaaccuggccgagggcacccuggugaucguggugcugaugccccccgagcagcugcugcaggacgccagaagcuuccugagagcccugggcacccugcugcacaccaaccugagaaucaagagagacagccagggcgagcugaugguguaccccuacuacggcgagaagagcgccgccaugaagaagcagagaaugaccagaagaagccugcccggcgagcaggagcaggagguggccggcagcaagguguuccuggagaucgacaacagacagugcgugcaggacagcgaccacugcuucaagaacaccgacgccgccgccgcccugcuggccagccacgccauccagggcacccugagcuacccccuggugagcguggugagcgagagccugacccccgagagaacccagcugcuguaccugcuggccguggccguggugaucauccuguucaucauccugcugggcgugaucauggccaagagaaagagaaagcacggcagccuguggcugcccgagggcuucacccugagaagagacgccagcaaccacaagagaagagagcccgugggccaggacgccgugggccugaagaaccugagcgugcaggugagcgaggccaaccugaucggcaccggcaccagcgagcacuggguggacgacgagggcccccagcccaagaaggugaaggccgaggacgaggcccugcugagcgaggaggacgaccccaucgacagaagacccuggacccagcagcaccuggaggccgccgacaucagaagaacccccagccuggcccugacccccccccaggccgagcaggagguggacgugcuggacgugaacgugagaggccccgacggcugcaccccccugaugcuggccagccugagaggcggcagcagcgaccugagcgacgaggacgaggacgccgaggacagcagcgccaacaucaucaccgaccugguguaccagggcgccagccugcaggcccagaccgacagaaccggcgagauggcccugcaccuggccgccagauacagcagagccgacgccgccaagagacugcuggacgccggcgccgacgccaacgcccaggacaacaugggcagaugcccccugcacgccgccguggccgccgacgcccagggcguguuccagauccugaucagaaacagagugaccgaccuggacgccagaaugaacgacggcaccaccccccugauccuggccgccagacuggccguggagggcaugguggccgagcugaucaacugccaggccgacgugaacgccguggacgaccacggcaagagcgcccugcacugggccgccgccgugaacaacguggaggccacccugcugcugcugaagaacggcgccaacagagacaugcaggacaacaaggaggagaccccccuguuccuggccgccagagagggcagcuacgaggccgccaagauccugcuggaccacuucgccaacagagacaucaccgaccacauggacagacugcccagagacguggccagagacagaaugcaccacgacaucgugagacugcuggacgaguacaacgugacccccagcccccccggcaccgugcugaccagcgcccugagccccgugaucugcggccccaacagaagcuuccugagccugaagcacacccccaugggcaagaagagcagaagacccagcgccaagagcaccaugcccaccagccugcccaaccuggccaaggaggccaaggacgccaagggcagcagaagaaagaagagccugagcgagaaggugcagcugagcgagagcagcgugacccugagccccguggacagccuggagagcccccacaccuacgugagcgacaccaccagcagccccaugaucaccagccccggcauccugcaggccagccccaaccccaugcuggccaccgccgccccccccgcccccgugcacgcccagcacgcccugagcuucagcaaccugcacgagaugcagccccuggcccacggcgccagcaccgugcugcccagcgugagccagcugcugagccaccaccacaucgugagccccggcagcggcagcgccggcagccugagcagacugcaccccgugcccgugcccgccgacuggaugaacagaauggaggugaacgagacccaguacaacgagauguucggcauggugcuggcccccgccgagggcacccaccccggcaucgccccccagagcagaccccccgagggcaagcacaucaccacccccagagagccccugccccccaucgugaccuuccagcugauccccaagggcagcaucgcccagcccgccggcgccccccagccccagagcaccugcccccccgccguggccggcccccugcccaccauguaccagauccccgagauggccagacugcccagcguggccuuccccaccgccaugaugccccagcaggacggccagguggcccagaccauccugcccgccuaccaccccuuccccgccagcgugggcaaguaccccaccccccccagccagcacagcuacgccagcagcaacgccgccgagagaacccccagccacagcggccaccugcagggcgagcaccccuaccugacccccagccccgagagccccgaccaguggagcagcagcagcccccacagcgccagcgacuggagcgacgugaccaccagccccacccccggcggcgccggcggcggccagagaggccccggcacccacaugagcgagcccccccacaacaacaugcagguguacgccuaa

SEQ ID NO: 20650 - RNA, 6966 nt, Artificial Sequence
  NOTCH3__Homo_sapiens__NP_000426
augggccccggcgccagaggcagaagaagaagaagaagacccaugagccccccccccccccccccccccgugagagcccugccccugcugcugcugcuggccggccccggcgccgccgccccccccugccuggacggcagccccugcgccaacggcggcagaugcacccagcugcccagcagagaggccgccugccugugcccccccggcugggugggcgagagaugccagcuggaggaccccugccacagcggccccugcgccggcagaggcgugugccagagcagcgugguggccggcaccgccagauucagcugcagaugccccagaggcuucagaggccccgacugcagccugcccgaccccugccugagcagccccugcgcccacggcgccagaugcagcgugggccccgacggcagauuccugugcagcugcccccccggcuaccagggcagaagcugcagaagcgacguggacgagugcagagugggcgagcccugcagacacggcggcaccugccugaacacccccggcagcuucagaugccagugccccgccggcuacaccggcccccugugcgagaaccccgccgugcccugcgcccccagccccugcagaaacggcggcaccugcagacagagcggcgaccugaccuacgacugcgccugccugcccggcuucgagggccagaacugcgaggugaacguggacgacugccccggccacagaugccugaacggcggcaccugcguggacggcgugaacaccuacaacugccagugcccccccgaguggaccggccaguucugcaccgaggacguggacgagugccagcugcagcccaacgccugccacaacggcggcaccugcuucaacacccugggcggccacagcugcgugugcgugaacggcuggaccggcgagagcugcagccagaacaucgacgacugcgccaccgccgugugcuuccacggcgccaccugccacgacagaguggccagcuucuacugcgccugccccaugggcaagaccggccugcugugccaccuggacgacgccugcgugagcaaccccugccacgaggacgccaucugcgacaccaaccccgugaacggcagagccaucugcaccugcccccccggcuucaccggcggcgccugcgaccaggacguggacgagugcagcaucggcgccaaccccugcgagcaccugggcagaugcgugaacacccagggcagcuuccugugccagugcggcagaggcuacaccggccccagaugcgagaccgacgugaacgagugccugagcggccccugcagaaaccaggccaccugccuggacagaaucggccaguucaccugcaucugcauggccggcuucaccggcaccuacugcgagguggacaucgacgagugccagagcagccccugcgugaacggcggcgugugcaaggacagagugaacggcuucagcugcaccugccccagcggcuucagcggcagcaccugccagcuggacguggacgagugcgccagcacccccugcagaaacggcgccaagugcguggaccagcccgacggcuacgagugcagaugcgccgagggcuucgagggcacccugugcgacagaaacguggacgacugcagccccgaccccugccaccacggcagaugcguggacggcaucgccagcuucagcugcgccugcgcccccggcuacaccggcaccagaugcgagagccagguggacgagugcagaagccagcccugcagacacggcggcaagugccuggaccugguggacaaguaccugugcagaugccccagcggcaccaccggcgugaacugcgaggugaacaucgacgacugcgccagcaaccccugcaccuucggcgugugcagagacggcaucaacagauacgacugcgugugccagcccggcuucaccggcccccugugcaacguggagaucaacgagugcgccagcagccccugcggcgagggcggcagcugcguggacggcgagaacggcuucagaugccugugcccccccggcagccugcccccccugugccugccccccagccaccccugcgcccacgagcccugcagccacggcaucugcuacgacgcccccggcggcuucagaugcgugugcgagcccggcuggagcggccccagaugcagccagagccuggccagagacgccugcgagagccagcccugcagagccggcggcaccugcagcagcgacggcaugggcuuccacugcaccugcccccccggcgugcagggcagacagugcgagcugcugagccccugcacccccaaccccugcgagcacggcggcagaugcgagagcgcccccggccagcugcccgugugcagcugcccccagggcuggcagggccccagaugccagcaggacguggacgagugcgccggccccgcccccugcggcccccacggcaucugcaccaaccuggccggcagcuucagcugcaccugccacggcggcuacaccggccccagcugcgaccaggacaucaacgacugcgaccccaaccccugccugaacggcggcagcugccaggacggcgugggcagcuucagcugcagcugccugcccggcuucgccggccccagaugcgccagagacguggacgagugccugagcaaccccugcggccccggcaccugcaccgaccacguggccagcuucaccugcaccugcccccccggcuacggcggcuuccacugcgagcaggaccugcccgacugcagccccagcagcugcuucaacggcggcaccugcguggacggcgugaacagcuucagcugccugugcagacccggcuacaccggcgcccacugccagcacgaggccgaccccugccugagcagacccugccugcacggcggcgugugcagcgccgcccaccccggcuucagaugcaccugccuggagagcuucaccggcccccagugccagacccugguggacuggugcagcagacagcccugccagaacggcggcagaugcgugcagaccggcgccuacugccugugcccccccggcuggagcggcagacugugcgacaucagaagccugcccugcagagaggccgccgcccagaucggcgugagacuggagcagcugugccaggccggcggccagugcguggacgaggacagcagccacuacugcgugugccccgagggcagaaccggcagccacugcgagcaggagguggaccccugccuggcccagcccugccagcacggcggcaccugcagaggcuacaugggcggcuacaugugcgagugccugcccggcuacaacggcgacaacugcgaggacgacguggacgagugcgccagccagcccugccagcacggcggcagcugcaucgaccugguggccagauaccugugcagcugcccccccggcacccugggcgugcugugcgagaucaacgaggacgacugcggccccggccccccccuggacagcggccccagaugccugcacaacggcaccugcguggaccuggugggcggcuucagaugcaccugcccccccggcuacaccggccugagaugcgaggccgacaucaacgagugcagaagcggcgccugccacgccgcccacaccagagacugccugcaggaccccggcggcggcuucagaugccugugccacgccggcuucagcggccccagaugccagaccgugcugagccccugcgagagccagcccugccagcacggcggccagugcagacccagccccggccccggcggcggccugaccuucaccugccacugcgcccagcccuucuggggccccagaugcgagagaguggccagaagcugcagagagcugcagugccccgugggcgugcccugccagcagacccccagaggccccagaugcgccugcccccccggccugagcggccccagcugcagaagcuuccccggcagcccccccggcgccagcaacgccagcugcgccgccgcccccugccugcacggcggcagcugcagacccgccccccuggcccccuucuucagaugcgccugcgcccagggcuggaccggccccagaugcgaggcccccgccgccgcccccgaggugagcgaggagcccagaugccccagagccgccugccaggccaagagaggcgaccagagaugcgacagagagugcaacagccccggcugcggcugggacggcggcgacugcagccugagcgugggcgaccccuggagacagugcgaggcccugcagugcuggagacuguucaacaacagcagaugcgaccccgccugcagcagccccgccugccuguacgacaacuucgacugccacgccggcggcagagagagaaccugcaaccccguguacgagaaguacugcgccgaccacuucgccgacggcagaugcgaccagggcugcaacaccgaggagugcggcugggacggccuggacugcgccagcgaggugcccgcccugcuggccagaggcgugcuggugcugaccgugcugcugccccccgaggagcugcugagaagcagcgccgacuuccugcagagacugagcgccauccugagaaccagccugagauucagacuggacgcccacggccaggccaugguguuccccuaccacagacccagccccggcagcgagcccagagccagaagagagcuggcccccgaggugaucggcagcguggugaugcuggagaucgacaacagacugugccugcagagccccgagaacgaccacugcuuccccgacgcccagagcgccgccgacuaccugggcgcccugagcgccguggagagacuggacuuccccuacccccugagagacgugagaggcgagccccuggagccccccgagcccagcgugccccugcugccccugcugguggccggcgccgugcugcugcuggugauccuggugcugggcgugaugguggccagaagaaagagagagcacagcacccugugguuccccgagggcuucagccugcacaaggacguggccagcggccacaagggcagaagagagcccgugggccaggacgcccugggcaugaagaacauggccaagggcgagagccugaugggcgagguggccaccgacuggauggacaccgagugccccgaggccaagagacugaagguggaggagcccggcaugggcgccgaggaggccguggacugcagacaguggacccagcaccaccugguggccgccgacaucagaguggcccccgccauggcccugacccccccccagggcgacgccgacgccgacggcauggacgugaacgugagaggccccgacggcuucaccccccugaugcuggccagcuucugcggcggcgcccuggagcccaugcccaccgaggaggacgaggccgacgacaccagcgccagcaucaucagcgaccugaucugccagggcgcccagcugggcgccagaaccgacagaaccggcgagaccgcccugcaccuggccgccagauacgccagagccgacgccgccaagagacugcuggacgccggcgccgacaccaacgcccaggaccacagcggcagaaccccccugcacaccgccgugaccgccgacgcccagggcguguuccagauccugaucagaaacagaagcaccgaccuggacgccagaauggccgacggcagcaccgcccugauccuggccgccagacuggccguggagggcaugguggaggagcugaucgccagccacgccgacgugaacgccguggacgagcugggcaagagcgcccugcacugggccgccgccgugaacaacguggaggccacccuggcccugcugaagaacggcgccaacaaggacaugcaggacagcaaggaggagaccccccuguuccuggccgccagagagggcagcuacgaggccgccaagcugcugcuggaccacuucgccaacagagagaucaccgaccaccuggacagacugcccagagacguggcccaggagagacugcaccaggacaucgugagacugcuggaccagcccagcggccccagaagcccccccggcccccacggccugggcccccugcugugcccccccggcgccuuccugcccggccugaaggccgcccagagcggcagcaagaagagcagaagaccccccggcaaggccggccugggcccccagggccccagaggcagaggcaagaagcugacccuggccugccccggcccccuggccgacagcagcgugacccugagccccguggacagccuggacagccccagacccuucggcggcccccccgccagccccggcggcuucccccuggagggccccuacgccgccgccaccgccaccgccgugagccuggcccagcugggcggccccggcagagccggccugggcagacagccccccggcggcugcgugcugagccugggccugcugaaccccguggccgugccccuggacugggccagacugcccccccccgccccccccggccccagcuuccugcugccccuggcccccggcccccagcugcugaaccccggcacccccgugagcccccaggagagacccccccccuaccuggccgugcccggccacggcgaggaguaccccgccgccggcgcccacagcagcccccccaaggccagauuccugagagugcccagcgagcaccccuaccugacccccagccccgagagccccgagcacugggccagccccagcccccccagccugagcgacuggagcgagagcacccccagccccgccaccgccaccggcgccauggccaccaccaccggcgcccugcccgcccagccccugccccugagcgugcccagcagccuggcccaggcccagacccagcugggcccccagcccgaggugacccccaagagacaggugcuggccuaa

SEQ ID NO: 20651 - RNA, 6012 nt, Artificial Sequence
  NOTCH4__Homo_sapiens__NP_004548
augcagccccccagccugcugcugcugcugcugcugcugcugcugcugugcgugagcguggugagacccagaggccugcugugcggcagcuuccccgagcccugcgccaacggcggcaccugccugagccugagccugggccagggcaccugccagugcgcccccggcuuccugggcgagaccugccaguuccccgaccccugccagaacgcccagcugugccagaacggcggcagcugccaggcccugcugcccgccccccugggccugcccagcagccccagcccccugacccccagcuuccugugcaccugccugcccggcuucaccggcgagagaugccaggccaagcuggaggaccccugcccccccagcuucugcagcaagagaggcagaugccacauccaggccagcggcagaccccagugcagcugcaugcccggcuggaccggcgagcagugccagcugagagacuucugcagcgccaaccccugcgugaacggcggcgugugccuggccaccuacccccagauccagugccacugcccccccggcuucgagggccacgccugcgagagagacgugaacgagugcuuccaggaccccggccccugccccaagggcaccagcugccacaacacccugggcagcuuccagugccugugccccgugggccaggagggccccagaugcgagcugagagccggccccugcccccccagaggcugcagcaacggcggcaccugccagcugaugcccgagaaggacagcaccuuccaccugugccugugcccccccggcuucaucggccccgacugcgaggugaaccccgacaacugcgugagccaccagugccagaacggcggcaccugccaggacggccuggacaccuacaccugccugugccccgagaccuggaccggcugggacugcagcgaggacguggacgagugcgagacccagggccccccccacugcagaaacggcggcaccugccagaacagcgccggcagcuuccacugcgugugcgugagcggcuggggcggcaccagcugcgaggagaaccuggacgacugcaucgccgccaccugcgcccccggcagcaccugcaucgacagagugggcagcuucagcugccugugcccccccggcagaaccggccugcugugccaccuggaggacaugugccugagccagcccugccacggcgacgcccagugcagcaccaacccccugaccggcagcacccugugccugugccagcccggcuacagcggccccaccugccaccaggaccuggacgagugccugauggcccagcagggccccagccccugcgagcacggcggcagcugccugaacacccccggcagcuucaacugccugugcccccccggcuacaccggcagcagaugcgaggccgaccacaacgagugccugagccagcccugccaccccggcagcaccugccuggaccugcuggccaccuuccacugccugugcccccccggccuggagggccagcugugcgagguggagaccaacgagugcgccagcgcccccugccugaaccacgccgacugccacgaccugcugaacggcuuccagugcaucugccugcccggcuucagcggcaccagaugcgaggaggacaucgacgagugcagaagcagccccugcgccaacggcggccagugccaggaccagcccggcgccuuccacugcaagugccugcccggcuucgagggccccagaugccagaccgagguggacgagugccugagcgaccccugccccgugggcgccagcugccuggaccugcccggcgccuucuucugccugugccccagcggcuucaccggccagcugugcgaggugccccugugcgcccccaaccugugccagcccaagcagaucugcaaggaccagaaggacaaggccaacugccugugccccgacggcagccccggcugcgccccccccgaggacaacugcaccugccaccacggccacugccagagaagcagcugcgugugcgacgugggcuggaccggccccgagugcgaggccgagcugggcggcugcaucagcgcccccugcgcccacggcggcaccugcuacccccagcccagcggcuacaacugcaccugccccaccggcuacaccggccccaccugcagcgaggagaugaccgccugccacagcggccccugccugaacggcggcagcugcaaccccagccccggcggcuacuacugcaccugcccccccagccacaccggcccccagugccagaccagcaccgacuacugcgugagcgcccccugcuucaacggcggcaccugcgugaacagacccggcaccuucagcugccugugcgccaugggcuuccagggccccagaugcgagggcaagcugagacccagcugcgccgacagccccugcagaaacagagccaccugccaggacagcccccagggccccagaugccugugccccaccggcuacaccggcggcagcugccagacccugauggaccugugcgcccagaagcccugccccagaaacagccacugccugcagaccggccccagcuuccacugccugugccugcagggcuggaccggcccccugugcaaccugccccugagcagcugccagaaggccgcccugagccagggcaucgacgugagcagccugugccacaacggcggccugugcguggacagcggccccagcuacuucugccacugcccccccggcuuccagggcagccugugccaggaccacgugaaccccugcgagagcagacccugccagaacggcgccaccugcauggcccagcccagcggcuaccugugccagugcgcccccggcuacgacggccagaacugcagcaaggagcuggacgccugccagagccagcccugccacaaccacggcaccugcacccccaagcccggcggcuuccacugcgccugcccccccggcuucgugggccugagaugcgagggcgacguggacgagugccuggaccagcccugccaccccaccggcaccgccgccugccacagccuggccaacgccuucuacugccagugccugcccggccacaccggccaguggugcgagguggagaucgaccccugccacagccagcccugcuuccacggcggcaccugcgaggccaccgccggcagcccccugggcuucaucugccacugccccaagggcuucgagggccccaccugcagccacagagcccccagcugcggcuuccaccacugccaccacggcggccugugccugcccagccccaagcccggcuucccccccagaugcgccugccugagcggcuacggcggccccgacugccugaccccccccgcccccaagggcugcggcccccccagccccugccuguacaacggcagcugcagcgagaccaccggccugggcggccccggcuucagaugcagcugcccccacagcagccccggccccagaugccagaagcccggcgccaagggcugcgagggcagaagcggcgacggcgccugcgacgccggcugcagcggccccggcggcaacugggacggcggcgacugcagccugggcgugcccgaccccuggaagggcugccccagccacagcagaugcuggcugcuguucagagacggccagugccacccccagugcgacagcgaggagugccuguucgacggcuacgacugcgagaccccccccgccugcacccccgccuacgaccaguacugccacgaccacuuccacaacggccacugcgagaagggcugcaacaccgccgagugcggcugggacggcggcgacugcagacccgaggacggcgaccccgaguggggccccagccuggcccugcugguggugcugagcccccccgcccuggaccagcagcuguucgcccuggccagagugcugagccugacccugagagugggccugugggugagaaaggacagagacggcagagacaugguguaccccuaccccggcgccagagccgaggagaagcugggcggcaccagagaccccaccuaccaggagagagccgccccccagacccagccccugggcaaggagaccgacagccugagcgccggcuucgugguggugaugggcguggaccugagcagaugcggccccgaccaccccgccagcagaugccccugggaccccggccugcugcugagauuccuggccgccauggccgccgugggcgcccuggagccccugcugcccggcccccugcuggccgugcacccccacgccggcaccgccccccccgccaaccagcugcccuggcccgugcugugcagccccguggccggcgugauccugcuggcccugggcgcccugcuggugcugcagcugaucagaagaagaagaagagagcacggcgcccuguggcugccccccggcuucaccagaagacccagaacccagagcgccccccacagaagaagacccccccugggcgaggacagcaucggccugaaggcccugaagcccaaggccgagguggacgaggacggcguggugaugugcagcggccccgaggagggcgaggaggugggccaggccgaggagaccggcccccccagcaccugccagcuguggagccugagcggcggcugcggcgcccugccccaggccgccaugcugacccccccccaggagagcgagauggaggcccccgaccuggacaccagaggccccgacggcgugaccccccugaugagcgccgugugcugcggcgaggugcagagcggcaccuuccagggcgccuggcugggcugccccgagcccugggagccccugcuggacggcggcgccugcccccaggcccacaccgugggcaccggcgagaccccccugcaccuggccgccagauucagcagacccaccgccgccagaagacugcuggaggccggcgccaaccccaaccagcccgacagagccggcagaaccccccugcacgccgccguggccgccgacgccagagaggugugccagcugcugcugagaagcagacagaccgccguggacgccagaaccgaggacggcaccaccccccugaugcuggccgccagacuggccguggaggaccugguggaggagcugaucgccgcccaggccgacgugggcgccagagacaaguggggcaagaccgcccugcacugggccgccgccgugaacaacgccagagccgccagaagccugcugcaggccggcgccgacaaggacgcccaggacaacagagagcagaccccccuguuccuggccgccagagagggcgccguggagguggcccagcugcugcugggccugggcgccgccagagagcugagagaccaggccggccuggcccccgccgacguggcccaccagagaaaccacugggaccugcugacccugcuggagggcgccggcccccccgaggccagacacaaggccacccccggcagagaggccggccccuuccccagagccagaaccgugagcgugagcgugcccccccacggcggcggcgcccugcccagaugcagaacccugagcgccggcgccggccccagaggcggcggcgccugccugcaggccagaaccuggagcguggaccuggccgccagaggcggcggcgccuacagccacugcagaagccugagcggcgugggcgccggcggcggccccacccccagaggcagaagauucagcgccggcaugagaggccccagacccaaccccgccaucaugagaggcagauacggcguggccgccggcagaggcggcagagugagcaccgacgacuggcccugcgacuggguggcccugggcgccugcggcagcgccagcaacauccccauccccccccccugccugacccccagccccgagagaggcagcccccagcuggacugcggcccccccgcccugcaggagaugcccaucaaccagggcggcgagggcaagaaguaa

SEQ ID NO: 20652 - RNA, 1491 nt, Artificial Sequence
  NOTUM__Homo_sapiens__NP_848588
augggcagaggcgugagagugcugcugcugcugagccugcugcacugcgccggcggcagcgagggcagaaagaccuggagaagaagaggccagcagcccccccccccccccagaaccgaggccgcccccgccgccggccagcccguggagagcuucccccuggacuucaccgccguggagggcaacauggacagcuucauggcccaggugaagagccuggcccagagccuguaccccugcagcgcccagcagcugaacgaggaccugagacugcaccugcugcugaacaccagcgugaccugcaacgacggcagccccgccggcuacuaccugaaggagagcagaggcagcagaagauggcugcuguuccuggagggcggcugguacugcuucaacagagagaacugcgacagcagauacgacaccaugagaagacugaugagcagcagagacuggcccagaaccagaaccggcaccggcauccugagcagccagcccgaggagaaccccuacugguggaacgccaacaugguguucauccccuacugcagcagcgacguguggagcggcgccagcagcaagagcgagaagaacgaguacgccuucaugggcgcccugaucauccaggagguggugagagagcugcugggcagaggccugagcggcgccaaggugcugcugcuggccggcagcagcgccggcggcaccggcgugcugcugaacguggacagaguggccgagcagcuggagaagcugggcuaccccgccauccaggugagaggccuggccgacagcggcugguuccuggacaacaagcaguacagacacaccgacugcguggacaccaucaccugcgcccccaccgaggccaucagaagaggcaucagauacuggaacggcguggugcccgagagaugcagaagacaguuccaggagggcgaggaguggaacugcuucuucggcuacaagguguaccccacccugagaugccccguguucguggugcaguggcuguucgacgaggcccagcugaccguggacaacgugcaccugaccggccagcccgugcaggagggccugagacuguacauccagaaccugggcagagagcugagacacacccugaaggacgugcccgccagcuucgcccccgccugccugagccacgagaucaucaucagaagccacuggaccgacgugcaggugaagggcaccagccugcccagagcccugcacugcugggacagaagccugcacgacagccacaaggccagcaagaccccccugaagggcugccccgugcaccugguggacagcugccccuggccccacugcaaccccagcugccccaccgugagagaccaguucaccggccaggagaugaacguggcccaguuccugaugcacaugggcuucgacaugcagaccguggcccagccccagggccuggagcccagcgagcugcugggcaugcugagcaacggcagcuaa

SEQ ID NO: 20653 - RNA, 1524 nt, Artificial Sequence
  NOVA1__Homo_sapiens__NP_002506
augauggccgccgcccccauccagcagaacggcacccacaccggcgugcccaucgaccuggacccccccgacagcagaaagagaccccuggaggccccccccgaggccggcagcaccaagagaaccaacaccggcgaggacggccaguacuuccugaaggugcugauccccagcuacgccgccggcagcaucaucggcaagggcggccagaccaucgugcagcugcagaaggagaccggcgccaccaucaagcugagcaagagcaaggacuucuaccccggcaccaccgagagagugugccugauccagggcaccguggaggcccugaacgccgugcacggcuucaucgccgagaagaucagagagaugccccagaacguggccaagaccgagcccgugagcauccugcagccccagaccaccgugaaccccgacagaaucaagcagacccugcccagcagccccaccaccaccaagagcagccccagcgaccccaugaccaccagcagagccaaccaggugaagaucaucgugcccaacagcaccgccggccugaucaucggcaagggcggcgccaccgugaaggccgugauggagcagagcggcgccugggugcagcugagccagaagcccgacggcaucaaccugcaggagagaguggugaccgugagcggcgagcccgagcagaacagaaaggccguggagcugaucauccagaagauccaggaggacccccagagcggcagcugccugaacaucagcuacgccaacgugaccggccccguggccaacagcaaccccaccggcagccccuacgccaacaccgccgaggugcugcccaccgccgccgccgccgccggccugcugggccacgccaaccuggccggcguggccgccuuccccgccgugcugagcggcuucaccggcaacgaccugguggccaucaccagcgcccugaacacccuggccagcuacggcuacaaccugaacacccugggccugggccugagccaggccgccgccaccggcgcccuggccgccgccgccgccagcgccaaccccgccgccgccgccgccaaccugcuggccaccuacgccagcgaggccagcgccagcggcagcaccgccggcggcaccgccggcaccuucgcccugggcagccuggccgccgccaccgccgccaccaacggcuacuucggcgccgccagcccccuggccgccagcgccauccugggcaccgagaagagcaccgacggcagcaaggacgugguggagaucgccgugcccgagaaccuggugggcgccauccugggcaagggcggcaagacccugguggaguaccaggagcugaccggcgccagaauccagaucagcaagaagggcgaguucgugcccggcaccagaaacagaaaggugaccaucaccggcacccccgccgccacccaggccgcccaguaccugaucacccagagaaucaccuacgagcagggcgugagagccgccaacccccagaaggugggcuaa

SEQ ID NO: 20654 - RNA, 1479 nt, Artificial Sequence
  NOVA2__Homo_sapiens__NP_002507
auggagcccgaggcccccgacagcagaaagagaccccuggagaccccccccgagguggugugcaccaagagaagcaacaccggcgaggagggcgaguacuuccugaaggugcugauccccagcuacgccgccggcagcaucaucggcaagggcggccagaccaucgugcagcugcagaaggagaccggcgccaccaucaagcugagcaagagcaaggacuucuaccccggcaccaccgagagagugugccuggugcagggcaccgccgaggcccugaacgccgugcacagcuucaucgccgagaaggugagagagaucccccaggccaugaccaagcccgagguggugaacauccugcagccccagaccaccaugaaccccgacagagccaagcaggccaagcugaucgugcccaacagcaccgccggccugaucaucggcaagggcggcgccaccgugaaggccgugauggagcagagcggcgccugggugcagcugagccagaagcccgagggcaucaaccugcaggagagaguggugaccgugagcggcgagcccgagcaggugcacaaggccgugagcgccaucgugcagaaggugcaggaggacccccagagcagcagcugccugaacaucagcuacgccaacguggccggccccguggccaacagcaaccccaccggcagccccuacgccagccccgccgacgugcugcccgccgccgccgccgccagcgccgccgccgccagcggccugcugggccccgccggccuggccggcgugggcgccuuccccgccgcccugcccgccuucagcggcaccgaccugcuggccaucagcaccgcccugaacacccuggccagcuacggcuacaacaccaacagccugggccugggccugaacagcgccgccgccagcggcgugcuggccgccguggccgccggcgccaaccccgccgccgccgccgccgccaaccugcuggccagcuacgccggcgaggccggcgccggccccgccggcggcgccgcccccccccccccccccccccccggcgcccugggcagcuucgcccuggccgccgccgccaacggcuaccugggcgccggcgccggcggcggcgccggcggcggcggcggcccccugguggccgccgccgccgccgccggcgccgccggcggcuuccugaccgccgagaagcuggccgccgagagcgccaaggagcugguggagaucgccgugcccgagaaccuggugggcgccauccugggcaagggcggcaagacccugguggaguaccaggagcugaccggcgccagaauccagaucagcaagaagggcgaguuccugcccggcaccagaaacagaagagugaccaucaccggcagccccgccgccacccaggccgcccaguaccugaucagccagagagugaccuacgagcagggcgugagagccagcaacccccagaaggugggcuaa

SEQ ID NO: 20655 - RNA, 1074 nt, Artificial Sequence
  NOV__Homo_sapiens__NP_002505
augcagagcgugcagagcaccagcuucugccugagaaagcagugccugugccugaccuuccugcugcugcaccugcugggccagguggccgccacccagagaugccccccccagugccccggcagaugccccgccaccccccccaccugcgcccccggcgugagagccgugcuggacggcugcagcugcugccuggugugcgccagacagagaggcgagagcugcagcgaccuggagcccugcgacgagagcagcggccuguacugcgacagaagcgccgaccccagcaaccagaccggcaucugcaccgccguggagggcgacaacugcguguucgacggcgugaucuacagaagcggcgagaaguuccagcccagcugcaaguuccagugcaccugcagagacggccagaucggcugcgugcccagaugccagcuggacgugcugcugcccgagcccaacugccccgcccccagaaagguggaggugcccggcgagugcugcgagaaguggaucugcggccccgacgaggaggacagccugggcggccugacccuggccgccuacagacccgaggccacccugggcguggaggugagcgacagcagcgugaacugcaucgagcagaccaccgaguggaccgccugcagcaagagcugcggcaugggcuucagcaccagagugaccaacagaaacagacagugcgagaugcugaagcagaccagacugugcauggugagacccugcgagcaggagcccgagcagcccaccgacaagaagggcaagaagugccugagaaccaagaagagccugaaggccauccaccugcaguucaagaacugcaccagccugcacaccuacaagcccagauucugcggcgugugcagcgacggcagaugcugcaccccccacaacaccaagaccauccaggccgaguuccagugcagccccggccagaucgugaagaagcccgugauggugaucggcaccugcaccugccacaccaacugccccaagaacaacgaggccuuccugcaggagcuggagcugaagaccaccagaggcaagauguaa

SEQ ID NO: 20656 - RNA, 1584 nt, Artificial Sequence
  NOX1__Homo_sapiens__NP_001258744
augggcaacuggguggugaaccacugguucagcgugcuguuccuggugguguggcugggccugaacguguuccuguucguggacgccuuccugaaguacgagaaggccgacaaguacuacuacaccagaaagauccugggcuucugcagcagaacccugagaaagcagcuggaccacaaccugaccuuccacaagcugguggccuacaugaucugccugcacaccgccauccacaucaucgcccaccuguucaacuucgacugcuacagcagaagcagacaggccaccgacggcagccuggccagcauccugagcagccugagccacgacgagaagaagggcggcagcuggcugaaccccauccagagcagaaacaccaccguggaguacgugaccuucaccagcaucgccggccugaccggcgugaucaugaccaucgcccugauccugauggugaccagcgccaccgaguucaucagaagaagcuacuucgagguguucugguacacccaccaccuguucaucuucuacauccugggccugggcauccacggcaucggcggcaucgugagaggccagaccgaggagagcaugaacgagagccaccccagaaagugcgccgagagcuucgagaugugggacgacagagacagccacugcagaagacccaaguucgagggccacccccccgagagcuggaaguggauccuggcccccgugauccuguacaucugcgagagaauccugagauucuacagaagccagcagaagguggugaucaccaagguggugaugcaccccagcaaggugcuggagcugcagaugaacaagagaggcuucagcauggaggugggccaguacaucuucgugaacugccccagcaucagccugcuggaguggcaccccuucacccugaccagcgcccccgaggaggacuucuucagcauccacaucagagccgccggcgacuggaccgagaaccugaucagagccuucgagcagcaguacagccccauccccagaaucgagguggacggccccuucggcaccgccagcgaggacguguuccaguacgagguggccgugcuggugggcgccggcaucggcgugacccccuucgccagcauccugaagagcaucugguacaaguuccagugcgccgaccacaaccugaagaccaagaagaucuacuucuacuggaucugcagagagaccggcgccuucagcugguucaacaaccugcugaccagccuggagcaggagauggaggagcugggcaaggugggcuuccugaacuacagacuguuccugaccggcugggacagcaacaucgugggccacgccgcccugaacuucgacaaggccaccgacaucgugaccggccugaagcagaagaccagcuucggcagacccaugugggacaacgaguucagcaccaucgccaccagccaccccaagagcguggugggcguguuccugugcggccccagaacccuggccaagagccugagaaagugcugccacagauacagcagccuggaccccagaaaggugcaguucuacuucaacaaggagaacuucuaa

SEQ ID NO: 20657 - RNA, 1707 nt, Artificial Sequence
  NOX3__Homo_sapiens__NP_056533
augaugggcugcuggauccugaacgagggccugagcaccauccuggugcugagcuggcugggcaucaacuucuaccuguucaucgacaccuucuacugguacgaggaggaggagagcuuccacuacaccagagugauccugggcagcacccuggccugggccagagccagcgcccugugccugaacuucaacugcaugcugauccugauccccgugagcagaaaccugaucagcuucaucagaggcaccagcaucugcugcagaggccccuggagaagacagcuggacaagaaccugagauuccacaagcugguggccuacggcaucgccgugaacgccaccauccacaucguggcccacuucuucaaccuggagagauaccacuggagccagagcgaggaggcccagggccugcuggccgcccugagcaagcugggcaacacccccaacgagagcuaccugaaccccgugagaaccuuccccaccaacaccaccaccgagcugcugagaaccaucgccggcgugaccggccuggugaucagccuggcccuggugcugaucaugaccagcagcaccgaguucaucagacaggccagcuacgagcuguucugguacacccaccacguguucaucguguucuuccugagccuggccauccacggcaccggcagaaucgugagaggccagacccaggacagccugagccugcacaacaucaccuucugcagagacagauacgccgaguggcagaccguggcccagugccccgugccccaguucagcggcaaggagcccagcgccuggaaguggauccugggccccguggugcuguacgccugcgagagaaucaucagauucuggagauuccagcaggagguggugaucaccaagguggugagccaccccagcggcgugcuggagcugcacaugaagaagagaggcuucaagauggcccccggccaguacauccuggugcagugccccgccaucagcagccuggaguggcaccccuucacccugaccagcgccccccaggaggacuucuucagcgugcacaucagagccgccggcgacuggaccgccgcccugcuggaggccuucggcgccgagggccaggcccugcaggagcccuggagccugcccagacuggccguggacggccccuucggcaccgcccugaccgacguguuccacuaccccgugugcgugugcguggccgccggcaucggcgugacccccuucgccgcccugcugaagagcaucugguacaagugcagcgaggcccagaccccccugaagcugagcaagguguacuucuacuggaucugcagagacgccagagccuucgagugguucgccgaccugcugcugagccuggagaccagaaugagcgagcagggcaagacccacuuccugagcuaccacaucuuccugaccggcugggacgagaaccaggcccugcacaucgcccugcacugggacgagaacaccgacgugaucaccggccugaagcagaagaccuucuacggcagacccaacuggaacaacgaguucaagcagaucgccuacaaccaccccagcagcagcaucggcguguucuucugcggccccaaggcccugagcagaacccugcagaagaugugccaccuguacagcagcgccgaccccagaggcgugcacuucuacuacaacaaggagagcuucuaa

SEQ ID NO: 20658 - RNA, 1617 nt, Artificial Sequence
  NOX4__Homo_sapiens__NP_001137308
auggccgugagcuggagaagcuggcuggccaacgagggcgugaagcaccugugccuguucaucuggcugagcaugaacgugcugcuguucuggaagaccuuccugcuguacaaccagggccccgaguaccacuaccugcaccagaugcugggccugggccugugccugagcagagccagcgccagcgugcugaaccugaacugcagccugauccugcugcccaugugcagaacccugcuggccuaccugagaggcagccagaaggugcccagcagaagaaccagaagacugcuggacaagagcagaaccuuccacaucaccugcggcgugaccaucugcaucuucagcggcgugcacguggccgcccaccuggugaacgcccugaacuucagcgugaacuacagcgaggacuucguggagcugaacgccgccagauacagagacgaggaccccagaaagcugcuguucaccaccgugcccggccugaccggcgugugcauggugguggugcuguuccugaugaucaccgccagcaccuacgccaucagagugagcaacuacgacaucuucugguacacccacaaccuguucuucguguucuacaugcugcugacccugcacgugagcggcggccugcugaaguaccagaccaaccuggacacccacccccccggcugcaucagccugaacagaaccagcagccagaacaucagccugcccgaguacuucagcgagcacuuccacgagcccuuccccgagggcuucagcaagcccgccgaguucacccagcacaaguucgugaagaucugcauggaggagcccagauuccaggccaacuucccccagaccuggcuguggaucagcggcccccugugccuguacugcgccgagagacuguacagauacaucagaagcaacaagcccgugaccaucaucagcgugaucagccaccccagcgacgugauggagaucagaauggugaaggagaacuucaaggccagacccggccaguacaucacccugcacugccccagcgugagcgcccuggagaaccaccccuucacccugaccaugugccccaccgagaccaaggccaccuucggcgugcaccugaagaucgugggcgacuggaccgagagauucagagaccugcugcugccccccagcagccaggacagcgagauccugcccuucauccagagcagaaacuaccccaaggacgacuggaagcccuacaagcugagaagacuguacuucaucugggugugcagagacauccagagcuucagaugguucgccgaccugcugugcaugcugcacaacaaguucuggcaggagaacagacccgacuacgugaacauccagcuguaccugagccagaccgacggcauccagaagaucaucggcgagaaguaccacgcccugaacagcagacuguucaucggcagacccagauggaagcugcuguucgacgagaucgccaaguacaacagaggcaagaccgugggcguguucugcugcggccccaacagccugagcaagacccugcacaagcugagcaaccagaacaacagcuacggcaccagauucgaguacaacaaggagagcuucagcuaa

SEQ ID NO: 20659 - RNA, 2214 nt, Artificial Sequence
  NOX5__Homo_sapiens__NP_001171708
augaacaccagcggcgaccccgcccagaccggccccgagggcugcagaggcaccaugagcgccgaggaggacgccagauggcugagaugggugacccagcaguucaagaccaucgccggcgaggacggcgagaucagccugcaggaguucaaggccgcccugcacgugaaggagagcuucuucgccgagagauucuucgcccuguucgacagcgacagaagcggcaccaucacccugcaggagcugcaggaggcccugacccugcugauccacggcagccccauggacaagcugaaguuccuguuccagguguacgacaucgacggcagcggcagcaucgaccccgacgagcugagaaccgugcugcagagcugccugagagagagcgccaucagccugcccgacgagaagcuggaccagcugacccuggcccuguucgagagcgccgacgccgacggcaacggcgccaucaccuucgaggagcugagagacgagcugcagagauuccccggcgugauggagaaccugaccaucagcgccgcccacuggcugaccgcccccgcccccagacccagacccagaagacccagacagcugaccagagccuacuggcacaaccacagaagccagcuguucugccuggccaccuacgccggccugcacgugcugcuguucggccuggccgccagcgcccacagagaccugggcgccagcgugaugguggccaagggcugcggccagugccugaacuucgacugcagcuucaucgccgugcugaugcugagaagaugccugaccuggcugagagccaccuggcuggcccaggugcugccccuggaccagaacauccaguuccaccagcugaugggcuacgugguggugggccugagccuggugcacaccguggcccacaccgugaacuucgugcugcaggcccaggccgaggccagccccuuccaguucugggagcugcugcugaccaccagacccggcaucggcugggugcacggcagcgccagccccaccggcguggcccugcugcugcugcugcugcugauguucaucugcagcagcagcugcaucagaagaagcggccacuucgagguguucuacuggacccaccugagcuaccugcugguguggcugcugcugaucuuccacggccccaacuucuggaaguggcugcuggugcccggcauccuguucuuccuggagaaggccaucggccuggccgugagcagaauggccgccgugugcaucauggaggugaaccugcugcccagcaaggugacccaccugcugaucaagagaccccccuucuuccacuacagacccggcgacuaccuguaccugaacauccccaccaucgccagauacgaguggcaccccuucaccaucagcagcgcccccgagcagaaggacaccaucuggcugcacaucagaagccagggccaguggaccaacagacuguacgagagcuucaaggccagcgacccccugggcagaggcagcaagagacugagcagaagcgugaccaugagaaagagccagagaagcagcaagggcagcgagauccugcuggagaagcacaaguucugcaacaucaagugcuacaucgacggccccuacggcacccccaccagaagaaucuucgccagcgagcacgccgugcugaucggcgccggcaucggcaucacccccuucgccagcauccugcagagcaucauguacagacaccagaagagaaagcacaccugccccagcugccagcacagcuggaucgagggcgugcaggacaacaugaagcugcacaagguggacuucaucuggaucaacagagaccagagaagcuucgagugguucgugagccugcugaccaagcuggagauggaccaggccgaggaggcccaguacggcagauuccuggagcugcacauguacaugaccagcgcccugggcaagaacgacaugaaggccaucggccugcagauggcccuggaccugcuggccaacaaggagaagaaggacagcaucaccggccugcagaccagaacccagcccggcagacccgacuggagcaagguguuccagaagguggccgccgagaagaagggcaaggugcagguguucuucugcggcagccccgcccuggccaaggugcugaagggccacugcgagaaguucggcuucagauucuuccaggagaacuucuaa

SEQ ID NO: 20660 - RNA, 1284 nt, Artificial Sequence
  NOXA1__Homo_sapiens__NP_001242997
auggccagccugggcgaccuggugagagccuggcaccugggcgcccaggccguggacagaggcgacugggccagagcccugcaccuguucagcggcgugcccgccccccccgccagacugugcuucaacgccggcugcgugcaccugcuggccggcgaccccgaggccgcccugagagccuucgaccaggccgugaccaaggacaccugcauggccgugggcuucuuccagagaggcguggccaacuuccagcuggccagauuccaggaggcccugagcgacuucuggcuggcccuggagcagcugagaggccacgccgccaucgacuacacccagcugggccugagauucaagcugcaggccugggaggugcugcacaacguggccagcgcccagugccagcugggccuguggaccgaggccgccagcagccugagagaggccaugagcaaguggcccgagggcagccugaacggccuggacagcgcccuggaccaggugcagggccccggcgccaaccacgacgccagaagccugaucauggacagccccagagccggcacccaccagggcccccuggacgccgagaccgaggugggcgccgacagaugcaccagcaccgccuaccaggagcagagaccccagguggagcaggugggcaagcaggccccccugagccccggccugcccgccaugggcggccccggccccggccccugcgaggaccccgccggcgccggcggcgccggcgccggcggcagcgagccccuggugaccgugaccgugcagugcgccuucaccguggcccugagagccagaagaggcgccgaccugagcagccugagagcccugcugggccaggcccugccccaccaggcccagcugggccagcugagcuaccuggcccccggcgaggacggccacugggugcccauccccgaggaggagagccugcagagagccuggcaggacgccgccgccugccccagaggccugcagcugcagugcagaggcgccggcggcagacccgugcuguaccaggugguggcccagcacagcuacagcgcccagggccccgaggaccugggcuucagacagggcgacaccguggacgugcugugcgaggagcccgacgugccccuggccguggaccaggccuggcuggagggccacugcgacggcagaaucggcaucuuccccaagugcuucguggugcccgccggccccagaaugagcggcgcccccggcagacugcccagaagccagcagggcgaccagcccuaa

SEQ ID NO: 20661 - RNA, 1113 nt, Artificial Sequence
  NOXO1__Homo_sapiens__NP_653204
auggccggccccagauaccccgugagcgugcagggcgccgcccuggugcagaucaagagacugcagaccuucgccuucagcgugagauggagcgacggcagcgacaccuucgugagaagaagcugggacgaguucagacagcugaagacccugaaggagaccuuccccguggaggccggccugcugagaagaagcgacagagugcugcccaagcugcuggacgccccccugcugggcagagugggcagaaccagcagaggccuggccagacugcagcugcuggagaccuacagcagaagacugcuggccaccgccgagagaguggccagaagccccaccaucaccggcuucuucgccccccagccccuggaccuggagcccgcccugccccccggcagcagagugauccugcccacccccgaggagcagccccugagcagagccgccggcagacugagcauccacagccuggaggcccagagccugagaugccugcagcccuucugcacccaggacaccagagacagacccuuccaggcccaggcccaggagagccuggacgugcugcugagacaccccagcggcugguggcugguggagaacgaggacagacagaccgccugguuccccgcccccuaccuggaggaggccgcccccggccagggcagagagggcggccccagccugggcagcagcggcccccaguucugcgccagcagagccuacgagagcagcagagccgacgagcugagcgugcccgccggcgccagagugagagugcuggagaccagcgacagaggcugguggcugugcagauacggcgacagagccggccugcugcccgccgugcugcugagacccgagggccugggcgcccugcugagcggcaccggcuucagaggcggcgacgaccccgccggcgaggccagaggcuuccccgagcccagccaggccaccgcccccccccccaccgugcccaccagacccagccccggcgccauccagagcagaugcugcaccgugaccagaagagcccuggagagaagacccagaagacagggcagacccagaggcugcguggacagcgugccccaccccaccaccgagcaguaa

SEQ ID NO: 20662 - RNA, 3471 nt, Artificial Sequence
  NPAP1__Homo_sapiens__NP_061831
augggcaaccugcugagcaaguucagacccggcugcagaagaagaccccugcccggccccggcagaggcgcccccgccccccugagcagagacgccagcccccccggcagagcccacagcgugcccacccccagacccuucagaggccuguucagaagaaacgccagaagaagacccagcgccgccagcaucuucguggcccccaagagacccugcccccugcccagagccgccgccgccccccugggcgugcugcccgccgugggcuggggccuggccaucagaaagacccccaugcugcccgccagaaacccccccagauucggccaccccagcagcgugagaauccccccccccagcagaauguucacccugcugcugcccagccccagagagcccgccgugaaggccagaaagcccauccccgccacccugcuggaggagaccgaggugugggcccaggagggccccagaagagugaagaaggacgaggaccccgugcagaucgagggcgaggacgacgagaagagaaccccccugagcagcggcgaggccagcagcaccagcagaagccagggcacccagggcgacguggccagcuucagaugcagccccggcccccuggagggcaacguguaccacaaguucagcgagaacagcaugagcgagaaggcccaggccagccccgccagcagcugccuggagggccccgccaugcccagcacccacagccaggccggcugcgccagacaccugggcaagcccgaccccgacgccaccgccccccccgagcccgccgugggcugcagccugcugcagcagaagcuggccgccgaggugcugaacgaggagcccccccccagcagccugggccugcccaucccccugaugagcggcaagagaaugcccgacgagaagcccuucugcaucccccccagaagcgccgccccccccagagccgccagaaacagacccugcaagagaaagaugagcaucccccugcugcugccccugccccccagccugccccugcugugggacagaggcgagcugcccccccccgccaagcugcccugccugagcguggagggcgaccugcacacccuggagaagagccccgaguacaagagaaacagcagaauccuggaggacaagaccgagaccaugaccaacagcagcaucacccagcccgcccccagcuucagccagcccgugcagaccaccgacagccugccccugaccaccuacaccagccaggugagcgccccccugcccauccccgaccuggccgaccuggccaccggcccccugauccugcccauccccccccugagcaccacccccaagauggacgagaagaucgccuucaccauccccaacagcccccuggcccugcccgccgaccuggugcccauccugggcgaccagagcaacgagaagggcggcagcuacaacagcguggugggcgccgccccccugaccagcgacccccccaccccccccagcagcacccccagcuucaagccccccgugaccagagagagccccaucagcaugugcguggacagcccccccccccugagcuuccugacccugcugcccgugcccagcaccggcaccagcgugaucaccagcaagcccaugaacagcaccagcgugaucagcaccgugaccaccaacgccagcgcccaccugaccagccagaccgccguggaccccgagguggugaacauggacaccaccgcccccagccagguggugaucuucaccagcagccugagcagcagagugagcagccugcccaacagccagauccacugcagcgccgagcagagacaccccggcaagaccagcguguacaccagcccccugcccuucaucuuccacaacaccacccccagcuucaaccagcuguucggcaaggaggccaccccccagcccaaguucgaggcccccgacggccagccccagaaggccagccugcccagcgccugcguguuccugagccugcccaucauccccccccccgacaccagcacccuggugaacagcgccagcaccgccagcagcagcaagccccccaucgagaccaacgccaugcacaccaccccccccagcaaggccgugauccugcagagcgccagcgugagcaagaaguaccugcccuucuaccugggccugcccggcagcggcaacacccagcccagcggcaacaccgccagcgugcagggcagcaccagccugcccgcccagagcgugagagcccccgccaccgccagcaaccacccccugaaccccggcgccaccccccagcccaaguucggcgcccccgacggcccccagcagaagaccagccugcccagcgcccacgacuuccugagccugcccaucauggugccccccgacaccagcacccuggugagcagcgccagcgccgccagccugagcaagcccgccaucgacaccagcgacaugaacaccaccccccccagcaagaccgugauccugcagagcaccuucgugagcagaaaggaggaguacaucagauucuacaugggccugcccggcagcggcaacacccugcacagcgacagcaucgccagcgcccaggugagcaccagcuuccccgcccaggccgacagaagacccaccaccaccagcagccacccccugaacaccggcagcaucagccacagcacccugggcgccaccgacggccagcagaagagcgacagcagcuucauccugggcaaccccgccacccccgcccccgugaucggccugaccagccccagcgugcagccccugagcggcagcaucaucccccccggcuucgccgagcugaccagccccuacaccgcccugggcacccccgugaacgccgagcccguggagggccacaacgccagcgccuuccccaacggcaccgccaagaccagcggcuucagaaucgccaccggcaugcccggcaccggcgacagcacccugcuggugggcaacaccauccccggcccccaggugaucaugggccccggcacccccauggacggcggcagcaucggcuucagcaugagcgcccccggccccagcagcaccagcggcgagcugaacaucggccagggccagagcggcacccccagcaccaccagcguguuccccuucggccaggccgccugggaccccaccggccacagcauggccgccgccccccagggcgccagcaacauccccguguucggcuacaccagcgccgccgccuacauccccggccuggacccccccacccagaacagcugcagcggcaugggcggcgacggcaccagaagcaucgugggcggccccugcgugcccgccuuccagcagugcauccugcagcacaccuggaccgagagaaaguucuacaccagcagcacccacuacuacggccaggagaccuacgugagaagacacgugugcuuccagcugcccuaa

SEQ ID NO: 20663 - RNA, 2475 nt, Artificial Sequence
  NPAS2__Homo_sapiens__NP_002509
auggacgaggacgagaaggacagagccaagagagccagcagaaacaagagcgagaagaagagaagagaccaguucaacgugcugaucaaggagcugagcagcaugcugcccggcaacaccagaaagauggacaagaccaccgugcuggagaaggugaucggcuuccugcagaagcacaacgaggugagcgcccagaccgagaucugcgacauccagcaggacuggaagcccagcuuccugagcaacgaggaguucacccagcugaugcuggaggcccuggacggcuucaucaucgccgugaccaccgacggcagcaucaucuacgugagcgacagcaucaccccccugcugggccaccugcccagcgacgugauggaccagaaccugcugaacuuccugcccgagcaggagcacagcgagguguacaagauccugagcagccacaugcuggugaccgacagccccagccccgaguaccugaagagcgacagcgaccuggaguucuacugccaccugcugagaggcagccugaaccccaaggaguuccccaccuacgaguacaucaaguucgugggcaacuucagaagcuacaacaacgugcccagccccagcugcaacggcuucgacaacacccugagcagacccugcagagugccccugggcaaggaggugugcuucaucgccaccgugagacuggccaccccccaguuccugaaggagaugugcaucguggacgagccccuggaggaguucaccagcagacacagccuggaguggaaguuccuguuccuggaccacagagccccccccaucaucggcuaccugcccuucgaggugcugggcaccagcggcuacgacuacuaccacaucgacgaccuggagcugcuggccagaugccaccagcaccugaugcaguucggcaagggcaagagcugcugcuacagauuccugaccaagggccagcaguggaucuggcugcagacccacuacuacaucaccuaccaccaguggaacagcaagcccgaguucaucgugugcacccacagcguggugagcuacgccgacgugagaguggagagaagacaggagcuggcccuggaggacccccccagcgaggcccugcacagcagcgcccugaaggacaagggcagcagccuggagcccagacagcacuucaacacccuggacgugggcgccagcggccugaacaccagccacagccccagcgccagcagcagaagcagccacaagagcagccacaccgccaugagcgagcccaccagcacccccaccaagcugauggccgaggccagcacccccgcccugcccagaagcgccacccugccccaggagcugcccgugcccggccugagccaggccgccaccaugcccgccccccugcccagccccagcagcugcgaccugacccagcagcugcugccccagaccgugcugcagagcacccccgcccccauggcccaguucagcgcccaguucagcauguuccagaccaucaaggaccagcuggagcagagaaccagaauccugcaggccaacaucagauggcagcaggaggagcugcacaagauccaggagcagcugugccuggugcaggacagcaacgugcagauguuccugcagcagcccgccgugagccugagcuucagcagcacccagagacccgaggcccagcagcagcugcagcagagaagcgccgccgugacccagccccagcugggcgccggcccccagcugcccggccagaucagcagcgcccaggugaccagccagcaccugcugagagagagcagcgugaucagcacccagggccccaagcccaugagaagcagccagcugaugcagagcagcggcagaagcggcagcagccuggugagccccuucagcagcgccaccgccgcccugccccccagccugaaccugaccacccccgccagcaccagccaggacgccagccagugccagcccagccccgacuucagccacgacagacagcugagacugcugcugagccagcccauccagcccaugaugcccggcagcugcgacgccagacagcccagcgaggugagcagaaccggcagacaggugaaguacgcccagagccagaccguguuccagaaccccgacgcccaccccgccaacagcagcagcgcccccaugcccgugcugcugaugggccaggccgugcugcaccccagcuuccccgccagccagcccagcccccugcagcccgcccaggccagacagcagcccccccagcacuaccugcaggugcaggcccccaccagccugcacagcgagcagcaggacagccugcugcugagcaccuacagccagcagcccggcacccugggcuacccccagcccccccccgcccagccccagccccugagaccccccagaagagugagcagccugagcgagagcagcggccugcagcagccccccagauaa

SEQ ID NO: 20664 - RNA, 2802 nt, Artificial Sequence
  NPAS3__Homo_sapiens__NP_001158221
auggcccccaccaagcccagcuuccagcaggaccccagcagaagagagagaaucaccgcccagcacccccugcccaaccagagcgagugcagaaagaucuacagauacgacggcaucuacugcgagagcaccuaccagaaccugcaggcccugagaaaggagaagagcagagacgccgccagaagcagaagaggcaaggagaacuucgaguucuacgagcuggccaagcugcugccccugcccgccgccaucaccagccagcuggacaaggccagcaucaucagacugaccaucagcuaccugaagaugagagacuucgccaaccagggcgacccccccuggaaccugagaauggagggccccccccccaacaccagcgugaaggugaucggcgcccagagaagaagaagccccagcgcccuggccaucgagguguucgaggcccaccugggcagccacauccugcagagccuggacggcuucguguucgcccugaaccaggagggcaaguuccuguacaucagcgagaccgugagcaucuaccugggccugagccagguggagcugaccggcagcagcguguucgacuacgugcaccccggcgaccacguggagauggccgagcagcugggcaugaagcugccccccggcagaggccugcugagccagggcaccgccgaggacggcgccagcagcgccagcagcagcagccagagcgagacccccgagcccguggagagcaccagccccagccugcugaccaccgacaacacccuggagagaagcuucuucaucagaaugaagagcacccugaccaagagaggcgugcacaucaagagcagcggcuacaaggugauccacaucaccggcagacugagacugagagugagccugagccacggcagaaccgugcccagccagaucaugggccugguggugguggcccacgcccugcccccccccaccaucaacgaggugagaaucgacugccacauguucgugaccagagugaacauggaccugaacaucaucuacugcgagaacagaaucagcgacuacauggaccugacccccguggacaucgugggcaagagaugcuaccacuucauccacgccgaggacguggagggcaucagacacagccaccuggaccugcugaacaagggccagugcgugaccaaguacuacagauggaugcagaagaacggcggcuacaucuggauccagagcagcgccaccaucgccaucaacgccaagaacgccaacgagaagaacaucaucugggugaacuaccugcugagcaaccccgaguacaaggacacccccauggacaucgcccagcugccccaccugcccgagaagaccagcgagagcagcgagaccagcgacagcgagagcgacagcaaggacaccagcggcaucaccgaggacaacgagaacagcaagagcgacgagaagggcaaccagagcgagaacagcgaggaccccgagcccgacagaaagaagagcggcaacgccugcgacaacgacaugaacugcaacgacgacggccacagcagcagcaaccccgacagcagagacagcgacgacagcuucgagcacagcgacuucgagaaccccaaggccggcgaggacggcuucggcgcccugggcgccaugcagaucaagguggagagauacguggagagcgagagcgaccugagacugcagaacugcgagagccugaccagcgacagcgccaaggacagcgacagcgccggcgaggccggcgcccaggccagcagcaagcaccagaagagaaagaagagaagaaagagacagaagggcggcagcgccagcagaagaagacugagcagcgccagcagccccggcggccuggacgccggccugguggagccccccagacugcugagcagccccaacagcgccagcgugcugaagaucaagaccgagaucagcgagcccaucaacuucgacaacgacagcagcaucuggaacuacccccccaacagagagaucagcagaaacgagagccccuacagcaugaccaagccccccagcagcgagcacuuccccagcccccagggcggcggcggcggcggcggcggcggcggcggccugcacguggccauccccgacagcgugcugaccccccccggcgccgacggcgccgccgccagaaagacccaguucggcgccagcgccaccgccgcccuggcccccguggccagcgacccccugagccccccccugagcgccagccccagagacaagcaccccggcaacggcggcggcggcggcggcggcggcggcggcgccggcggcggcggccccagcgccagcaacagccugcuguacaccggcgaccuggaggcccugcagagacugcaggccggcaacguggugcugccccuggugcacagagugaccggcacccuggccgccaccagcaccgccgcccagagaguguacaccaccggcaccaucagauacgcccccgccgaggugacccuggccaugcagagcaaccugcugcccaacgcccacgccgugaacuucguggacgugaacagccccggcuucggccuggaccccaagacccccauggagaugcuguaccaccacgugcacagacugaacaugagcggccccuucggcggcgccgugagcgccgccagccugacccagaugcccgccggcaacguguucaccaccgccgagggccuguucagcacccugcccuuccccguguacagcaacggcauccacgccgcccagacccuggagagaaaggaggacuaa

SEQ ID NO: 20665 - RNA, 2409 nt, Artificial Sequence
  NPAS4__Homo_sapiens__NP_849195
auguacagaagcaccaagggcgccagcaaggccagaagagaccagaucaacgccgagaucagaaaccugaaggagcugcugccccuggccgaggccgacaaggugagacugagcuaccugcacaucaugagccuggccugcaucuacaccagaaagggcguguucuucgccggcggcaccccccuggccggccccaccggccugcugagcgcccaggagcuggaggacaucguggccgcccugcccggcuuccugcugguguucaccgccgagggcaagcugcuguaccugagcgagagcgugagcgagcaccugggccacagcaugguggaccugguggcccagggcgacagcaucuacgacaucaucgaccccgccgaccaccugaccgugagacagcagcugacccugcccagcgcccuggacaccgacagacuguucagaugcagauucaacaccagcaagagccugagaagacagagcgccggcaacaagcuggugcugaucagaggcagauuccacgcccacccccccggcgccuacugggccggcaaccccguguucaccgccuucugcgccccccuggagcccagacccagacccggccccggccccggccccggccccgccagccuguuccuggccauguuccagagcagacacgccaaggaccuggcccugcuggacaucagcgagagcgugcugaucuaccugggcuucgagagaagcgagcugcugugcaagagcugguacggccugcugcaccccgaggaccuggcccacgccagcgcccagcacuacagacugcuggccgagagcggcgacauccaggccgagaugguggugagacugcaggccaagaccggcggcugggccuggaucuacugccugcuguacagcgagggccccgagggccccaucaccgccaacaacuaccccaucagcgacauggaggccuggagccugagacagcagcugaacagcgaggacacccaggccgccuacgugcugggcacccccaccaugcugcccagcuuccccgagaacauccugagccaggaggagugcagcagcaccaacccccuguucaccgccgcccugggcgcccccagaagcaccagcuuccccagcgcccccgagcugagcguggugagcgccagcgaggagcugcccagacccagcaaggagcuggacuucagcuaccugaccuuccccagcggccccgagcccagccugcaggccgagcugagcaaggaccuggugugcaccccccccuacaccccccaccagcccggcggcugcgccuuccuguucagccugcacgagcccuuccagacccaccugcccacccccagcagcacccugcaggagcagcugacccccagcaccgccaccuucagcgaccagcugacccccagcagcgccaccuuccccgacccccugaccagcccccugcagggccagcugaccgagaccagcgugagaagcuacgaggaccagcugacccccugcaccagcaccuuccccgaccagcugcugcccagcaccgccaccuuccccgagccccugggcagccccgcccacgagcagcugaccccccccagcaccgccuuccaggcccaccuggacagccccagccagaccuuccccgagcagcugagccccaaccccaccaagaccuacuucgcccaggagggcugcagcuuccuguacgagaagcugccccccagccccagcagccccggcaacggcgacugcacccugcuggcccuggcccagcugagaggcccccugagcguggacgugccccuggugcccgagggccugcugacccccgaggccagccccgugaagcagagcuucuuccacuacagcgagaaggagcagaacgagaucgacagacugauccagcagaucagccagcuggcccagggcauggacagacccuucagcgccgaggccggcaccggcggccuggagccccugggcggccuggagccccuggacagcaaccugagccugagcggcgccggcccccccgugcugagccuggaccugaagcccuggaagugccaggagcuggacuuccuggccgaccccgacaacauguuccuggaggagacccccguggaggacaucuucauggaccugagcacccccgaccccagcgaggaguggggcagcggcgaccccgaggccgagggccccggcggcgcccccagccccugcaacaaccugagccccgaggaccacagcuuccuggaggaccuggccaccuacgagaccgccuucgagaccggcgugagcgccuuccccuacgacggcuucaccgacgagcugcaccagcugcagagccaggugcaggacagcuuccacgaggacggcagcggcggcgagcccaccuucuaa

SEQ ID NO: 20666 - RNA, 4284 nt, Artificial Sequence
  NPAT__Homo_sapiens__NP_002510
augcugcugcccagcgacguggccagacuggugcugggcuaccugcagcaggagaaccugaucagcaccugccagaccuucauccuggagagcagcgaccugaaggaguacgccgagcacugcaccgacgagggcuucauccccgccugccugcugagccuguucggcaagaaccugaccaccauccugaacgaguacguggccaugaagaccaaggagaccagcaacaacgugcccgccaucaugagcagccuguggaagaagcuggaccacacccugagccagaucagaagcaugcagagcagccccagauucgccggcagccagagagccagaaccagaaccggcaucgccgagaucaagagacagagaaagcuggccagccagaccgcccccgccagcgccgagcugcugacccugcccuaccugagcggccaguucaccaccccccccagcaccggcacccaggugaccagacccagcggccagaucagcgaccccagcagaagcuacuucgugguggugaaccacagccagagccaggacaccgugaccaccggcgaggcccugaacgugauccccggcgcccaggagaagaaggcccacgccagccugaugagccccggcagaagaaagagcgagagccagagaaagagcaccacccugagcggcccccacagcaccaucagaaacuuccaggaccccaacgccuucgccguggagaagcagauggugaucgagaacgccagagagaagauccugagcaacaagagccugcaggagaagcuggccgagaacaucaacaaguuccugaccagcgacaacaacaucgcccaggugcccaagcagaccgacaacaaccccaccgagcccgagaccagcaucgacgaguuccugggccugcccagcgagauccacaugagcgaggaggccauccaggacauccuggagcagaccgagagcgaccccgccuuccaggcccuguucgaccuguucgacuacggcaagaccaagaacaacaagaacaucagccagagcaucagcagccagcccauggagagcaaccccagcaucgugcuggccgacgagaccaaccuggccgugaagggcagcuucgagaccgaggagagcgacggccagagcggccagcccgccuucugcaccagcuaccagaacgacgacccccugaacgcccugaagaacagcaacaaccacgacgugcugagacaggaggaccaggagaacuucagccagaucagcaccagcauccagaagaaggccuucaagaccgccgugcccaccgagcagaagugcgacaucgacaucaccuucgagagcgugcccaaccugaacgacuucaaccagagaggcaacagcaacgccgagugcaacccccacugcgccgagcuguacaccaaccagaugagcaccgagaccgagauggccaucggcaucgagaagaacagccugagcagcaacgugcccagcgagagccagcugcagcccgaccagcccgacauccccaucaccagcuucgugagccugggcugcgaggccaacaacgagaaccugauccugagcggcaagagcagccagcugcugagccaggacaccagccugaccggcaagcccagcaagaagagccaguucugcgagaacagcaacgacaccgugaagcugaagaucaacuuccacggcagcaagagcagcgacagcagcgaggugcacaagagcaagaucgagaucaacgugcuggagcccgugaugagccagcugagcaacugccaggacaacagcugccugcagagcgagauccugcccgugagcguggagagcagccaccugaacgugagcggccagguggagauccaccugggcgacagccugagcagcaccaagcagcccagcaacgacagcgccagcguggagcugaaccacaccgagaacgaggcccaggccagcaagagcgagaacagccaggagcccagcagcagcgugaaggaggagaacaccaucuuccugagccugggcggcaacgccaacugcgagaagguggcccugaccccccccgagggcacccccguggagaacagccacagccugccccccgagagcgugugcagcagcgugggcgacagccaccccgagagccagaacaccgacgacaagcccagcagcaacaacagcgccgagaucgacgccagcaacaucgugagccugaaggugaucaucagcgacgaccccuucgugagcagcgacaccgagcugaccagcgccgugagcagcaucaacggcgagaaccugcccaccaucauccugagcagccccaccaagagccccaccaagaacgccgagcuggugaagugccugagcagcgaggagaccgugggcgccgugguguacgccgaggugggcgacagcgccagcauggagcagagccugcugaccuucaagagcgaggacagcgccgugaacaacacccagaacgaggacggcaucgccuucagcgccaacgugacccccugcgugagcaaggacggcggcuacauccagcugaugcccgccaccagcaccgccuucggcaacagcaacaacauccugaucgccaccugcgugaccgaccccaccgcccugggcaccagcgugagccagagcaacgugguggugcugcccggcaacagcgcccccaugaccgcccagccccugcccccccagcugcagaccccccccagaagcaacagcguguucgccgugaaccaggccgugagccccaacuucagccagggcagcgccaucaucaucgccagccccgugcagcccgugcugcagggcauggugggcaugauccccgugagcguggugggccagaacggcaacaacuucagcaccccccccagacaggugcugcacaugccccugaccgcccccgugugcaacagaagcaucccccaguuccccgugccccccaagagccagaaggcccagggccugagaaacaagcccugcaucggcaagcaggugaacaaccugguggacagcagcggccacagcgugggcugccacgcccagaagaccgaggugagcgacaagagcaucgccaccgaccugggcaagaagagcgaggagaccaccgugcccuuccccgaggagagcaucgugcccgccgccaagcccugccacagaagagugcugugcuucgacagcaccaccgcccccguggccaacacccagggccccaaccacaagauggugagccagaacaaggagagaaacgccgugagcuuccccaaccuggacagccccaacgugagcagcacccugaagccccccagcaacaacgccaucaagagagagaaggagaagcccccccugcccaagauccugagcaagagcgagagcgccaucagcagacacaccaccaucagagagacccagagcgagaagaaggugagccccaccgagaucgugcuggagagcuuccacaaggccaccgccaacaaggagaacgagcugugcagcgacguggagagacagaagaaccccgagaacagcaagcugagcaucggccagcagaacggcggccugagaagcgagaagagcaucgccagccugcaggagaugaccaagaagcagggcaccagcagcaacaacaagaacgugcugagcgugggcaccgccgugaaggaccugaagcaggagcagaccaagagcgccagcagccugaucaccaccgagaugcugcaggacauccagagacacagcagcgugagcagacuggccgacagcagcgaccugcccgugcccagaacccccggcagcggcgccggcgagaagcacaaggaggagcccaucgacaucaucaaggcccccagcagcagaagauucagcgaggacagcagcaccagcaaggugauggugccccccgugacccccgaccugcccgccugcagccccgccagcgagaccggcagcgagaacagcgugaacauggccgcccacacccugaugauccugagcagagccgccaucagcagaaccaccagcgccaccccccugaaggacaacacccagcaguucagagccagcagcagaagcaccaccaagaagagaaagaucgaggagcuggacgagagagagagaaacagcagacccagcagcaagaaccugaccaacagcagcauccccaugaagaagaagaagaucaagaagaagaagcugcccagcagcuuccccgccggcauggacguggacaaguuccugcugagccugcacuacgacgaguaa

SEQ ID NO: 20667 - RNA, 378 nt, Artificial Sequence
  NPB__Homo_sapiens__NP_683694
auggccagaagcgccacccuggccgccgccgcccuggcccugugccugcugcuggccccccccggccuggccugguacaagcccgccgccggccacagcagcuacagcgugggcagagccgccggccugcugagcggccugagaagaagccccuacgccagaagaagccagcccuacagaggcgccgagccccccggcggcgccggcgccagccccgagcugcagcugcaccccagacugagaagccuggccgugugcgugcaggacguggcccccaaccugcagagaugcgagagacugcccgacggcagaggcaccuaccagugcaaggccaacguguuccugagccugagagccgccgacugccuggccgccuaa

SEQ ID NO: 20668 - RNA, 987 nt, Artificial Sequence
  NPBWR1__Homo_sapiens__NP_005276
auggacaacgccagcuucagcgagcccuggcccgccaacgccagcggccccgaccccgcccugagcugcagcaacgccagcacccuggccccccugcccgccccccuggccguggccgugcccgugguguacgccgugaucugcgccgugggccuggccggcaacagcgccgugcuguacgugcugcugagagcccccagaaugaagaccgugaccaaccuguucauccugaaccuggccaucgccgacgagcuguucacccuggugcugcccaucaacaucgccgacuuccugcugagacaguggcccuucggcgagcugaugugcaagcugaucguggccaucgaccaguacaacaccuucagcagccuguacuuccugaccgugaugagcgccgacagauaccugguggugcuggccaccgccgagagcagaagaguggccggcagaaccuacagcgccgccagagccgugagccuggccguguggggcaucgugacccugguggugcugcccuucgccguguucgccagacuggacgacgagcagggcagaagacagugcgugcugguguucccccagcccgaggccuucugguggagagccagcagacuguacacccuggugcugggcuucgccauccccgugagcaccaucugcgugcuguacaccacccugcugugcagacugcacgccaugagacuggacagccacgccaaggcccuggagagagccaagaagagagugaccuuccuggugguggccauccuggccgugugccugcugugcuggacccccuaccaccugagcaccgugguggcccugaccaccgaccugccccagaccccccuggugaucgccaucagcuacuucaucaccagccugagcuacgccaacagcugccugaaccccuuccuguacgccuuccuggacgccagcuucagaagaaaccugagacagcugaucaccugcagagccgccgccuaa

SEQ ID NO: 20669 - RNA, 3837 nt, Artificial Sequence
  NPC1__Homo_sapiens__NP_000262
augaccgccagaggccuggcccugggccugcugcugcugcugcugugccccgcccagguguucagccagagcugcgugugguacggcgagugcggcaucgccuacggcgacaagagauacaacugcgaguacagcggcccccccaagccccugcccaaggacggcuacgaccuggugcaggagcugugccccggcuucuucuucggcaacgugagccugugcugcgacgugagacagcugcagacccugaaggacaaccugcagcugccccugcaguuccugagcagaugccccagcugcuucuacaaccugcugaaccuguucugcgagcugaccugcagccccagacagagccaguuccugaacgugaccgccaccgaggacuacguggaccccgugaccaaccagaccaagaccaacgugaaggagcugcaguacuacgugggccagagcuucgccaacgccauguacaacgccugcagagacguggaggcccccagcagcaacgacaaggcccugggccugcugugcggcaaggacgccgacgccugcaacgccaccaacuggaucgaguacauguucaacaaggacaacggccaggcccccuucaccaucacccccguguucagcgacuuccccgugcacggcauggagcccaugaacaacgccaccaagggcugcgacgagagcguggacgaggugaccgcccccugcagcugccaggacugcagcaucgugugcggccccaagccccagcccccccccccccccgcccccuggaccauccugggccuggacgccauguacgugaucauguggaucaccuacauggccuuccugcugguguucuucggcgccuucuucgccguguggugcuacagaaagagauacuucgugagcgaguacacccccaucgacagcaacaucgccuucagcgugaacgccagcgacaagggcgaggccagcugcugcgaccccgugagcgccgccuucgagggcugccugagaagacuguucaccagauggggcagcuucugcgugagaaaccccggcugcgugaucuucuucagccugguguucaucaccgccugcagcagcggccugguguucgugagagugaccaccaaccccguggaccuguggagcgcccccagcagccaggccagacuggagaaggaguacuucgaccagcacuucggccccuucuucagaaccgagcagcugaucaucagagccccccugaccgacaagcacaucuaccagcccuaccccagcggcgccgacgugcccuucggccccccccuggacauccagauccugcaccaggugcuggaccugcagaucgccaucgagaacaucaccgccagcuacgacaacgagaccgugacccugcaggacaucugccuggccccccugagccccuacaacaccaacugcaccauccugagcgugcugaacuacuuccagaacagccacagcgugcuggaccacaagaagggcgacgacuucuucguguacgccgacuaccacacccacuuccuguacugcgugagagcccccgccagccugaacgacaccagccugcugcacgaccccugccugggcaccuucggcggccccguguuccccuggcuggugcugggcggcuacgacgaccagaacuacaacaacgccaccgcccuggugaucaccuuccccgugaacaacuacuacaacgacaccgagaagcugcagagagcccaggccugggagaaggaguucaucaacuucgugaagaacuacaagaaccccaaccugaccaucagcuucaccgccgagagaagcaucgaggacgagcugaacagagagagcgacagcgacguguucaccguggugaucagcuacgccaucauguuccuguacaucagccuggcccugggccacaugaagagcugcagaagacugcugguggacagcaaggugagccugggcaucgccggcauccugaucgugcugagcagcguggccugcagccugggcguguucagcuacaucggccugccccugacccugaucgugaucgaggugauccccuuccuggugcuggccgugggcguggacaacaucuucauccuggugcaggccuaccagagagacgagagacugcagggcgagacccuggaccagcagcugggcagagugcugggcgagguggcccccagcauguuccugagcagcuucagcgagaccguggccuucuuccugggcgcccugagcgugaugcccgccgugcacaccuucagccuguucgccggccuggccguguucaucgacuuccugcugcagaucaccugcuucgugagccugcugggccuggacaucaagagacaggagaagaacagacuggacaucuucugcugcgugagaggcgccgaggacggcaccagcgugcaggccagcgagagcugccuguucagauucuucaagaacagcuacagcccccugcugcugaaggacuggaugagacccaucgugaucgccaucuucgugggcgugcugagcuucagcaucgccgugcugaacaagguggacaucggccuggaccagagccugagcaugcccgacgacagcuacaugguggacuacuucaagagcaucagccaguaccugcacgccggcccccccguguacuucgugcuggaggagggccacgacuacaccagcagcaagggccagaacauggugugcggcggcaugggcugcaacaacgacagccuggugcagcagaucuucaacgccgcccagcuggacaacuacaccagaaucggcuucgcccccagcagcuggaucgacgacuacuucgacugggugaagccccagagcagcugcugcagaguggacaacaucaccgaccaguucugcaacgccagcgugguggaccccgccugcgugagaugcagaccccugacccccgagggcaagcagagaccccagggcggcgacuucaugagauuccugcccauguuccugagcgacaaccccaaccccaagugcggcaagggcggccacgccgccuacagcagcgccgugaacauccugcugggccacggcaccagagugggcgccaccuacuucaugaccuaccacaccgugcugcagaccagcgccgacuucaucgacgcccugaagaaggccagacugaucgccagcaacgugaccgagaccaugggcaucaacggcagcgccuacagaguguuccccuacagcguguucuacguguucuacgagcaguaccugaccaucaucgacgacaccaucuucaaccugggcgugagccugggcgccaucuuccuggugaccauggugcugcugggcugcgagcuguggagcgccgugaucaugugcgccaccaucgccauggugcuggugaacauguucggcgugauguggcuguggggcaucagccugaacgccgugagccuggugaaccuggugaugagcugcggcaucagcguggaguucugcagccacaucaccagagccuucaccgugagcaugaagggcagcagaguggagagagccgaggaggcccuggcccacaugggcagcagcguguucagcggcaucacccugaccaaguucggcggcaucguggugcuggccuucgccaagagccagaucuuccagaucuucuacuucagaauguaccuggccauggugcugcugggcgccacccacggccugaucuuccugcccgugcugcugagcuacaucggccccagcgugaacaaggccaagagcugcgccaccgaggagagauacaagggcaccgagagagagagacugcugaacuucuaa

SEQ ID NO: 20670 - RNA, 3999 nt, Artificial Sequence
  NPC1L1__Homo_sapiens__NP_001095118
auggccgaggccggccugagaggcuggcugcugugggcccugcugcugagacuggcccagagcgagcccuacaccaccauccaccagcccggcuacugcgccuucuacgacgagugcggcaagaaccccgagcugagcggcagccugaugacccugagcaacgugagcugccugagcaacacccccgccagaaagaucaccggcgaccaccugauccugcugcagaagaucugccccagacuguacaccggccccaacacccaggccugcugcagcgccaagcagcuggugagccuggaggccagccugagcaucaccaaggcccugcugaccagaugccccgccugcagcgacaacuucgugaaccugcacugccacaacaccugcagccccaaccagagccuguucaucaacgugaccagaguggcccagcugggcgccggccagcugcccgccgugguggccuacgaggccuucuaccagcacagcuucgccgagcagagcuacgacagcugcagcagagugagagugcccgccgccgccacccuggccgugggcaccaugugcggcguguacggcagcgcccugugcaacgcccagagauggcugaacuuccagggcgacaccggcaacggccuggccccccuggacaucaccuuccaccugcuggagcccggccaggccgugggcagcggcauccagccccugaacgagggcguggccagaugcaacgagagccagggcgacgacguggccaccugcagcugccaggacugcgccgccagcugccccgccaucgccagaccccaggcccuggacagcaccuucuaccugggccagaugcccggcagccuggugcugaucaucauccugugcagcguguucgccguggugaccauccugcuggugggcuucagaguggcccccgccagagacaagagcaagaugguggaccccaagaagggcaccagccugagcgacaagcugagcuucagcacccacacccugcugggccaguucuuccagggcuggggcaccuggguggccagcuggccccugaccauccuggugcugagcgugauccccgugguggcccuggccgccggccugguguucaccgagcugaccaccgaccccguggagcuguggagcgcccccaacagccaggccagaagcgagaaggccuuccacgaccagcacuucggccccuucuucagaaccaaccaggugauccugaccgcccccaacagaagcagcuacagauacgacagccugcugcugggccccaagaacuucagcggcauccuggaccuggaccugcugcuggagcugcuggagcugcaggagagacugagacaccugcagguguggagccccgaggcccagagaaacaucagccugcaggacaucugcuacgccccccugaaccccgacaacaccagccuguacgacugcugcaucaacagccugcugcaguacuuccagaacaacagaacccugcugcugcugaccgccaaccagacccugaugggccagaccagccagguggacuggaaggaccacuuccuguacugcgccaacgccccccugaccuucaaggacggcaccgcccuggcccugagcugcauggccgacuacggcgcccccguguuccccuuccuggccaucggcggcuacaagggcaaggacuacagcgaggccgaggcccugaucaugaccuucagccugaacaacuaccccgccggcgaccccagacuggcccaggccaagcugugggaggaggccuuccuggaggagaugagagccuuccagagaagaauggccggcauguuccaggugaccuucauggccgagagaagccuggaggacgagaucaacagaaccaccgccgaggaccugcccaucuucgccaccagcuacaucgugaucuuccuguacaucagccuggcccugggcagcuacagcagcuggagcagagugaugguggacagcaaggccacccugggccugggcggcguggccguggugcugggcgccgugauggccgccaugggcuucuucagcuaccugggcaucagaagcagccuggugauccugcagguggugcccuuccuggugcugagcgugggcgccgacaacaucuucaucuucgugcuggaguaccagagacugcccagaagacccggcgagcccagagaggugcacaucggcagagcccugggcagaguggcccccagcaugcugcugugcagccugagcgaggccaucugcuucuuccugggcgcccugacccccaugcccgccgugagaaccuucgcccugaccagcggccuggccgugauccuggacuuccugcugcagaugagcgccuucguggcccugcugagccuggacagcaagagacaggaggccagcagacuggacgugugcugcugcgugaagccccaggagcugcccccccccggccagggcgagggccugcugcugggcuucuuccagaaggccuacgcccccuuccugcugcacuggaucaccagaggcguggugcugcugcuguuccuggcccuguucggcgugagccuguacagcaugugccacaucagcgugggccuggaccaggagcuggcccugcccaaggacagcuaccugcuggacuacuuccuguuccugaacagauacuucgaggugggcgcccccguguacuucgugaccacccugggcuacaacuucagcagcgaggccggcaugaacgccaucugcagcagcgccggcugcaacaacuucagcuucacccagaagauccaguacgccaccgaguuccccgagcagagcuaccuggccauccccgccagcagcuggguggacgacuucaucgacuggcugacccccagcagcugcugcagacuguacaucagcggccccaacaaggacaaguucugccccagcaccgugaacagccugaacugccugaagaacugcaugagcaucaccaugggcagcgugagacccagcguggagcaguuccacaaguaccugcccugguuccugaacgacagacccaacaucaagugccccaagggcggccuggccgccuacagcaccagcgugaaccugaccagcgacggccaggugcuggccagcagauucauggccuaccacaagccccugaagaacagccaggacuacaccgaggcccugagagccgccagagagcuggccgccaacaucaccgccgaccugagaaaggugcccggcaccgaccccgccuucgagguguuccccuacaccaucaccaacguguucuacgagcaguaccugaccauccugcccgagggccuguucaugcugagccugugccuggugcccaccuucgccgugagcugccugcugcugggccuggaccugagaagcggccugcugaaccugcugagcaucgugaugauccugguggacaccgugggcuucauggcccuguggggcaucagcuacaacgccgugagccugaucaaccuggugagcgccgugggcaugagcguggaguucgugagccacaucaccagaagcuucgccaucagcaccaagcccaccuggcuggagagagccaaggaggccaccaucagcaugggcagcgccguguucgccggcguggccaugaccaaccugcccggcauccuggugcugggccuggccaaggcccagcugauccagaucuucuucuucagacugaaccugcugaucacccugcugggccugcugcacggccugguguuccugcccgugauccugagcuacgugggccccgacgugaaccccgcccuggcccuggagcagaagagagccgaggaggccguggccgccgugaugguggccagcugccccaaccaccccagcagagugagcaccgccgacaacaucuacgugaaccacagcuucgagggcagcaucaagggcgccggcgccaucagcaacuuccugcccaacaacggcagacaguucuaa

SEQ ID NO: 20671 - RNA, 456 nt, Artificial Sequence
  NPC2__Homo_sapiens__NP_006423
augagauuccuggccgccaccuuccugcugcuggcccugagcaccgccgcccaggccgagcccgugcaguucaaggacugcggcagcguggacggcgugaucaaggaggugaacgugagccccugccccacccagcccugccagcugagcaagggccagagcuacagcgugaacgugaccuucaccagcaacauccagagcaagagcagcaaggccguggugcacggcauccugaugggcgugcccgugcccuuccccauccccgagcccgacggcugcaagagcggcaucaacugccccauccagaaggacaagaccuacagcuaccugaacaagcugcccgugaagagcgaguaccccagcaucaagcuggugguggaguggcagcugcaggacgacaagaaccagagccuguucugcugggagauccccgugcagaucgugagccaccuguaa

SEQ ID NO: 20672 - RNA, 978 nt, Artificial Sequence
  NPDC1__Homo_sapiens__NP_056207
auggccaccccccugcccccccccagccccagacaccugagacugcugagacugcugcugagcggccuggugcugggcgccgcccugagaggcgccgccgccggccaccccgacguggccgccugccccggcagccuggacugcgcccugaagagaagagccagaugcccccccggcgcccacgccugcggccccugccugcagcccuuccaggaggaccagcagggccugugcgugcccagaaugagaagaccccccggcggcggcagaccccagcccagacuggaggacgagaucgacuuccuggcccaggagcuggccagaaaggagagcggccacagcacccccccccugcccaaggacagacagagacugcccgagcccgccacccugggcuucagcgccagaggccagggccuggagcugggccugcccagcacccccggcacccccacccccaccccccacaccagccugggcagccccgugagcagcgaccccgugcacaugagcccccuggagcccagaggcggccagggcgacggccuggcccuggugcugauccuggccuucugcguggccggcgccgccgcccugagcguggccagccugugcuggugcagacugcagagagagaucagacugacccagaaggccgacuacgccaccgccaaggcccccggcagccccgccgcccccagaaucagccccggcgaccagagacuggcccagagcgccgagauguaccacuaccagcaccagagacagcagaugcugugccuggagagacacaaggagccccccaaggagcuggacaccgccagcagcgacgaggagaacgaggacggcgacuucaccguguacgagugccccggccuggcccccaccggcgagauggaggugagaaacccccuguucgaccacgccgcccugagcgccccccugcccgcccccagcagcccccccgcccugcccuaa

SEQ ID NO: 20673 - RNA, 1488 nt, Artificial Sequence
  NPEPL1__Homo_sapiens__NP_001191801
auggagcugcacggcggcaacagaggcggcuaccagcccaaggcccuggagcagagcggcugcuggcuguggcaggccgcccugagcacccugaaccccaaccccaccgacagcugcccccuguaccugaacuacgccaccguggccgcccugcccugcagagugagcagacacaacagccccagcgccgcccacuucaucaccagacuggugagaaccugccugccccccggcgcccacagaugcaucgugauggugugcgagcagcccgagguguucgccagcgccugcgcccuggccagagccuucccccuguucacccacagaagcggcgccagcagaagacuggagaagaagaccgugaccguggaguucuuccuggugggccaggacaacggccccguggaggugagcacccugcagugccuggccaacgccaccgacggcgugagacuggccgccagaaucguggacacccccugcaacgagaugaacaccgacaccuuccuggaggagaucaacaaggugggcaaggagcugggcaucauccccaccaucaucagagacgaggagcugaagaccagaggcuucggcggcaucuacggcgugggcaaggccgcccugcacccccccgcccuggccgugcugagccacacccccgacggcgccacccagaccaucgccugggugggcaagggcaucguguacgacaccggcggccugagcaucaagggcaagaccaccaugcccggcaugaagagagacugcggcggcgccgccgccgugcugggcgccuucagagccgccaucaagcagggcuucaaggacaaccugcacgccguguucugccuggccgagaacagcgugggccccaacgccaccagacccgacgacauccaccugcuguacagcggcaagaccguggagaucaacaacaccgacgccgagggcagacuggugcuggccgacggcgugagcuacgccugcaaggaccugggcgccgacaucauccuggacauggccacccugaccggcgcccagggcaucgccaccggcaaguaccacgccgccgugcugaccaacagcgccgagugggaggccgccugcgugaaggccggcagaaagugcggcgaccuggugcacccccugguguacugccccgagcugcacuucagcgaguucaccagcgccguggccgacaugaagaacagcguggccgacagagacaacagccccagcagcugcgccggccuguucaucgccagccacaucggcuucgacuggcccggcgugugggugcaccuggacaucgccgcccccgugcacgccggcgagagagccaccggcuucggcguggcccugcugcuggcccuguucggcagagccagcgaggacccccugcugaaccuggugagcccccugggcugcgagguggacguggaggagggcgaccugggcagagacagcaagagaagaagacugguguaa

SEQ ID NO: 20674 - RNA, 2760 nt, Artificial Sequence
  NPEPPS__Homo_sapiens__NP_006301
auguggcuggccgccgccgcccccagccuggccagaagacugcuguuccugggcccccccccccccccccugcugcugcugguguucagcagaagcagcagaagaagacugcacagccugggccuggccgccaugcccgagaagagacccuucgagagacugcccgccgacgugagccccaucaacuacagccugugccugaagcccgaccugcuggacuucaccuucgagggcaagcuggaggccgccgcccaggugagacaggccaccaaccagaucgugaugaacugcgccgacaucgacaucaucaccgccagcuacgcccccgagggcgacgaggagauccacgccaccggcuucaacuaccagaacgaggacgagaaggugacccugagcuuccccagcacccugcagaccggcaccggcacccugaagaucgacuucgugggcgagcugaacgacaagaugaagggcuucuacagaagcaaguacaccacccccagcggcgaggugagauacgccgccgugacccaguucgaggccaccgacgccagaagagccuuccccugcugggacgagcccgccaucaaggccaccuucgacaucagccugguggugcccaaggacagaguggcccugagcaacaugaacgugaucgacagaaagcccuaccccgacgacgagaaccugguggaggugaaguucgccagaacccccgugaugagcaccuaccugguggccuucguggugggcgaguacgacuucguggagaccagaagcaaggacggcgugugcgugagaguguacacccccgugggcaaggccgagcagggcaaguucgcccuggagguggccgccaagacccugcccuucuacaaggacuacuucaacgugcccuacccccugcccaagaucgaccugaucgccaucgccgacuucgccgccggcgccauggagaacuggggccuggugaccuacagagagaccgcccugcugaucgaccccaagaacagcugcagcagcagcagacaguggguggcccugguggugggccacgagcuggcccaccagugguucggcaaccuggugaccauggagugguggacccaccuguggcugaacgagggcuucgccagcuggaucgaguaccugugcguggaccacugcuuccccgaguacgacaucuggacccaguucgugagcgccgacuacaccagagcccaggagcuggacgcccuggacaacagccaccccaucgaggugagcgugggccaccccagcgagguggacgagaucuucgacgccaucagcuacagcaagggcgccagcgugaucagaaugcugcacgacuacaucggcgacaaggacuucaagaagggcaugaacauguaccugaccaaguuccagcagaagaacgccgccaccgaggaccugugggagagccuggagaacgccagcggcaagcccaucgccgccgugaugaacaccuggaccaagcagaugggcuucccccugaucuacguggaggccgagcagguggaggacgacagacugcugagacugagccagaagaaguucugcgccggcggcagcuacgugggcgaggacugcccccaguggauggugcccaucaccaucagcaccagcgaggaccccaaccaggccaagcugaagauccugauggacaagcccgagaugaacguggugcugaagaacgugaagcccgaccagugggugaagcugaaccugggcaccgugggcuucuacagaacccaguacagcagcgccaugcuggagagccugcugcccggcaucagagaccugagccugccccccguggacagacugggccugcagaacgaccuguucagccuggccagagccggcaucaucagcaccguggaggugcugaaggugauggaggccuucgugaacgagcccaacuacaccguguggagcgaccugagcugcaaccugggcauccugagcacccugcugagccacaccgacuucuacgaggagauccaggaguucgugaaggacguguucagccccaucggcgagagacugggcugggaccccaagcccggcgagggccaccuggacgcccugcugagaggccuggugcugggcaagcugggcaaggccggccacaaggccacccuggaggaggccagaagaagauucaaggaccacguggagggcaagcagauccugagcgccgaccugagaagccccguguaccugaccgugcugaagcacggcgacggcaccacccuggacaucaugcugaagcugcacaagcaggccgacaugcaggaggagaagaacagaaucgagagagugcugggcgccacccugcugcccgaccugauccagaaggugcugaccuucgcccugagcgaggaggugagaccccaggacaccgugagcgugaucggcggcguggccggcggcagcaagcacggcagaaaggccgccuggaaguucaucaaggacaacugggaggagcuguacaacagauaccagggcggcuuccugaucagcagacugaucaagcugagcguggagggcuucgccguggacaagauggccggcgaggugaaggccuucuucgagagccaccccgcccccagcgccgagagaaccauccagcagugcugcgagaacauccugcugaacgccgccuggcugaagagagacgccgagagcauccaccaguaccugcugcagagaaaggccagcccccccaccguguaa

SEQ ID NO: 20675 - RNA, 342 nt, Artificial Sequence
  NPFF__Homo_sapiens__NP_003708
auggacagcagacaggccgccgcccugcuggugcugcugcugcugaucgacggcggcugcgccgagggccccggcggccagcaggaggaccagcugagcgccgaggaggacagcgagccccugcccccccaggacgcccagaccagcggcagccugcugcacuaccugcugcaggccauggagagacccggcagaagccaggccuuccuguuccagccccagagauucggcagaaacacccagggcagcuggagaaacgaguggcugagccccagagccggcgagggccugaacagccaguucuggagccuggccgccccccagagauucggcaagaaguaa

SEQ ID NO: 20676 - RNA, 1272 nt, Artificial Sequence
  NPFFR2__Homo_sapiens__NP_001138228
auguucaucaugaacgagaagugggacaccaacagcagcgagaacuggcaccccaucuggaacgugaacgacaccaagcaccaccuguacagcgacaucaacaucaccuacgugaacuacuaccugcaccagccccagguggccgccaucuucaucaucagcuacuuccugaucuucuuccugugcaugaugggcaacaccguggugugcuucaucgugaugagaaacaagcacaugcacaccgugaccaaccuguucauccugaaccuggccaucagcgaccugcuggugggcaucuucugcaugcccaucacccugcuggacaacaucaucgccggcuggcccuucggcaacaccaugugcaagaucagcggccuggugcagggcaucagcguggccgccagcguguucacccugguggccaucgccguggacagauuccagugcgugguguaccccuucaagcccaagcugaccaucaagaccgccuucgugaucaucaugaucaucugggugcuggccaucaccaucaugagccccagcgccgugaugcugcacgugcaggaggagaaguacuacagagugagacugaacagccagaacaagaccagccccguguacuggugcagagaggacuggcccaaccaggagaugagaaagaucuacaccaccgugcuguucgccaacaucuaccuggccccccugagccugaucgugaucauguacggcagaaucggcaucagccuguucagagccgccgugccccacaccggcagaaagaaccaggagcaguggcacguggugagcagaaagaagcagaagaucaucaagaugcugcugaucguggcccugcuguucauccugagcuggcugccccuguggacccugaugaugcugagcgacuacgccgaccugagccccaacgagcugcagaucaucaacaucuacaucuaccccuucgcccacuggcuggccuucggcaacagcagcgugaaccccaucaucuacggcuucuucaacgagaacuucagaagaggcuuccaggaggccuuccagcugcagcugugccagaagagagccaagcccauggaggccuacgcccugaaggccaagagccacgugcugaucaacaccagcaaccagcuggugcaggagagcaccuuccagaacccccacggcgagacccugcuguacagaaagagcgccgagaagccccagcaggagcuggugauggaggagcugaaggagaccaccaacagcagcgagaucuaa

SEQ ID NO: 20677 - RNA, 2202 nt, Artificial Sequence
  NPHP1__Homo_sapiens__NP_000263
augcuggccagaagacagagagacccccugcaggcccugagaagaagaaaccaggagcugaagcagcagguggacagccugcugagcgagagccagcugaaggaggcccuggagcccaacaagagacagcacaucuaccagagaugcauccagcugaagcaggccaucgacgagaacaagaacgcccugcagaagcugagcaaggccgacgagagcgcccccguggccaacuacaaccagagaaaggaggaggagcacacccugcuggacaagcugacccagcagcugcagggccuggccgugaccaucagcagagagaacaucaccgaggugggcgcccccaccgaggaggaggaggagagcgagagcgaggacagcgaggacagcggcggcgaggaggaggacgccgaggaggaggaggaggagaaggaggagaacgagagccacaaguggagcaccggcgaggaguacaucgccgugggcgacuucaccgcccagcaggugggcgaccugaccuucaagaagggcgagauccugcuggugaucgagaagaagcccgacggcugguggaucgccaaggacgccaagggcaacgagggccuggugcccagaaccuaccuggagcccuacagcgaggaggaggagggccaggagagcagcgaggagggcagcgaggaggacguggaggccguggacgagaccgccgacggcgccgaggugaagcagagaaccgacccccacuggagcgccgugcagaaggccaucagcgaggccggcaucuucugccuggugaaccacgugagcuucugcuaccugaucgugcugaugagaaacagaauggagaccguggaggacaccaacggcagcgagaccggcuucagagccuggaacgugcagagcagaggcagaaucuuccuggugagcaagcccgugcugcagcagaucaacaccguggacgugcugaccaccaugggcgccauccccgccggcuucagacccagcacccugagccagcugcuggaggagggcaaccaguucagagccaacuacuuccugcagcccgagcugaugcccagccagcuggccuucagagaccugaugugggacgccaccgagggcaccaucagaagcagacccagcagaaucagccugauccugacccuguggagcugcaagaugaucccccugcccggcaugagcauccaggugcugagcagacacgugagacugugccuguucgacggcaacaaggugcugagcaacauccacaccgugagagccaccuggcagcccaagaagcccaagaccuggaccuucagcccccaggugaccagaauccugcccugccugcuggacggcgacugcuucaucagaagcaacagcgccagccccgaccugggcauccuguucgagcugggcaucagcuacaucagaaacagcaccggcgagagaggcgagcugagcugcggcuggguguuccugaagcuguucgacgccagcggcgugcccauccccgccaagaccuacgagcuguuccugaacggcggcacccccuacgagaagggcaucgagguggaccccagcaucagcagaagagcccacggcagcguguucuaccagaucaugaccaugagaagacagccccagcugcuggugaagcugagaagccugaacagaagaagcagaaacgugcugagccugcugcccgagacccugaucggcaacaugugcagcauccaccugcugaucuucuacagacagauccugggcgacgugcugcugaaggacagaaugagccugcagagcaccgaccugaucagccaccccaugcuggccaccuuccccaugcugcuggagcagcccgacgugauggacgcccugagaagcagcugggccggcaaggagagcacccugaagagaagcgagaagagagacaaggaguuccugaagagcaccuuccugcugguguaccacgacugcgugcugccccugcugcacagcaccagacugccccccuucagaugggccgaggaggagaccgagaccgccagauggaaggugaucaccgacuuccugaagcagaaccaggagaaccagggcgcccugcaggcccugcugagccccgacggcgugcacgagcccuucgaccugagcgagcagaccuacgacuuccugggcgagaugagaaagaacgccguguaa

SEQ ID NO: 20678 - RNA, 3993 nt, Artificial Sequence
  NPHP3__Homo_sapiens__NP_694972
augggcaccgccagcagccuggugagccccgccggcggcgaggugaucgaggacaccuacggcgccggcggcggcgaggccugcgagauccccguggaggugaagcccaaggccagacugcugagaaacagcuucagaagaggcgccggcgccgccgccggcgccggccccggcagccugcccagaggcgugggcgccggcggccugcugggcgccagcuucaagagcaccggcagcagcgugcccgagcuggaguacgccgccgccgaguacgagagacugagaaaggaguacgagaucuucagagugagcaagaaccaggagcugcugagcaugggcagaagagaggccaagcuggacaccgagaacaagagacugagagccgagcugcaggcccugcagaagaccuaccagaagauccugagagagaaggagagcgcccuggaggccaaguaccaggccauggagagagccgccaccuucgagcacgacagagacaaggugaagagacaguucaagaucuucagagagaccaaggagaacgagauccaggaccugcugagagccaagagagagcuggagagcaagcugcagagacugcaggcccagggcauccagguguucgaccccggcgagagcgacagcgacgacaacugcaccgacgugaccgccgccggcacccagugcgaguacuggaccggcggcgcccugggcagcgagcccagcaucggcagcaugauccagcugcagcagagcuucagaggccccgaguucgcccacagcagcaucgacguggagggccccuucgccaacgugaacagagacgacugggacaucgccguggccagccugcugcaggugaccccccuguucagccacagccuguggagcaacaccgugagaugcuaccugaucuacaccgacgagacccagcccgagauggaccuguuccugaaggacuacagccccaagcugaagagaaugugcgagaccaugggcuacuucuuccacgccguguacuuccccaucgacguggagaaccaguaccugaccgugagaaagugggagaucgagaagagcagccuggugauccuguucauccaccugacccugcccagccugcugcuggaggacugcgaggaggccuuccugaagaaccccgagggcaagcccagacugaucuuccacagacuggaggacggcaaggugagcagcgacagcgugcagcagcugaucgaccaggugagcaaccugaacaagaccagcaaggccaagaucaucgaccacagcggcgaccccgccgagggcguguacaagaccuacaucugcguggagaagaucaucaagcaggacauccugggcuucgagaacaccgaccuggagaccaaggaccugggcagcgaggacagcauccccgaggaggacgacuucggcgacgugcugugggacauccacgacgagcaggagcagauggagaccuuccagcaggccagcaacagcgcccacgagcugggcuucgagaaguacuaccagagacugaacgaccugguggccgcccccgcccccauccccccccugcuggugagcggcggccccggcagcggcaagagccugcugcugagcaaguggauccagcugcagcagaagaacagccccaacacccugauccugagccacuucgugggcagacccaugagcaccagcagcgagagcagccugaucaucaagagacugacccugaagcugaugcagcacagcuggagcgugagcgcccugacccuggaccccgccaagcugcuggaggaguuccccagauggcuggagaagcugagcgccagacaccagggcagcaucaucaucgugaucgacagcaucgaccaggugcagcagguggagaagcacaugaaguggcugaucgacccccugcccgugaacgugagagugaucgugagcgugaacguggagaccugcccccccgccuggagacuguggcccacccugcaccuggacccccugagccccaaggacgccaagagcaucaucaucgccgagugccacagcguggacaucaagcugagcaaggagcaggagaagaagcuggagagacacugcagaagcgccaccaccugcaacgcccuguacgugacccuguucggcaagaugaucgccagagccggcagagccggcaaccuggacaagauccugcaccagugcuuccagugccaggacacccugagccuguacagacuggugcugcacagcaucagagagagcauggccaacgacguggacaaggagcugaugaagcagauccugugccuggugaacgugagccacaacggcgugagcgagagcgagcugauggagcuguaccccgagaugagcuggaccuuccugaccagccugauccacagccuguacaagaugugccugcugaccuacggcugcggccugcugagauuccagcaccugcaggccugggagaccgugagacuggaguaccuggagggccccaccgugaccagcagcuacagacagaagcugaucaacuacuucacccugcagcugagccaggacagagugaccuggagaagcgccgacgagcugcccuggcuguuccagcagcagggcagcaagcagaagcugcacgacugccugcugaaccuguucgugagccagaaccuguacaagagaggccacuucgccgagcugcugagcuacuggcaguucgugggcaaggacaagagcgccauggccaccgaguacuucgacagccugaagcaguacgagaagaacugcgagggcgaggacaacaugagcugccuggccgaccuguacgagacccugggcagauuccugaaggaccugggccugcugagccaggccaucgugccccugcagagaagccuggagaucagagagaccgcccuggaccccgaccaccccagaguggcccagagccugcaccagcuggccagcguguacgugcaguggaagaaguucggcaacgccgagcagcuguacaagcaggcccuggagaucagcgagaacgccuacggcgccgaccaccccuacaccgccagagagcuggaggcccuggccacccuguaccagaagcagaacaaguacgagcaggccgagcacuucagaaagaagagcuucaagauccaccagaaggccaucaagaagaagggcaaccuguacggcuucgcccugcugagaagaagagcccugcagcuggaggagcugacccugggcaaggacacccccgacaacgccagaacccugaacgagcugggcgugcuguacuaccugcagaacaaccuggagaccgccgaccaguuccugaagagaagccuggagaugagagagagagugcugggccccgaccaccccgacugcgcccagagccugaacaaccuggccgcccugugcaacgagaagaagcaguacgacaaggccgaggagcuguacgagagagcccuggacaucagaagaagagcccuggcccccgaccaccccagccuggccuacaccgugaagcaccuggccauccuguacaagaagaugggcaagcuggacaaggccgugccccuguacgagcuggccguggagaucagacagaagagcuucggccccaagcaccccagcguggccaccgcccuggugaaccuggccgugcuguacagccagaugaagaagcacguggaggcccugccccuguacgagagagcccugaagaucuacgaggacagccugggcagaaugcaccccagagugggcgagacccugaagaaccuggccgugcugagcuacgagggcggcgacuucgagaaggccgccgagcuguacaagagagccauggagaucaaggaggccgagaccagccugcugggcggcaaggcccccagcagacacagcagcagcggcgacaccuucagccugaagaccgcccacagccccaacguguuccugcagcagggccagagauaa

SEQ ID NO: 20679 - RNA, 2742 nt, Artificial Sequence
  NPHP4__Homo_sapiens__NP_001278522
augcaccccagaagccugagcguggcccccaaguggagcggcggccugcccggcaaccaccccagaccccugagagaguucccccuggaggccggcaucagccaccuggaggccgaccugagccagaccagccuggugcuggagaccagcaucgccgagcagcugcaggagcugcccuucaccccccugcacgcccccaucguggugggcacccagaccagaagcagcgccggccagcccagcagagccagcauggugcugcugcagagcagcggcuuccccgagauccuggacgccaacaagcagcccgccgaggccgugagcgccaccgagcccgugaccuucaacccccagaaggaggagagcgacugccugcagagcaacgagauggugcugcaguuccuggccuucagcagaguggcccaggacugcagaggcaccagcuggcccaagaccguguacuucaccuuccaguucuacagauucccccccgccaccacccccagacugcagcuggugcagcuggacgaggccggccagcccagcagcggcgcccugacccacauccuggugcccgugagcagagacggcaccuucgacgccggcagccccggcuuccagcugagauacauggugggccccggcuuccugaagcccggcgagagaagaugcuucgccagauaccuggccgugcagacccugcagaucgacgugugggacggcgacagccugcugcugaucggcagcgccgccgugcagaugaagcaccugcugagacagggcagacccgccgugcaggccagccacgagcuggaggugguggccaccgaguacgagcaggacaacaugguggugagcggcgacaugcugggcuucggcagagugaagcccaucggcgugcacagcguggugaagggcagacugcaccugacccuggccaacgugggccaccccugcgagcagaaggugagaggcugcagcacccugccccccagcagaagcagagugaucagcaacgacggcgccagcagauucagcggcggcagccugcugaccaccggcagcagcagaagaaagcacguggugcaggcccagaagcuggccgacguggacagcgagcuggccgccaugcugcugacccacgccagacagggcaagggcccccaggacgugagcagagagagcgacgccaccagaagaagaaagcuggagagaaugagaagcgugagacugcaggaggccggcggcgaccugggcagaagaggcaccagcgugcuggcccagcagagcgugagaacccagcaccugagagaccugcaggugaucgccgccuacagagagagaaccaaggccgagagcaucgccagccugcugagccuggccaucaccaccgagcacacccugcacgccacccugggcguggccgaguucuucgaguucgugcugaagaacccccacaacacccagcacaccgugaccguggagaucgacaaccccgagcugagcgugaucguggacagccaggaguggagagacuucaagggcgccgccggccugcacacccccguggaggaggacauguuccaccugagaggcagccuggccccccagcuguaccugagaccccacgagaccgcccacgugcccuucaaguuccagagcuucagcgccggccagcuggccauggugcaggccagccccggccugagcaacgagaagggcauggacgccgugagccccuggaagagcagcgccgugcccaccaagcacgccaaggugcuguucagagccagcggcggcaagcccaucgccgugcugugccugaccguggagcugcagccccacgugguggaccagguguucagauucuaccaccccgagcugagcuuccugaagaaggccaucagacugccccccuggcacaccuuccccggcgcccccgugggcaugcugggcgaggacccccccgugcacgugagaugcagcgaccccaacgugaucugcgagacccagaacgugggccccggcgagcccagagacaucuuccugaagguggccagcggccccagccccgagaucaaggacuucuucgugaucaucuacagcgacagauggcuggccacccccacccagaccuggcagguguaccugcacagccugcagagaguggacgugagcugcguggccggccagcugaccagacugagccuggugcugagaggcacccagaccgugagaaaggugagagccuucaccagccacccccaggagcugaagaccgaccccaagggcguguucgugcugccccccagaggcgugcaggaccugcacgugggcgugagaccccugagagccggcagcagauucgugcaccugaaccugguggacguggacugccaccagcugguggccagcuggcuggugugccugugcugcagacagccccugaucagcaaggccuucgagaucaugcuggccgccggcgagggcaagggcgugaacaagagaaucaccuacaccaaccccuaccccagcagaagaaccuuccaccugcacagcgaccaccccgagcugcugagauucagagaggacagcuuccaggugggcggcggcgagaccuacaccaucggccugcaguucgcccccagccagagagugggcgaggaggagauccugaucuacaucaacgaccacgaggacaagaacgaggaggccuucugcgugaaggugaucuaccaguaa

SEQ ID NO: 20680 - RNA, 3726 nt, Artificial Sequence
  NPHS1__Homo_sapiens__NP_004637
auggcccugggcaccacccugagagccagccugcugcugcugggccugcugaccgagggccuggcccagcuggccauccccgccagcgugcccagaggcuucugggcccugcccgagaaccugaccgugguggagggcgccagcguggagcugagaugcggcgugagcacccccggcagcgccgugcagugggccaaggacggccugcugcugggccccgaccccagaauccccggcuuccccagauacagacuggagggcgaccccgccagaggcgaguuccaccugcacaucgaggccugcgaccugagcgacgacgccgaguacgagugccaggugggcagaagcgagaugggccccgagcuggugagccccagagugauccugagcauccuggugccccccaagcugcugcugcugacccccgaggccggcaccauggugaccuggguggccggccaggaguacguggugaacugcgugagcggcgacgccaagcccgcccccgacaucaccauccugcugagcggccagaccaucagcgacaucagcgccaacgugaacgagggcagccagcagaagcuguucaccguggaggccaccgccagagugacccccagaagcagcgacaacagacagcugcuggugugcgaggccagcagccccgcccuggaggcccccaucaaggccagcuucaccgugaacgugcuguucccccccggcccccccgugaucgaguggcccggccuggacgagggccacgugagagccggccagagccuggagcugcccugcguggccagaggcggcaacccccuggccacccugcaguggcugaagaacggccagcccgugagcaccgccuggggcaccgagcacacccaggccguggccagaagcgugcuggugaugaccgugagacccgaggaccacggcgcccagcugagcugcgaggcccacaacagcgugagcgccggcacccaggagcacggcaucacccugcaggugaccuucccccccagcgccaucaucauccugggcagcgccagccagaccgagaacaagaacgugacccugagcugcgugagcaagagcagcagacccagagugcugcugagaugguggcugggcuggagacagcugcugcccauggaggagaccgugauggacggccugcacggcggccacaucagcaugagcaaccugaccuuccuggccagaagagaggacaacggccugacccugaccugcgaggccuucagcgaggccuucaccaaggagaccuucaagaagagccugauccugaacgugaaguaccccgcccagaagcuguggaucgagggcccccccgagggccagaagcugagagccggcaccagagugagacuggugugccuggccaucggcggcaaccccgagcccagccugaugugguacaaggacagcagaaccgugaccgagagcagacugccccaggagagcagaagagugcaccugggcagcguggagaagagcggcagcaccuucagcagagagcuggugcuggugaccggccccagcgacaaccaggccaaguucaccugcaaggccggccagcugagcgccagcacccagcuggccgugcaguucccccccaccaacgugaccauccuggccaacgccagcgcccugagacccggcgacgcccugaaccugaccugcgugagcgugagcagcaacccccccgugaaccugagcugggacaaggagggcgagagacuggagggcguggccgccccccccagaagagcccccuucaagggcagcgccgccgccagaagcgugcugcugcaggugagcagcagagaccacggccagagagugaccugcagagcccacagcgccgagcugagagagaccgugagcagcuucuacagacugaacgugcuguacagacccgaguuccugggcgagcaggugcugguggugaccgccguggagcagggcgaggcccugcugcccgugagcgugagcgccaaccccgcccccgaggccuucaacuggaccuucagaggcuacagacugagccccgccggcggccccagacacagaauccugagcagcggcgcccugcaccuguggaacgugaccagagccgacgacggccuguaccagcugcacugccagaacagcgagggcaccgccgaggccagacugagacuggacgugcacuacgcccccaccaucagagcccugcaggaccccaccgaggugaacgugggcggcagcguggacaucgugugcaccguggacgccaaccccauccugcccggcauguucaacugggagagacugggcgaggacgaggaggaccagagccuggacgacauggagaagaucagcagaggccccaccggcagacugagaauccaccacgccaagcuggcccaggccggcgccuaccagugcaucguggacaacggcguggccccccccgccagaagacugcugagacugguggugagauucgccccccagguggagcaccccaccccccugaccaagguggccgccgccggcgacagcaccagcagcgccacccugcacugcagagccagaggcgugcccaacaucguguucaccuggaccaagaacggcgugccccuggaccugcaggaccccagauacaccgagcacaccuaccaccagggcggcgugcacagcagccugcugaccaucgccaacgugagcgccgcccaggacuacgcccuguucaccugcaccgccaccaacgcccugggcagcgaccagaccaacauccagcuggugagcaucagcagacccgacccccccagcggccugaagguggugagccugaccccccacagcgugggccuggaguggaagcccggcuucgacggcggccugccccagagauucugcaucagauacgaggcccugggcacccccggcuuccacuacguggacguggugcccccccaggccaccaccuucacccugaccggccugcagcccagcaccagauacagaguguggcugcuggccagcaacgcccugggcgacagcggccuggccgacaagggcacccagcugcccaucaccacccccggccugcaccagcccagcggcgagcccgaggaccagcugcccaccgagccccccagcggccccagcggccugccccugcugcccgugcuguucgcccugggcggccugcugcugcugagcaacgccagcugcgugggcggcgugcuguggcagagaagacugagaagacuggccgagggcaucagcgagaagaccgaggccggcagcgaggaggacagagugagaaacgaguacgaggagagccaguggaccggcgagagagacacccagagcagcaccgugagcaccaccgaggccgagcccuacuacagaagccugagagacuucagcccccagcugccccccacccaggaggaggugagcuacagcagaggcuucaccggcgaggacgaggacauggccuuccccggccaccuguacgacgagguggagagaaccuacccccccagcggcgccuggggcccccuguacgacgaggugcagaugggccccugggaccugcacuggcccgaggacaccuaccaggaccccagaggcaucuacgaccagguggccggcgaccuggacacccuggagcccgacagccugcccuucgagcugagaggccaccugguguaa

SEQ ID NO: 20681 - RNA, 948 nt, Artificial Sequence
  NPHS2__Homo_sapiens__NP_001284504
auggagagaagagccagaagcagcagcagagagagcagaggcagaggcggcagaaccccccacaaggagaacaagagagccaaggccgagagaagcggcggcggcagaggcagacaggaggccggccccgagcccagcggcagcggcagagccggcacccccggcgagcccagagcccccgccgccaccgugguggacguggacgaggugagaggcagcggcgaggagggcaccgaggugguggcccugcuggagagcgagagacccgaggagggcaccaagagcagcggccugggcgccugcgaguggcugcuggugcugaucagccugcuguucaucaucaugaccuuccccuucagcaucugguucugcgugaagguggugcaggaguacgagagagugaucaucuucagacugggccaccugcugcccggcagagccaagggccccggccuguucuucuuccugcccugccuggacaccuaccacaagguggaccugagacugcagacccuggagauccccuuccacgagguggcccuggacagcgugaccugcaucuggggcaucaagguggagagaaucgagaucaaggacgugagacugcccgccggccugcagcacagccuggccguggaggccgaggcccagagacaggccaaggugagaaugaucgccgccgaggccgagaaggccgccagcgagagccugagaauggccgccgagauccugagcggcacccccgccgccgugcagcugagauaccugcacacccugcagagccugagcaccgagaagcccagcaccguggugcugccccugcccuucgaccugcugaacugccugagcagccccagcaacagaacccagggcagccugcccuuccccagccccagcaagcccguggagccccugaaccccaagaagaaggacagccccaugcuguaa

SEQ ID NO: 20682 - RNA, 906 nt, Artificial Sequence
  NPL__Homo_sapiens__NP_001186979
augagcagagcccccggcauccuggccagcuggagaagagcccccagccugagcgugcagaagggcagccagaccgccagacacaccugccaccccgaggugccccugggcaacugcuuccugcccguguacaaggccagcccccugaccgugaccagacugugggccgagagacuggaccaggugaucauccacgugggcgcccugagccugaaggagagccaggagcuggcccagcacgccgccgagaucggcgccgacggcaucgccgugaucgcccccuucuuccugaagcccuggaccaaggacauccugaucaacuuccugaaggagguggccgccgccgcccccgcccugcccuucuacuacuaccacauccccgcccugaccggcgugaagaucagagccgaggagcugcuggacggcauccuggacaagauccccaccuuccagggccugaaguucagcgacaccgaccugcuggacuucggccagugcguggaccagaacagacagcagcaguucgccuuccuguucggcguggacgagcagcugcugagcgcccuggugaugggcgccaccggcgccgugggcagcaccuacaacuaccugggcaagaagaccaaccagaugcuggaggccuucgagcagaaggacuucagccuggcccugaacuaccaguucugcauccagagauucaucaacuucguggugaagcugggcuucggcgugagccagaccaaggccaucaugacccuggugagcggcauccccaugggcccccccagacugccccugcagaaggccagcagagaguucaccgacagcgccgaggccaagcugaagagccuggacuuccugagcuucaccgaccugaaggacggcaaccuggaggccggcagcuaa

SEQ ID NO: 20683 - RNA, 1827 nt, Artificial Sequence
  NPLOC4__Homo_sapiens__NP_060391
auggccgagagcaucaucaucagagugcagagccccgacggcgugaagagaaucaccgccaccaagagagagaccgccgccaccuuccugaagaagguggccaaggaguucggcuuccagaacaacggcuucagcguguacaucaacagaaacaagaccggcgagaucaccgccagcagcaacaagagccugaaccugcugaagaucaagcacggcgaccugcuguuccuguuccccagcagccuggccggccccagcagcgagauggagaccagcgugccccccggcuucaagguguucggcgcccccaacgugguggaggacgagaucgaccaguaccugagcaagcaggacggcaagaucuacagaagcagagacccccagcugugcagacacggcccccugggcaagugcgugcacugcgugccccuggagcccuucgacgaggacuaccugaaccaccuggagccccccgugaagcacaugagcuuccacgccuacaucagaaagcugaccggcggcgccgacaagggcaaguucguggcccuggagaacaucagcugcaagaucaagagcggcugcgagggccaccugcccuggcccaacggcaucugcaccaagugccagcccagcgccaucacccugaacagacagaaguacagacacguggacaacaucauguucgagaaccacaccguggccgacagauuccuggacuucuggagaaagaccggcaaccagcacuucggcuaccuguacggcagauacaccgagcacaaggacaucccccugggcaucagagccgagguggccgccaucuacgagcccccccagaucggcacccagaacagccuggagcugcuggaggaccccaaggccgaggugguggacgagaucgccgccaagcugggccugagaaaggugggcuggaucuucaccgaccuggugagcgaggacaccagaaagggcaccgugagauacagcagaaacaaggacaccuacuuccugagcagcgaggagugcaucaccgccggcgacuuccagaacaagcaccccaacaugugcagacugagccccgacggccacuucggcagcaaguucgugaccgccguggccaccggcggccccgacaaccaggugcacuucgagggcuaccaggugagcaaccagugcauggcccuggugagagacgagugccugcugcccugcaaggacgcccccgagcugggcuacgccaaggagagcagcagcgagcaguacgugcccgacguguucuacaaggacguggacaaguucggcaacgagaucacccagcuggccagaccccugcccguggaguaccugaucaucgacaucaccaccaccuuccccaaggaccccguguacaccuucagcaucagccagaaccccuuccccaucgagaacagagacgugcugggcgagacccaggacuuccacagccuggccaccuaccugagccagaacaccagcagcguguuccuggacaccaucagcgacuuccaccugcugcuguuccuggugaccaacgaggugaugccccugcaggacagcaucagccugcugcuggaggccgugagaaccagaaacgaggagcuggcccagaccuggaagagaagcgagcagugggccaccaucgagcagcugugcagcaccgugggcggccagcugcccggccugcacgaguacggcgccgugggcggcagcacccacaccgccaccgccgccaugugggccugccagcacugcaccuucaugaaccagcccggcaccggccacugcgagaugugcagccugcccagaaccuaa

SEQ ID NO: 20684 - RNA, 780 nt, Artificial Sequence
  NPM1__Homo_sapiens__NP_001032827
auggaggacagcauggacauggacaugagcccccugagaccccagaacuaccuguucggcugcgagcugaaggccgacaaggacuaccacuucaagguggacaacgacgagaacgagcaccagcugagccugagaaccgugagccugggcgccggcgccaaggacgagcugcacaucguggaggccgaggccaugaacuacgagggcagccccaucaaggugacccuggccacccugaagaugagcgugcagcccaccgugagccugggcggcuucgagaucaccccccccguggugcugagacugaagugcggcagcggccccgugcacaucagcggccagcaccugguggccguggaggaggacgccgagagcgaggacgaggaggaggaggacgugaagcugcugagcaucagcggcaagagaagcgcccccggcggcggcagcaaggugccccagaagaaggugaagcuggccgccgacgaggacgacgacgacgacgacgaggaggacgacgacgaggacgacgacgacgacgacuucgacgacgaggaggccgaggagaaggcccccgugaagaagagcaucagagacacccccgccaagaacgcccagaagagcaaccagaacggcaaggacagcaagcccagcagcacccccagaagcaagggccaggagagcuucaagaagcaggagaagacccccaagacccccaagggccccagcagcguggaggacaucaaggccaagaugcaggccagcaucgagaaggcccacuaa

SEQ ID NO: 20685 - RNA, 411 nt, Artificial Sequence
  NPM2__Homo_sapiens__NP_001273610
augaaccugagcagcgccagcagcaccgaggagaaggccgugaccaccgugcuguggggcugcgagcugagccaggagagaagaaccuggaccuucagaccccagcuggagggcaagcagagcugcagacugcugcugcacaccaucugccugggcgagaaggccaaggaggagaugcacagaguggagauccugccccccgccaaccaggaggacaagaagaugcagcccgugaccaucgccagccugcaggccagcgugcugcccauggugagcauggugggcgugcagcugagcccccccgugaccuuccagcugagagccggcagcggccccguguuccugagcggccaggagagauacgagaagaaggccggcaagagaagaagaggcaacaagagccagagauaa

SEQ ID NO: 20686 - RNA, 1698 nt, Artificial Sequence
  NPNT__Homo_sapiens__NP_001028219
auggacuuccugcuggcccuggugcuggugagcagccuguaccugcaggccgccgccgaguucgacggcagauggcccagacagaucgugagcagcaucggccugugcagauacggcggcagaaucgacugcugcuggggcugggccagacagagcuggggccagugccagcccgugugccagcccagaugcaagcacggcgagugcaucggccccaacaagugcaagugccaccccggcuacgccggcaagaccugcaaccaggaccugaacgagugcggccugaagcccagacccugcaagcacagaugcaugaacaccuacggcagcuacaagugcuacugccugaacggcuacaugcugaugcccgacggcagcugcagcagcgcccugaccugcagcauggccaacugccaguacggcugcgacguggugaagggccagaucagaugccagugccccagccccggccugcagcuggcccccgacggcagaaccugcguggacguggacgagugcgccaccggcagagccagcugccccagauucagacagugcgugaacaccuucggcagcuacaucugcaagugccacaagggcuucgaccugauguacaucggcggcaaguaccagugccacgacaucgacgagugcagccugggccaguaccagugcagcagcuucgccagaugcuacaacaucagaggcagcuacaagugcaagugcaaggagggcuaccagggcgacggccugaccugcguguacauccccaaggugaugaucgagcccagcggccccauccacgugcccaagggcaacggcaccauccugaagggcgacaccggcaacaacaacuggauccccgacgugggcagcaccugguggccccccaagacccccuacaucccccccaucaucaccaacagacccaccagcaagcccaccaccagacccacccccaagcccacccccauccccacccccccccccccccccccccugcccaccgagcugagaaccccccugccccccaccacccccgagagacccaccaccggccugaccaccaucgcccccgccgccagcaccccccccggcggcaucaccguggacaacagagugcagaccgacccccagaagcccagaggcgacguguucauccccagacagcccagcaacgaccuguucgagaucuucgagaucgagagaggcgugagcgccgacgacgaggccaaggacgaccccggcgugcuggugcacagcugcaacuucgaccacggccugugcggcuggaucagagagaaggacaacgaccugcacugggagcccaucagagaccccgccggcggccaguaccugaccgugagcgccgccaaggcccccggcggcaaggccgccagacuggugcugccccugggcagacugaugcacagcggcgaccugugccugagcuucagacacaaggugaccggccugcacagcggcacccugcagguguucgugagaaagcacggcgcccacggcgccgcccuguggggcagaaacggcggccacggcuggagacagacccagaucacccugagaggcgccgacaucaagagcgugguguucaagggcgagaagagaagaggccacaccggcgagaucggccuggacgacgugagccugaagaagggccacugcagcgaggagagauaa

SEQ ID NO: 20687 - RNA, 381 nt, Artificial Sequence
  NPPC__Homo_sapiens__NP_077720
augcaccugagccagcugcuggccugcgcccugcugcugacccugcugagccugagacccagcgaggccaagcccggcgccccccccaaggugcccagaaccccccccgccgaggagcuggccgagccccaggccgccggcggcggccagaagaagggcgacaaggcccccggcggcggcggcgccaaccugaagggcgacagaagcagacugcugagagaccugagaguggacaccaagagcagagccgccugggccagacugcugcaggagcaccccaacgccagaaaguacaagggcgccaacaagaagggccugagcaagggcugcuucggccugaagcuggacagaaucggcagcaugagcggccugggcugcuaa

SEQ ID NO: 20688 - RNA, 3186 nt, Artificial Sequence
  NPR1__Homo_sapiens__NP_000897
augcccggccccagaagacccgccggcagcagacugagacugcugcugcugcugcugcugcccccccugcugcugcugcugagaggcagccacgccggcaaccugaccguggccguggugcugccccuggccaacaccagcuaccccuggagcugggccagagugggccccgccguggagcuggcccuggcccaggugaaggccagacccgaccugcugcccggcuggaccgugagaaccgugcugggcagcagcgagaacgcccugggcgugugcagcgacaccgccgccccccuggccgccguggaccugaagugggagcacaaccccgccguguuccugggccccggcugcguguacgccgccgcccccgugggcagauucaccgcccacuggagagugccccugcugaccgccggcgcccccgcccugggcuucggcgugaaggacgaguacgcccugaccaccagagccggccccagcuacgccaagcugggcgacuucguggccgcccugcacagaagacugggcugggagagacaggcccugaugcuguacgccuacagacccggcgacgaggagcacugcuucuuccugguggagggccuguucaugagagugagagacagacugaacaucaccguggaccaccuggaguucgccgaggacgaccugagccacuacaccagacugcugagaaccaugcccagaaagggcagagugaucuacaucugcagcagccccgacgccuucagaacccugaugcugcuggcccuggaggccggccugugcggcgaggacuacguguucuuccaccuggacaucuucggccagagccugcagggcggccagggccccgcccccagaagacccugggagagaggcgacggccaggacgugagcgccagacaggccuuccaggccgccaagaucaucaccuacaaggaccccgacaaccccgaguaccuggaguuccugaagcagcugaagcaccuggccuacgagcaguucaacuucaccauggaggacggccuggugaacaccauccccgccagcuuccacgacggccugcugcuguacauccaggccgugaccgagacccuggcccacggcggcaccgugaccgacggcgagaacaucacccagagaauguggaacagaagcuuccagggcgugaccggcuaccugaagaucgacagcagcggcgacagagagaccgacuucagccugugggacauggaccccgagaacggcgccuucagaguggugcugaacuacaacggcaccagccaggagcugguggccgugagcggcagaaagcugaacuggccccugggcuaccccccccccgacauccccaagugcggcuucgacaacgaggaccccgccugcaaccaggaccaccugagcacccuggaggugcuggcccuggugggcagccugagccugcugggcauccugaucgugagcuucuucaucuacagaaagaugcagcuggagaaggagcuggccagcgagcuguggagagugagaugggaggacguggagcccagcagccuggagagacaccugagaagcgccggcagcagacugacccugagcggcagaggcagcaacuacggcagccugcugaccaccgagggccaguuccagguguucgccaagaccgccuacuacaagggcaaccugguggccgugaagagagugaacagaaagagaaucgagcugaccagaaaggugcuguucgagcugaagcacaugagagacgugcagaacgagcaccugaccagauucgugggcgccugcaccgacccccccaacaucugcauccugaccgaguacugccccagaggcagccugcaggacauccuggagaacgagagcaucacccuggacuggauguucagauacagccugaccaacgacaucgugaagggcaugcuguuccugcacaacggcgccaucugcagccacggcaaccugaagagcagcaacugcgugguggacggcagauucgugcugaagaucaccgacuacggccuggagagcuucagagaccuggaccccgagcagggccacaccguguacgccaagaagcuguggaccgcccccgagcugcugagaauggccagcccccccgugagaggcagccaggccggcgacguguacagcuucggcaucauccugcaggagaucgcccugagaagcggcguguuccacguggagggccuggaccugagccccaaggagaucaucgagagagugaccagaggcgagcagccccccuucagacccagccuggcccugcagagccaccuggaggagcugggccugcugaugcagagaugcugggccgaggacccccaggagagaccccccuuccagcagaucagacugacccugagaaaguucaacagagagaacagcagcaacauccuggacaaccugcugagcagaauggagcaguacgccaacaaccuggaggagcugguggaggagagaacccaggccuaccuggaggagaagagaaaggccgaggcccugcuguaccagauccugccccacagcguggccgagcagcugaagagaggcgagaccgugcaggccgaggccuucgacagcgugaccaucuacuucagcgacaucgugggcuucaccgcccugagcgccgagagcacccccaugcagguggugacccugcugaacgaccuguacaccugcuucgacgccgugaucgacaacuucgacguguacaagguggagaccaucggcgacgccuacaugguggugagcggccugcccgugagaaacggcagacugcacgccugcgagguggccagaauggcccuggcccugcuggacgccgugagaagcuucagaaucagacacagaccccaggagcagcugagacugagaaucggcauccacaccggccccgugugcgccggcguggugggccugaagaugcccagauacugccuguucggcgacaccgugaacaccgccagcagaauggagagcaacggcgaggcccugaagauccaccugagcagcgagaccaaggccgugcuggaggaguucggcggcuucgagcuggagcugagaggcgacguggagaugaagggcaagggcaaggugagaaccuacuggcugcugggcgagagaggcagcagcaccagaggcuaa

SEQ ID NO: 20689 - RNA, 3144 nt, Artificial Sequence
  NPR2__Homo_sapiens__NP_003986
auggcccugcccagccugcugcugcugguggccgcccuggccggcggcgugagaccccccggcgccagaaaccugacccuggccguggugcugcccgagcacaaccugagcuacgccugggccuggcccagagugggccccgccguggcccuggccguggaggcccugggcagagcccugcccguggaccugagauucgugagcagcgagcuggagggcgccugcagcgaguaccuggccccccugagcgccguggaccugaagcuguaccacgaccccgaccugcugcugggccccggcugcguguaccccgccgccagcguggccagauucgccagccacuggagacugccccugcugaccgccggcgccguggccagcggcuucagcgccaagaacgaccacuacagaacccuggugagaaccggccccagcgcccccaagcugggcgaguucguggugacccugcacggccacuucaacuggaccgccagagccgcccugcuguaccuggacgccagaaccgacgacagaccccacuacuucaccaucgagggcguguucgaggcccugcagggcagcaaccugagcgugcagcaccagguguacgccagagagcccggcggccccgagcaggccacccacuucaucagagccaacggcagaaucguguacaucugcggcccccuggagaugcugcacgagauccugcugcaggcccagagagagaaccugaccaacggcgacuacguguucuucuaccuggacguguucggcgagagccugagagccggccccaccagagccaccggcagacccuggcaggacaacagaaccagagagcaggcccaggcccugagagaggccuuccagaccgugcuggugaucaccuacagagagccccccaaccccgaguaccaggaguuccagaacagacugcugaucagagccagagaggacuucggcguggagcugggccccagccugaugaaccugaucgccggcugcuucuacgacggcauccugcuguacgccgaggugcugaacgagaccauccaggagggcggcaccagagaggacggccugagaaucguggagaagaugcagggcagaagauaccacggcgugaccggccugguggugauggacaagaacaacgacagagagaccgacuucgugcugugggccaugggcgaccuggacagcggcgacuuccagcccgccgcccacuacagcggcgccgagaagcagaucugguggaccggcagacccauccccugggugaagggcgccccccccagcgacaacccccccugcgccuucgaccuggacgaccccagcugcgacaagaccccccugagcacccuggccaucguggcccugggcaccggcaucaccuucaucauguucggcgugagcagcuuccugaucuucagaaagcugaugcuggagaaggagcuggccagcaugcuguggagaaucagaugggaggagcugcaguucggcaacagcgagagauaccacaagggcgccggcagcagacugacccugagccugagaggcagcagcuacggcagccugaugaccgcccacggcaaguaccagaucuucgccaacaccggccacuucaagggcaacgugguggccaucaagcacgugaacaagaagagaaucgagcugaccagacaggugcuguucgagcugaagcacaugagagacgugcaguucaaccaccugaccagauucaucggcgccugcaucgacccccccaacaucugcaucgugaccgaguacugccccagaggcagccugcaggacauccuggagaacgacagcaucaaccuggacuggauguucagauacagccugaucaacgaccuggugaagggcauggccuuccugcacaacagcaucaucagcagccacggcagccugaagagcagcaacugcgugguggacagcagauucgugcugaagaucaccgacuacggccuggccagcuucagaagcaccgccgagcccgacgacagccacgcccuguacgccaagaagcuguggaccgcccccgagcugcugagcggcaacccccugcccaccaccggcaugcagaaggccgacguguacagcuucggcaucauccugcaggagaucgcccugagaagcggccccuucuaccuggagggccuggaccugagccccaaggagaucgugcagaaggugagaaacggccagagacccuacuucagacccagcaucgacagaacccagcugaacgaggagcuggugcugcugauggagagaugcugggcccaggaccccgccgagagacccgacuucggccagaucaagggcuucaucagaagauucaacaaggagggcggcaccagcauccuggacaaccugcugcugagaauggagcaguacgccaacaaccuggagaagcugguggaggagagaacccaggccuaccuggaggagaagagaaaggccgaggcccugcuguaccagauccugccccacagcguggccgagcagcugaagagaggcgagaccgugcaggccgaggccuucgacagcgugaccaucuacuucagcgacaucgugggcuucaccgcccugagcgccgagagcacccccaugcagguggugacccugcugaacgaccuguacaccugcuucgacgccaucaucgacaacuucgacguguacaagguggagaccaucggcgacgccuacaugguggugagcggccugcccggcagaaacggccagagacacgcccccgagaucgccagaauggcccuggcccugcuggacgccgugagcagcuucagaaucagacacagaccccacgaccagcugagacugagaaucggcgugcacaccggccccgugugcgccggcguggugggccugaagaugcccagauacugccuguucggcgacaccgugaacaccgccagcagaauggagagcaacggccaggcccugaagauccacgugagcagcaccaccaaggacgcccuggacgagcugggcugcuuccagcuggagcugagaggcgacguggagaugaagggcaagggcaagaugagaaccuacuggcugcugggcgagagaaagggcccccccggccugcuguaa

SEQ ID NO: 20690 - RNA, 1623 nt, Artificial Sequence
  NPR3__Homo_sapiens__NP_000899
augcccagccugcuggugcugaccuucagccccugcgugcugcugggcugggcccugcuggccggcggcaccggcggcggcggcgugggcggcggcggcggcggcgccggcaucggcggcggcagacaggagagagaggcccugcccccccagaagaucgaggugcuggugcugcugccccaggacgacagcuaccuguucagccugaccagagugagacccgccaucgaguacgcccugagaagcguggagggcaacggcaccggcagaagacugcugccccccggcaccagauuccagguggccuacgaggacagcgacugcggcaacagagcccuguucagccugguggacagaguggccgccgccagaggcgccaagcccgaccugauccugggccccgugugcgaguacgccgccgcccccguggccagacuggccagccacugggaccugcccaugcugagcgccggcgcccuggccgccggcuuccagcacaaggacagcgaguacagccaccugaccagaguggcccccgccuacgccaagaugggcgagaugaugcuggcccuguucagacaccaccacuggagcagagccgcccugguguacagcgacgacaagcuggagagaaacugcuacuucacccuggagggcgugcacgagguguuccaggaggagggccugcacaccagcaucuacagcuucgacgagaccaaggaccuggaccuggaggacaucgugagaaacauccaggccagcgagagaguggugaucaugugcgccagcagcgacaccaucagaagcaucaugcugguggcccacagacacggcaugaccagcggcgacuacgccuucuucaacaucgagcuguucaacagcagcagcuacggcgacggcagcuggaagagaggcgacaagcacgacuucgaggccaagcaggccuacagcagccugcagaccgugacccugcugagaaccgugaagcccgaguucgagaaguucagcauggaggugaagagcagcguggagaagcagggccugaacauggaggacuacgugaacauguucguggagggcuuccacgacgccauccugcuguacgugcuggcccugcacgaggugcugagagccggcuacagcaagaaggacggcggcaagaucauccagcagaccuggaacagaaccuucgagggcaucgccggccaggugagcaucgacgccaacggcgacagauacggcgacuucagcgugaucgccaugaccgacguggaggccggcacccaggaggugaucggcgacuacuucggcaaggagggcagauucgagaugagacccaacgugaaguaccccuggggcccccugaagcugagaaucgacgagaacagaaucguggagcacaccaacagcagccccugcaagagcugcggccuggaggagagcgccgugaccggcaucguggugggcgcccugcugggcgccggccugcugauggccuucuacuucuucagaaagaaguacagaaucaccaucgagagaagaacccagcaggaggagagcaaccugggcaagcacagagagcugagagaggacagcaucagaagccacuucagcguggccuaa

SEQ ID NO: 20691 - RNA, 1143 nt, Artificial Sequence
  NPRL2__Homo_sapiens__NP_006536
augggcagcggcugcagaaucgagugcaucuucuucagcgaguuccaccccacccugggccccaagaucaccuaccaggugcccgaggacuucaucagcagagagcuguucgacaccgugcagguguacaucaucaccaagcccgagcugcagaacaagcugaucaccgugaccgccauggagaagaagcugaucggcugccccgugugcaucgagcacaagaaguacagcagaaacgcccugcuguucaaccugggcuucgugugcgacgcccaggccaagaccugcgcccuggagcccaucgugaagaagcuggccggcuaccugaccacccuggagcuggagagcagcuucgugagcauggaggagagcaagcagaagcuggugcccaucaugaccauccugcuggaggagcugaacgccagcggcagaugcacccugcccaucgacgagagcaacaccauccaccugaaggugaucgagcagagacccgacccccccguggcccaggaguacgacgugcccguguucaccaaggacaaggaggacuucuucaacagccagugggaccugaccacccagcagauccugcccuacaucgacggcuucagacacauccagaagaucagcgccgaggccgacguggagcugaaccuggugagaaucgccauccagaaccugcuguacuacggcguggugacccuggugagcauccugcaguacagcaacguguacugccccacccccaaggugcaggaccugguggacgacaagagccugcaggaggccugccugagcuacgugaccaagcagggccacaagagagccagccugagagacguguuccagcuguacugcagccugagccccggcaccaccgugagagaccugaucggcagacacccccagcagcugcagcacguggacgagagaaagcugauccaguucggccugaugaagaaccugaucagaagacugcagaaguaccccgugagagugaccagagaggagcagagccaccccgccagacuguacaccggcugccacagcuacgacgagaucugcugcaagaccggcaugagcuaccacgagcuggacgagagacuggagaacgaccccaacaucaucaucugcuggaaguaa

SEQ ID NO: 20692 - RNA, 1173 nt, Artificial Sequence
  NPRL3__Homo_sapiens__NP_001034565
auggccgacggcaacgagggcccccagagccccuuccaccacauccugcccaagugcaagcuggccagagaccugaaggaggccuacgacagccugugcaccagcggcguggugagacugcacaucaacagcuggcuggaggugagcuucugccugccccacaagauccacuacgccgccagcagccugaucccccccgaggccaucgagagaagccugaaggccaucagacccuaccacgcccugcugcugcugagcgacgagaagagccugcugggcgagcugcccaucgacugcagccccgcccuggugagagugaucaagaccaccagcgccgugaagaaccugcagcagcuggcccaggacgccgaccuggcccugcugcagguguuccagcuggccgcccaccugguguacuggggcaaggccaucaucaucuacccccugugcgagaacaacguguacaugcugagccccaacgccagcgugugccuguacagcccccuggccgagcaguucagccaccaguuccccagccacgaccugcccagcgugcuggccaaguucagccugcccgugagccugagcgaguucagaaacccccuggcccccgccgugcaggagacccagcugauccagauggugguguggaugcugcagagaagacugcugauccagcugcacaccuacgugugccugauggccagccccagcgaggaggagcccagacccagagaggacgacgugcccuucaccgccagagugggcggcagaagccugagcacccccaacgcccugagcuucggcagccccaccagcagcgacgacaugacccugaccagccccagcauggacaacagcagcgccgagcugcugcccagcggcgacagcccccugaaccagagaaugaccgagaaccugcuggccagccugagcgagcacgagagagccgccauccugagcgugcccgccgcccagaaccccgaggaccugagaauguucgccagacugcugcacuacuucagaggcagacaccaccuggaggagaucauguacaacgagaacaccagaagaagccagcugcugaugcuguucgacaaguucagaagcgugcugguggugaccacccacgaggaccccgugaucgccguguuccaggcccugcugcccuaa

SEQ ID NO: 20693 - RNA, 270 nt, Artificial Sequence
  NPS__Homo_sapiens__NP_001025184
augaucagcagcgugaagcugaaccugauccuggugcugagccugagcaccaugcacguguucuggugcuaccccgugcccagcagcaaggugagcggcaagagcgacuacuuccugauccugcugaacagcugccccaccagacuggacagaagcaaggagcuggccuuccugaagcccauccuggagaagauguucgugaagagaagcuucagaaacggcgugggcaccggcaugaagaagaccagcuuccagagagccaagagcuaa

SEQ ID NO: 20694 - RNA, 918 nt, Artificial Sequence
  NPSR1__Homo_sapiens__NP_001287863
augcccgccaacuucaccgagggcagcuucgacagcagcggcaccggccagacccuggacagcagccccguggccugcaccgagaccgugaccuucaccgaggugguggagggcaaggaguggggcagcuucuacuacagcuucaagaccgagcagcugaucacccugugggugcuguucguguucaccaucgugggcaacagcguggugcuguucagcaccuggagaagaaagaagaagagcagaaugaccuucuucgugacccagcuggccaucaccgagaagcaggccagagugcugaucgugaucgccuggagccugagcuuccuguucagcauccccacccugaucaucuucggcaagagaacccugagcaacggcgaggugcagugcugggcccuguggcccgacgacagcuacuggacccccuacaugaccaucguggccuuccugguguacuucaucccccugaccaucaucagcaucauguacggcaucgugaucagaaccaucuggaucaagagcaagaccuacgagaccgugaucagcaacugcagcgacggcaagcugugcagcagcuacaacagaggccugaucagcaaggccaagaucaaggccaucaaguacagcaucaucaucauccuggccuucaucugcugcuggagccccuacuuccuguucgacauccuggacaacuucaaccugcugcccgacacccaggagagauucuacgccagcgugaucauccagaaccugcccgcccugaacagcgccaucaacccccugaucuacugcguguucagcagcagcaucagcuuccccugcagagagcagagaagccaggacagcagaaugaccuucagagagagaaccgagagacacgagaugcagauccugagcaagcccgaguucaucuaa

SEQ ID NO: 20695 - RNA, 1185 nt, Artificial Sequence
  NPTN__Homo_sapiens__NP_001154835
augagcggcagcagccugcccagcgcccuggcccugagccugcugcuggugagcggcagccugcugcccggccccggcgccgcccagaacgccggcuucgugaagagccccaugagcgagaccaagcugaccggcgacgccuucgagcuguacugcgacguggugggcagccccacccccgagauccaguggugguacgccgaggugaacagagccgagagcuucagacagcugugggacggcgccagaaagagaagagugaccgugaacaccgccuacggcagcaacggcgugagcgugcugagaaucaccagacugacccuggaggacagcggcaccuacgagugcagagccagcaacgaccccaagagaaacgaccugagacagaaccccagcaucaccuggaucagagcccaggccaccaucagcgugcugcagaagcccagaaucgugaccagcgaggaggugaucaucagagacagccccgugcugcccgugacccugcagugcaaccugaccagcagcagccacacccugaccuacagcuacuggaccaagaacggcguggagcugagcgccaccagaaagaacgccagcaacauggaguacagaaucaacaagcccagagccgaggacagcggcgaguaccacugcguguaccacuucgugagcgcccccaaggccaacgccaccaucgaggugaaggccgcccccgacaucaccggccacaagagaagcgagaacaagaacgagggccaggacgccaccauguacugcaagagcgugggcuacccccaccccgacuggaucuggagaaagaaggagaacggcaugcccauggacaucgugaacaccagcggcagauucuucaucaucaacaaggagaacuacaccgagcugaacaucgugaaccugcagaucaccgaggaccccggcgaguacgagugcaacgccaccaacgccaucggcagcgccagcguggugaccgugcugagagugagaagccaccuggccccccuguggcccuuccugggcauccuggccgagaucaucauccugguggugaucaucgugguguacgagaagagaaagagacccgacgaggugcccgacgccggccccaugaagaccaacagcaccaacaaccacaaggacaagaaccugagacagagaaacaccaacuaa

SEQ ID NO: 20696 - RNA, 1299 nt, Artificial Sequence
  NPTX1__Homo_sapiens__NP_002513
augcccgccggcagagccgccagaaccugcgcccugcuggcccugugccugcugggcgccggcgcccaggacuucggccccaccagauucaucugcaccagcgugcccguggacgccgacaugugcgccgccagcguggccgccggcggcgccgaggagcugagaagcagcgugcugcagcugagagagaccgugcugcagcagaaggagaccauccugagccagaaggagaccaucagagagcugaccgccaagcugggcagaugcgagagccagagcacccuggaccccggcgccggcgaggccagagccggcggcggcagaaagcagcccggcagcggcaagaacaccaugggcgaccugagcagaacccccgccgccgagacccugagccagcugggccagacccugcagagccugaagaccagacuggagaaccuggagcaguacagcagacugaacagcagcagccagaccaacagccugaaggaccugcugcagagcaagaucgacgagcuggagagacaggugcugagcagagugaacacccuggaggagggcaagggcggccccagaaacgacaccgaggagagagugaagaucgagaccgcccugaccagccugcaccagagaaucagcgagcuggagaagggccagaaggacaacagacccggcgacaaguuccagcugaccuucccccugagaaccaacuacauguacgccaaggugaagaagagccugcccgagauguacgccuucaccgugugcauguggcugaagagcagcgccacccccggcgugggcacccccuucagcuacgccgugcccggccaggccaacgagcuggugcugaucgaguggggcaacaaccccauggagauccugaucaacgacaagguggccaagcugcccuucgugaucaacgacggcaaguggcaccacaucugcgugaccuggaccaccagagacggcgugugggaggccuaccaggacggcacccagggcggcagcggcgagaaccuggcccccuaccaccccaucaagccccagggcgugcuggugcugggccaggagcaggacacccugggcggcggcuucgacgccacccaggccuucgugggcgagcuggcccacuucaacaucugggacagaaagcugacccccggcgagguguacaaccuggccaccugcagcaccaaggcccugagcggcaacgugaucgccugggccgagagccacaucgagaucuacggcggcgccaccaaguggaccuucgaggccugcagacagaucaacuaa

SEQ ID NO: 20697 - RNA, 1296 nt, Artificial Sequence
  NPTX2__Homo_sapiens__NP_002514
augcuggcccugcuggccgccagcguggcccuggccguggccgccggcgcccaggacagccccgcccccggcagcagauucgugugcaccgcccugccccccgaggccgugcacgccggcugcccccugcccgccaugcccaugcagggcggcgcccagagccccgaggaggagcugagagccgccgugcugcagcugagagagaccguggugcagcagaaggagacccugggcgcccagagagaggccaucagagagcugaccggcaagcuggccagaugcgagggccuggccggcggcaaggccagaggcgccggcgccaccggcaaggacaccaugggcgaccugcccagagaccccggccacgugguggagcagcugagcagaagccugcagacccugaaggacagacuggagagccuggagcaccagcugagagccaacgugagcaacgccggccugcccggcgacuucagagaggugcugcagcagagacugggcgagcuggagagacagcugcugagaaagguggccgagcuggaggacgagaagagccugcugcacaacgagaccagcgcccacagacagaagaccgagagcacccugaacgcccugcugcagagagugaccgagcuggagagaggcaacagcgccuucaagagccccgacgccuucaaggugagccugccccugagaaccaacuaccuguacggcaagaucaagaagacccugcccgagcuguacgccuucaccaucugccuguggcugagaagcagcgccagccccggcaucggcacccccuucagcuacgccgugcccggccaggccaacgagaucgugcugaucgaguggggcaacaaccccaucgagcugcugaucaacgacaagguggcccagcugccccuguucgugagcgacggcaaguggcaccacaucugcgugaccuggaccaccagagacggcaugugggaggccuuccaggacggcgagaagcugggcaccggcgagaaccuggcccccuggcaccccaucaagcccggcggcgugcugauccugggccaggagcaggacaccgugggcggcagauucgacgccacccaggccuucgugggcgagcugagccaguucaacaucugggacagagugcugagagcccaggagaucgugaacaucgccaacugcagcaccaacaugcccggcaacaucauccccuggguggacaacaacguggacguguucggcggcgccagcaaguggcccguggagaccugcgaggagagacugcuggaccuguaa

SEQ ID NO: 20698 - RNA, 1503 nt, Artificial Sequence
  NPTXR__Homo_sapiens__NP_055108
augaaguuccuggccgugcugcuggccgccggcaugcuggccuuccugggcgccgugaucugcaucaucgccagcgugccccuggccgccagccccgccagagcccugcccggcggcgccgacaacgccagcguggccagcggcgccgccgccagccccggcccccagagaagccugagcgcccugcacggcgccggcggcagcgccggcccccccgcccugcccggcgcccccgccgccagcgcccacccccugccccccggcccccuguucagcagauuccugugcaccccccuggccgccgccugccccagcggcgcccagcagggcgacgccgccggcgccgcccccggcgagagagaggagcugcugcugcugcagagcaccgccgagcagcugagacagaccgcccugcagcaggaggccagaaucagagccgaccaggacaccaucagagagcugaccggcaagcugggcagaugcgagagcggccugcccagaggccugcagggcgccggccccagaagagacaccauggccgacggccccugggacagccccgcccugauccuggagcuggaggacgccgugagagcccugagagacagaaucgacagacuggagcaggagcugcccgccagagugaaccugagcgccgcccccgcccccgugagcgccgugcccaccggccugcacagcaagauggaccagcuggagggccagcugcuggcccaggugcuggcccuggagaaggagagaguggcccugagccacagcagcagaagacagagacaggagguggagaaggagcuggacgugcugcagggcagaguggccgagcuggagcacggcagcagcgccuacagcccccccgacgccuucaagaucagcauccccaucagaaacaacuacauguacgccagagugagaaaggcccugcccgagcuguacgccuucaccgccugcauguggcugagaagcagaagcagcggcaccggccagggcacccccuucagcuacagcgugcccggccaggccaacgagaucgugcugcuggaggccggccacgagcccauggagcugcugaucaacgacaagguggcccagcugccccugagccugaaggacaacggcuggcaccacaucugcaucgccuggaccaccagagacggccuguggagcgccuaccaggacggcgagcugcagggcagcggcgagaaccuggccgccuggcaccccaucaagccccacggcauccugauccugggccaggagcaggacacccugggcggcagauucgacgccacccaggccuucgugggcgacaucgcccaguucaaccugugggaccacgcccugacccccgcccaggugcugggcaucgccaacugcaccgccccccugcugggcaacgugcugcccugggaggacaagcugguggaggccuucggcggcgccaccaaggccgccuucgacgugugcaagggcagagccaaggccuaa

SEQ ID NO: 20699 - RNA, 591 nt, Artificial Sequence
  NPVF__Homo_sapiens__NP_071433
auggagaucaucagcagcaagcuguucauccugcugacccuggccaccagcagccugcugaccagcaacaucuucugcgccgacgagcuggugaugagcaaccugcacagcaaggagaacuacgacaaguacagcgagcccagaggcuaccccaagggcgagagaagccugaacuucgaggagcugaaggacuggggccccaagaacgugaucaagaugagcacccccgccgugaacaagaugccccacagcuucgccaaccugccccugagauucggcagaaacgugcaggaggagagaagcgccggcgccaccgccaaccugccccugagaagcggcagaaacauggaggugagccuggugagaagagugcccaaccugccccagagauucggcagaaccaccaccgccaagagcgugugcagaaugcugagcgaccugugccagggcagcaugcacagccccugcgccaacgaccuguucuacagcaugaccugccagcaccaggagauccagaaccccgaccagaagcagagcagaagacugcuguucaagaagaucgacgacgccgagcugaagcaggagaaguaa

SEQ ID NO: 20700 - RNA, 498 nt, Artificial Sequence
  NPW__Homo_sapiens__NP_001092926
auggccuggagacccggcgagagaggcgcccccgccagcagacccagacuggcccugcugcugcugcugcugcugcugccccugcccagcggcgccugguacaagcacguggccagccccagauaccacaccgugggcagagccgccggccugcugaugggccugagaagaagccccuaccuguggagaagagcccugagagccgccgccggcccccuggccagagacacccugagccccgagcccgccgccagagaggccccccugcugcugcccagcugggugcaggagcugugggagaccagaagaagaagcagccaggccggcauccccgugagagcccccagaagccccagagcccccgagcccgcccuggagcccgagagccuggacuucagcggcgccggccagagacugagaagagacgugagcagacccgccguggaccccgccgccaacagacugggccugcccugccuggcccccggccccuucuaa

SEQ ID NO: 20701 - RNA, 1155 nt, Artificial Sequence
  NPY1R__Homo_sapiens__NP_000900
augaacagcacccuguucagccagguggagaaccacagcgugcacagcaacuucagcgagaagaacgcccagcugcuggccuucgagaacgacgacugccaccugccccuggccaugaucuucacccuggcccuggccuacggcgccgugaucauccugggcgugagcggcaaccuggcccugaucaucaucauccugaagcagaaggagaugagaaacgugaccaacauccugaucgugaaccugagcuucagcgaccugcugguggccaucaugugccugcccuucaccuucguguacacccugauggaccacuggguguucggcgaggccaugugcaagcugaaccccuucgugcagugcgugagcaucaccgugagcaucuucagccuggugcugaucgccguggagagacaccagcugaucaucaaccccagaggcuggagacccaacaacagacacgccuacgugggcaucgccgugaucugggugcuggccguggccagcagccugcccuuccugaucuaccaggugaugaccgacgagcccuuccagaacgugacccuggacgccuacaaggacaaguacgugugcuucgaccaguuccccagcgacagccacagacugagcuacaccacccugcugcuggugcugcaguacuucggcccccugugcuucaucuucaucugcuacuucaagaucuacaucagacugaagagaagaaacaacaugauggacaagaugagagacaacaaguacagaagcagcgagaccaagagaaucaacaucaugcugcugagcaucgugguggccuucgccgugugcuggcugccccugaccaucuucaacaccguguucgacuggaaccaccagaucaucgccaccugcaaccacaaccugcuguuccugcugugccaccugaccgccaugaucagcaccugcgugaaccccaucuucuacggcuuccugaacaagaacuuccagagagaccugcaguucuucuucaacuucugcgacuucagaagcagagacgacgacuacgagaccaucgccaugagcaccaugcacaccgacgugagcaagaccagccugaagcaggccagccccguggccuucaagaagaucaacaacaacgacgacaacgagaagaucuaa

SEQ ID NO: 20702 - RNA, 1146 nt, Artificial Sequence
  NPY2R__Homo_sapiens__NP_000901
augggccccaucggcgccgaggccgacgagaaccagaccguggaggagaugaagguggagcaguacggcccccagaccacccccagaggcgagcuggugcccgaccccgagcccgagcugaucgacagcaccaagcugaucgaggugcagguggugcugauccuggccuacugcagcaucauccugcugggcgugaucggcaacagccuggugauccacguggugaucaaguucaagagcaugagaaccgugaccaacuucuucaucgccaaccuggccguggccgaccugcuggugaacacccugugccugcccuucacccugaccuacacccugaugggcgaguggaagaugggccccgugcugugccaccuggugcccuacgcccagggccuggccgugcaggugagcaccaucacccugaccgugaucgcccuggacagacacagaugcaucguguaccaccuggagagcaagaucagcaagagaaucagcuuccugaucaucggccuggccuggggcaucagcgcccugcuggccagcccccuggccaucuucagagaguacagccugaucgagaucauccccgacuucgagaucguggccugcaccgagaaguggcccggcgaggagaagagcaucuacggcaccguguacagccugagcagccugcugauccuguacgugcugccccugggcaucaucagcuucagcuacaccagaaucuggagcaagcugaagaaccacgugagccccggcgccgccaacgaccacuaccaccagagaagacagaagaccaccaagaugcuggugugcgugguggugguguucgccgugagcuggcugccccugcacgccuuccagcuggccguggacaucgacagccaggugcuggaccugaaggaguacaagcugaucuucaccguguuccacaucaucgccaugugcagcaccuucgccaacccccugcuguacggcuggaugaacagcaacuacagaaaggccuuccugagcgccuucagaugcgagcagagacuggacgccauccacagcgaggugagcgugaccuucaaggccaagaagaaccuggaggugagaaagaacagcggccccaacgacagcuucaccgaggccaccaacguguaa

SEQ ID NO: 20703 - RNA, 1362 nt, Artificial Sequence
  NPY5R__Homo_sapiens__XP_011530316
auggacagcaagcaggacuacaacauggaccuggagcuggacgaguacuacaacaagacccuggccaccgagaacaacaccgccgccaccagaaacagcgacuuccccgugugggacgacuacaagagcagcguggacgaccugcaguacuuccugaucggccuguacaccuucgugagccugcugggcuucaugggcaaccugcugauccugauggcccugaugaagaagagaaaccagaagaccaccgugaacuuccugaucggcaaccuggccuucagcgacauccugguggugcuguucugcagccccuucacccugaccagcgugcugcuggaccaguggauguucggcaaggugaugugccacaucaugcccuuccugcagugcgugagcgugcuggugagcacccugauccugaucagcaucgccaucgugagauaccacaugaucaagcaccccaucagcaacaaccugaccgccaaccacggcuacuuccugaucgccaccguguggacccugggcuucgccaucugcagcccccugcccguguuccacagccugguggagcugcaggagaccuucggcagcgcccugcugagcagcagauaccugugcguggagagcuggcccagcgacagcuacagaaucgccuucaccaucagccugcugcuggugcaguacauccugccccuggugugccugaccgugagccacaccagcgugugcagaagcaucagcugcggccugagcaacaaggagaacagacuggaggagaacgagaugaucaaccugacccugcaccccagcaagaagagcggcccccaggugaagcugagcggcagccacaaguggagcuacagcuucaucaagaagcacagaagaagauacagcaagaagaccgccugcgugcugcccgcccccgagagacccagccaggagaaccacagcagaauccugcccgagaacuucggcagcgugagaagccagcugagcagcagcagcaaguucauccccggcgugcccaccugcuucgagaucaagcccgaggagaacagcgacgugcacgagcugagagugaagagaagcgugaccagaaucaagaagagaagcagaagcguguucuacagacugaccauccugauccugguguucgccgugagcuggaugccccugcaccuguuccacguggugaccgacuucaacgacaaccugaucagcaacagacacuucaagcugguguacugcaucugccaccugcugggcaugaugagcugcugccugaaccccauccuguacggcuuccugaacaacggcaucaaggccgaccuggugagccugauccacugccugcacauguaa

SEQ ID NO: 20704 - RNA, 294 nt, Artificial Sequence
  NPY__Homo_sapiens__NP_000896
augcugggcaacaagagacugggccugagcggccugacccuggcccugagccugcuggugugccugggcgcccuggccgaggccuaccccagcaagcccgacaaccccggcgaggacgcccccgccgaggacauggccagauacuacagcgcccugagacacuacaucaaccugaucaccagacagagauacggcaagagaagcagccccgagacccugaucagcgaccugcugaugagagagagcaccgagaacgugcccagaaccagacuggaggaccccgccaugugguaa

SEQ ID NO: 20705 - RNA, 825 nt, Artificial Sequence
  NQO1__Homo_sapiens__NP_000894
auggugggcagaagagcccugaucgugcuggcccacagcgagagaaccagcuucaacuacgccaugaaggaggccgccgccgccgcccugaagaagaagggcugggaggugguggagagcgaccuguacgccaugaacuucaaccccaucaucagcagaaaggacaucaccggcaagcugaaggaccccgccaacuuccaguaccccgccgagagcgugcuggccuacaaggagggccaccugagccccgacaucguggccgagcagaagaagcuggaggccgccgaccuggugaucuuccaguucccccugcagugguucggcgugcccgccauccugaagggcugguucgagagaguguucaucggcgaguucgccuacaccuacgccgccauguacgacaagggccccuucagaagcaagaaggccgugcugagcaucaccaccggcggcagcggcagcauguacagccugcagggcauccacggcgacaugaacgugauccuguggcccauccagagcggcauccugcacuucugcggcuuccaggugcuggagccccagcugaccuacagcaucggccacacccccgccgacgccagaauccagauccuggagggcuggaagaagagacuggagaacaucugggacgagaccccccuguacuucgcccccagcagccuguucgaccugaacuuccaggccggcuuccugaugaagaaggaggugcaggacgaggagaagaacaagaaguucggccugagcgugggccaccaccugggcaagagcauccccaccgacaaccagaucaaggccagaaaguaa

SEQ ID NO: 20706 - RNA, 582 nt, Artificial Sequence
  NQO2__Homo_sapiens__NP_001277151
auggccggcaagaaggugcugaucguguacgcccaccaggagcccaagagcuucaacggcagccugaagaacguggccguggacgagcugagcagacagggcugcaccgugaccgugagcgaccuguacgccaugaaccuggagcccagagccaccgacaaggacaucaccggcacccugagcaaccccgagguguucaacuacggcguggagacccacgaggccuacaagcagagaagccuggccagcgacaucaccgacgagcagaagaaggugagagaggccgaccuggugaucuuccagggcaagcuggcccugcugagcgugaccaccggcggcaccgccgagauguacaccaagaccggcgugaacggcgacagcagauacuuccuguggccccugcagcacggcacccugcacuucugcggcuucaaggugcuggccccccagaucagcuucgcccccgagaucgccagcgaggaggagagaaagggcaugguggccgccuggagccagagacugcagaccaucuggaaggaggagcccauccccugcaccgcccacuggcacuucggccaguaa

SEQ ID NO: 20707 - RNA, 1413 nt, Artificial Sequence
  NR0B1__Homo_sapiens__NP_000466
auggccggcgagaaccaccaguggcagggcagcauccuguacaacaugcugaugagcgccaagcagaccagagccgcccccgaggcccccgagaccagacugguggaccagugcuggggcugcagcugcggcgacgagcccggcgugggcagagagggccugcugggcggcagaaacguggcccugcuguacagaugcugcuucugcggcaaggaccaccccagacagggcagcauccuguacagcaugcugaccagcgccaagcagaccuacgccgcccccaaggcccccgaggccacccugggccccugcuggggcugcagcugcggcagcgaccccggcgugggcagagccggccugcccggcggcagacccguggcccugcuguacagaugcugcuucugcggcgaggaccaccccagacagggcagcauccuguacagccugcugaccagcagcaagcagacccacguggcccccgccgcccccgaggccagacccggcggcgccuggugggacagaagcuacuucgcccagagacccggcggcaaggaggcccugcccggcggcagagccaccgcccugcuguacagaugcugcuucugcggcgaggaccacccccagcagggcagcacccuguacugcgugcccaccagcaccaaccaggcccaggccgcccccgaggagagacccagagcccccuggugggacaccagcagcggcgcccugagacccguggcccugaagagcccccagguggugugcgaggccgccagcgccggccugcugaagacccugagauucgugaaguaccugcccugcuuccaggugcugccccuggaccagcagcuggugcuggugagaaacugcugggccagccugcugaugcuggagcuggcccaggacagacugcaguucgagaccguggaggugagcgagcccagcaugcugcagaagauccugaccaccagaagaagagagaccggcggcaacgagccccugcccgugcccacccugcagcaccaccuggccccccccgccgaggccagaaaggugcccagcgccagccaggugcaggccaucaagugcuuccugagcaagugcuggagccugaacaucagcaccaaggaguacgccuaccugaagggcaccgugcuguucaaccccgacgugcccggccugcagugcgugaaguacauccagggccugcaguggggcacccagcagauccugagcgagcacaccagaaugacccaccagggcccccacgacagauucaucgagcugaacagcacccuguuccugcugagauucaucaacgccaacgugaucgccgagcuguucuucagacccaucaucggcaccgugagcauggacgacaugaugcuggagaugcugugcaccaagaucuaa

SEQ ID NO: 20708 - RNA, 1845 nt, Artificial Sequence
  NR1D1__Homo_sapiens__NP_068370
augaccacccuggacagcaacaacaacaccggcggcgugaucaccuacaucggcagcagcggcagcagccccagcagaaccagccccgagagccuguacagcgacaacagcaacggcagcuuccagagccugacccagggcugccccaccuacuucccccccagccccaccggcagccugacccaggaccccgccagaagcuucggcagcaucccccccagccugagcgacgacggcagccccagcagcagcagcagcagcagcagcagcagcagcagcuucuacaacggcagcccccccggcagccugcagguggccauggaggacagcagcagagugagccccagcaagagcaccagcaacaucaccaagcugaacggcauggugcugcugugcaaggugugcggcgacguggccagcggcuuccacuacggcgugcacgccugcgagggcugcaagggcuucuucagaagaagcauccagcagaacauccaguacaagagaugccugaagaacgagaacugcagcaucgugagaaucaacagaaacagaugccagcagugcagauucaagaagugccugagcgugggcaugagcagagacgccgugagauucggcagaauccccaagagagagaagcagagaaugcuggccgagaugcagagcgccaugaaccuggccaacaaccagcugagcagccagugcccccuggagaccagccccacccagcaccccacccccggccccaugggccccagccccccccccgcccccgugcccagcccccuggugggcuucagccaguucccccagcagcugaccccccccagaagccccagccccgagcccaccguggaggacgugaucagccagguggccagagcccacagagagaucuucaccuacgcccacgacaagcugggcagcagccccggcaacuucaacgccaaccacgccagcggcagcccccccgccaccaccccccacagaugggagaaccagggcugcccccccgcccccaacgacaacaacacccuggccgcccagagacacaacgaggcccugaacggccugagacaggcccccagcagcuacccccccaccuggccccccggccccgcccaccacagcugccaccagagcaacagcaacggccacagacugugccccacccacguguacgccgcccccgagggcaaggcccccgccaacagccccagacagggcaacagcaagaacgugcugcuggccugccccaugaacauguacccccacggcagaagcggcagaaccgugcaggagaucugggaggacuucagcaugagcuucacccccgccgugagagaggugguggaguucgccaagcacauccccggcuucagagaccugagccagcacgaccaggugacccugcugaaggccggcaccuucgaggugcugauggugagauucgccagccuguucaacgugaaggaccagaccgugauguuccugagcagaaccaccuacagccugcaggagcugggcgccaugggcaugggcgaccugcugagcgccauguucgacuucagcgagaagcugaacagccuggcccugaccgaggaggagcugggccuguucaccgccguggugcuggugagcgccgacagaagcggcauggagaacagcgccagcguggagcagcugcaggagacccugcugagagcccugagagcccuggugcugaagaacagaccccuggagaccagcagauucaccaagcugcugcugaagcugcccgaccugagaacccugaacaacaugcacagcgagaagcugcugagcuucagaguggacgcccaguaa

SEQ ID NO: 20709 - RNA, 1740 nt, Artificial Sequence
  NR1D2__Homo_sapiens__NP_005117
auggaggugaacgccggcggcgugaucgccuacaucagcagcagcagcagcgccagcagccccgccagcugccacagcgagggcagcgagaacagcuuccagagcagcagcagcagcgugcccagcagccccaacagcagcaacagcgacaccaacggcaaccccaagaacggcgaccuggccaacaucgagggcauccugaagaacgacagaaucgacugcagcaugaagaccagcaagagcagcgcccccggcaugaccaagagccacagcggcgugaccaaguucagcggcauggugcugcugugcaaggugugcggcgacguggccagcggcuuccacuacggcgugcacgccugcgagggcugcaagggcuucuucagaagaagcauccagcagaacauccaguacaagaagugccugaagaacgagaacugcagcaucaugagaaugaacagaaacagaugccagcagugcagauucaagaagugccugagcgugggcaugagcagagacgccgugagauucggcagaauccccaagagagagaagcagagaaugcugaucgagaugcagagcgccaugaagaccaugaugaacagccaguucagcggccaccugcagaacgacacccugguggagcaccacgagcagaccgcccugcccgcccaggagcagcugagacccaagccccagcuggagcaggagaacaucaagagcagcagcccccccagcagcgacuucgccaaggaggaggugaucggcauggugaccagagcccacaaggacaccuucauguacaaccaggagcagcaggagaacagcgccgagagcaugcagccccagagaggcgagagaauccccaagaacauggagcaguacaaccugaaccacgaccacugcggcaacggccugagcagccacuuccccugcagcgagagccagcagcaccugaacggccaguucaagggcagaaacaucaugcacuaccccaacggccacgccaucugcaucgccaacggccacugcaugaacuucagcaacgccuacacccagagagugugcgacagagugcccaucgacggcuucagccagaacgagaacaagaacagcuaccugugcaacaccggcggcagaaugcaccuggugugccccaugagcaagagccccuacguggacccccacaagagcggccacgagaucugggaggaguucagcaugagcuucacccccgccgugaaggaggugguggaguucgccaagagaauccccggcuucagagaccugagccagcacgaccaggugaaccugcugaaggccggcaccuucgaggugcugauggugagauucgccagccuguucgacgccaaggagagaaccgugaccuuccugagcggcaagaaguacagcguggacgaccugcacagcaugggcgccggcgaccugcugaacagcauguucgaguucagcgagaagcugaacgcccugcagcugagcgacgaggagaugagccuguucaccgccguggugcuggugagcgccgacagaagcggcaucgagaacgugaacagcguggaggcccugcaggagacccugaucagagcccugagaacccugaucaugaagaaccaccccaacgaggccagcaucuucaccaagcugcugcugaagcugcccgaccugagaagccugaacaacaugcacagcgaggagcugcuggccuucaaggugcaccccuaa

SEQ ID NO: 20710 - RNA, 1095 nt, Artificial Sequence
  NR1H2__Homo_sapiens__NP_001243576
augagcagccccaccaccagcagccuggacaccccccugcccggcaacggccccccccagcccggcgcccccagcagcagccccaccgugaaggaggagggccccgagcccuggcccggcggccccgaccccgacgugcccggcaccgacgaggccagcagcgccugcagcaccgacuggggcgugcugagcgaggagcagaucagaaagaagaagaucagaaagcagcagcagcaggagagccagagccagagccagagccccgugggcccccagggcagcagcagcagcgccagcggccccggcgccagccccggcggcagcgaggccggcagccagggcagcggcgagggcgagggcgugcagcugaccgccgcccaggagcugaugauccagcagcugguggccgcccagcugcagugcaacaagagaagcuucagcgaccagcccaaggugacccccuggccccugggcgccgacccccagagcagagacgccagacagcagagauucgcccacuucaccgagcuggccaucaucagcgugcaggagaucguggacuucgccaagcaggugcccggcuuccugcagcugggcagagaggaccagaucgcccugcugaaggccagcaccaucgagaucaugcugcuggagaccgccagaagauacaaccacgagaccgagugcaucaccuuccugaaggacuucaccuacagcaaggacgacuuccacagagccggccugcagguggaguucaucaaccccaucuucgaguucagcagagccaugagaagacugggccuggacgacgccgaguacgcccugcugaucgccaucaacaucuucagcgccgacagacccaacgugcaggagcccggcagaguggaggcccugcagcagcccuacguggaggcccugcugagcuacaccagaaucaagagaccccaggaccagcugagauuccccagaaugcugaugaagcuggugagccugagaacccugagcagcgugcacagcgagcagguguucgcccugagacugcaggacaagaagcugcccccccugcugagcgagaucugggacgugcacgaguaa

SEQ ID NO: 20711 - RNA, 1164 nt, Artificial Sequence
  NR1H3__Homo_sapiens__NP_001123573
augagccuguggcugggcgcccccgugcccgacaucccccccgacagcgccguggagcuguggaagcccggcgcccaggacgccagcagccaggcccagggcggcagcagcugcauccugagagaggaggccagaaugccccacagcgccggcggcaccgccggcgugggccuggaggccgccgagcccaccgcccugcugaccagagccgagccccccagcgagcccaccgagaucagaccccagaagagaaagaagggccccgcccccaagaugcugggcaacgagcugugcagcgugugcggcgacaaggccagcggcuuccacuacaacgugcugagcugcgagggcugcaagggcuucuucagaagaagcgugaucaagggcgcccacuacaucugccacagcggcggccacugccccauggacaccuacaugagaagaaagugccaggagugcagacugagaaagugcagacaggccggcaugagagaggagugcgugcugagcgaggagcagaucagacugaagaagcugaagagacaggaggaggagcaggcccacgccaccagccugccccccagagccagcagccccccccagauccugccccagcugagccccgagcagcugggcaugaucgagaagcugguggccgcccagcagcagugcaacagaagaagcuucagcgacagacugagagugaccgugaugcugcuggagaccagcagaagauacaaccccggcagcgagagcaucaccuuccugaaggacuucagcuacaacagagaggacuucgccaaggccggccugcagguggaguucaucaaccccaucuucgaguucagcagagccaugaacgagcugcagcugaacgacgccgaguucgcccugcugaucgccaucagcaucuucagcgccgacagacccaacgugcaggaccagcugcagguggagagacugcagcacaccuacguggaggcccugcacgccuacgugagcauccaccacccccacgacagacugauguuccccagaaugcugaugaagcuggugagccugagaacccugagcagcgugcacagcgagcagguguucgcccugagacugcaggacaagaagcugcccccccugcugagcgagaucugggacgugcacgaguaa

SEQ ID NO: 20712 - RNA, 1278 nt, Artificial Sequence
  NR1H4__Homo_sapiens__NP_001193907
augggcagcaagaugaaccugaucgagcacagccaccugcccaccaccgacgaguucagcuucagcgagaaccuguucggcgugcugaccgagcagguggccggcccccugggccagaaccuggagguggagcccuacagccaguacagcaacgugcaguucccccaggugcagccccagaucagcagcagcagcuacuacagcaaccugggcuucuacccccagcagcccgaggagugguacagccccggcaucuacgagcugagaagaaugcccgccgagacccuguaccagggcgagaccgagguggccgagaugcccgugaccaagaagcccagaaugggcgccagcgccggcagaaucaagggcgacgagcugugcguggugugcggcgacagagccagcggcuaccacuacaacgcccugaccugcgagggcugcaagggccugcugaccgagauccagugcaagagcaagagacugagaaagaacgugaagcagcacgccgaccagaccgugaacgaggacagcgagggcagagaccugagacaggugaccagcaccaccaagagcugcagagagaagaccgagcugacccccgaccagcagacccugcugcacuucaucauggacagcuacaacaagcagagaaugccccaggagaucaccaacaagauccugaaggaggaguucagcgccgaggagaacuuccugauccugaccgagauggccaccaaccacgugcaggugcugguggaguucaccaagaagcugcccggcuuccagacccuggaccacgaggaccagaucgcccugcugaagggcagcgccguggaggccauguuccugagaagcgccgagaucuucaacaagaagcugcccagcggccacagcgaccugcuggaggagagaaucagaaacagcggcaucagcgacgaguacaucacccccauguucagcuucuacaagagcaucggcgagcugaagaugacccaggaggaguacgcccugcugaccgccaucgugauccugagccccgacagacaguacaucaaggacagagaggccguggagaagcugcaggagccccugcuggacgugcugcagaagcugugcaagauccaccagcccgagaacccccagcacuucgccugccugcugggcagacugaccgagcugagaaccuucaaccaccaccacgccgagaugcugaugagcuggagagugaacgaccacaaguucaccccccugcugugcgagaucugggacgugcaguaa

SEQ ID NO: 20713 - RNA, 1422 nt, Artificial Sequence
  NR1I2__Homo_sapiens__NP_071285
augaccgugaccagaacccaccacuucaaggagggcagccugagagcccccgccaucccccugcacagcgccgccgccgagcuggccagcaaccaccccagaggccccgaggccaaccuggaggugagacccaaggagagcuggaaccacgccgacuucgugcacugcgaggacaccgagagcgugcccggcaagcccagcgugaacgccgacgaggaggugggcggcccccagaucugcagagugugcggcgacaaggccaccggcuaccacuucaacgugaugaccugcgagggcugcaagggcuucuucagaagagccaugaagagaaacgccagacugagaugccccuucagaaagggcgccugcgagaucaccagaaagaccagaagacagugccaggccugcagacugagaaagugccuggagagcggcaugaagaaggagaugaucaugagcgacgaggccguggaggagagaagagcccugaucaagagaaagaagagcgagagaaccggcacccagccccugggcgugcagggccugaccgaggagcagagaaugaugaucagagagcugauggacgcccagaugaagaccuucgacaccaccuucagccacuucaagaacuucagacugcccggcgugcugagcagcggcugcgagcugcccgagagccugcaggcccccagcagagaggaggccgccaaguggagccaggugagaaaggaccugugcagccugaaggugagccugcagcugagaggcgaggacggcagcguguggaacuacaagccccccgccgacagcggcggcaaggagaucuucagccugcugccccacauggccgacaugagcaccuacauguucaagggcaucaucagcuucgccaaggugaucagcuacuucagagaccugcccaucgaggaccagaucagccugcugaagggcgccgccuucgagcugugccagcugagauucaacaccguguucaacgccgagaccggcaccugggagugcggcagacugagcuacugccuggaggacaccgccggcggcuuccagcagcugcugcuggagcccaugcugaaguuccacuacaugcugaagaagcugcagcugcacgaggaggaguacgugcugaugcaggccaucagccuguucagccccgacagacccggcgugcugcagcacagagugguggaccagcugcaggagcaguucgccaucacccugaagagcuacaucgagugcaacagaccccagcccgcccacagauuccuguuccugaagaucauggccaugcugaccgagcugagaagcaucaacgcccagcacacccagagacugcugagaauccaggacauccaccccuucgccaccccccugaugcaggagcuguucggcaucaccggcagcuaa

SEQ ID NO: 20714 - RNA, 1023 nt, Artificial Sequence
  NR1I3__Homo_sapiens__NP_001070937
auggccagcagagaggacgagcugagaaacugcguggugugcggcgaccaggccaccggcuaccacuucaacgcccugaccugcgagggcugcaagggcuucuucagaagaaccgugagcaagagcaucggccccaccugccccuucgccggcagcugcgaggugagcaagacccagagaagacacugccccgccugcagacugcagaagugccuggacgccggcaugagaaaggacaugauccugagcgccgaggcccuggcccugagaagagccaagcaggcccagagaagagcccagcagacccccgugcagcugagcaaggagcaggaggagcugaucagaacccugcugggcgcccacaccagacacaugggcaccauguucgagcaguucgugcaguucagaccccccgcccaccuguucauccaccaccagccccugcccacccuggcccccgugcugccccuggugacccacuucgccgacaucaacaccuucauggugcugcaggugaucaaguucaccaaggaccugcccguguucagaagccugcccaucgaggaccagaucagccugcugaagggcgccgccguggagaucugccacaucgugcugaacaccaccuucugccugcagacccagaacuuccugugcggcccccugagauacaccaucgaggacggcgccagagugggcuuccagguggaguuccuggagcugcuguuccacuuccacggcacccugagaaagcugcagcugcaggagcccgaguacgugcugcuggccgccauggcccuguucagccccgcccccuaccugaccgacagacccggcgugacccagagagacgagaucgaccagcugcaggaggagauggcccugacccugcagagcuacaucaagggccagcagagaagacccagagacagaagccccggcacccccuggauccacuggagcggcaagaugcugggccccaagaucggccccggcagcaagggcgcccaguggcugcaguaa

SEQ ID NO: 20715 - RNA, 1404 nt, Artificial Sequence
  NR2C1__Homo_sapiens__NP_001027458
auggccaccaucgaggagaucgcccaccagaucaucgagcagcagaugggcgagaucgugaccgagcagcagaccggccagaagauccagaucgugaccgcccuggaccacaacacccagggcaagcaguucauccugaccaaccacgacggcagcacccccagcaaggugauccuggccagacaggacagcacccccggcaagguguuccugaccacccccgacgccgccggcgugaaccagcuguucuucaccacccccgaccugagcgcccagcaccugcagcugcugaccgacaacagccccgaccagggccccaacaagguguucgaccugugcguggugugcggcgacaaggccagcggcagacacuacggcgccgugaccugcgagggcugcaagggcuucuucaagagaagcaucagaaagaaccugguguacagcugcagaggcagcaaggacugcaucaucaacaagcaccacagaaacagaugccaguacugcagacugcagagaugcaucgccuucggcaugaagcaggacagcgugcagugcgagagaaagcccaucgaggugagcagagagaagagcagcaacugcgccgccagcaccgagaagaucuacaucagaaaggaccugagaagcccccugaccgccacccccaccuucgugaccgacagcgagagcaccagaagcaccggccugcuggacagcggcauguucaugaacauccaccccagcggcgugaagaccgagagcgccgugcugaugaccagcgacaaggccgagagcugccagggcgaccugagcacccuggccaacguggugaccagccuggccaaccugggcaagaccaaggaccugagccagaacagcaacgagaugagcaugaucgagagccugagcaacgacgacaccagccugugcgaguuccaggagaugcagaccaacggcgacgugagcagagccuucgacacccuggccaaggcccugaaccccggcgagagcaccgccugccagagcagcguggccggcauggagggcagcgugcaccugaucaccggcgacagcagcaucaacuacaccgagaaggagggcccccugcugagcgacagccacguggccuucagacugaccaugcccagccccaugcccgaguaccugaacgugcacuacaucggcgagagcgccagcagacugcuguuccugagcaugcacugggcccugagcauccccagcuuccaggcccugggccaggagaacagcaucagccuggugaaggccuacuggaacgagcuguucacccugggccuggcccagugcuggcaggugaugaacguggccaccauccuggccaccuucgugaacugccugcacaacagccugcagcaggccgagggcuaa

SEQ ID NO: 20716 - RNA, 1791 nt, Artificial Sequence
  NR2C2__Homo_sapiens__NP_001278623
augaccagccccagccccagaauccagaucaucagcaccgacagcgccguggccagcccccagagaauccagaucgugaccgaccagcagaccggccagaagauccagaucgugaccgccguggacgccagcggcagccccaagcagcaguucauccugaccagccccgacggcgccggcaccggcaaggugauccuggccagccccgagaccagcagcgccaagcagcugaucuucaccaccagcgacaaccuggugcccggcagaauccagaucgugaccgacagcgccagcguggagagacugcugggcaagaccgacgugcagagaccccaggugguggaguacugcguggugugcggcgacaaggccagcggcagacacuacggcgccgugagcugcgagggcugcaagggcuucuucaagagaagcgugagaaagaaccugaccuacagcugcagaagcaaccaggacugcaucaucaacaagcaccacagaaacagaugccaguucugcagacugaagaagugccuggagaugggcaugaagauggagagcgugcagagcgagagaaagcccuucgacgugcagagagagaagcccagcaacugcgccgccagcaccgagaagaucuacaucagaaaggaccugagaagcccccugaucgccacccccaccuucguggccgacaaggacggcgccagacagaccggccugcuggaccccggcaugcuggugaacauccagcagccccugaucagagaggacggcaccgugcugcuggccaccgacagcaaggccgagaccagccagggcgcccugggcacccuggccaacguggugaccagccuggccaaccugagcgagagccugaacaacggcgacaccagcgagauccagcccgaggaccagagcgccagcgagaucaccagagccuucgacacccuggccaaggcccugaacaccaccgacagcagcagcagccccagccuggccgacggcaucgacaccagcggcggcggcagcauccacgugaucagcagagaccagagcacccccaucaucgagguggagggcccccugcugagcgacacccacgugaccuucaagcugaccaugcccagccccaugcccgaguaccugaacgugcacuacaucugcgagagcgccagcagacugcuguuccugagcaugcacugggccagaagcauccccgccuuccaggcccugggccaggacugcaacaccagccuggugagagccugcuggaacgagcuguucacccugggccuggcccagugcgcccaggugaugagccugagcaccauccuggccgccaucgugaaccaccugcagaacagcauccaggaggacaagcugagcggcgacagaaucaagcaggugauggagcacaucuggaagcugcaggaguucugcaacagcauggccaagcuggacaucgacggcuacgaguacgccuaccugaaggccaucgugcuguucagccccgaccaccccggccugaccagcaccagccagaucgagaaguuccaggagaaggcccagauggagcugcaggacuacgugcagaagaccuacagcgaggacaccuacagacuggccagaauccuggugagacugcccgcccugagacugaugagcagcaacaucaccgaggagcuguucuucaccggccugaucggcaacgugagcaucgacagcaucauccccuacauccugaagauggagaccgccgaguacaacggccagaucaccggcgccagccuguaa

SEQ ID NO: 20717 - RNA, 1269 nt, Artificial Sequence
  NR2E1__Homo_sapiens__NP_001273031
auguucagagccggcgccgagggcgccgagaaggagcccagccccagacccgagugcagagccgaccccggccccggccugggcuucccccugggcagcggccugcccuggcccagccugcuggagagccccggcggcagaauccuggacauccccugcaaggugugcggcgacagaagcagcggcaagcacuacggcguguacgccugcgacggcugcagcggcuucuucaagagaagcaucagaagaaacagaaccuacgugugcaagagcggcaaccagggcggcugccccguggacaagacccacagaaaccagugcagagccugcagacugaagaagugccuggaggugaacaugaacaaggacgccgugcagcacgagagaggccccagaaccagcaccaucagaaagcagguggcccuguacuucagaggccacaaggaggagaacggcgccgccgcccacuuccccagcgccgcccugcccgcccccgccuucuucaccgccgugacccagcuggagccccacggccuggagcuggccgccgugagcaccacccccgagagacagacccuggugagccuggcccagcccacccccaaguacccccacgaggugaacggcacccccauguaccuguacgagguggccaccgagagcgugugcgagagcgccgccagacugcuguucaugagcaucaagugggccaagagcgugcccgccuucagcacccugagccugcaggaccagcugaugcugcuggaggacgccuggagagagcuguucgugcugggcaucgcccagugggccauccccguggacgccaacacccugcuggccgugagcggcaugaacggcgacaacaccgacagccagaagcugaacaagaucaucagcgagauccaggcccugcaggaggugguggccagauucagacagcugagacuggacgccaccgaguucgccugccugaagugcaucgugaccuucaaggccgugcccacccacagcggcagcgagcugagaagcuucagaaacgccgccgccaucgccgcccugcaggacgaggcccagcugacccugaacagcuacauccacaccagauaccccacccagcccugcagauucggcaagcugcugcugcugcugcccgcccugagaagcaucagccccagcaccaucgaggagguguucuucaagaagaccaucggcaacgugcccaucaccagacugcugagcgacauguacaagagcagcgacaucuaa

SEQ ID NO: 20718 - RNA, 1233 nt, Artificial Sequence
  NR2E3__Homo_sapiens__NP_055064
auggagaccagacccaccgcccugaugagcagcaccguggccgccgccgcccccgccgccggcgccgccagcagaaaggagagccccggcagauggggccugggcgaggaccccaccggcgugagccccagccugcagugcagagugugcggcgacagcagcagcggcaagcacuacggcaucuacgccugcaacggcugcagcggcuucuucaagagaagcgugagaagaagacugaucuacagaugccaggugggcgccggcaugugccccguggacaaggcccacagaaaccagugccaggccugcagacugaagaagugccugcaggccggcaugaaccaggacgccgugcagaacgagagacagcccagaagcaccgcccaggugcaccuggacagcauggagagcaacaccgagagcagacccgagagccugguggccccccccgcccccgccggcagaagccccagaggccccacccccaugagcgccgccagagcccugggccaccacuucauggccagccugaucaccgccgagaccugcgccaagcuggagcccgaggacgccgacgagaacaucgacgugaccagcaacgaccccgaguuccccagcagccccuacagcagcagcagccccugcggccuggacagcauccacgagaccagcgccagacugcuguucauggccgugaagugggccaagaaccugcccguguucagcagccugcccuucagagaccaggugauccugcuggaggaggccuggagcgagcuguuccugcugggcgccauccaguggagccugccccuggacagcugcccccugcuggccccccccgaggccagcgccgccggcggcgcccagggcagacugacccuggccagcauggagaccagagugcugcaggagaccaucagcagauucagagcccuggccguggaccccaccgaguucgccugcaugaaggcccuggugcuguucaagcccgagaccagaggccugaaggaccccgagcacguggaggcccugcaggaccagagccaggugaugcugagccagcacagcaaggcccaccaccccagccagcccgugagauucggcaagcugcugcugcugcugcccagccugagauucaucaccgccgagagaaucgagcugcuguucuucagaaagaccaucggcaacacccccauggagaagcugcugugcgacauguucaagaacuaa

SEQ ID NO: 20719 - RNA, 1272 nt, Artificial Sequence
  NR2F1__Homo_sapiens__NP_005645
auggccaugguggugagcagcuggagagacccccaggacgacguggccggcggcaaccccggcggccccaaccccgccgcccaggccgccagaggcggcggcggcggcgccggcgagcagcagcagcaggccggcagcggcgccccccacaccccccagacccccggccagcccggcgcccccgccacccccggcaccgccggcgacaagggccagggcccccccggcagcggccagagccagcagcacaucgagugcguggugugcggcgacaagagcagcggcaagcacuacggccaguucaccugcgagggcugcaagagcuucuucaagagaagcgugagaagaaaccugaccuacaccugcagagccaacagaaacugccccaucgaccagcaccacagaaaccagugccaguacugcagacugaagaagugccugaaggugggcaugagaagagaggccgugcagagaggcagaaugccccccacccagcccaaccccggccaguacgcccugaccaacggcgacccccugaacggccacugcuaccugagcggcuacaucagccugcugcugagagccgagcccuaccccaccagcagauacggcagccagugcaugcagcccaacaacaucaugggcaucgagaacaucugcgagcuggccgccagacugcuguucagcgccguggagugggccagaaacauccccuucuuccccgaccugcagaucaccgaccaggugagccugcugagacugaccuggagcgagcuguucgugcugaacgccgcccagugcagcaugccccugcacguggccccccugcuggccgccgccggccugcacgccagccccaugagcgccgacagagugguggccuucauggaccacaucagaaucuuccaggagcagguggagaagcugaaggcccugcacguggacagcgccgaguacagcugccugaaggccaucgugcuguucaccagcgacgccugcggccugagcgacgccgcccacaucgagagccugcaggagaagagccagugcgcccuggaggaguacgugagaagccaguaccccaaccagcccagcagauucggcaagcugcugcugagacugcccagccugagaaccgugagcagcagcgugaucgagcagcuguucuucgugagacuggugggcaagacccccaucgagacccugaucagagacaugcugcugagcggcagcagcuucaacuggcccuacaugagcauccagugcagcuaa

SEQ ID NO: 20720 - RNA, 846 nt, Artificial Sequence
  NR2F2__Homo_sapiens__NP_001138627
augcaggccgugugggaccuggagcagggcaaguacggcuucgccgugcagagaggcagaaugccccccacccagcccacccacggccaguucgcccugaccaacggcgacccccugaacugccacagcuaccugagcggcuacaucagccugcugcugagagccgagcccuaccccaccagcagauucggcagccagugcaugcagcccaacaacaucaugggcaucgagaacaucugcgagcuggccgccagaaugcuguucagcgccguggagugggccagaaacauccccuucuuccccgaccugcagaucaccgaccagguggcccugcugagacugaccuggagcgagcuguucgugcugaacgccgcccagugcagcaugccccugcacguggccccccugcuggccgccgccggccugcacgccagccccaugagcgccgacagagugguggccuucauggaccacaucagaaucuuccaggagcagguggagaagcugaaggcccugcacguggacagcgccgaguacagcugccugaaggccaucgugcuguucaccagcgacgccugcggccugagcgacguggcccacguggagagccugcaggagaagagccagugcgcccuggaggaguacgugagaagccaguaccccaaccagcccaccagauucggcaagcugcugcugagacugcccagccugagaaccgugagcagcagcgugaucgagcagcuguucuucgugagacuggugggcaagacccccaucgagacccugaucagagacaugcugcugagcggcagcagcuucaacuggcccuacauggccauccaguaa

SEQ ID NO: 20721 - RNA, 1215 nt, Artificial Sequence
  NR2F6__Homo_sapiens__NP_005225
auggccauggugaccggcggcuggggcggccccggcggcgacaccaacggcguggacaaggccggcggcuaccccagagccgccgaggacgacagcgccagcccccccggcgccgccagcgacgccgagcccggcgacgaggagagacccggccugcagguggacugcguggugugcggcgacaagagcagcggcaagcacuacggcguguucaccugcgagggcugcaagagcuucuucaagagaagcaucagaagaaaccugagcuacaccugcagaagcaacagagacugccagaucgaccagcaccacagaaaccagugccaguacugcagacugaagaagugcuucagagugggcaugagaaaggaggccgugcagagaggcagaaucccccacagccugcccggcgccguggccgccagcagcggcagcccccccggcagcgcccuggccgccguggccagcggcggcgaccuguuccccggccagcccgugagcgagcugaucgcccagcugcugagagccgagcccuaccccgccgccgccggcagauucggcgccggcggcggcgccgccggcgccgugcugggcaucgacaacgugugcgagcuggccgccagacugcuguucagcaccguggagugggccagacacgcccccuucuuccccgagcugcccguggccgaccagguggcccugcugagacugagcuggagcgagcuguucgugcugaacgccgcccaggccgcccugccccugcacaccgccccccugcuggccgccgccggccugcacgccgcccccauggccgccgagagagccguggccuucauggaccaggugagagccuuccaggagcagguggacaagcugggcagacugcagguggacagcgccgaguacggcugccugaaggccaucgcccuguucacccccgacgccugcggccugagcgaccccgcccacguggagagccugcaggagaaggcccagguggcccugaccgaguacgugagagcccaguaccccagccagccccagagauucggcagacugcugcugagacugcccgcccugagagccgugcccgccagccugaucagccagcuguucuucaugagacuggugggcaagacccccaucgagacccugaucagagacaugcugcugagcggcagcaccuucaacuggcccuacggcagcggccaguaa

SEQ ID NO: 20722 - RNA, 2334 nt, Artificial Sequence
  NR3C1__Homo_sapiens__NP_001018085
auggacagcaaggagagccugacccccggcagagaggagaaccccagcagcgugcuggcccaggagagaggcgacgugauggacuucuacaagacccugagaggcggcgccaccgugaaggugagcgccagcagccccagccuggccguggccagccagagcgacagcaagcagagaagacugcugguggacuuccccaagggcagcgugagcaacgcccagcagcccgaccugagcaaggccgugagccugagcaugggccuguacaugggcgagaccgagaccaaggugaugggcaacgaccugggcuucccccagcagggccagaucagccugagcagcggcgagaccgaccugaagcugcuggaggagagcaucgccaaccugaacagaagcaccagcgugcccgagaaccccaagagcagcgccagcaccgccgugagcgccgcccccaccgagaaggaguuccccaagacccacagcgacgugagcagcgagcagcagcaccugaagggccagaccggcaccaacggcggcaacgugaagcuguacaccaccgaccagagcaccuucgacauccugcaggaccuggaguucagcagcggcagccccggcaaggagaccaacgagagccccuggagaagcgaccugcugaucgacgagaacugccugcugagcccccuggccggcgaggacgacagcuuccugcuggagggcaacagcaacgaggacugcaagccccugauccugcccgacaccaagcccaagaucaaggacaacggcgaccuggugcugagcagccccagcaacgugacccugccccaggugaagaccgagaaggaggacuucaucgagcugugcacccccggcgugaucaagcaggagaagcugggcaccguguacugccaggccagcuuccccggcgccaacaucaucggcaacaagaugagcgccaucagcgugcacggcgugagcaccagcggcggccagauguaccacuacgacaugaacaccgccagccugagccagcagcaggaccagaagcccaucuucaacgugaucccccccauccccgugggcagcgagaacuggaacagaugccagggcagcggcgacgacaaccugaccagccugggcacccugaacuuccccggcagaaccguguucagcaacggcuacagcagccccagcaugagacccgacgugagcagcccccccagcagcagcagcaccgccaccaccggccccccccccaagcugugccuggugugcagcgacgaggccagcggcugccacuacggcgugcugaccugcggcagcugcaagguguucuucaagagagccguggagggccagcacaacuaccugugcgccggcagaaacgacugcaucaucgacaagaucagaagaaagaacugccccgccugcagauacagaaagugccugcaggccggcaugaaccuggaggccagaaagaccaagaagaagaucaagggcauccagcaggccaccaccggcgugagccaggagaccagcgagaaccccggcaacaagaccaucgugcccgccacccugccccagcugacccccacccuggugagccugcuggaggugaucgagcccgaggugcuguacgccggcuacgacagcagcgugcccgacagcaccuggagaaucaugaccacccugaacaugcugggcggcagacaggugaucgccgccgugaagugggccaaggccauccccggcuucagaaaccugcaccuggacgaccagaugacccugcugcaguacagcuggauguuccugauggccuucgcccugggcuggagaagcuacagacagagcagcgccaaccugcugugcuucgcccccgaccugaucaucaacgagcagagaaugacccugcccugcauguacgaccagugcaagcacaugcuguacgugagcagcgagcugcacagacugcaggugagcuacgaggaguaccugugcaugaagacccugcugcugcugagcagcgugcccaaggacggccugaagagccaggagcuguucgacgagaucagaaugaccuacaucaaggagcugggcaaggccaucgugaagagagagggcaacagcagccagaacuggcagagauucuaccagcugaccaagcugcuggacagcaugcacgaggugguggagaaccugcugaacuacugcuuccagaccuuccuggacaagaccaugagcaucgaguuccccgagaugcuggccgagaucaucaccaaccagauccccaaguacagcaacggcaacaucaagaagcugcuguuccaccagaaguaa

SEQ ID NO: 20723 - RNA, 2955 nt, Artificial Sequence
  NR3C2__Homo_sapiens__NP_000892
auggagaccaagggcuaccacagccugcccgagggccuggacauggagagaagauggggccaggugagccaggccguggagagaagcagccugggccccaccgagagaaccgacgagaacaacuacauggagaucgugaacgugagcugcgugagcggcgccauccccaacaacagcacccagggcagcagcaaggagaagcaggagcugcugcccugccugcagcaggacaacaacagacccggcauccugaccagcgacaucaagaccgagcuggagagcaaggagcugagcgccaccguggccgagagcaugggccuguacauggacagcgugagagacgccgacuacagcuacgagcagcagaaccagcagggcagcaugagccccgccaagaucuaccagaacguggagcagcuggugaaguucuacaagggcaacggccacagacccagcacccugagcugcgugaacaccccccugagaagcuucaugagcgacagcggcagcagcgugaacggcggcgugaugagagccguggugaagagccccaucaugugccacgagaagagccccagcgugugcagcccccugaacaugaccagcagcgugugcagccccgccggcaucaacagcgugagcagcaccaccgccagcuucggcagcuuccccgugcacagccccaucacccagggcaccccccugaccugcagccccaacguggagaacagaggcagcagaagccacagccccgcccacgccagcaacgugggcagcccccugagcagcccccugagcagcaugaagagcagcaucagcagcccccccagccacugcagcgugaagagccccgugagcagccccaacaacgugacccugagaagcagcgugagcagccccgccaacaucaacaacagcagaugcagcgugagcagccccagcaacaccaacaacagaagcacccugagcagccccgccgccagcaccgugggcagcaucugcagccccgugaacaacgccuucagcuacaccgccagcggcaccagcgccggcagcagcacccugagagacguggugcccagccccgacacccaggagaagggcgcccaggaggugcccuuccccaagaccgaggagguggagagcgccaucagcaacggcgugaccggccagcugaacaucgugcaguacaucaagcccgagcccgacggcgccuucagcagcagcugccugggcggcaacagcaagaucaacagcgacagcagcuucagcgugcccaucaagcaggagagcaccaagcacagcugcagcggcaccagcuucaagggcaaccccaccgugaaccccuuccccuucauggacggcagcuacuucagcuucauggacgacaaggacuacuacagccugagcggcauccugggcccccccgugcccggcuucgacggcaacugcgagggcagcggcuuccccgugggcaucaagcaggagcccgacgacggcagcuacuaccccgaggccagcauccccagcagcgccaucgugggcgugaacagcggcggccagagcuuccacuacagaaucggcgcccagggcaccaucagccugagcagaagcgccagagaccagagcuuccagcaccugagcagcuucccccccgugaacacccugguggagagcuggaagagccacggcgaccugagcagcagaagaagcgacggcuaccccgugcuggaguacauccccgagaacgugagcagcagcacccugagaagcgugagcaccggcagcagcagacccagcaagaucugccuggugugcggcgacgaggccagcggcugccacuacggcguggugaccugcggcagcugcaagguguucuucaagagagccguggagggccagcacaacuaccugugcgccggcagaaacgacugcaucaucgacaagaucagaagaaagaacugccccgccugcagacugcagaagugccugcaggccggcaugaaccugggcgccagaaagagcaagaagcugggcaagcugaagggcauccacgaggagcagccccagcagcagcagcccccccccccccccccccccccccagagccccgaggagggcaccaccuacaucgcccccgccaaggagcccagcgugaacaccgcccuggugccccagcugagcaccaucagcagagcccugacccccagccccgugauggugcuggagaacaucgagcccgagaucguguacgccggcuacgacagcagcaagcccgacaccgccgagaaccugcugagcacccugaacagacuggccggcaagcagaugauccagguggugaagugggccaaggugcugcccggcuucaagaaccugccccuggaggaccagaucacccugauccaguacagcuggaugugccugagcagcuucgcccugagcuggagaagcuacaagcacaccaacagccaguuccuguacuucgcccccgaccugguguucaacgaggagaagaugcaccagagcgccauguacgagcugugccagggcaugcaccagaucagccugcaguucgugagacugcagcugaccuucgaggaguacaccaucaugaaggugcugcugcugcugagcaccauccccaaggacggccugaagagccaggccgccuucgaggagaugagaaccaacuacaucaaggagcugagaaagauggugaccaagugccccaacaacagcggccagagcuggcagagauucuaccagcugaccaagcugcuggacagcaugcacgaccuggugagcgaccugcuggaguucugcuucuacaccuucagagagagccacgcccugaagguggaguuccccgccaugcugguggagaucaucagcgaccagcugcccaagguggagagcggcaacgccaagccccuguacuuccacagaaaguaa

SEQ ID NO: 20724 - RNA, 1836 nt, Artificial Sequence
  NR4A1__Homo_sapiens__NP_001189162
auguggcuggccaaggccugcuggagcauccagagcgagaugcccugcauccaggcccaguacggcacccccgcccccagccccggccccagagaccaccuggccagcgacccccugacccccgaguucaucaagcccaccauggaccuggccagccccgaggccgcccccgccgcccccaccgcccugcccagcuucagcaccuucauggacggcuacaccggcgaguucgacaccuuccuguaccagcugcccggcaccgugcagcccugcagcagcgccagcagcagcgccagcagcaccagcagcagcagcgccaccagccccgccagcgccagcuucaaguucgaggacuuccagguguacggcugcuaccccggcccccugagcggccccguggacgaggcccugagcagcagcggcagcgacuacuacggcagccccugcagcgcccccagccccagcacccccagcuuccagcccccccagcugagccccugggacggcagcuucggccacuucagccccagccagaccuacgagggccugagagccuggaccgagcagcugcccaaggccagcggccccccccagccccccgccuucuucagcuucagcccccccaccggccccagccccagccuggcccagagcccccugaagcuguuccccagccaggccacccaccagcugggcgagggcgagagcuacagcaugcccaccgccuuccccggccuggcccccaccagcccccaccuggagggcagcggcauccuggacacccccgugaccagcaccaaggccagaagcggcgcccccggcggcagcgagggcagaugcgccgugugcggcgacaacgccagcugccagcacuacggcgugagaaccugcgagggcugcaagggcuucuucaagagaaccgugcagaagaacgccaaguacaucugccuggccaacaaggacugccccguggacaagagaagaagaaacagaugccaguucugcagauuccagaagugccuggccgugggcauggugaaggagguggugagaaccgacagccugaagggcagaagaggcagacugcccagcaagcccaagcagccccccgacgccagccccgccaaccugcugaccagccuggugagagcccaccuggacagcggccccagcaccgccaagcuggacuacagcaaguuccaggagcuggugcugccccacuucggcaaggaggacgccggcgacgugcagcaguucuacgaccugcugagcggcagccuggaggugaucagaaagugggccgagaagauccccggcuucgccgagcugagccccgccgaccaggaccugcugcuggagagcgccuuccuggagcuguucauccugagacuggccuacagaagcaagcccggcgagggcaagcugaucuucugcagcggccuggugcugcacagacugcagugcgccagaggcuucggcgacuggaucgacagcauccuggccuucagcagaagccugcacagccugcugguggacgugcccgccuucgccugccugagcgcccuggugcugaucaccgacagacacggccugcaggagcccagaagaguggaggagcugcagaacagaaucgccagcugccugaaggagcacguggccgccguggccggcgagccccagcccgccagcugccugagcagacugcugggcaagcugcccgagcugagaacccugugcacccagggccugcagagaaucuucuaccugaagcuggaggaccuggugccccccccccccaucaucgacaagaucuucauggacacccugcccuucuaa

SEQ ID NO: 20725 - RNA, 1797 nt, Artificial Sequence
  NR4A2__Homo_sapiens__NP_006177
augcccugcgugcaggcccaguacggcagcagcccccagggcgccagccccgccagccagagcuacagcuaccacagcagcggcgaguacagcagcgacuuccugacccccgaguucgugaaguucagcauggaccugaccaacaccgagaucaccgccaccaccagccugcccagcuucagcaccuucauggacaacuacagcaccggcuacgacgugaagccccccugccuguaccagaugccccugagcggccagcagagcagcaucaagguggaggacauccagaugcacaacuaccagcagcacagccaccugcccccccagagcgaggagaugaugccccacagcggcagcguguacuacaagcccagcagcccccccacccccaccacccccggcuuccaggugcagcacagccccaugugggacgaccccggcagccugcacaacuuccaccagaacuacguggccaccacccacaugaucgagcagagaaagacccccgugagcagacugagccuguucagcuucaagcagagcccccccggcacccccgugagcagcugccagaugagauucgacggcccccugcacgugcccaugaaccccgagcccgccggcagccaccacgugguggacggccagaccuucgccgugcccaaccccaucagaaagcccgccagcaugggcuuccccggccugcagaucggccacgccagccagcugcuggacacccaggugcccagcccccccagcagaggcagccccagcaacgagggccugugcgccgugugcggcgacaacgccgccugccagcacuacggcgugagaaccugcgagggcugcaagggcuucuucaagagaaccgugcagaagaacgccaaguacgugugccuggccaacaagaacugccccguggacaagagaagaagaaacagaugccaguacugcagauuccagaagugccuggccgugggcauggugaaggagguggugagaaccgacagccugaagggcagaagaggcagacugcccagcaagcccaagagcccccaggagcccagcccccccagcccccccgugagccugaucagcgcccuggugagagcccacguggacagcaaccccgccaugaccagccuggacuacagcagauuccaggccaaccccgacuaccagaugagcggcgacgacacccagcacauccagcaguucuacgaccugcugaccggcagcauggagaucaucagaggcugggccgagaagauccccggcuucgccgaccugcccaaggccgaccaggaccugcuguucgagagcgccuuccuggagcuguucgugcugagacuggccuacagaagcaaccccguggagggcaagcugaucuucugcaacggcguggugcugcacagacugcagugcgugagaggcuucggcgaguggaucgacagcaucguggaguucagcagcaaccugcagaacaugaacaucgacaucagcgccuucagcugcaucgccgcccuggccauggugaccgagagacacggccugaaggagcccaagagaguggaggagcugcagaacaagaucgugaacugccugaaggaccacgugaccuucaacaacggcggccugaacagacccaacuaccugagcaagcugcugggcaagcugcccgagcugagaacccugugcacccagggccugcagagaaucuucuaccugaagcuggaggaccuggugcccccccccgccaucaucgacaagcuguuccuggacacccugcccuucuaa

SEQ ID NO: 20726 - RNA, 1881 nt, Artificial Sequence
  NR4A3__Homo_sapiens__NP_008912
augcccugcgugcaggcccaguacagccccagcccccccggcagcagcuacgccgcccagaccuacagcagcgaguacaccaccgagaucaugaaccccgacuacaccaagcugaccauggaccugggcagcaccgagaucaccgccaccgccaccaccagccugcccagcaucagcaccuucguggagggcuacagcagcaacuacgagcugaagcccagcugcguguaccagaugcagagaccccugaucaagguggaggagggcagagcccccagcuaccaccaccaccaccaccaccaccaccaccaccaccaccaccaccagcagcagcaccagcagcccagcaucccccccgccagcagccccgaggacgaggugcugcccagcaccagcauguacuucaagcagagcccccccagcacccccaccacccccgccuuccccccccaggccggcgcccugugggacgaggcccugcccagcgcccccggcugcaucgcccccggcccccugcuggacccccccaugaaggccgugcccaccguggccggcgccagauucccccuguuccacuucaagcccagccccccccacccccccgcccccagccccgccggcggccaccaccugggcuacgaccccaccgccgccgccgcccugagccugccccugggcgccgccgccgccgccggcagccaggccgccgcccuggagagccaccccuacggccugccccuggccaagagagccgccccccuggccuuccccccccugggccugacccccagccccaccgccagcagccugcugggcgagagccccagccugcccagcccccccagcagaagcagcagcagcggcgagggcaccugcgccgugugcggcgacaacgccgccugccagcacuacggcgugagaaccugcgagggcugcaagggcuucuucaagagaaccgugcagaagaacgccaaguacgugugccuggccaacaagaacugccccguggacaagagaagaagaaacagaugccaguacugcagauuccagaagugccugagcgugggcauggugaaggagguggugagaaccgacagccugaagggcagaagaggcagacugcccagcaagcccaagagcccccugcagcaggagcccagccagcccagcccccccagcccccccaucugcaugaugaacgcccuggugagagcccugaccgacagcacccccagagaccuggacuacagcagauacugccccaccgaccaggccgccgccggcaccgacgccgagcacgugcagcaguucuacaaccugcugaccgccagcaucgacgugagcagaagcugggccgagaagauccccggcuucaccgaccugcccaaggaggaccagacccugcugaucgagagcgccuuccuggagcuguucgugcugagacugagcaucagaagcaacaccgccgaggacaaguucguguucugcaacggccuggugcugcacagacugcagugccugagaggcuucggcgaguggcuggacagcaucaaggacuucagccugaaccugcagagccugaaccuggacauccaggcccuggccugccugagcgcccugagcaugaucaccgagagacacggccugaaggagcccaagagaguggaggagcugugcaacaagaucaccagcagccugaaggaccaccagagcaagggccaggcccuggagcccaccgagagcaaggugcugggcgcccugguggagcugagaaagaucugcacccugggccugcagagaaucuucuaccugaagcuggaggaccuggugagcccccccagcaucaucgacaagcuguuccuggacacccugcccuucuaa

SEQ ID NO: 20727 - RNA, 1386 nt, Artificial Sequence
  NR5A1__Homo_sapiens__NP_004950
auggacuacagcuacgacgaggaccuggacgagcugugccccgugugcggcgacaaggugagcggcuaccacuacggccugcugaccugcgagagcugcaagggcuucuucaagagaaccgugcagaacaacaagcacuacaccugcaccgagagccagagcugcaagaucgacaagacccagagaaagagaugccccuucugcagauuccagaagugccugaccgugggcaugagacuggaggccgugagagccgacagaaugagaggcggcagaaacaaguucggccccauguacaagagagacagagcccugaagcagcagaagaaggcccagaucagagccaacggcuucaagcuggagaccggcccccccaugggcgugccccccccccccccccccgcccccgacuacgugcugccccccagccugcacggccccgagcccaagggccuggccgccggcccccccgccggcccccugggcgacuucggcgcccccgcccugcccauggccgugcccggcgcccacggcccccuggccggcuaccuguaccccgccuuccccggcagagccaucaagagcgaguaccccgagcccuacgccagccccccccagcccggccugcccuacggcuaccccgagcccuucagcggcggccccaacgugcccgagcugauccugcagcugcugcagcuggagcccgacgaggaccaggugagagccagaauccugggcugccugcaggagcccaccaagagcagacccgaccagcccgccgccuucggccugcugugcagaauggccgaccagaccuucaucagcaucguggacugggccagaagaugcaugguguucaaggagcuggagguggccgaccagaugacccugcugcagaacugcuggagcgagcugcugguguucgaccacaucuacagacaggugcagcacggcaaggagggcagcauccugcuggugaccggccaggagguggagcugaccaccguggccacccaggccggcagccugcugcacagccuggugcugagagcccaggagcuggugcugcagcugcuggcccugcagcuggacagacaggaguucgugugccugaaguucaucauccuguucagccuggaccugaaguuccugaacaaccacauccuggugaaggacgcccaggagaaggccaacgccgcccugcuggacuacacccugugccacuacccccacugcggcgacaaguuccagcagcugcugcugugccugguggaggugagagcccugagcaugcaggccaaggaguaccuguaccacaagcaccugggcaacgagaugcccagaaacaaccugcugaucgagaugcugcaggccaagcagaccuaa

SEQ ID NO: 20728 - RNA, 1410 nt, Artificial Sequence
  NR5A2__Homo_sapiens__NP_001263393
auggugaacuacagcuacgacgaggaccuggaggagcugugccccgugugcggcgacaaggugagcggcuaccacuacggccugcugaccugcgagagcugcaagggcuucuucaagagaaccgugcagaacaacaagagauacaccugcaucgagaaccagaacugccagaucgacaagacccagagaaagagaugccccuacugcagauuccagaagugccugagcgugggcaugaagcuggaggccgugagagccgacagaaugagaggcggcagaaacaaguucggccccauguacaagagagacagagcccugaagcagcagaagaaggcccugaucagagccaacggccugaagcuggaggccaugagccaggugauccaggccaugcccagcgaccugaccaucagcagcgccauccagaacauccacagcgccagcaagggccugccccugaaccacgccgcccugccccccaccgacuacgacagaagccccuucgugaccagccccaucagcaugaccaugcccccccacggcagccugcagggcuaccagaccuacggccacuuccccagcagagccaucaagagcgaguaccccgaccccuacaccagcagccccgagagcaucaugggcuacagcuacauggacagcuaccagaccagcagccccgccagcaucccccaccugauccuggagcugcugaagugcgagcccgacgagccccaggugcaggccaagaucauggccuaccugcagcaggagcaggccaacagaagcaagcacgagaagcugagcaccuucggccugaugugcaagauggccgaccagacccuguucagcaucguggagugggccagaagcagcaucuucuucagagagcugaagguggacgaccagaugaagcugcugcagaacugcuggagcgagcugcugauccuggaccacaucuacagacagguggugcacggcaaggagggcagcaucuuccuggugaccggccagcagguggacuacagcaucaucgccagccaggccggcgccacccugaacaaccugaugagccacgcccaggagcugguggccaagcugagaagccugcaguucgaccagagagaguucgugugccugaaguuccuggugcuguucagccuggacgugaagaaccuggagaacuuccagcugguggagggcgugcaggagcaggugaacgccgcccugcuggacuacaccaugugcaacuacccccagcagaccgagaaguucggccagcugcugcugagacugcccgagaucagagccaucagcaugcaggccgaggaguaccuguacuacaagcaccugaacggcgacgugcccuacaacaaccugcugaucgagaugcugcacgccaagagagccuaa

SEQ ID NO: 20729 - RNA, 1431 nt, Artificial Sequence
  NR6A1__Homo_sapiens__NP_001265475
auggagagagacgagcccccccccagcggcggcggcggcggcggcggcagcgccggcuuccuggagccccccgccgcccugccccccccccccagaaacggcuucugccaggacgagcuggccgagcuggaccccggcaccaacgacagagccgagcagagaaccugccugaucugcggcgacagagccaccggccugcacuacggcaucaucagcugcgagggcugcaagggcuucuucaagagaagcaucugcaacaagagaguguacagaugcagcagagacaagaacugcgugaugagcagaaagcagagaaacagaugccaguacugcagacugcugaagugccugcagaugggcaugaacagaaaggccaucagagaggacggcaugcccggcggcagaaacaagagcaucggccccgugcagaucagcgaggaggagaucgagagaaucaugagcggccaggaguucgaggaggaggccaaccacuggagcaaccacggcgacagcgaccacagcagccccggcaacagagccagcgagagcaaccagcccagccccggcagcacccugagcagcagcagaagcguggagcugaacggcuucauggccuucagagagcaguacaugggcaugagcgugcccccccacuaccaguacaucccccaccuguucagcuacagcggccacagcccccugcugccccagcaggccagaagccuggacccccagagcuacagccugauccaccagcugcugagcgccgaggaccuggagccccugggcacccccaugcugaucgaggacggcuacgccgugacccaggccgagcuguucgcccugcugugcagacuggccgacgagcugcuguucagacagaucgccuggaucaagaagcugcccuucuucugcgagcugagcaucaaggacuacaccugccugcugagcagcaccuggcaggagcugauccugcugagcagccugaccguguacagcaagcagaucuucggcgagcuggccgacgugaccgccaaguacagccccagcgacgaggagcugcacagauucagcgacgagggcauggaggugaucgagagacugaucuaccuguaccacaaguuccaccagcugaaggugagcaacgaggaguacgccugcaugaaggccaucaacuuccugaaccaggacaucagaggccugaccagcgccagccagcuggagcagcugaacaagagauacugguacaucugccaggacuucaccgaguacaaguacacccaccagcccaacagauuccccgaccugaugaugugccugcccgagaucagauacaucgccggcaagauggugaacgugccccuggagcagcugccccugcuguucaagguggugcugcacagcugcaagaccagcgugggcaaggaguaa

SEQ ID NO: 20730 - RNA, 5088 nt, Artificial Sequence
  NRAP__Homo_sapiens__NP_006166
augaacgugcagcccugcagcagaugcggcuacggcguguaccccgccgagaagaucagcugcaucgaccagaucuggcacaaggccugcuuccacugcgaggugugcaagaugaugcugagcgugaacaacuucgugagccaccagaagaagcccuacugccacgcccacaaccccaagaacaacaccuucaccagcguguaccacaccccccugaaccugaacgugagaaccuuccccgaggccaucagcggcauccacgaccaggaggacggcgagcagugcaagagcguguuccacugggacaugaagagcaaggacaaggagggcgcccccaacagacagccccuggccaacgagagagccuacuggaccggcuacggcgagggcaacgccuggugccccggcgcccugcccgaccccgagaucgugagaaugguggaggccagaaagagccugggcgaggaguacaccgaggacuacgagcagcccagaggcaagggcagcuuccccgccaugaucacccccgccuaccagagagccaagaaggccaaccagcuggccagccagguggaguacaagagaggccacgacgagagaaucagcagauucagcaccgugguggacacccccgagcugcugagaagcaaggccggcgcccagcugcagagcgacgugagauacaccgaggacuacgagcagcagagaggcaagggcagcuuccccgccaugaucacccccgccuaccagaucgccaagagagccaacgagcuggccagcgacgugagauaccaccagcaguaccagaaggagaugagaggcauggccggccccgccaucggcgccgagggcauccugaccagagagugcgccgaccaguacggccagggcuaccccgaggaguacgaggagcacagaggcaagggcagcuuccccgccaugaucacccccgccuaccagaacgccaagaaggcccacgagcuggccagcgacaucaaguacagacaggacuucaacaagaugaagggcgccgcccacuaccacagccugcccgcccaggacaaccuggugcugaagcaggcccagagcgugaacaagcuggugagcgagaacaaguacaaggagaacuaccagaaccacaugagaggcagauacgagggcgugggcauggacagaagaacccugcacgccaugaaggugggcagccuggccagcaacguggccuacaaggccgacuacaagcacgacaucguggacuacaacuaccccgccacccugacccccagcuaccagaccgccaugaagcuggugccccugaaggacgccaacuacagacagagcaucgacaagcugaaguacagcagcgugaccgacaccccccagaucgugcaggccaagaucaacgcccagcagcugagccacgugaacuacagagccgacuacgagaagaacaagcugaacuacacccugccccaggacgugccccagcuggugaaggccaagaccaacgccaagcuguucagcgaggugaaguacaaggagggcugggagaagaccaagggcaagggcuucgagaugaagcuggacgccaugagccugcuggccgccaaggccagcggcgagcuggccagcaacaucaaguacaaggaggaguacgagaagaccaagggcaaggccaugggcaccgccgacagcagacugcugcacagccugcagaucgccaagaugagcagcgagguggaguacaagaagggcuucgaggagagcaagaccagauuccaccugcccauggacauggugaacaucagacacgccaagaaggcccagacccuggccagcgaccuggacuacagaaagaagcugcacgaguacaccgugcugcccgaggacaugaagacccagugggccaagaaggccuacggccugcagagcgagcugcaguacaaggccgaccuggccuggaugaagggcgugggcuggcugaccgagggcagccugaaccuggagcaggccaagaaggccggccagcuggugagcgagaagaacuacagacagagaguggacgagcugaaguucaccagcgugaccgacagcagccagauggagcacgccaagaagagccaggagcugcagagcggcguggccuacaaggccggcaacgagcagagcgugcaccaguacaccaucagcaaggacgagccccuguuccugcaggccagagccaacgccgccaaccugagcgagaagcuguacaagagcagcugggagaaccagaaggccaagggcuucgagcugagacuggacagccugaccuuccuggccgccaaggccaagagagaccuggccagcgaggugaaguacaaggaggacuacgagagaagcagaggcaagcugaucggcgccaaggacgugcagggcgacagccagaugagccacagccugcagaugagcaagcugcagagcgagcuggaguacaagaagggcuucgaggacaccaagagccagugccacgugagccuggacauggugcaccuggugcacgccagaaaggcccagcaccuggccaccgacgugggcuacaagaccgccgagcaccacuucaccgcccugcccaccgacaugaagguggagugggccaagaaggccuacggccugcagagcgacaaccaguacagagccgacgugaaguggaugaagggcaugggcuggguggccaccggcagccugaacguggagcaggccaagaaggccggcgagcugaucagcgagaagaaguacagacagcaccccgacgcccugaaguucaccagcaucaaggacacccccgagauggugcaggccagaaucagcuacacccaggccguggacagacuguacagagagcagggcgagaacaucaagcaccacuacacccccaccgccgaccugcccgaggugcugcuggccaagcugaacgccaugaacaucagcgagaccagauacaaggagagcuggagcaagcugagagacggcggcuacaagcugagacuggacgcccugcccuuccaggccgccaaggccagcggcgagaucaucagcgacuacaaguacaaggaggccuucgagaagaugaagggccagaugcugggcagcagaagccuggaggacgacaucagccuggcccacagcguguacgccaccagccugcagagcgacgugaacuacaagaagggcuucgagcacagcaaggcccaguuccaccugccccuggacauggccgcccuggugcacgccaagaaggcccagacccuggccagcaaccaggacuacaagcacccccugccccaguacaccagccuggccgaggaccugagacugagcugcgccaagaaggcccacaagcugcagagcgagaaccuguacagaagcgaccugaacuucaugagaggcguggccugcgugauccccggcacccuggagaucgagggcagaaagaaggccagcgagcugaucagcgagagcaaguacagacagcacccccacagcuucaaguacaccgccgugaccgacacccccaaccugcugcacgccaaguucagcaaccagaucaccaacgagagacuguacaaggccgccggcgaggacgccagacacgaguacaccaugacccugggccugcccgaguucaucagagccaagaccaacgccgccaaccugagcgacgccagauacaaggagagcuggagaaaccugagagcccagggcuacaagcugaccaucgaggcccugcccuuccaggccgccagagccagcggcgacaucgccagcgacuuccuguacagacacgacuucgugaaggagagaggcaagcugaucggcccccagagcgugagagacgaccccagaauccagcacugcagaagaaugggccagcugcagagcgagcugcaguacagaagaggcgccaccagcagccaggcccaguuccaccugcccauggacauggugcaccuggugcacgccaagaacgcccaggcccuggccagcgaccacgacuacagaacccaguaccacaaguucaccgcccugcccgaggaccugaagauggccugggccaagaaggcccacgcccugcagagcgagcugagauacaagagcgaccugaucggcaugaagggcaucggcuggcuggcccugagaagcccccagauggagagcgccaagaaggccggcgagcugaucagcgagaccaaguacagaaagaagcccgacagcaucaaguucaccaccgugguggacagccccgaccuggugcacgccaagaacagcuacaugcacugcaacgagagaauguacagaagcggcgacgccgagagccugcacagauacacccugauccccgaccaccccgacuucaccagagccagacugaacgcccugcaccugagcgacaagguguacagaaacagcugggagcagaccagagccggcagcuacgacuucagacuggacgccauccccuuccagaccgccagagccagcagagagaucgccagcgacuucagauacaaggaggccuuccugagagacagaggccugcagaucggcuacagaagcguggacgacgaccccagaaugaagcacuuccugaacgugggcagacugcagagcgacaacgaguacaagaaggacuucgccaagagcagaagccaguuccacagcagcaccgaccagcccggccugcugcaggccaagagaagccagcagcuggccagcgacgugcacuacagacagccccugccccagcccaccugcgaccccgagcagcugggccugagacacgcccagaaggcccaccagcugcagagcgacgugaaguacaagagcgaccugaaccugaccagaggcgugggcuggaccccccccggcagcuacaagguggagauggccagaagagccgccgagcuggccaacgccagaggccugggccugcagggcgccuacagaggcgccgaggccguggaggccggcgaccaccagagcggcgaggugaaccccgacgccaccgagauccugcacgugaagaagaagaaggcccugcugcuguaa

SEQ ID NO: 20731 - RNA, 345 nt, Artificial Sequence
  NRARP__Homo_sapiens__NP_001004354
augagccaggccgagcugagcaccugcagcgccccccagacccagagaaucuuccaggaggccgugagaaagggcaacacccaggagcugcagagccugcugcagaacaugaccaacugcgaguucaacgugaacagcuucggccccgagggccagaccgcccugcaccagagcgugaucgacggcaaccuggagcuggugaagcugcuggugaaguucggcgccgacaucagacuggccaacagagacggcuggagcgcccugcacaucgccgccuucggcggccaccaggacaucgugcuguaccugaucaccaaggccaaguacgccgccagcggcagauaa

SEQ ID NO: 20732 - RNA, 1608 nt, Artificial Sequence
  NRBP1__Homo_sapiens__XP_005264331
augagcgagggcgagagccagaccgugcugagcagcggcagcgaccccaagguggagagcagcagcagcgcccccggccugaccagcgugagcccccccgugaccagcaccaccagcgccgccagccccgaggaggaggaggagagcgaggacgagagcgagauccuggaggagagccccugcggcagauggcagaagagaagagaggaggugaaccagagaaacgugcccggcaucgacagcgccuaccuggccauggacaccgaggagggcguggaggugguguggaacgaggugcaguucagcgagagaaagaacuacaagcugcaggaggagaaggugagagccguguucgacaaccugauccagcuggagcaccugaacaucgugaaguuccacaaguacugggccgacaucaaggagaacaaggccagagugaucuucaucaccgaguacaugagcagcggcagccugaagcaguuccugaagaagaccaagaagaaccacaagaccaugaacgagaaggccuggaagagauggugcacccagauccugagcgcccugagcuaccugcacagcugcgacccccccaucauccacggcaaccugaccugcgacaccaucuucauccagcacaacggccugaucaagaucggcagcguggcccccgacaccaucaacaaccacgugaagaccugcagagaggagcagaagaaccugcacuucuucgcccccgaguacggcgaggugaccaacgugaccaccgccguggacaucuacagcuucggcaugugcgcccuggagauggccgugcuggagauccagggcaacggcgagagcagcuacgugccccaggaggccaucagcagcgccauccagcugcuggaggacccccugcagagagaguucauccagaagugccugcagagcgagcccgccagaagacccaccgccagagagcugcuguuccaccccgcccuguucgaggugcccagccugaagcugcuggccgcccacugcaucgugggccaccagcacaugauccccgagaacgcccuggaggagaucaccaagaacauggacaccagcgccgugcuggccgagauccccgccggccccggcagagagcccgugcagacccuguacagccagagccccgcccuggagcuggacaaguuccuggaggacgugagaaacggcaucuacccccugaccgccuucggccugcccagaccccagcagccccagcaggaggaggugaccagccccguggugccccccagcgugaagacccccacccccgagcccgccgagguggagaccagaaagguggugcugaugcagugcaacaucgagagcguggaggagggcgugaagcaccaccugacccugcugcugaagcuggaggacaagcugaacagacaccugagcugcgaccugaugcccaacgagaacauccccgagcuggccgccgagcuggugcagcugggcuucaucagcgaggccgaccagagcagacugaccagccugcuggaggagacccugaacaaguucaacuucgccagaaacagcacccugaacagcgccgccgugaccgugagcagcuaa

SEQ ID NO: 20733 - RNA, 1506 nt, Artificial Sequence
  NRBP2__Homo_sapiens__NP_848659
auggccgcccccgagcccgcccccagaagagccagagagagagagagagagagagaggacgagagcgaggacgagagcgacauccuggaggagagccccugcggcagauggcagaagagaagagagcaggugaaccagggcaacaugcccggccugcagagcaccuuccuggccauggacaccgaggagggcguggaggugguguggaacgagcugcacuucggcgacagaaaggccuucgccgcccacgaggagaagauccagaccguguucgagcagcuggugcugguggaccaccccaacaucgugaagcugcacaaguacuggcuggacaccagcgaggccugcgccagagugaucuucaucaccgaguacgugagcagcggcagccugaagcaguuccugaagaagaccaagaagaaccacaaggccaugaacgccagagccuggaagagauggugcacccagauccugagcgcccugagcuuccugcacgccugcagcccccccaucauccacggcaaccugaccagcgacaccaucuucauccagcacaacggccugaucaagaucggcagcguguggcacagaaucuucagcaacgcccugcccgacgaccugagaagccccaucagagccgagagagaggagcugagaaaccugcacuucuucccccccgaguacggcgagguggccgacggcaccgccguggacaucuucagcuucggcaugugcgcccuggagauggccgugcuggagauccagaccaacggcgacaccagagugaccgaggaggccaucgccagagccagacacagccugagcgaccccaacaugagagaguucauccugugcugccuggccagagaccccgccagaagacccagcgcccacagccugcuguuccacagagugcuguucgaggugcacagccugaagcugcuggccgcccacugcuucauccagcaccaguaccugaugcccgagaacgugguggaggagaagaccaaggccauggaccugcacgccgugcuggccgagcugcccagacccagaagacccccccugcaguggagauacagcgaggugagcuucauggagcuggacaaguuccuggaggacgugagaaacggcaucuacccccugaugaacuucgccgccaccagaccccugggccugcccagagugcuggcccccccccccgaggaggugcagaaggccaagacccccacccccgagcccuucgacagcgagaccagaaaggugauccagaugcagugcaaccuggagagaagcgaggacaaggccagauggcaccugacccugcugcuggugcuggaggacagacugcacagacagcugaccuacgaccugcugcccaccgacagcgcccaggaccuggccagcgagcuggugcacuacggcuuccugcacgaggacgacagaaugaagcuggccgccuuccuggagagcaccuuccugaaguacagaggcacccaggccuaa

SEQ ID NO: 20734 - RNA, 3915 nt, Artificial Sequence
  NRCAM__Homo_sapiens__NP_001032209
augcagcugaagaucaugcccaagaagaagagacugagcgccggcagagugccccugauccuguuccugugccagaugaucagcgcccuggaggugccccuggaccccaagcugcuggaggaccuggugcagccccccaccaucacccagcagagccccaaggacuacaucaucgaccccagagagaacaucgugauccagugcgaggccaagggcaagcccccccccagcuucagcuggaccagaaacggcacccacuucgacaucgacaaggacccccuggugaccaugaagcccggcaccggcacccugaucaucaacaucaugagcgagggcaaggccgagaccuacgagggcguguaccagugcaccgccagaaacgagagaggcgccgccgugagcaacaacaucguggugagacccagcagaagcccccuguggaccaaggagaagcuggagcccaucacccugcagagcggccagagccuggugcugcccugcagaccccccaucggccugcccccccccaucaucuucuggauggacaacagcuuccagagacugccccagagcgagagagugagccagggccugaacggcgaccuguacuucagcaacgugcugcccgaggacaccagagaggacuacaucugcuacgccagauucaaccacacccagaccauccagcagaagcagcccaucagcgugaaggugaucagcguggacgagcugaacgacaccaucgccgccaaccugagcgacaccgaguucuacggcgccaagagcagcagagagagaccccccaccuuccugacccccgagggcaacgccagcaacaaggaggagcugagaggcaacgugcugagccuggagugcaucgccgagggccugcccacccccaucaucuacugggccaaggaggacggcaugcugcccaagaacagaaccguguacaagaacuucgagaagacccugcagaucauccacgugagcgaggccgacagcggcaacuaccagugcaucgccaagaacgcccugggcgccauccaccacaccaucagcgugagagugaaggccgcccccuacuggaucaccgccccccagaaccuggugcugagccccggcgaggacggcacccugaucugcagagccaacggcaaccccaagcccagaaucagcuggcugaccaacggcgugcccaucgagaucgcccccgacgaccccagcagaaagaucgacggcgacaccaucaucuucagcaacgugcaggagagaagcagcgccguguaccagugcaacgccagcaacgaguacggcuaccugcuggccaacgccuucgugaacgugcuggccgagccccccagaauccugacccccgccaacacccuguaccaggugaucgccaacagacccgcccugcuggacugcgccuucuucggcagcccccugcccaccaucgagugguucaagggcgccaagggcagcgcccugcacgaggacaucuacgugcugcacgagaacggcacccuggagauccccguggcccagaaggacagcaccggcaccuacaccugcguggccagaaacaagcugggcauggccaagaacgaggugcaccuggagaucaaggaccccaccuggaucgugaagcagcccgaguacgccguggugcagagaggcagcauggugagcuucgagugcaaggugaagcacgaccacacccugagccugaccgugcuguggcugaaggacaacagagagcugcccagcgacgagagauucaccguggacaaggaccaccuggugguggccgacgugagcgacgacgacagcggcaccuacaccugcguggccaacaccacccuggacagcgugagcgccagcgccgugcugagcgugguggcccccacccccacccccgcccccguguacgacgugcccaacccccccuucgaccuggagcugaccgaccagcuggacaagagcgugcagcugagcuggacccccggcgacgacaacaacagccccaucaccaaguucaucaucgaguacgaggacgccaugcacaagcccggccuguggcaccaccagaccgaggugagcggcacccagaccaccgcccagcugaagcugagccccuacgugaacuacagcuucagagugauggccgugaacagcaucggcaagagccugcccagcgaggccagcgagcaguaccugaccaaggccagcgagcccgacaagaaccccaccgccguggagggccugggcagcgagcccgacaaccuggugaucaccuggaagccccugaacggcuucgagagcaacggccccggccugcaguacaaggugagcuggagacagaaggacggcgacgacgaguggaccagcguggugguggccaacgugagcaaguacaucgugagcggcacccccaccuucgugcccuaccugaucaaggugcaggcccugaacgacaugggcuucgcccccgagcccgccguggugaugggccacagcggcgaggaccugcccaugguggcccccggcaacgugagagugaacguggugaacagcacccuggccgaggugcacugggaccccgugccccugaagagcaucagaggccaccugcagggcuacagaaucuacuacuggaagacccagagcagcagcaagagaaacagaagacacaucgagaagaagauccugaccuuccagggcagcaagacccacggcaugcugcccggccuggagcccuucagccacuacacccugaacgugagaguggugaacggcaagggcgagggccccgccagccccgacagaguguucaacacccccgagggcgugcccagcgcccccagcagccugaagaucgugaaccccacccuggacagccugacccuggagugggacccccccagccaccccaacggcauccugaccgaguacacccugaaguaccagcccaucaacagcacccacgagcugggcccccugguggaccugaagauccccgccaacaagaccagauggacccugaagaaccugaacuucagcaccagauacaaguucuacuucuacgcccagaccagcgccggcagcggcagccagaucaccgaggaggccgugaccaccguggacgaggccggcauccugccccccgacgugggcgccggcaaggugcaggccgugaaccccagaaucagcaaccugaccgccgccgccgccgagaccuacgccaacaucagcugggaguacgagggccccgagcacgugaacuucuacguggaguacggcguggccggcagcaaggaggaguggagaaaggagaucgugaacggcagcagaagcuucuucggccugaagggccugaugcccggcaccgccuacaaggugagagugggcgccgugggcgacagcggcuucgugagcagcgaggacguguucgagaccggccccgccauggccagcagacagguggacaucgccacccagggcugguucaucggccugaugugcgccguggcccugcugauccugauccugcugaucgugugcuucaucagaagaaacaagggcggcaaguaccccgugaaggagaaggaggacgcccacgccgaccccgagauccagcccaugaaggaggacgacggcaccuucggcgaguacagcgacgccgaggaccacaagccccugaagaagggcagcagaacccccagcgacagaaccgugaagaaggaggacagcgacgacagccugguggacuacggcgagggcgugaacggccaguucaacgaggacggcagcuucaucggccaguacagcggcaagaaggagaaggagcccgccgagggcaacgagagcagcgaggcccccagccccgugaacgccaugaacagcuucguguaa

SEQ ID NO: 20735 - RNA, 3564 nt, Artificial Sequence
  NRD1__Homo_sapiens__XP_011539823
augcugagaagagugaccguggccgccgugugcgccaccagaagaaagcugugcgaggccggcagagagcuggccgcccuguggggcaucgagaccagaggcagaugcgaggacagcgccgccgccagacccuuccccauccuggccaugcccggcagaaacaaggccaagagcaccugcagcugccccgaccugcagcccaacggccaggaccugggcgagaacagcagaguggccagacugggcgccgacgagagcgaggaggagggcagaagaggcagccugagcaacgccggcgaccccgagaucgugaagagccccagcgaccccaagcaguacagauacaucaagcugcagaacggccugcaggcccugcugaucagcgaccugagcaacauggagggcaagaccggcaacaccaccgacgacgaggaggaggaggagguggaggaggaggaggaggacgacgacgaggacagcggcgccgagaucgaggacgacgacgaggagggcuucgacgacgaggacgaguucgacgacgagcacgacgacgaccuggacaccgaggacaacgagcuggaggagcuggaggagagagccgaggccagaaagaagaccaccgagaagcagcagcugcagagccuguuccugcuguggagcaagcugaccgacagacugugguucaagagcaccuacagcaagaugagcagcacccugcugguggagaccagaaaccuguacggcguggugggcgccgagagcagaagcgcccccgugcagcaccuggccggcuggcaggccgaggagcagcagggcgagaccgacaccgugcugagcgccgccgcccugugcgugggcgugggcagcuucgccgaccccgacgaccugcccggccuggcccacuuccuggagcacaugguguucaugggcagccugaaguaccccgacgagaacggcuucgacgccuuccugaagaagcacggcggcagcgacaacgccagcaccgacugcgagagaaccguguuccaguucgacgugcagagaaaguacuucaaggaggcccuggacagaugggcccaguucuucauccacccccugaugaucagagacgccaucgacagagagguggaggccguggacagcggcaacgccgagacccugaagcacgagcccagaaagaacaacaucgacacccacgccagacugagagaguucuggaugagauacuacagcagccacuacaugacccugguggugcagagcaaggagacccuggacacccuggagaagugggugaccgagaucuucagccagauccccaacaacggccugcccagacccaacuucggccaccugaccgaccccuucgacacccccgccuucaacaagcuguacagaguggugcccaucagaaagauccacgcccugaccaucaccugggcccugcccccccagcagcagcacuacagagugaagccccugcacuacaucagcuggcuggugggccacgagggcaagggcagcauccugagcuuccugagaaagaagugcugggcccuggcccuguucggcggcaacggcgagaccggcuucgagcagaacagcaccuacagcguguucagcaucagcaucacccugaccgacgagggcuacgagcacuucuacgagguggccuacaccguguuccaguaccugaagaugcugcagaagcugggccccgagaagagaaucuucgaggagaucagaaagaucgaggacaacgaguuccacuaccaggagcagaccgaccccguggaguacguggagaacaugugcgagaacaugcagcuguacccccugcaggacauccugaccggcgaccagcugcuguucgaguacaagcccgaggugaucggcgaggcccugaaccagcuggugccccagaaggccaaccuggugcugcugagcggcgccaacgagggcaagugcgaccugaaggagaagugguucggcacccaguacagcaucgaggacaucgagaacagcugggccgagcuguggaacagcaacuucgagcugaaccccgaccugcaccugcccgccgagaacaaguacaucgccaccgacuucacccugaaggccuucgacugccccgagaccgaguaccccgugaagaucgugaacaccccccagggcugccugugguacaagaaggacaacaaguucaagauccccaaggccuacaucagauuccaccugaucagcccccugauccagaagagcgccgccaacguggugcuguucgacaucuucgugaacauccugacccacaaccuggccgagcccgccuacgaggccgacguggcccagcuggaguacaagcugguggccggcgagcacggccugaucaucagagugaagggcuucaaccacaagcugccccugcuguuccagcugaucaucgacuaccuggccgaguucaacagcacccccgccguguucaccaugaucaccgagcagcugaagaagaccuacuucaacauccugaucaagcccgagacccuggccaaggacgugagacugcugauccuggaguacgccagauggagcaugaucgacaaguaccaggcccugauggacggccugagccuggagagccugcugagcuucgugaaggaguucaagagccagcuguucguggagggccuggugcagggcaacgugaccagcaccgagagcauggacuuccugaaguacgugguggacaagcugaacuucaagccccuggagcaggagaugcccgugcaguuccaggugguggagcugcccagcggccaccaccugugcaaggugaaggcccugaacaagggcgacgccaacagcgaggugaccguguacuaccagagcggcaccagaagccugagagaguacacccugauggagcugcuggugaugcacauggaggagcccugcuucgacuuccugagaaccaagcagacccugggcuaccacguguaccccaccugcagaaacaccagcggcauccugggcuucagcgugaccgugggcacccaggccaccaaguacaacagcgaggugguggacaagaagaucgaggaguuccugagcagcuucgaggagaagaucgagaaccugaccgaggaggccuucaacacccaggugaccgcccugaucaagcugaaggagugcgaggacacccaccugggcgaggagguggacagaaacuggaacgagguggugacccagcaguaccuguucgacagacuggcccacgagaucgaggcccugaagagcuucagcaagagcgaccuggugaacugguucaaggcccacagaggccccggcagcaagaugcugagcgugcacguggugggcuacggcaaguacgagcuggaggaggacggcacccccagcagcgaggacagcaacagcagcugcgaggugaugcagcugaccuaccugcccaccagcccccugcuggccgacugcaucauccccaucaccgacaucagagccuucaccaccacccugaaccugcugcccuaccacaagaucgugaaguaa

SEQ ID NO: 20736 - RNA, 3495 nt, Artificial Sequence
  NRDE2__Homo_sapiens__NP_060440
auggcccuguuccccgccuucgccggccugagcgaggcccccgacggcggcagcagcagaaaggagcuggacuggcugagcaaccccagcuucugcgugggcagcaucaccagccugagccagcagaccgaggccgcccccgcccacgugagcgagggccugccccugaccagaagccaccugaagagcgagagcagcgacgagagcgacaccaacaagaagcugaagcagaccagcagaaagaagaagaaggagaagaagaagaagagaaagcaccagcaccacaagaagaccaagagaaagcacggccccagcagcagcagcagaagcgagaccgacaccgacagcgagaaggacaagcccagcagaggcgugggcggcagcaagaaggagagcgaggagcccaaccagggcaacaacgccgccgccgacaccggccacagauucguguggcuggaggacauccaggccgugaccggcgagaccuucagaaccgacaagaagcccgaccccgccaacugggaguacaagagccuguacagaggcgacaucgccagauacaagagaaagggcgacagcugccugggcaucaaccccaagaagcagugcaucagcugggagggcaccagcaccgagaagaagcacagcagaaagcagguggagagauacuucaccaagaagagcgugggccugaugaacaucgacggcguggccaucagcagcaagaccgagccccccagcagcgagcccaucagcuucauccccgugaaggaccuggaggacgccgcccccgugaccaccuggcugaacccccugggcaucuacgaccagagcaccacccacuggcugcagggccagggcccccccgagcaggagagcaagcagcccgacgcccagcccgacagcgagagcgccgcccugaaggccaagguggaggaguucaacagaagagugagagagaaccccagagacacccagcuguggauggccuucguggccuuccaggacgaggugaugaagagccccggccuguacgccaucgaggagggcgagcaggagaagagaaagagaagccugaagcugauccuggagaagaagcuggccauccuggagagagccaucgagagcaaccagagcagcguggaccugaagcuggccaagcugaagcugugcaccgaguucugggagcccagcacccuggugaaggaguggcagaagcugaucuuccugcaccccaacaacaccgcccuguggcagaaguaccugcuguucugccagagccaguucagcaccuucagcaucagcaagauccacagccuguacggcaagugccugagcacccugagcgccgugaaggacggcagcauccugagccaccccgcccugcccggcaccgaggaggccauguucgcccuguuccugcagcagugccacuuccugagacaggccggccacagcgagaaggccaucagccuguuccaggccaugguggacuucaccuucuucaagcccgacagcgugaaggaccugcccaccaagggccagguggaguucuucgagcccuucugggacagcggcgagcccagagccggcgagaagggcgccagaggcuggaaggccuggaugcaccagcaggagagaggcggcuggguggugaucaaccccgacgaggacgacgacgagcccgaggaggacgaccaggagaucaaggacaagacccugcccagauggcagaucuggcuggccgccgagagaagcagagaccagagacacuggagacccuggagacccgacaagaccaagaagcagaccgaggaggacugcgaggaccccgagagacaggugcuguucgacgacaucggccagagccugaucagacugagcagccacgaccugcaguuccagcugguggaggccuuccugcaguuccugggcgugcccagcggcuucaccccccccgccagcugccuguaccuggccauggacgagaacagcaucuucgacaacggccuguacgacgagaagccccugaccuucuucaacccccuguucagcggcgccagcugcgugggcagaauggacagacugggcuaccccagauggaccagaggccagaacagagagggcgaggaguucaucagaaacguguuccaccuggugaugccccuguucagcggcaaggagaagagccagcugugcuucagcuggcugcaguacgagaucgccaaggugaucuggugccugcacaccaagaacaagaagagacugaagagccagggcaagaacugcaagaagcuggccaagaaccugcugaaggagcccgagaacugcaacaacuucugccuguggaagcaguacgcccaccuggaguggcugcugggcaacaccgaggacgccagaaagguguucgacaccgcccugggcauggccggcagcagagagcugaaggacagcgaccugugcgagcugagccugcuguacgccgagcuggagguggagcugagccccgaggugagaagagccgccaccgccagagccgugcacauccugaccaagcugaccgagagcagccccuacggccccuacaccggccaggugcuggccgugcacauccugaaggccagaaaggccuacgagcacgcccugcaggacugccugggcgacagcugcgugagcaaccccgcccccaccgacagcugcagcagacugaucagccuggccaagugcuucaugcuguuccaguaccugaccaucggcaucgacgccgccgugcagaucuacgagcagguguucgccaagcugaacagcagcguguuccccgagggcagcggcgagggcgacagcgccagcagccagagcuggaccagcgugcuggaggccaucacccugaugcacaccagccugcugagauuccacaugaaggugagcguguacccccuggccccccugagagaggcccugagccaggcccugaagcuguaccccggcaaccaggugcuguggagaagcuacgugcagauccagaacaagagccacagcgccagcaagaccagaagauucuucgacaccaucaccagaagcgccaagccccuggagcccuggcuguucgccaucgaggccgagaagcugagaaagagacugguggagaccgugcagagacuggacggcagagagauccacgccaccauccccgagaccggccugaugcacagaauccaggcccuguucgagaacgccaugagaagcgacagcggcagccagugcccccugcuguggagaauguaccugaacuuccuggugagccugggcaacaaggagagaagcaagggcguguucuacaaggcccugcagaacugccccugggccaaggugcuguaccuggacgccguggaguacuuccccgacgagaugcaggagauccuggaccugaugaccgagaaggagcugagagugagacugccccuggaggagcuggagcugcugcuggaggacuaa

SEQ ID NO: 20737 - RNA, 339 nt, Artificial Sequence
  NREP__Homo_sapiens__NP_001135947
augaagggcguguggaacuacagcgcccugagcagaagagaggacgagaccagaacccagagaagcagaaugaccgacagagugcccugcagcaagugcuuccaggugcacugccagaucagcgugcugaacugcguguacuaccccgagcuguucgugugggugagccaggagcccuuccccaacaaggacauggagggcagacugcccaagggcagacugcccgugcccaaggaggugaacagaaagaagaacgacgagaccaacgccgccagccugaccccccugggcagcagcgagcugagaagccccagaaucagcuaccugcacuucuucuaa

SEQ ID NO: 20738 - RNA, 1569 nt, Artificial Sequence
  NRF1__Homo_sapiens__NP_001280092
auggaggagcacggcgugacccagaccgagcacauggccaccaucgaggcccacgccguggcccagcaggugcagcaggugcacguggccaccuacaccgagcacagcaugcugagcgccgacgaggacagccccagcagccccgaggacaccagcuacgacgacagcgacauccugaacagcaccgccgccgacgaggugaccgcccaccuggccgccgccggccccgugggcauggccgccgccgccgccguggccaccggcaagaagagaaagagaccccacguguucgagagcaaccccagcaucagaaagagacagcagaccagacugcugagaaagcugagagccacccuggacgaguacaccaccagagugggccagcaggccaucgugcugugcaucagccccagcaagcccaaccccguguucaagguguucggcgccgccccccuggagaacguggugagaaaguacaagagcaugauccuggaggaccuggagagcgcccuggccgagcacgcccccgccccccaggaggugaacagcgagcugcccccccugaccaucgacggcauccccgugagcguggacaagaugacccaggcccagcugagagccuucauccccgagaugcugaaguacagcaccggcagaggcaagcccggcuggggcaaggagagcugcaagcccaucugguggcccgaggacauccccugggccaacgugagaagcgacgugagaaccgaggagcagaagcagagagugagcuggacccaggcccugagaaccaucgugaagaacugcuacaagcagcacggcagagaggaccugcuguacgccuucgaggaccagcagacccagacccaggccaccgccacccacagcaucgcccaccuggugcccagccagaccguggugcagaccuucagcaaccccgacggcaccgugagccugauccaggugggcaccggcgccaccguggccacccuggccgacgccagcgagcugcccaccaccgugaccguggcccaggugaacuacagcgccguggccgacggcgagguggagcagaacugggccacccugcagggcggcgagaugaccauccagaccacccaggccagcgaggccacccaggccguggccagccuggccgaggccgccguggccgccagccaggagaugcagcagggcgccaccgugaccauggcccugaacagcgaggccgccgcccacgccguggccacccuggccgaggccacccugcagggcggcggccagaucgugcugagcggcgagaccgccgccgccgugggcgcccugaccggcgugcaggacgccaacggccuguucauggccgacagagccggcagaaaguggauccugaccgacaaggccaccggccuggugcagauccccgugagcauguaccagaccguggugaccagccuggcccagggcaacggccccgugcagguggccauggcccccgugaccaccagaaucagcgacagcgccgugaccauggacggccaggccguggagguggugacccuggagcaguaa

SEQ ID NO: 20739 - RNA, 1824 nt, Artificial Sequence
  NRG1__Homo_sapiens__NP_001153467
augggcaagggcagagccggcagagugggcaccaccgcccugccccccagacugaaggagaugaagagccaggagagcgccgccggcagcaagcuggugcugagaugcgagaccagcagcgaguacagcagccugagauucaagugguucaagaacggcaacgagcugaacagaaagaacaagccccagaacaucaagauccagaagaagcccggcaagagcgagcugagaaucaacaaggccagccuggccgacagcggcgaguacaugugcaaggugaucagcaagcugggcaacgacagcgccagcgccaacaucaccaucguggagagcaacgagaucaucaccggcaugcccgccagcaccgagggcgccuacgugagcagcgccaccagcaccagcaccaccggcaccagccaccuggugaagugcgccgagaaggagaagaccuucugcgugaacggcggcgagugcuucauggugaaggaccugagcaaccccagcagauaccugugcaagugccccaacgaguucaccggcgacagaugccagaacuacgugauggccagcuucuacaagcaccugggcaucgaguucauggaggccgaggagcuguaccagaagagagugcugaccaucaccggcaucugcaucgcccugcugguggugggcaucaugugcgugguggccuacugcaagaccaagaagcagagaaagaagcugcacgacagacugagacagagccugagaagcgagagaaacaacaugaugaacaucgccaacggcccccaccaccccaaccccccccccgagaacgugcagcuggugaaccaguacgugagcaagaacgugaucagcagcgagcacaucguggagagagaggccgagaccagcuucagcaccagccacuacaccagcaccgcccaccacagcaccaccgugacccagacccccagccacagcuggagcaacggccacaccgagagcauccugagcgagagccacagcgugaucgugaugagcagcguggagaacagcagacacagcagccccaccggcggccccagaggcagacugaacggcaccggcggccccagagagugcaacagcuuccugagacacgccagagagacccccgacagcuacagagacagcccccacagcgagagauacgugagcgccaugaccacccccgccagaaugagccccguggacuuccacacccccagcagccccaagagcccccccagcgagaugagcccccccgugagcagcaugaccgugagcaugcccagcauggccgugagccccuucauggaggaggagagaccccugcugcuggugaccccccccagacugagagagaagaaguucgaccaccacccccagcaguucagcagcuuccaccacaaccccgcccacgacagcaacagccugcccgccagcccccugagaaucguggaggacgaggaguacgagaccacccaggaguacgagcccgcccaggagcccgugaagaagcuggccaacagcagaagagccaagagaaccaagcccaacggccacaucgccaacagacuggagguggacagcaacaccagcagccagagcagcaacagcgagagcgagaccgaggacgagagagugggcgaggacacccccuuccugggcauccagaacccccuggccgccagccuggaggccacccccgccuucagacuggccgacagcagaaccaaccccgccggcagauucagcacccaggaggagauccaggccagacugagcagcgugaucgccaaccaggaccccaucgccguguaa

SEQ ID NO: 20740 - RNA, 2355 nt, Artificial Sequence
  NRG2__Homo_sapiens__NP_001171864
augagacaggugugcugcagcgcccugcccccccccccccuggagaagggcagaugcagcagcuacagcgacagcagcagcagcagcagcgagagaagcagcagcagcagcagcagcagcagcgagagcggcagcagcagcagaagcagcagcaacaacagcagcaucagcagacccgccgccccccccgagcccagaccccagcagcagccccagcccagaagccccgccgccagaagagccgccgccagaagcagagccgccgccgccggcggcaugagaagagaccccgcccccggcuucagcaugcugcuguucggcgugagccuggccugcuacagccccagccugaagagcgugcaggaccaggccuacaaggcccccguggugguggagggcaaggugcagggccuggugcccgccggcggcagcagcagcaacagcaccagagagccccccgccagcggcagaguggcccuggugaaggugcuggacaaguggccccugagaagcggcggccugcagagagagcaggugaucagcgugggcagcugcgugccccuggagagaaaccagagauacaucuucuuccuggagcccaccgagcagccccugguguucaagaccgccuucgccccccuggacaccaacggcaagaaccugaagaaggaggugggcaagauccugugcaccgacugcgccaccagacccaagcugaagaagaugaagagccagaccggccaggugggcgagaagcagagccugaagugcgaggccgccgccggcaacccccagcccagcuacagaugguucaaggacggcaaggagcugaacagaagcagagacaucagaaucaaguacggcaacggcagaaagaacagcagacugcaguucaacaaggugaagguggaggacgccggcgaguacgugugcgaggccgagaacauccugggcaaggacaccgugagaggcagacuguacgugaacagcgaggccgaggagcuguaccagaagagagugcugaccaucaccggcaucugcguggcccugcugguggugggcaucgugugcgugguggccuacugcaagaccaagaagcagagaaagcagaugcacaaccaccugagacagaacaugugccccgcccaccagaacagaagccuggccaacggccccagccaccccagacuggaccccgaggagauccagauggccgacuacaucagcaagaacgugcccgccaccgaccacgugaucagaagagagaccgagaccaccuucagcggcagccacagcugcagccccagccaccacugcagcaccgccacccccaccagcagccacagacacgagagccacaccuggagccuggagagaagcgagagccugaccagcgacagccagagcggcaucaugcugagcagcgugggcaccagcaagugcaacagccccgccugcguggaggccagagccagaagagccgccgccuacaaccuggaggagagaagaagagccaccgccccccccuaccacgacagcguggacagccugagagacagcccccacagcgagagauacgugagcgcccugaccacccccgccagacugagccccguggacuuccacuacagccuggccacccaggugcccaccuucgagaucaccagccccaacagcgcccacgccgugagccugccccccgccgcccccaucagcuacagacuggccgagcagcagccccugcugagacaccccgccccccccggccccggccccggccccggccccggccccggccccggcgccgacaugcagagaagcuacgacagcuacuacuaccccgccgccggccccggccccagaagaggcaccugcgcccugggcggcagccugggcagccugcccgccagccccuucagaauccccgaggacgacgaguacgagaccacccaggagugcgcccccccccccccccccagacccagagccagaggcgccagcagaagaaccagcgccggccccagaagauggagaagaagcagacugaacggccuggccgcccagagagccagagccgccagagacagccugagccugagcagcggcagcggcggcggcagcgccagcgccagcgacgacgacgccgacgacgccgacggcgcccuggccgccgagagcacccccuuccugggccugagaggcgcccacgacgcccugagaagcgacagccccccccugugccccgccgccgacagcagaaccuacuacagccuggacagccacagcaccagagccagcagcagacacagcagaggccccccccccagagccaagcaggacagcgccccccuguaa

SEQ ID NO: 20741 - RNA, 2091 nt, Artificial Sequence
  NRG3__Homo_sapiens__NP_001010848
augagcgagggcgccgccgccgccagcccccccggcgccgccagcgccgccgccgccagcgccgaggagggcaccgccgccgccgccgccgccgccgccgccggcggcggccccgacggcggcggcgagggcgccgccgagccccccagagagcugagaugcagcgacugcaucguguggaacagacagcagaccuggcugugcguggugccccuguucaucggcuucaucggccugggccugagccugaugcugcugaaguggaucguggugggcagcgugaaggaguacgugcccaccgaccugguggacagcaagggcaugggccaggaccccuucuuccugagcaagcccagcagcuuccccaaggccauggagaccaccaccaccaccaccagcaccaccagccccgccacccccagcgccggcggcgccgccagcagcagaacccccaacagaaucagcaccagacugaccaccaucaccagagcccccaccagauuccccggccacagagugcccaucagagccagccccagaagcaccaccgccagaaacaccgccgcccccgccaccgugcccagcaccaccgcccccuucuucagcagcagcacccugggcagcagaccccccgugcccggcacccccagcacccaggccaugcccagcuggcccaccgccgccuacgccaccagcagcuaccugcacgacagcacccccagcuggacccugagccccuuccaggacgccgccagcagcagcagcagcagcagcagcagcgccaccaccaccacccccgagaccagcaccagccccaaguuccacaccaccaccuacagcaccgagagaagcgagcacuucaagcccugcagagacaaggaccuggccuacugccugaacgacggcgagugcuucgugaucgagacccugaccggcagccacaagcacugcagaugcaaggagggcuaccagggcgugagaugcgaccaguuccugcccaagaccgacagcauccugagcgaccccaccgaccaccugggcaucgaguucauggagagcgaggagguguaccagagacaggugcugagcaucagcugcaucaucuucggcaucgugaucgugggcauguucugcgccgccuucuacuucaagagcaagaagcaggccaagcagauccaggagcagcugaaggugccccagaacggcaagagcuacagccugaaggccagcagcaccauggccaagagcgagaaccuggugaagagccacgugcagcugcagaacuacagcaagguggagagacaccccgugaccgcccuggagaagaugauggagagcagcuucgugggcccccagagcuuccccgaggugcccagccccgacagaggcagccagagcgugaagcaccacagaagccugagcagcugcugcagccccggccagagaagcggcaugcugcacagaaacgccuucagaagaaccccccccagccccagaagcagacugggcggcaucgugggccccgccuaccagcagcuggaggagagcagaauccccgaccaggacaccauccccugccagggcuacagcagcagcggccugaagacccagagaaacaccagcaucaacaugcagcugcccagcagagagaccaaccccuacuucaacagccuggagcagaaggaccuggugggcuacagcagcaccagagccagcagcgugcccaucauccccagcgugggccuggaggagaccugccugcagaugcccggcaucagcgaggugaagagcaucaaguggugcaagaacagcuacagcgccgacguggugaacgugagcauccccgugagcgacugccugaucgccgagcagcaggaggugaagauccugcuggagaccgugcaggagcagaucagaauccugaccgacgccagaagaagcgaggacuacgagcuggccagcguggagaccgaggacagcgccagcgagaacaccgccuuccugccccugagccccaccgccaagagcgagagagaggcccaguucgugcugagaaacgagauccagagagacagcgcccugaccaaguaa

SEQ ID NO: 20742 - RNA, 348 nt, Artificial Sequence
  NRG4__Homo_sapiens__NP_612640
augcccaccgaccacgaggagcccugcggccccagccacaagagcuucugccugaacggcggccugugcuacgugauccccaccauccccagccccuucugcagaugcguggagaacuacaccggcgccagaugcgaggagguguuccugcccggcagcagcauccagaccaagagcaaccuguucgaggccuucguggcccuggccgugcuggugacccugaucaucggcgccuucuacuuccugugcagaaagggccacuuccagagagccagcagcgugcaguacgacaucaaccugguggagaccagcagcaccagcgcccaccacagccacgagcagcacuaa

SEQ ID NO: 20743 - RNA, 237 nt, Artificial Sequence
  NRGN__Homo_sapiens__NP_001119653
auggacugcugcaccgagaacgccugcagcaagcccgacgacgacauccuggacaucccccuggacgaccccggcgccaacgccgccgccgccaagauccaggccagcuucagaggccacauggccagaaagaagaucaagagcggcgagagaggcagaaagggccccggccccggcggccccggcggcgccggcguggccagaggcggcgccggcggcggccccagcggcgacuaa

SEQ ID NO: 20744 - RNA, 3477 nt, Artificial Sequence
  NRIP1__Homo_sapiens__XP_005261122
augacccacggcgaggagcugggcagcgacgugcaccaggacagcaucgugcugaccuaccuggagggccugcugaugcaccaggccgccggcggcagcggcaccgccguggacaagaagagcgccggccacaacgaggaggaccagaacuucaacaucagcggcagcgccuuccccaccugccagagcaacggccccgugcugaacacccacaccuaccagggcagcggcaugcugcaccugaagaaggccagacugcugcagagcagcgaggacuggaacgccgccaagagaaagagacugagcgacagcaucaugaaccugaacgugaagaaggaggcccugcuggccggcaugguggacagcgugcccaagggcaagcaggacagcacccugcuggccagccugcugcagagcuucagcagcagacugcagaccguggcccugagccagcagaucagacagagccugaaggagcagggcuacgcccugagccacgacagccugaagguggagaaggaccugagaugcuacggcguggccagcagccaccugaagacccugcugaagaagagcaaggugaaggaccagaagcccgacaccaaccugcccgacgugaccaagaaccugaucagagacagauucgccgagagcccccaccacgugggccagagcggcaccaaggugaugagcgagccccugagcugcgccgccagacugcaggccguggccagcaugguggagaagagagccagccccgccaccagccccaagcccagcguggccugcagccagcuggcccugcugcugagcagcgaggcccaccugcagcaguacagcagagagcacgcccugaagacccagaacgccaaccaggccgccagcgagagacuggccgccauggccagacugcaggagaacggccagaaggacgugggcagcuaccagcugcccaagggcaugagcagccaccugaacggccaggccagaaccagcagcagcaagcugauggccagcaagagcagcgccaccguguuccagaaccccaugggcaucauccccagcagccccaagaacgccggcuacaagaacagccuggagagaaacaacaucaagcaggccgccaacaacagccugcugcugcaccugcugaagagccagaccauccccaagcccaugaacggccacagccacagcgagagaggcagcaucuucgaggagagcagcacccccaccaccaucgacgaguacagcgacaacaaccccagcuucaccgacgacagcagcggcgacgagagcagcuacagcaacugcgugcccaucgaccugagcugcaagcacagaaccgagaagagcgagagcgaccagcccgugagccuggacaacuucacccagagccugcugaacaccugggaccccaaggugcccgacguggacaucaaggaggaccaggacaccagcaagaacagcaagcugaacagccaccagaaggugacccugcugcagcugcugcugggccacaagaacgaggagaacguggagaagaacaccagcccccagggcgugcacaacgacgugagcaaguucaacacccagaacuacgccagaaccagcgugaucgagagccccagcaccaacagaaccacccccgugagcacccccccccugcugaccagcagcaaggccggcagccccaucaaccugagccagcacagccuggugaucaaguggaacagcccccccuacgugugcagcacccagagcgagaagcugaccaacaccgccagcaaccacagcauggaccugaccaagagcaaggacccccccggcgagaagcccgcccagaacgagggcgcccagaacagcgccaccuucagcgccagcaagcugcugcagaaccuggcccagugcggcaugcagagcagcaugagcguggaggagcagagacccagcaagcagcugcugaccggcaacaccgacaagcccaucggcaugaucgacagacugaacagcccccugcugagcaacaagaccaacgccguggaggagaacaaggccuucagcagccagcccaccggccccgagcccggccugagcggcagcgagaucgagaaccugcuggagagaagaaccgugcugcagcugcugcugggcaaccccaacaagggcaagagcgagaagaaggagaagaccccccugagagacgagagcacccaggagcacagcgagagagcccugagcgagcagauccugauggugaagaucaagagcgagcccugcgacgaccugcagauccccaacaccaacgugcaccugagccacgacgccaagagcgcccccuuccugggcauggcccccgccgugcagagaagcgcccccgcccugcccgugagcgaggacuucaagagcgagcccgugagcccccaggacuucagcuucagcaagaacggccugcugagcagacugcugagacagaaccaggacagcuaccuggccgacgacagcgacagaagccacagaaacaacgagauggcccugcuggagagcaagaaccugugcauggugcccaagaagagaaagcuguacaccgagccccuggagaaccccuucaagaagaugaagaacaacaucguggacgccgccaacaaccacagcgcccccgaggugcuguacggcagccugcugaaccaggaggagcugaaguucagcagaaacgaccuggaguucaaguaccccgccggccacggcagcgccagcgagagcgagcacagaagcugggccagagagagcaagagcuucaacgugcugaagcagcugcugcugagcgagaacugcgugagagaccugagcccccacagaagcaacagcguggccgacagcaagaagaagggccacaagaacaacgugaccaacagcaagcccgaguucagcaucagcagccugaacggccugauguacagcagcacccagcccagcagcugcauggacaacagaaccuucagcuaccccggcguggugaagacccccgugagccccaccuuccccgagcaccugggcugcgccggcagcagacccgagagcggccugcugaacggcugcagcaugcccagcgagaagggccccaucaagugggugaucaccgacgccgagaagaacgaguacgagaaggacagccccagacugaccaagaccaaccccauccuguacuacaugcugcagaagggcggcaacagcgugaccagcagagagacccaggacaaggacaucuggagagaggccagcagcgccgagagcgugagccaggugaccgccaaggaggagcugcugcccaccgccgagaccaaggccagcuucuucaaccugagaagccccuacaacagccacaugggcaacaacgccagcagaccccacagcgccaacggcgagguguacggccugcugggcagcgugcugaccaucaagaaggagagcgaguaa

SEQ ID NO: 20745 - RNA, 846 nt, Artificial Sequence
  NRIP2__Homo_sapiens__NP_113662
augcuguucaucuucccccugagccugcccuggagacccagcugcuggaaggagagcugcagcaccggccagagacaggccggcagaagcagagaggacagcgugacccccccccccagcagccccuggcccaccccccccgccggcgccaugagcaccaagcaggaggccagaagagacgagggcgaggccagaaccagaggccaggaggcccagcugagagacagagcccaccugagccagcagagaagacugaagcaggccacccaguuccugcacaaggacagcgccgaccugcugccccuggacagccugaagagacugggcaccagcaaggaccugcagcccagaagcgugauccagagaagacugguggagggcaaccccaacuggcugcagggcgagccccccagaaugcaggaccugauccacggccaggagagcagaagaaagaccagcagaaccgagauccccgcccugcuggugaacugcaagugccaggaccagcugcugagaguggccguggacaccggcacccaguacaacagaaucagcgccggcugccugagcagacugggccuggagaagagagugcugaaggccagcgccggcgaccuggcccccggcccccccacccagguggagcagcuggagcugcagcugggccaggagaccguggugugcagcgcccaggugguggacgccgagagccccgaguucugccugggccugcagacccugcugagccugaagugcugcaucgaccuggagcacggcgugcugagacugaaggcccccuucagcgagcugcccuuccugccccuguaccaggagcccggccaguaa

SEQ ID NO: 20746 - RNA, 4749 nt, Artificial Sequence
  NRK__Homo_sapiens__NP_940867
auggccggccccggcggcuggagagacagagaggugaccgaccugggccaccugcccgaccccaccggcaucuucagccuggacaagaccaucggccugggcaccuacggcagaaucuaccugggccugcacgagaagaccggcgccuucaccgccgugaaggugaugaacgccagaaagaccccccugcccgagaucggcagaagagugagagugaacaaguaccagaagagcgugggcuggagauacagcgacgaggaggaggaccugagaaccgagcugaaccugcugagaaaguacagcuuccacaagaacaucgugagcuucuacggcgccuucuucaagcugagcccccccggccagagacaccagcuguggauggugauggagcugugcgccgccggcagcgugaccgacguggugagaaugaccagcaaccagagccugaaggaggacuggaucgccuacaucugcagagagauccugcagggccuggcccaccugcacgcccacagagugauccacagagacaucaagggccagaacgugcugcugacccacaacgccgaggugaagcugguggacuucggcgugagcgcccaggugagcagaaccaacggcagaagaaacagcuucaucggcacccccuacuggauggcccccgaggugaucgacugcgacgaggaccccagaagaagcuacgacuacagaagcgacguguggagcgugggcaucaccgccaucgagauggccgagggcgcccccccccugugcaaccugcagccccuggaggcccuguucgugauccugagagagagcgcccccaccgugaagagcagcggcuggagcagaaaguuccacaacuucauggagaagugcaccaucaagaacuuccuguucagacccaccagcgccaacaugcugcagcaccccuucgugagagacaucaagaacgagagacacgugguggagagccugaccagacaccugaccggcaucaucaagaagagacagaagaagggcaucccccugaucuucgagagagaggaggccaucaaggagcaguacaccgugagaagauucagaggccccagcugcacccacgagcugcugagacugcccaccagcagcagaugcagaccccugagagugcugcacggcgagcccagccagcccagauggcugcccgacagagaggagccccaggugcaggcccugcagcagcugcagggcgccgccagaguguucaugccccugcaggcccuggacagcgcccccaagccccugaagggccaggcccaggccccccagagacugcagggcgccgccagaguguucaugccccugcaggcccaggugaaggccaaggccagcaagccccugcagaugcagaucaaggccccccccagacugagaagagccgccagagugcugaugccccugcaggcccaggugagagcccccagacugcugcaggugcagagccaggugagcaagaagcagcaggcccagacccagaccagcgagccccaggaccuggaccaggugcccgaggaguuccagggccaggaccaggugcccgagcagcagagacagggccaggcccccgagcagcagcagagacacaaccaggugcccgagcaggagcuggagcagaaccaggcccccgagcagcccgaggugcaggagcaggccgccgagcccgcccaggccgagaccgaggccgaggagcccgagagccugagagugaacgcccagguguuccugccccugcugagccaggaccaccacgugcugcugccccugcaccuggacacccaggugcugauccccguggagggccagaccgagggcagcccccaggcccaggccuggacccuggagcccccccaggccaucggcagcgugcaggcccugaucgagggccugagcagagaccugcugagagcccccaacagcaacaacagcaagccccugggcccccugcagacccugauggagaaccugagcagcaacagauucuacagccagcccgagcaggccagagagaagaagagcaaggugagcacccugagacaggcccuggccaagagacugagccccaagagauucagagccaagagcagcuggagacccgagaagcuggagcugagcgaccuggaggccagaagacagagaagacagagaagaugggaggacaucuucaaccagcacgaggaggagcugagacagguggacaaggacaaggaggacgagagcagcgacaacgacgagguguuccacagcauccaggccgaggugcagaucgagccccugaagcccuacaucagcaaccccaagaagaucgaggugcaggagagaagccccagcgugcccaacaaccaggaccacgcccaccacgugaaguucagcagcagcgugccccagagaagccugcuggagcaggcccagaagcccaucgacaucagacagagaagcagccagaacagacagaacuggcuggccgccagcgagagcagcagcgaggaggagagccccgugaccggcagaagaagccagagcagcccccccuacagcaccaucgaccagaagcugcugguggacauccacgugcccgacggcuucaaggugggcaagaucagcccccccguguaccugaccaacgagugggugggcuacaacgcccugagcgagaucuucagaaacgacuggcugacccccgcccccgugauccagccccccgaggaggacggcgacuacguggagcuguacgacgccagcgccgacaccgacggcgacgacgacgacgagagcaacgacaccuucgaggacaccuacgaccacgccaacggcaacgacgaccuggacaaccagguggaccaggccaacgacgugugcaaggaccacgacgacgacaacaacaaguucguggacgacgugaacaacaacuacuacgaggcccccagcugccccagagccagcuacggcagagacggcagcugcaagcaggacggcuacgacggcagcagaggcaaggaggaggccuacagaggcuacggcagccacaccgccaacagaagccacggcggcagcgccgccagcgaggacaacgccgccaucggcgaccaggaggagcacgccgccaacaucggcagcgagagaagaggcagcgagggcgacggcggcaagggcguggugagaaccagcgaggagagcggcgcccugggccugaacggcgaggagaacugcagcgagaccgacggccccggccugaagagacccgccagccaggacuucgaguaccugcaggaggagcccggcggcggcaacgaggccagcaacgccaucgacagcggcgccgcccccagcgcccccgaccacgagagcgacaacaaggacaucagcgagagcagcacccagagcgacuucagcgccaaccacagcagccccagcaagggcagcggcaugagcgccgacgccaacuucgccagcgccauccuguacgccggcuucguggaggugcccgaggagagccccaagcagcccagcgaggugaacgugaacccccuguacgugagccccgccugcaagaagccccugauccacauguacgagaaggaguucaccagcgagaucugcugcggcagccuguggggcgugaaccugcugcugggcaccagaagcaaccuguaccugauggacagaagcggcaaggccgacaucaccaagcugaucagaagaagacccuucagacagauccaggugcuggagccccugaaccugcugaucaccaucagcggccacaagaacagacugagaguguaccaccugaccuggcugagaaacaagauccugaacaacgaccccgagagcaagagaagacaggaggagaugcugaagaccgaggaggccugcaaggccaucgacaagcugaccggcugcgagcacuucagcgugcugcagcacgaggagaccaccuacaucgccaucgcccugaagagcagcauccaccuguacgccugggcccccaagagcuucgacgagagcaccgccaucaaggugugcaucgaccagagcgccgacagcgagggcgacuacaugagcuaccaggccuacaucagaauccuggccaagauccaggccgccgaccccgugaacagauucaagagacccgacgagcugcugcaccugcugaagcugaagguguuccccacccuggaccacaagcccgugaccguggaccuggccaucggcagcgagaagagacugaagaucuucuucagcagcgccgacggcuaccaccugaucgacgccgagagcgaggugaugagcgacgugacccugcccaagaacccccuggagaucaucaucccccagaacaucaucauccugcccgacugccugggcaucggcaugaugcugaccuucaacgccgaggcccugagcguggaggccaacgagcagcuguucaagaagauccuggagauguggaaggacauccccagcagcaucgccuucgagugcacccagagaaccaccggcuggggccagaaggccaucgaggugagaagccugcagagcagagugcuggagagcgagcugaagagaagaagcaucaagaagcugagauuccugugcaccagaggcgacaagcuguucuucaccagcacccugagaaaccaccacagcagaguguacuucaugacccugggcaagcuggaggagcugcagagcaacuacgacguguaa

SEQ ID NO: 20747 - RNA, 813 nt, Artificial Sequence
  NRL__Homo_sapiens__XP_011535103
augggcaaccuggccgaggccgagagcagaagagccccccuggccgcccccagaggcagagcccagagaaaggugcacagcagccagcccagcagcagaauggcccugccccccagcccccuggccauggaguacgugaacgacuucgaccugaugaaguucgaggugaagagagagcccagcgagggcagacccggcccccccaccgccagccugggcagcacccccuacagcagcgugccccccagccccaccuucagcgagcccggcauggugggcgccaccgagggcaccagacccggccuggaggagcuguacuggcuggccacccugcagcagcagcugggcgccggcgaggcccugggccugagccccgaggaggccauggagcugcugcagggccagggccccgugcccguggacggcccccacggcuacuaccccggcagccccgaggagaccggcgcccagcacgugcagcuggccgagagauucagcgacgccgcccuggugagcaugagcgugagagagcugaacagacagcugagaggcugcggcagagacgaggcccugagacugaagcagagaagaagaacccugaagaacagaggcuacgcccaggccugcagaagcaagagacugcagcagagaagaggccuggaggccgagagagccagacuggccgcccagcuggacgcccugagagccgagguggccagacuggccagagagagagaccuguacaaggccagaugcgacagacugaccagcagcggccccggcagcggcgaccccagccaccuguuccuguaa

SEQ ID NO: 20748 - RNA, 612 nt, Artificial Sequence
  NRM__Homo_sapiens__NP_001257638
auggcccccgcccugcugcugauccccgccgcccuggccagcuucauccuggccuucggcaccggcguggaguucgugagauucaccagccugagaccccugcugggcggcauccccgagagcggcggccccgacgccagacagggcuggcuggccgcccugcaggacagaagcauccuggccccccuggccugggaccugggccugcugcugcuguucgugggccagcacagccugauggccgccgagagagugaaggccuggaccagcagauacuucggcgugcugcagagaagccuguacguggccugcaccgcccuggcccugcagguguacuaccacgugcugggccugggcgagccccuggcccugaagagccccagagcccugagacuguucagccaccugagacaccccgugugcguggagcugcugaccgugcuguggguggugcccacccugggcaccgacagacugcugcuggccuuccugcugacccuguaccugggccuggcccacggccuggaccagcaggaccugagauaccugagagcccagcugcagagaaagcugcaccugcugagcagaccccaggacggcgaggccgaguaa

SEQ ID NO: 20749 - RNA, 429 nt, Artificial Sequence
  NRN1__Homo_sapiens__NP_001265639
augggccugaagcugaacggcagauacaucagccugauccuggccgugcagaucgccuaccuggugcaggccgugagagccgccggcaagugcgacgccguguucaagggcuucagcgacugccugcugaagcugggcgacagcauggccaacuacccccagggccuggacgacaagaccaacaucaagaccgugugcaccuacugggaggacuuccacagcugcaccgugaccgcccugaccgacugccaggagggcgccaaggacaugugggacaagcugagaaaggagagcaagaaccugaacauccagggcagccuguucgagcugugcggcagcggcaacggcgccgccggcagccugcugcccgccuuccccgugcugcuggugagccugagcgccgcccuggccaccuggcugagcuucuaa

SEQ ID NO: 20750 - RNA, 1935 nt, Artificial Sequence
  NRP1__Homo_sapiens__NP_001019799
auggagagaggccugccccugcugugcgccgugcuggcccuggugcuggcccccgccggcgccuucagaaacgacaagugcggcgacaccaucaagaucgagagccccggcuaccugaccagccccggcuacccccacagcuaccaccccagcgagaagugcgaguggcugauccaggcccccgaccccuaccagagaaucaugaucaacuucaacccccacuucgaccuggaggacagagacugcaaguacgacuacguggagguguucgacggcgagaacgagaacggccacuucagaggcaaguucugcggcaagaucgcccccccccccguggugagcagcggccccuuccuguucaucaaguucgugagcgacuacgagacccacggcgccggcuucagcaucagauacgagaucuucaagagaggccccgagugcagccagaacuacaccacccccagcggcgugaucaagagccccggcuuccccgagaaguaccccaacagccuggagugcaccuacaucguguucgcccccaagaugagcgagaucauccuggaguucgagagcuucgaccuggagcccgacagcaacccccccggcggcauguucugcagauacgacagacuggagaucugggacggcuuccccgacgugggcccccacaucggcagauacugcggccagaagacccccggcagaaucagaagcagcagcggcauccugagcaugguguucuacaccgacagcgccaucgccaaggagggcuucagcgccaacuacagcgugcugcagagcagcgugagcgaggacuucaagugcauggaggcccugggcauggagagcggcgagauccacagcgaccagaucaccgccagcagccaguacagcaccaacuggagcgccgagagaagcagacugaacuaccccgagaacggcuggacccccggcgaggacagcuacagagaguggauccagguggaccugggccugcugagauucgugaccgccgugggcacccagggcgccaucagcaaggagaccaagaagaaguacuacgugaagaccuacaagaucgacgugagcagcaacggcgaggacuggaucaccaucaaggagggcaacaagcccgugcuguuccagggcaacaccaaccccaccgacguggugguggccguguuccccaagccccugaucaccagauucgugagaaucaagcccgccaccugggagaccggcaucagcaugagauucgagguguacggcugcaagaucaccgacuaccccugcagcggcaugcugggcauggugagcggccugaucagcgacagccagaucaccagcagcaaccagggcgacagaaacuggaugcccgagaacaucagacuggugaccagcagaagcggcugggcccugccccccgccccccacagcuacaucaacgaguggcugcagaucgaccugggcgaggagaagaucgugagaggcaucaucauccagggcggcaagcacagagagaacaagguguucaugagaaaguucaagaucggcuacagcaacaacggcagcgacuggaagaugaucauggacgacagcaagagaaaggccaagagcuucgagggcaacaacaacuacgacacccccgagcugagaaccuuccccgcccugagcaccagauucaucagaaucuaccccgagagagccacccacggcggccugggccugagaauggagcugcugggcugcgagguggaggcccccaccgccggccccaccacccccaacggcaaccugguggacgagugcgacgacgaccaggccaacugccacagcggcaccggcgacgacuuccagcugaccggcggcaccaccgugcuggccaccgagaagcccaccgugaucgacagcaccauccagagcggcaucaaguaa

SEQ ID NO: 20751 - RNA, 2781 nt, Artificial Sequence
  NRP2__Homo_sapiens__NP_003863
auggacauguucccccugaccuggguguuccuggcccuguacuucagcagacaccaggugagaggccagcccgacccccccugcggcggcagacugaacagcaaggacgccggcuacaucaccagccccggcuacccccaggacuaccccagccaccagaacugcgaguggaucguguacgcccccgagcccaaccagaagaucgugcugaacuucaacccccacuucgagaucgagaagcacgacugcaaguacgacuucaucgagaucagagacggcgacagcgagagcgccgaccugcugggcaagcacugcggcaacaucgccccccccaccaucaucagcagcggcagcaugcuguacaucaaguucaccagcgacuacgccagacagggcgccggcuucagccugagauacgagaucuucaagaccggcagcgaggacugcagcaagaacuucaccagccccaacggcaccaucgagagccccggcuuccccgagaaguacccccacaaccuggacugcaccuucaccauccuggccaagcccaagauggagaucauccugcaguuccugaucuucgaccuggagcacgacccccugcaggugggcgagggcgacugcaaguacgacuggcuggacaucugggacggcaucccccacgugggcccccugaucggcaaguacugcggcaccaagacccccagcgagcugagaagcagcaccggcauccugagccugaccuuccacaccgacauggccguggccaaggacggcuucagcgccagauacuaccuggugcaccaggagccccuggagaacuuccagugcaacgugccccugggcauggagagcggcagaaucgccaacgagcagaucagcgccagcagcaccuacagcgacggcagauggaccccccagcagagcagacugcacggcgacgacaacggcuggacccccaaccuggacagcaacaaggaguaccugcagguggaccugagauuccugaccaugcugaccgccaucgccacccagggcgccaucagcagagagacccagaacggcuacuacgugaagagcuacaagcuggaggugagcaccaacggcgaggacuggaugguguacagacacggcaagaaccacaagguguuccaggccaacaacgacgccaccgagguggugcugaacaagcugcacgccccccugcugaccagauucgugagaaucagaccccagaccuggcacagcggcaucgcccugagacuggagcuguucggcugcagagugaccgacgcccccugcagcaacaugcugggcaugcugagcggccugaucgccgacagccagaucagcgccagcagcacccaggaguaccuguggagccccagcgccgccagacuggugagcagcagaagcggcugguuccccagaaucccccaggcccagcccggcgaggaguggcugcagguggaccugggcacccccaagaccgugaagggcgugaucauccagggcgccagaggcggcgacagcaucaccgccguggaggccagagccuucgugagaaaguucaaggugagcuacagccugaacggcaaggacugggaguacauccaggaccccagaacccagcagcccaagcuguucgagggcaacaugcacuacgacacccccgacaucagaagauucgaccccauccccgcccaguacgugagaguguaccccgagagauggagccccgccggcaucggcaugagacuggaggugcugggcugcgacuggaccgacagcaagcccaccguggagacccugggccccaccgugaagagcgaggagaccaccacccccuaccccaccgaggaggaggccaccgagugcggcgagaacugcagcuucgaggacgacaaggaccugcagcugcccagcggcuucaacugcaacuucgacuuccuggaggagcccugcggcuggauguacgaccacgccaaguggcugagaaccaccugggccagcagcagcagccccaacgacagaaccuuccccgacgacagaaacuuccugagacugcagagcgacagccagagagagggccaguacgccagacugaucagcccccccgugcaccugcccagaagccccgugugcauggaguuccaguaccaggccaccggcggcagaggcguggcccugcagguggugagagaggccagccaggagagcaagcugcugugggugaucagagaggaccagggcggcgaguggaagcacggcagaaucauccugcccagcuacgacauggaguaccagaucguguucgagggcgugaucggcaagggcagaagcggcgagaucgccaucgacgacaucagaaucagcaccgacgugccccuggagaacugcauggagcccaucagcgccuucgccguggacauccccgagauccacgagagagagggcuacgaggacgagaucgacgacgaguacgagguggacuggagcaacagcagcagcgccaccagcggcagcggcgcccccagcaccgacaaggagaagagcuggcuguacacccuggaccccauccugaucaccaucaucgccaugagcagccugggcgugcugcugggcgccaccugcgccggccugcugcuguacugcaccugcagcuacagcggccugagcagcagaagcugcaccacccuggagaacuacaacuucgagcuguacgacggccugaagcacaaggugaagaugaaccaccagaagugcugcagcgaggccuaa

SEQ ID NO: 20752 - RNA, 588 nt, Artificial Sequence
  NRSN1__Homo_sapiens__NP_542454
augagcagcugcagcaacgugugcggcagcagacaggcccaggccgccgccgagggcggcuaccagagauacggcgugagaagcuaccugcaccaguucuacgaggacugcaccgccagcaucugggaguacgaggacgacuuccagauccagagaagccccaacagauggagcagcguguucuggaaggugggccugaucagcggcaccguguucgugauccugggccugaccgugcuggccgugggcuuccuggugccccccaagaucgaggccuucggcgaggccgacuucguggugguggacacccacgccgugcaguucaacagcgcccuggacauguacaagcuggccggcgccgugcuguucugcaucggcggcaccagcauggccggcugccugcugaugagcguguucgugaagagcuacagcaaggaggagaaguuccugcagcagaaguucaaggagagaaucgccgacaucaaggcccacacccagcccgugaccaaggcccccggccccggcgagaccaagauccccgugacccugagcagagugcagaacgugcagccccugcuggccaccuaa

SEQ ID NO: 20753 - RNA, 615 nt, Artificial Sequence
  NRSN2__Homo_sapiens__NP_079234
augaugcccagcugcaacagaagcugcagcugcagcagaggccccagcguggaggacggcaagugguacggcgugagaagcuaccugcaccuguucuacgaggacugcgccggcaccgcccugagcgacgaccccgagggcccccccgugcugugccccagaagacccuggcccagccugugcuggaagaucagccugagcagcggcacccugcugcugcugcugggcguggccgcccugaccaccggcuacgccgugccccccaagcuggagggcaucggcgagggcgaguuccuggugcuggaccagagagccgccgacuacaaccaggcccugggcaccugcagacuggccggcaccgcccugugcguggccgccggcgugcugcuggccaucugccuguucugggccaugaucggcuggcugagccaggacaccaaggccgagccccuggaccccgaggccgacagccacguggagguguucggcgacgagcccgagcagcagcugagccccaucuucagaaacgccagcggccagagcugguucagcccccccgccagccccuucggccagagcagcgugcagaccauccagcccaagagagacagcuaa

SEQ ID NO: 20754 - RNA, 594 nt, Artificial Sequence
  NRTN__Homo_sapiens__XP_011526343
augcagagauggaaggccgccgcccuggccagcgugcugugcagcagcgugcugagcaucuggaugugcagagagggccugcugcugagccacagacugggccccgcccuggugccccugcacagacugcccagaacccuggacgccagaaucgccagacuggcccaguacagagcccugcugcagggcgcccccgacgccauggagcugagagagcugacccccugggccggcagaccccccggccccagaagaagagccggccccagaagaagaagagccagagccagacugggcgccagacccugcggccugagagagcuggaggugagagugagcgagcugggccugggcuacgccagcgacgagaccgugcuguucagauacugcgccggcgccugcgaggccgccgccagaguguacgaccugggccugagaagacugagacagagaagaagacugagaagagagagagugagagcccagcccugcugcagacccaccgccuacgaggacgaggugagcuuccuggacgcccacagcagauaccacaccgugcacgagcugagcgccagagagugcgccugcguguaa

SEQ ID NO: 20755 - RNA, 4644 nt, Artificial Sequence
  NRXN1__Homo_sapiens__NP_001129131
augggcaccgcccugcugcagagaggcggcugcuuccugcugugccugagccugcugcugcugggcugcugggccgagcugggcagcggccuggaguuccccggcgccgagggccaguggaccagauuccccaaguggaacgccugcugcgagagcgagaugagcuuccagcugaagaccagaagcgccagaggccuggugcuguacuucgacgacgagggcuucugcgacuuccuggagcugauccugaccagaggcggcagacugcagcugagcuucagcaucuucugcgccgagcccgccacccugcuggccgacacccccgugaacgacggcgccuggcacagcgugagaaucagaagacaguucagaaacaccacccuguucaucgaccagguggaggccaaguggguggaggugaagagcaagagaagagacaugaccguguucagcggccuguucgugggcggccugccccccgagcugagagccgccgcccugaagcugacccuggccagcgugagagagagagagcccuucaagggcuggaucagagacgugagagugaacagcagccaggugcugcccguggacagcggcgaggugaagcuggacgacgagccccccaacagcggcggcggcagccccugcgaggccggcgaggagggcgagggcggcgugugccugaacggcggcgugugcagcgugguggacgaccaggccgugugcgacugcagcagaaccggcuucagaggcaaggacugcagccaggagaucaaguucggccugcagugcgugcugcccgugcugcugcacgacaacgaccagggcaaguacugcugcaucaacaccgccaagccccugaccgagaaggacaacaacguggagggccuggcccaccugaugaugggcgaccagggcaagagcaagggcaaggaggaguacaucgccaccuucaagggcagcgaguacuucugcuacgaccugagccagaaccccauccagagcagcagcgacgagaucacccugagcuucaagacccugcagagaaacggccugaugcugcacaccggcaagagcgccgacuacgugaaccuggcccugaagaacggcgccgugagccuggugaucaaccugggcagcggcgccuucgaggcccugguggagcccgugaacggcaaguucaacgacaacgccuggcacgacgugaaggugaccagaaaccugagacagcacagcggcaucggccacgccauggugaacaagcugcacugcagcgugaccaucagcguggacggcauccugaccaccaccggcuacacccaggaggacuacaccaugcugggcagcgacgacuucuucuacgugggcggcagccccagcaccgccgaccugcccggcagccccgugagcaacaacuucaugggcugccugaaggaggugguguacaagaacaacgacgugagacuggagcugagcagacuggccaagcagggcgaccccaagaugaagauccacggcgugguggccuucaagugcgagaacguggccacccuggaccccaucaccuucgagacccccgagagcuucaucagccugcccaaguggaacgccaagaagaccggcagcaucagcuucgacuucagaaccaccgagcccaacggccugauccuguucagccacggcaagcccagacaccagaaggacgccaagcacccccagaugaucaagguggacuucuucgccaucgagaugcuggacggccaccuguaccugcugcuggacaugggcagcggcaccaucaagaucaaggcccugcugaagaaggugaacgacggcgagugguaccacguggacuuccagagagacggcagaagcggcaccaucagcgugaacacccugagaacccccuacaccgcccccggcgagagcgagauccuggaccuggacgacgagcuguaccugggcggccugcccgagaacaaggccggccugguguuccccaccgagguguggaccgcccugcugaacuacggcuacgugggcugcaucagagaccuguucaucgacggccagagcaaggacaucagacagauggccgaggugcagagcaccgccggcgugaagcccagcugcagcaaggagaccgccaagcccugccugagcaaccccugcaagaacaacggcaugugcagagacggcuggaacagauacgugugcgacugcagcggcaccggcuaccugggcagaagcugcgagagagaggccaccgugcugagcuacgacggcagcauguucaugaagauccagcugcccguggugaugcacaccgaggccgaggacgugagccugagauucagaagccagagagccuacggcauccugauggccaccaccagcagagacagcgccgacacccugagacuggagcuggacgccggcagagugaagcugaccgugaaccuggacugcaucagaaucaacugcaacagcagcaagggccccgagacccuguucgccggcuacaaccugaacgacaacgaguggcacaccgugagaguggugagaagaggcaagagccugaagcugaccguggacgaccagcaggccaugaccggccagauggccggcgaccacaccagacuggaguuccacaacaucgagaccggcaucaucaccgagagaagauaccugagcagcgugcccagcaacuucaucggccaccugcagagccugaccuucaacggcauggccuacaucgaccugugcaagaacggcgacaucgacuacugcgagcugaacgccagauucggcuucagaaacaucaucgccgaccccgugaccuucaagaccaagagcagcuacguggcccuggccacccugcaggccuacaccagcaugcaccuguucuuccaguucaagaccaccagccuggacggccugauccuguacaacagcggcgacggcaacgacuucaucgugguggagcuggugaagggcuaccugcacuacguguucgaccugggcaacggcgccaaccugaucaagggcagcagcaacaagccccugaacgacaaccaguggcacaacgugaugaucagcagagacaccagcaaccugcacaccgugaagaucgacaccaagaucaccacccagaucaccgccggcgccagaaaccuggaccugaagagcgaccuguacaucggcggcguggccaaggagaccuacaagagccugcccaagcuggugcacgccaaggagggcuuccagggcugccuggccagcguggaccugaacggcagacugcccgaccugaucagcgacgcccuguucugcaacggccagaucgagagaggcugcgagggccccagcaccaccugccaggaggacagcugcagcaaccagggcgugugccugcagcagugggacggcuucagcugcgacugcagcaugaccagcuucagcggcccccugugcaacgaccccggcaccaccuacaucuucagcaagggcggcggccagaucaccuacaaguggccccccaacgacagacccagcaccagagccgacagacuggccaucggcuucagcaccgugcagaaggaggccgugcuggugagaguggacagcagcagcggccugggcgacuaccuggagcugcacauccaccagggcaagaucggcgugaaguucaacgugggcaccgacgacaucgccaucgaggagagcaacgccaucaucaacgacggcaaguaccacguggugagauucaccagaagcggcggcaacgccacccugcagguggacagcuggcccgugaucgagagauaccccgccggcaacaacgacaacgagagacuggccaucgccagacagagaauccccuacagacugggcagagugguggacgaguggcugcuggacaagggcagacagcugaccaucuucaacagccaggccaccaucaucaucggcggcaaggagcagggccagcccuuccagggccagcugagcggccuguacuacaacggccugaaggugcugaacauggccgccgagaacgacgccaacaucgccaucgugggcaacgugagacuggugggcgaggugcccagcagcaugaccaccgagagcaccgccaccgccaugcagagcgagaugagcaccagcaucauggagaccaccaccacccuggccaccagcaccgccagaagaggcaagccccccaccaaggagcccaucagccagaccaccgacgacauccugguggccagcgccgagugccccagcgacgacgaggacaucgaccccugcgagcccagcagcggcggccuggccaaccccaccagagccggcggcagagagcccuaccccggcagcgccgaggugaucagagagagcagcagcaccaccggcaugguggugggcaucguggccgccgccgcccugugcauccugauccugcuguacgccauguacaaguacagaaacagagacgagggcagcuaccacguggacgagagcagaaacuacaucagcaacagcgcccagagcaacggcgccguggugaaggagaagcagcccagcagcgccaagagcagcaacaagaacaagaagaacaaggacaaggaguacuacguguaa

SEQ ID NO: 20756 - RNA, 5139 nt, Artificial Sequence
  NRXN2__Homo_sapiens__NP_055895
auggccagcggcagcagauggagacccaccccccccccccugcugcugcugcugcugcuggcccuggccgccagagccgacggccuggaguucggcggcggccccggccagugggccagauacgccagaugggccggcgccgccagcagcggcgagcugagcuucagccugagaaccaacgccaccagagcccugcugcuguaccuggacgacggcggcgacugcgacuuccuggagcugcugcugguggacggcagacugagacugagauucacccugagcugcgccgagcccgccacccugcagcuggacacccccguggccgacgacagauggcacauggugcugcugaccagagacgccagaagaaccgcccuggccguggacggcgaggccagagccgccgaggugagaagcaagagaagagagaugcagguggccagcgaccuguucgugggcggcaucccccccgacgugagacugagcgcccugacccugagcaccgugaaguacgagccccccuucagaggccugcuggccaaccugaagcugggcgagagaccccccgcccugcugggcagccagggccugagaggcgccaccgccgacccccugugcgcccccgccagaaaccccugcgccaacggcggccugugcaccgugcuggcccccggcgaggugggcugcgacugcagccacaccggcuucggcggcaaguucugcagcgaggaggagcaccccauggagggccccgcccaccugacccugaacagcgaggugggcagccugcuguucagcgagggcggcgccggcagaggcggcgccggcgacgugcaccagcccaccaagggcaaggaggaguucguggccaccuucaagggcaacgaguucuucugcuacgaccugagccacaaccccauccagagcagcaccgacgagaucacccuggccuucagaacccugcagagaaacggccugaugcugcacaccggcaagagcgccgacuacgugaaccugagccugaagagcggcgccguguggcuggugaucaaccugggcagcggcgccuucgaggcccugguggagcccgugaacggcaaguucaacgacaacgccuggcacgacgugagagugaccagaaaccugagacagcacgccggcaucggccacgccauggugaacaagcugcacuaccuggugaccaucagcguggacggcauccugaccaccaccggcuacacccaggaggacuacaccaugcugggcagcgacgacuucuucuacaucggcggcagccccaacaccgccgaccugcccggcagccccgugagcaacaacuucaugggcugccugaaggacgugguguacaagaacaacgacuucaagcuggagcugagcagacuggccaaggagggcgaccccaagaugaagcugcagggcgaccugagcuucagaugcgaggacguggccgcccuggaccccgugaccuucgagagccccgaggccuucguggcccugcccagauggagcgccaagagaaccggcagcaucagccuggacuucagaaccaccgagcccaacggccugcugcuguucagccagggcagaagagccggcggcggcgccggcagccacagcagcgcccagagagccgacuacuucgccauggagcugcuggacggccaccuguaccugcugcuggacaugggcagcggcggcaucaagcugagagccagcagcagaaaggugaacgacggcgaguggugccacguggacuuccagagagacggcagaaagggcagcaucagcgugaacagcagaagcacccccuuccuggccaccggcgacagcgagauccuggaccuggagagcgagcuguaccugggcggccugcccgagggcggcagaguggaccugccccugccccccgagguguggaccgccgcccugagagccggcuacgugggcugcgugagagaccuguucaucgacggcagaagcagagaccugagaggccuggccgaggcccagggcgccgugggcguggcccccuucugcagcagagagacccugaagcagugcgccagcgcccccugcagaaacggcggcgugugcagagagggcuggaacagauucaucugcgacugcaucggcaccggcuuccugggcagagugugcgagagagaggccaccgugcugagcuacgacggcagcauguacaugaagaucaugcugcccaacgccaugcacaccgaggccgaggacgugagccugagauucaugagccagagagccuacggccugaugauggccaccaccagcagagagagcgccgacacccugagacuggagcuggacggcggccagaugaagcugaccgugaaccuggacugccugagagugggcugcgcccccagcaagggccccgagacccuguucgccggccacaagcugaacgacaacgaguggcacaccgugagaguggugagaagaggcaagagccugcagcugagcguggacaacgugaccguggagggccagauggccggcgcccacaugagacuggaguuccacaacaucgagaccggcaucaugaccgagagaagauucaucagcguggugcccagcaacuucaucggccaccugagcggccugguguucaacggccagcccuacauggaccagugcaaggacggcgacaucaccuacugcgagcugaacgccagauucggccugagagccaucguggccgaccccgugaccuucaagagcagaagcagcuaccuggcccuggccacccugcaggccuacgccagcaugcaccuguucuuccaguucaagaccaccgcccccgacggccugcugcuguucaacagcggcaacggcaacgacuucaucgugaucgagcuggugaagggcuacauccacuacguguucgaccugggcaacggccccagccugaugaagggcaacagcgacaagcccgugaacgacaaccaguggcacaacgugguggugagcagagaccccggcaacgugcacacccugaagaucgacagcagaaccgugacccagcacagcaacggcgccagaaaccuggaccugaagggcgagcuguacaucggcggccugagcaagaacauguucagcaaccugcccaagcugguggccagcagagacggcuuccagggcugccuggccagcguggaccugaacggcagacugcccgaccugaucgccgacgcccugcacagaaucggccagguggagagaggcugcgacggccccagcaccaccugcaccgaggagagcugcgccaaccagggcgugugccugcagcagugggacggcuucaccugcgacugcaccaugaccagcuacggcggccccgugugcaacgaccccggcaccaccuacaucuucggcaagggcggcgcccugaucaccuacaccuggccccccaacgacagacccagcaccagaauggacagacuggccgugggcuucagcacccaccagagaagcgccgugcuggugagaguggacagcgccagcggccugggcgacuaccugcagcugcacaucgaccagggcaccgugggcgugaucuucaacgugggcaccgacgacaucaccaucgacgagcccaacgccaucgugagcgacggcaaguaccacguggugagauucaccagaagcggcggcaacgccacccugcagguggacagcuggcccgugaacgagagauaccccgccggcaacuucgacaacgagagacuggccaucgccagacagagaauccccuacagacugggcagagugguggacgaguggcugcuggacaagggcagacagcugaccaucuucaacagccaggccgccaucaagaucggcggcagagaccagggcagacccuuccagggccaggugagcggccuguacuacaacggccugaaggugcuggcccuggccgccgagagcgaccccaacgugagaaccgagggccaccugagacuggugggcgagggccccagcgugcugcugagcgccgagaccaccgccaccacccugcuggccgacauggccaccaccaucauggagaccaccaccaccauggccaccaccaccaccagaagaggcagaagccccacccugagagacagcaccacccagaacaccgacgaccugcugguggccagcgccgagugccccagcgacgacgaggaccuggaggagugcgagcccagcaccggcggcgagcugauccugcccaucaucaccgaggacagccuggaccccccccccguggccaccagaagccccuucgugccccccccccccaccuucuaccccuuccugaccggcgugggcgccacccaggacacccugcccccccccgccgccagaagaccccccagcggcggccccugccaggccgagagagacgacagcgacugcgaggagcccaucgaggccagcggcuucgccagcggcgagguguucgacagcagccugccccccaccgacgacgaggacuucuacaccaccuucccccuggugaccgacagaaccacccugcugagccccagaaagcccgcccccagacccaaccugagaaccgacggcgccaccggcgcccccggcgugcuguucgcccccagcgcccccgcccccaaccugcccgccggcaagaugaaccacagagacccccugcagccccugcuggagaaccccccccugggccccggcgcccccaccagcuucgagcccagaagaccccccccccugagacccggcgugaccagcgcccccggcuucccccaccugcccaccgccaaccccaccggccccggcgagagaggcccccccggcgccguggaggugaucagagagagcagcagcaccaccggcaugguggugggcaucguggccgccgccgcccugugcauccugauccugcuguacgccauguacaaguacagaaacagagacgagggcagcuaccagguggaccagagcagaaacuacaucagcaacagcgcccagagcaacggcgccguggugaaggagaaggcccccgccgcccccaagacccccagcaaggccaagaagaacaaggacaaggaguacuacguguaa

SEQ ID NO: 20757 - RNA, 1380 nt, Artificial Sequence
  NRXN3__Homo_sapiens__NP_001098720
augcaccugagaauccacgccagaagaagcccccccagaagacccgccuggacccugggcaucugguuccuguucuggggcugcaucgugagcagcguguggagcagcagcaacguggccagcagcagcagcaccagcagcagccccggcagccacagccagcacgagcaccacuuccacggcagcaagcaccacagcgugcccaucagcaucuacagaagccccgugagccugagaggcggccacgccggcgccaccuacaucuucggcaagagcggcggccugauccuguacaccuggcccgccaacgacagacccagcaccagaagcgacagacuggccgugggcuucagcaccaccgugaaggacggcauccuggugagaaucgacagcgcccccggccugggcgacuuccugcagcugcacaucgagcagggcaagaucggcgugguguucaacaucggcaccguggacaucagcaucaaggaggagagaacccccgugaacgacggcaaguaccacguggugagauucaccagaaacggcggcaacgccacccugcagguggacaacuggcccgugaacgagcacuaccccaccggcaacaccgacaacgagagauuccagauggugaagcagaagauccccuucaaguacaacagacccguggaggaguggcugcaggagaagggcagacagcugaccaucuucaacacccaggcccagaucgccaucggcggcaaggacaagggcagacuguuccagggccagcugagcggccuguacuacgacggccugaaggugcugaacauggccgccgagaacaaccccaacaucaagaucaacggcagcgugagacuggugggcgaggugcccagcauccugggcaccacccagaccaccagcaugccccccgagaugagcaccaccgugauggagaccaccaccaccauggccaccaccaccaccagaaagaacagaagcaccgccagcauccagcccaccagcgacgaccuggugagcagcgccgagugcagcagcgacgacgaggacuucguggagugcgagcccagcaccgccaaccccaccgagcccggcaucagaagagugcccggcgccagcgaggugaucagagagagcagcagcaccaccggcaugguggugggcaucguggccgccgccgcccugugcauccugauccugcuguacgccauguacaaguacagaaacagagacgagggcagcuaccagguggacgagaccagaaacuacaucagcaacagcgcccagagcaacggcacccugaugaaggagaagcagcagagcagcaagagcggccacaagaagcagaagaacaaggacagagaguacuacguguaa

SEQ ID NO: 20758 - RNA, 783 nt, Artificial Sequence
  NSA2__Homo_sapiens__NP_055701
augccccagaacgaguacaucgagcugcacagaaagagauacggcuacagacuggacuaccacgagaagaagagaaagaaggagagcagagaggcccacgagagaagcaagaaggccaagaagaugaucggccugaaggccaagcuguaccacaagcagagacacgccgagaagauccagaugaagaagaccaucaagaugcacgagaagagaaacaccaagcagaagaacgacgagaagaccccccagggcgccgugcccgccuaccugcuggacagagagggccagagcagagccaaggugcugagcaacaugaucaagcagaagagaaaggagaaggccggcaagugggaggugccccugcccaaggugagagcccagggcgagaccgaggugcugaaggugaucagaaccggcaagagaaagaagaaggccuggaagagaauggugaccaaggugugcuucgugggcgacggcuucaccagaaagccccccaaguacgagagauucaucagacccaugggccugagauucaagaaggcccacgugacccaccccgagcugaaggccaccuucugccugcccauccugggcgugaagaagaaccccagcagcccccuguacaccacccugggcgugaucaccaagggcaccgugaucgaggugaacgugagcgagcugggccuggugacccagggcggcaaggugaucuggggcaaguacgcccaggugaccaacaaccccgagaacgacggcugcaucaacgccgugcugcugguguaa

SEQ ID NO: 20759 - RNA, 7284 nt, Artificial Sequence
  NSD1__Homo_sapiens__XP_005266018
augccccugaagaccagaaccgcccugagcgacgaccccgacagcagcaccagcacccugggcaacaugcuggagcugcccggcaccagcagcagcagcaccagccaggagcugcccuucugccagcccaagaagaagagcaccccccugaaguacgaggugggcgaccugaucugggccaaguucaagagaagacccugguggcccugcagaaucugcagcgacccccugaucaacacccacagcaagaugaaggugagcaacagaagacccuacagacaguacuacguggaggccuucggcgaccccagcgagagagccuggguggccggcaaggccaucgugauguucgagggcagacaccaguucgaggagcugcccgugcugagaagaagaggcaagcagaaggagaagggcuacagacacaaggugccccagaagauccugagcaagugggaggccagcgugggccuggccgagcaguacgacgugcccaagggcagcaagaacagaaagugcauccccggcagcaucaagcuggacagcgaggaggacaugcccuucgaggacugcaccaacgaccccgagagcgagcacgaccugcugcugaacggcugccugaagagccuggccuucgacagcgagcacagcgccgacgagaaggagaagcccugcgccaagagcagagccagaaagagcagcgacaaccccaagagaaccagcgugaagaagggccacauccaguucgaggcccacaaggacgagagaagaggcaagauccccgagaaccugggccugaacuucaucagcggcgacaucagcgacacccaggccagcaacgagcugagcagaaucgccaacagccugaccggcagcaacaccgcccccggcagcuuccuguucagcagcugcggcaagaacaccgccaagaaggaguucgagaccagcaacggcgacagccugcugggccugcccgagggcgcccugaucagcaagugcagcagagagaagaacaagccccagagaagccuggugugcggcagcaaggugaagcugugcuacaucggcgccggcgacgaggagaagagaagcgacagcaucagcaucugcaccaccagcgacgacggcagcagcgaccuggaccccaucgagcacagcagcgagagcgacaacagcgugcuggagauccccgacgccuucgacagaaccgagaacaugcugagcaugcagaagaacgagaagaucaaguacagcagauucgccgccaccaacaccagagugaaggccaagcagaagccccugaucagcaacagccacaccgaccaccugaugggcugcaccaagagcgccgagcccggcaccgagaccagccaggugaaccugagcgaccugaaggccagcacccuggugcacaagccccagagcgacuucaccaacgacgcccugagccccaaguucaaccugagcagcagcaucagcagcgagaacagccugaucaagggcggcgccgccaaccaggcccugcugcacagcaagagcaagcagcccaaguucagaagcaucaagugcaagcacaaggagaaccccgugauggccgagccccccgugaucaacgaggagugcagccugaagugcugcagcagcgacaccaagggcagcccccuggccagcaucagcaagagcggcaagguggacggccugaagcugcugaacaacaugcacgagaagaccagagacagcagcgacaucgagaccgccguggugaagcacgugcugagcgagcugaaggagcugagcuacagaagccugggcgaggacgugagcgacagcggcaccagcaagcccagcaagccccugcuguucagcagcgccagcagccagaaccacauccccaucgagcccgacuacaaguucagcacccugcugaugaugcugaaggacaugcacgacagcaagaccaaggagcagagacugaugaccgcccagaaccuggugagcuacagaagccccggcagaggcgacugcagcaccaacagccccgugggcgugagcaaggugcuggugagcggcggcagcacccacaacagcgagaagaagggcgacggcacccagaacagcgccaaccccagccccagcggcggcgacagcgcccugagcggcgagcugagcgccagccugcccggccugcugagcgacaagagagaccugcccgccagcggcaagagcagaagcgacugcgugaccagaagaaacugcggcagaagcaagcccagcagcaagcugagagacgccuucagcgcccagauggugaagaacaccgugaacagaaaggcccugaagaccgagagaaagagaaagcugaaccagcugcccagcgugacccuggacgccgugcugcagggcgacagagagagaggcggcagccugagaggcggcgccgaggaccccagcaaggaggacccccugcagaucaugggccaccugaccagcgaggacggcgaccacuucagcgacgugcacuucgacagcaaggugaagcagagcgaccccggcaagaucagcgagaagggccugagcuucgagaacggcaagggccccgagcuggacagcgugaugaacagcgagaacgacgagcugaacggcgugaaccagguggugcccaagaagagauggcagagacugaaccagagaagaaccaagcccagaaagagaaugaacagauucaaggagaaggagaacagcgagugcgccuucagagugcugcugcccagcgaccccgugcaggagggcagagacgaguuccccgagcacagaacccccagcgccagcauccuggaggagccccugaccgagcagaaccacgccgacugccuggacagcgccggccccagacugaacgugugcgacaagagcagcgccagcaucggcgacauggagaaggagcccggcauccccagccugaccccccaggccgagcugcccgagcccgccgugagaagcgagaagaagagacugagaaagcccagcaaguggcugcuggaguacaccgaggaguacgaccagaucuucgcccccaagaagaagcagaagaaggugcaggagcaggugcacaaggugagcagcagaugcgaggaggagagccugcuggccagaggcagaagcagcgcccagaacaagcagguggacgagaacagccugaucagcaccaaggaggagccccccgugcuggagagagaggcccccuuccuggagggcccccuggcccagagcgagcugggcggcggccacgccgagcugccccagcugacccugagcgugcccguggcccccgaggugagccccagacccgcccuggagagcgaggagcugcuggugaagacccccggcaacuacgagagcaagagacagagaaagcccaccaagaagcugcuggagagcaacgaccuggaccccggcuucaugcccaagaagggcgaccugggccugagcaagaagugcuacgaggccggccaccuggagaacggcaucaccgagagcugcgccaccagcuacagcaaggacuucggcggcggcaccaccaagaucuucgacaagcccagaaagagaaagagacagagacacgccgccgccaagaugcagugcaagaaggugaagaacgacgacagcagcaaggagauccccggcagcgagggcgagcugaugccccacagaaccgccaccagccccaaggagaccguggaggagggcguggagcacgaccccggcaugcccgccagcaagaagaugcagggcgagagaggcggcggcgccgcccugaaggagaacgugugccagaacugcgagaagcugggcgagcugcugcugugcgaggcccagugcugcggcgccuuccaccuggagugccugggccugaccgagaugcccagaggcaaguucaucugcaacgagugcagaaccggcauccacaccugcuucgugugcaagcagagcggcgaggacgugaagagaugccugcugccccugugcggcaaguucuaccacgaggagugcgugcagaaguacccccccaccgugaugcagaacaagggcuucagaugcagccugcacaucugcaucaccugccacgccgccaaccccgccaacgugagcgccagcaagggcagacugaugagaugcgugagaugccccguggccuaccacgccaacgacuucugccuggccgccggcagcaagauccuggccagcaacagcaucaucugccccaaccacuucacccccagaagaggcugcagaaaccacgagcacgugaacgugagcuggugcuucgugugcagcgagggcggcagccugcugugcugcgacagcugccccgccgccuuccacagagagugccugaacaucgacauccccgagggcaacugguacugcaacgacugcaaggccggcaagaagccccacuacagagagaucgugugggugaaggugggcagauacagaugguggcccgccgagaucugccaccccagagccgugcccagcaacaucgacaagaugagacacgacgugggcgaguuccccgugcuguucuucggcagcaacgacuaccuguggacccaccaggccagaguguuccccuacauggagggcgacgugagcagcaaggacaagaugggcaagggcguggacggcaccuacaagaaggcccugcaggaggccgccgccagauucgaggagcugaaggcccagaaggagcugagacagcugcaggaggacagaaagaacgacaagaagcccccccccuacaagcacaucaaggugaacagacccaucggcagagugcagaucuucaccgccgaccugagcgagauccccagaugcaacugcaaggccaccgacgagaaccccugcggcaucgacagcgagugcaucaacagaaugcugcuguacgagugccaccccaccgugugccccgccggcggcagaugccagaaccagugcuucagcaagagacaguaccccgagguggagaucuucagaacccugcagagaggcuggggccugagaaccaagaccgacaucaagaagggcgaguucgugaacgaguacgugggcgagcugaucgacgaggaggagugcagagccagaaucagauacgcccaggagcacgacaucaccaacuucuacaugcugacccuggacaaggacagaaucaucgacgccggccccaagggcaacuacgccagauucaugaaccacugcugccagcccaacugcgagacccagaaguggagcgugaacggcgacaccagagugggccuguucgcccugagcgacaucaaggccggcaccgagcugaccuucaacuacaaccuggagugccugggcaacggcaagaccgugugcaagugcggcgcccccaacugcagcggcuuccugggcgugagacccaagaaccagcccaucgccaccgaggagaagagcaagaaguucaagaagaagcagcagggcaagagaagaacccagggcgagaucaccaaggagagagaggacgagugcuucagcugcggcgacgccggccagcuggugagcugcaagaagcccggcugccccaagguguaccacgccgacugccugaaccugaccaagagacccgccggcaagugggagugccccuggcaccagugcgacaucugcggcaaggaggccgccagcuucugcgagaugugccccagcagcuucugcaagcagcacagagagggcaugcuguucaucagcaagcuggacggcagacugagcugcaccgagcacgaccccugcggccccaacccccuggagcccggcgagaucagagaguacgugcccccccccgugccccugccccccggccccagcacccaccuggccgagcagagcaccggcauggccgcccaggcccccaagaugagcgacaagccccccgccgacaccaaccagaugcugagccugagcaagaaggcccuggccggcaccugccagagaccccugcugcccgagagaccccuggagagaaccgacagcagaccccagccccuggacaaggugagagaccuggccggcagcggcaccaagagccagagccuggugagcagccagagaccccuggacagaccccccgccguggccggccccagaccccagcugagcgacaagcccagccccgugaccagccccagcagcagccccagcgugagaagccagccccuggagagaccccugggcaccgccgaccccagacuggacaagagcaucggcgccgccagccccagaccccagagccuggagaagaccagcgugcccaccggccugagacugcccccccccgacagacugcugaucaccagcagccccaagccccagaccagcgacagacccaccgacaagccccacgccagccugagccagagacugcccccccccgagaaggugcugagcgccguggugcagacccugguggccaaggagaaggcccugagacccguggaccagaacacccagagcaagaacagagccgcccuggugauggaccugaucgaccugacccccagacagaaggagagagccgccagcccccaccaggugaccccccaggccgacgagaagaugcccgugcuggagagcagcagcuggcccgccagcaagggccugggccacaugcccagagccguggagaagggcugcgugagcgacccccugcagaccagcggcaaggccgccgcccccagcgaggaccccuggcaggccgugaagagccugacccaggccagacugcugagccagccccccgccaaggccuuccuguacgagcccaccacccaggccagcggcagagccagcgccggcgccgagcagacccccggcccccugagccagagccccggccuggugaagcaggccaagcagauggugggcggccagcagcugcccgcccuggccgccaagagcggccagagcuucagaagccugggcaaggcccccgccagccugcccaccgaggagaagaagcuggugaccaccgagcagagccccugggcccugggcaaggccagcagcagagccggccuguggcccaucguggccggccagacccuggcccagagcugcuggagcgccggcagcacccagacccuggcccagaccugcuggagccugggcagaggccaggaccccaagcccgagcagaacacccugcccgcccugaaccaggcccccagcagccacaagugcgccgagagcgagcagaaguaa

SEQ ID NO: 20760 - RNA, 1122 nt, Artificial Sequence
  NSDHL__Homo_sapiens__XP_011529480
auggagcccgccgugagcgagcccaugagagaccagguggccagaacccaccugaccgaggacacccccaaggugaacgccgacaucgagaaggugaaccagaaccaggccaagagaugcaccgugaucggcggcagcggcuuccugggccagcacaugguggagcagcugcuggccagaggcuacgccgugaacguguucgacauccagcagggcuucgacaacccccaggugagauucuuccugggcgaccugugcagcagacaggaccuguaccccgcccugaagggcgugaacaccguguuccacugcgccagccccccccccagcagcaacaacaaggagcuguucuacagagugaacuacaucggcaccaagaacgugaucgagaccugcaaggaggccggcgugcagaagcugauccugaccagcagcgccagcgugaucuucgagggcguggacaucaagaacggcaccgaggaccugcccuacgccaugaagcccaucgacuacuacaccgagaccaagauccugcaggagagagccgugcugggcgccaacgaccccgagaagaacuuccugaccaccgccaucagaccccacggcaucuucggccccagagacccccagcuggugcccauccugaucgaggccgccagaaacggcaagaugaaguucgugaucggcaacggcaagaaccugguggacuucaccuucguggagaacguggugcacggccacauccuggccgccgagcagcugagcagagacagcacccugggcggcaaggccuuccacaucaccaacgacgagcccauccccuucuggaccuuccugagcagaauccugaccggccugaacuacgaggcccccaaguaccacauccccuacuggguggccuacuaccuggcccugcugcugagccugcuggugauggugaucagccccgugauccagcugcagcccaccuucacccccaugagaguggcccuggccggcaccuuccacuacuacagcugcgagagagccaagaaggccaugggcuaccagccccuggugaccauggacgacgccauggagagaaccgugcagagcuucagacaccugagaagagugaaguaa

SEQ ID NO: 20761 - RNA, 2235 nt, Artificial Sequence
  NSF__Homo_sapiens__NP_006169
auggccggcagaagcaugcaggccgccagaugccccaccgacgagcugagccugaccaacugcgccguggugaacgagaaggacuuccagagcggccagcacgugaucgugagaaccagccccaaccacagauacaccuucacccugaagacccaccccagcguggugcccggcagcaucgccuucagccugccccagagaaagugggccggccugagcaucggccaggagaucgaggugagccuguacaccuucgacaaggccaagcagugcaucggcaccaugaccaucgagaucgacuuccugcagaagaagagcaucgacagcaaccccuacgacaccgacaagauggccgccgaguucauccagcaguucaacaaccaggccuucagcgugggccagcagcugguguucagcuucaacgagaagcuguucggccugcuggugaaggacaucgaggccauggaccccagcauccugaagggcgagcccgccaccggcaagagacagaagaucgaggugggccugguggugggcaacagccagguggccuucgagaaggccgagaacagcagccugaaccugaucggcaaggccaagaccaaggagaacagacagagcaucaucaaccccgacuggaacuucgagaagaugggcaucggcggccuggacaaggaguucagcgacaucuucagaagagccuucgccagcagaguguucccccccgagaucguggagcagaugggcugcaagcacgugaagggcauccugcuguacggcccccccggcugcggcaagacccugcuggccagacagaucggcaagaugcugaacgccagagagcccaagguggugaacggccccgagauccugaacaaguacgugggcgagagcgaggccaacaucagaaagcuguucgccgacgccgaggaggagcagagaagacugggcgccaacagcggccugcacaucaucaucuucgacgagaucgacgccaucugcaagcagagaggcagcauggccggcagcaccggcgugcacgacaccguggugaaccagcugcugagcaagaucgacggcguggagcagcugaacaacauccuggugaucggcaugaccaacagacccgaccugaucgacgaggcccugcugagacccggcagacuggaggugaagauggagaucggccugcccgacgagaagggcagacugcagauccugcacauccacaccgccagaaugagaggccaccagcugcugagcgccgacguggacaucaaggagcuggccguggagaccaagaacuucagcggcgccgagcuggagggccuggugagagccgcccagagcaccgccaugaacagacacaucaaggccagcaccaagguggagguggacauggagaaggccgagagccugcaggugaccagaggcgacuuccuggccagccuggagaacgacaucaagcccgccuucggcaccaaccaggaggacuacgccagcuacaucaugaacggcaucaucaaguggggcgaccccgugaccagagugcuggacgacggcgagcugcuggugcagcagaccaagaacagcgacagaaccccccuggugagcgugcugcuggagggccccccccacagcggcaagaccgcccuggccgccaagaucgccgaggagagcaacuuccccuucaucaagaucugcagccccgacaagaugaucggcuucagcgagaccgccaagugccaggccaugaagaagaucuucgacgacgccuacaagagccagcugagcugcguggugguggacgacaucgagagacugcuggacuacgugcccaucggccccagauucagcaaccuggugcugcaggcccugcuggugcugcugaagaaggcccccccccagggcagaaagcugcugaucaucggcaccaccagcagaaaggacgugcugcaggagauggagaugcugaacgccuucagcaccaccauccacgugcccaacaucgccaccggcgagcagcugcuggaggcccuggagcugcugggcaacuucaaggacaaggagagaaccaccaucgcccagcaggugaagggcaagaagguguggaucggcaucaagaagcugcugaugcugaucgagaugagccugcagauggaccccgaguacagagugagaaaguuccuggcccugcugagagaggagggcgccagcccccuggacuucgacuaa

SEQ ID NO: 20762 - RNA, 1119 nt, Artificial Sequence
  NSFL1C__Homo_sapiens__NP_001193665
auggccgccgagagacaggaggcccugagagaguucguggccgugaccggcgccgaggaggacagagccagauucuuccuggagagcgccggcugggaccugcagaucgcccuggccagcuucuacgaggacggcggcgacgaggacaucgugaccaucagccaggccacccccagcagcgugagcagaggcaccgcccccagcgacaacagagugaccagcuucagagaccugauccacgaccaggacgaggacgaggaggaggaggagggccagagaagcagauucuacgccggcggcagcgagagaagcggccagcagaucgugggcccccccagaaagaagagccccaacgagcugguggacgaccuguucaagggcgccaaggagcacggcgccguggccguggagagagugaccaagagccccggcgagaccagcaagcccagacccuucgccggcggcggcuacagacugggcgccgcccccgaggaggagagcgccuacguggccggcgagaagagacagcacagcagccaggacgugcacguggugcugaagcuguggaagagcggcuucagccuggacaacggcgagcugagaagcuaccaggaccccagcaacgcccaguuccuggagagcaucagaagaggcgaggugcccgccgagcugagaagacuggcccacggcggccaggugaaccuggacauggaggaccacagagacgaggacuucgugaagcccaagggcgccuucaaggccuucaccggcgagggccagaagcugggcagcaccgccccccaggugcugagcaccagcagccccgcccagcaggccgagaacgaggccaaggccagcagcagcauccugaucgacgagagcgagcccaccaccaacauccagaucagacuggccgacggcggcagacuggugcagaaguucaaccacagccacagaaucagcgacaucagacuguucaucguggacgccagacccgccauggccgccaccagcuucauccugaugaccaccuuccccaacaaggagcuggccgacgagagccagacccugaaggaggccaaccugcugaacgccgugaucgugcagagacugaccuaa

SEQ ID NO: 20763 - RNA, 558 nt, Artificial Sequence
  NSG1__Homo_sapiens__NP_001274692
auggugaagcugggcaacaacuucgccgagaagggcaccaagcagccccugcuggaggacggcuucgacaccaucccccugaugaccccccuggacgugaaccagcugcaguuccccccccccgacaaggugguggugaagaccaagaccgaguacgagcccgacagaaagaagggcaaggccagacccccccagaucgccgaguucaccgugagcaucaccgagggcgugaccgagagauucaaggugagcgugcuggugcuguucgcccuggccuuccugaccugcgugguguuccuggugguguacaagguguacaaguacgacagagccugccccgacggcuucgugcugaagaacacccagugcauccccgagggccuggagagcuacuacgccgagcaggacagcagcgccagagagaaguucuacaccgugaucaaccacuacaaccuggccaagcagagcaucaccagaagcgugagccccuggaugagcgugcugagcgaggagaagcugagcgagcaggagaccgaggccgccgagaagagcgccuaa

SEQ ID NO: 20764 - RNA, 2847 nt, Artificial Sequence
  NSMAF__Homo_sapiens__NP_001138244
augaccggccaggccagauuccacagaggcgccgaggccugcagagccaucagacagugcagaagcagaagacccagagccgcccaccccgagggcagagccggcagcggcagaggcagcagacacgccagccccggcgugagaagaggcggcuucagccugcugcugcugaaccuggaggaguacuacuucgagcagcacagagccaaccacauccugcacaagggcagccaccacgagagaaagaucagaggcagccugaagaucugcagcaagagcgugaucuucgagcccgacagcaucagccagcccaucaucaagaucccccugagagacugcaucaagaucggcaagcacggcgagaacggcgccaacagacacuucaccaaggccaagagcggcggcaucagccugaucuucagccagguguacuucaucaaggagcacaacgugguggcccccuacaagaucgagagaggcaagauggaguacguguucgagcuggacgugcccggcaagguggaggacgugguggagacccugcugcagcugcacagagccagcugccuggacaagcugggcgaccagaccgccaugaucaccgccauccugcagagcagacuggccagaaccagcuucgacaagaacagauuccagaacaucagcgagaagcugcacauggagugcaaggccgagauggugaccccccuggugaccaaccccggccacgugugcaucaccgacaccaaccuguacuuccagccccugaacggcuaccccaagcccguggugcagaucacccugcaggacgugagaagaaucuacaagagaagacacggccugaugccccugggccuggagguguucugcaccgaggacgaccugugcagcgacaucuaccugaaguucuacgagccccaggacagagacgaccuguacuucuacaucgccaccuaccuggagcaccacguggccgagcacaccgccgagagcuacaugcugcaguggcagagaggccaccugagcaacuaccaguaccugcugcaccugaacaaccuggccgacagaagcugcaacgaccugagccaguaccccguguuccccuggaucauccacgacuacagcagcagcgagcuggaccugagcaaccccggcaccuucagagaccugagcaagcccgugggcgcccugaacaaggagagacuggagagacugcugaccagauaccaggagaugcccgagcccaaguucauguacggcagccacuacagcagccccggcuacgugcuguucuaccuggugagaaucgcccccgaguacaugcugugccugcagaacggcagauucgacaacgccgacagaauguucaacagcaucgccgagaccuggaagaacugccuggacggcgccaccgacuucaaggagcugauccccgaguucuacggcgacgacgugagcuuccuggugaacagccugaagcuggaccugggcaagagacagggcggccagaugguggacgacguggagcugccccccugggccagcagccccgaggacuuccugcagaagagcaaggacgcccuggagagcaacuacgugagcgagcaccugcacgaguggaucgaccugaucuucggcuacaagcagaagggcagcgacgccgugggcgcccacaacguguuccacccccugaccuacgagggcggcguggaccugaacagcauccaggaccccgacgagaagguggccaugcugacccagauccuggaguucggccagacccccaagcagcuguucgugaccccccaccccagaagaaucacccccaaguucaagagccugagccagaccagcagcuacaacgccagcauggccgacagccccggcgaggagagcuucgaggaccugaccgaggagagcaagacccuggccuggaacaacaucaccaagcugcagcugcacgagcacuacaagauccacaaggaggccgugaccggcaucaccgugagcagaaacggcagcagcguguucaccaccagccaggacagcacccugaagauguucagcaaggagagcaagaugcugcagagaagcaucagcuucagcaacauggcccugagcagcugccugcugcugcccggcgacgccaccgugaucaccagcagcugggacaacaacguguacuucuacagcaucgccuucggcagaagacaggacacccugaugggccacgacgacgccgugagcaagaucugcuggcacgacaacagacuguacagcgccagcugggacagcaccgugaagguguggagcggcgugcccgccgagaugcccggcaccaagagacaccacuucgaccugcuggccgagcuggagcacgacgugagcguggacaccaucagccugaacgccgccagcacccugcuggugagcggcaccaaggagggcaccgugaacaucugggaccugaccaccgccacccugaugcaccagauccccugccacagcggcaucgugugcgacaccgccuucagccccgacagcagacacgugcugagcaccggcaccgacggcugccugaacgugaucgacgugcagaccggcaugcugaucagcagcaugaccagcgacgagccccagagaugcuucgugugggacggcaacagcgugcugagcggcagccagagcggcgagcugcuggugugggaccugcugggcgccaagaucagcgagagaauccagggccacaccggcgccgugaccugcaucuggaugaacgagcagugcagcagcaucaucaccggcggcgaggacagacagaucaucuucuggaagcugcaguacuaa

SEQ ID NO: 20765 - RNA, 744 nt, Artificial Sequence
  NSMCE2__Homo_sapiens__NP_775956
augcccggcagaagcagcagcaacagcggcagcaccggcuucaucagcuucagcggcguggagagcgcccugagcagccugaagaacuuccaggccugcaucaacagcggcauggacaccgccagcagcguggcccuggaccugguggagagccagaccgaggugagcagcgaguacagcauggacaaggccaugguggaguucgccacccuggacagacagcugaaccacuacgugaaggccgugcagagcaccaucaaccacgugaaggaggagagacccgagaagauccccgaccugaagcugcugguggagaagaaguuccuggcccugcagagcaagaacagcgacgccgacuuccagaacaacgagaaguucgugcaguucaagcagcagcugaaggagcugaagaagcagugcggccugcaggccgacagagaggccgacggcaccgagggcguggacgaggacaucaucgugacccagagccagaccaacuucaccugccccaucaccaaggaggagaugaagaagcccgugaagaacaaggugugcggccacaccuacgaggaggacgccaucgugagaaugaucgagagcagacagaagagaaagaagaaggccuacugcccccagaucggcugcagccacaccgacaucagaaagagcgaccugauccaggacgaggcccugagaagagccaucgagaaccacaacaagaagagacacagacacagcgaguaa

SEQ ID NO: 20766 - RNA, 1593 nt, Artificial Sequence
  NSMF__Homo_sapiens__NP_001124441
augggcgccgccgccagcagaagaagagcccugagaagcgaggccaugagcagcguggccgccaaggugagagccgccagagccuucggcgaguaccugagccagagccaccccgagaacagaaacggcgccgaccaccugcuggccgacgccuacagcggccacgacggcagccccgagaugcagcccgccccccagaacaagagaagacugagccuggugagcaacggcugcuacgagggcagccugagcgaggagcccagcaucagaaagcccgccggcgagggcccccagcccagaguguacaccaucagcggcgagcccgcccugcugcccagccccgaggccgaggccaucgagcuggccguggugaagggcagaagacagagacacccccaccaccacagccagccccugagagccagccccggcggcagcagagaggacgugagcagacccugccagagcugggccggcagcagacagggcagcaaggagugccccggcugcgcccagcuggcccccggccccacccccagagccuucggccuggaccagcccccccugcccgagaccagcggcagaagaaagaagcuggagagaauguacagcguggacagagugagcgacgacauccccaucagaaccugguuccccaaggagaaccuguucagcuuccagaccgccaccaccaccaugcaggccaucagcguguucagaggcuacgccgagagaaagagaagaaagagagagaacgacagcgccagcgugauccagagaaacuucagaaagcaccugagaauggugggcagcagaagagugaaggcccagaccuucgccgagagaagagagagaagcuucagcagaagcuggagcgaccccacccccaugaaggccgacaccagccacgacagcagagacagcagcgaccugcagagcagccacugcacccuggacgaggccuucgaggaccuggacugggacaccgagaagggccuggaggccguggccugcgacaccgagggcuucgugccccccaaggugaugcugaucagcagcaaggugcccaaggccgaguacauccccaccaucaucagaagagacgaccccagcaucauccccauccuguacgaccacgagcacgccaccuucgaggacauccuggaggagaucgagagaaagcugaacguguaccacaagggcgccaagaucuggaagaugcugaucuucugccagggcggccccggccaccuguaccugcugaagaacaagguggccaccuucgccaagguggagaaggaggaggacaugauccacuucuggaagagacugagcagacugaugagcaaggugaaccccgagcccaacgugauccacaucaugggcugcuacauccugggcaaccccaacggcgagaagcuguuccagaaccugagaacccugaugacccccuacagagugaccuucgagagcccccuggagcugagcgcccagggcaagcagaugaucgagaccuacuucgacuucagacuguacagacuguggaagagcagacagcacagcaagcugcuggacuucgacgacgugcuguaa

SEQ ID NO: 20767 - RNA, 1515 nt, Artificial Sequence
  NSRP1__Homo_sapiens__NP_001248396
augaagcagaccaagcuggagauccagaaggcccuggccgaggacgccaccguguacgaguacgacagcaucuacgacgagaugcagaagaagaaggaggagaacaaccccaagcugcugcugggcaaggacagaaagcccaaguacauccacaaccugcugaaggccguggagaucagaaagaaggagcaggagaagagaauggagaagaagauccagagagagagagagauggagaagggcgaguucgacgacaaggaggccuucgugaccagcgccuacaagaagaagcugcaggagagagccgaggaggaggagagagagaagagagccgccgcccuggaggccugccuggacgugaccaagcagaaggaccugagcggcuucuacagacaccugcugaaccaggccgugggcgaggaggaggugcccaagugcagcuucagagaggccagaagcggcaucaaggaggagaagagcagaggcuucagcaacgaggugagcagcaagaacagaaucccccaggagaagugcauccugcagaccgacgugaagguggaggagaaccccgacgccgacagcgacuucgacgccaagagcagcgccgacgacgagaucgaggagaccagagugaacugcagaagagagaaggugaucgagacccccgagaacgacuucaagcaccacagaagccagaaccacagcagaagccccagcgaggagagaggccacagcaccagacaccacaccaagggcagcagaaccagcagaggccacgagaagagagaggaccagcaccagcagaagcagagcagagaccaggagaaccacuacaccgacagagacuacagaaaggagagagacagccacagacacagagaggccagccacagagacagccacuggaagagacacgagcaggaggacaagcccagagccagagaccagagagagagaagcgacagaguguggaagagagagaaggacagagagaaguacagccagagagagcaggagagagacagacagcagaacgaccagaacagacccagcgagaagggcgagaaggaggagaagagcaaggccaaggaggagcacaugaaggugagaaaggagagauacgagaacaacgacaaguacagagacagagagaagagagaggugggcgugcagagcagcgagagaaaccaggacagaaaggagagcagccccaacagcagagccaaggacaaguuccuggaccaggagagaagcaacaagaugagaaacauggccaaggacaaggagagaaaccaggagaagcccagcaacagcgagagcagccugggcgccaagcacagacugaccgaggagggccaggagaagggcaaggagcaggagagaccccccgaggccgugagcaaguucgccaagagaaacaacgaggagaccgugaugagcgccagagacagauaccuggccagacagauggccagagugaacgccaagaccuacaucgagaaggaggacgacuaa

SEQ ID NO: 20768 - RNA, 2199 nt, Artificial Sequence
  NSUN2__Homo_sapiens__NP_001180384
augggcagaagaagcagaggcagaagacugcagcagcagcagagacccgaggacgccgaggacggcgccgagggcggcggcaagagaggcgaggccggcugggagggcggcuaccccgagaucgugaaggagaacaagcuguucgagcacuacuaccaggagcugaagaucgugcccgagggcgaguggggccaguucauggacgcccugagagagccccugcccgccacccugagaaucaccggcuacaagagauaccccgaggagcuggccuggcacaccaaccugagcagaaagauccugagaaagagcccccaccuggagaaguuccaccaguuccuggugagcgagaccgagagcggcaacaucagcagacaggaggccgugagcaugauccccccccugcugcugaacgugagaccccaccacaagauccuggacaugugcgccgcccccggcagcaagaccacccagcugaucgagaugcugcacgccgacaugaacgugcccuuccccgagggcuucgugaucgccaacgacguggacaacaagagaugcuaccugcuggugcaccaggccaagagacugagcagccccugcaucaugguggugaaccacgacgccagcagcauccccagacugcagaucgacguggacggcagaaaggagauccuguucuacgacagaauccugugcgacgugcccugcagcggcgacggcaccaugagaaagaacaucgacguguggaagaaguggaccacccugaacagccugcagcugcacggccugcagcugagaaucgccaccagaggcgccgagcagcuggccgagggcggcagaaugguguacagcaccugcagccugaaccccaucgaggacgaggccgugaucgccagccugcuggagaagagcgagggcgcccuggagcuggccgacgugagcaacgagcugcccggccugaaguggaugcccggcaucacccaguggaaggugaugaccaaggacggccagugguucaccgacugggacgccgugccccacagcagacacacccagaucagacccaccauguucccccccaaggaccccgagaagcugcaggccaugcaccuggagagaugccugagaauccugccccaccaccagaacaccggcggcuucuucguggccgugcuggugaagaagagcagcaugcccuggaacaagagacagcccaagcugcagggcaagagcgccgagaccagagagagcacccagcugagccccgccgaccugaccgagggcaagcccaccgaccccagcaagcuggagagccccagcuucaccggcaccggcgacaccgagaucgcccacgccaccgaggaccuggagaacaacggcagcaagaaggacggcgugugcggccccccccccagcaagaagaugaagcuguucggcuucaaggaggaccccuucguguucauccccgaggacgacccccuguucccccccaucgagaaguucuacgcccuggaccccagcuuccccagaaugaaccugcugaccagaaccaccgagggcaagaagagacagcuguacauggugagcaaggagcugagaaacgugcugcugaacaacagcgagaagaugaaggugaucaacaccggcaucaagguguggugcagaaacaacagcggcgaggaguucgacugcgccuucagacuggcccaggagggcaucuacacccuguaccccuucaucaacagcagaaucaucaccgugagcauggaggacgugaagauccugcugacccaggagaaccccuucuucagaaagcugagcagcgagaccuacagccaggccaaggaccuggccaagggcagcaucgugcugaaguacgagcccgacagcgccaaccccgacgcccugcagugccccaucgugcugugcggcuggagaggcaaggccagcaucagaaccuucgugcccaagaacgagagacugcacuaccugagaaugaugggccuggaggugcugggcgagaagaagaaggagggcgugauccugaccaacgagagcgccgccagcaccggccagcccgacaacgacgugaccgagggccagagagccggcgagcccaacagccccgacgccgaggaggccaacagccccgacgugaccgccggcugcgaccccgccggcgugcacccccccagauaa

SEQ ID NO: 20769 - RNA, 1023 nt, Artificial Sequence
  NSUN3__Homo_sapiens__NP_071355
augcugacccagcugaaggccaagagcgagggcaagcuggccaagcagaucugcaagguggugcuggaccacuucgagaagcaguacagcaaggagcugggcgacgccuggaacaccgugagagagauccugaccagccccagcugcuggcaguacgccgugcugcugaacagauucaacuaccccuucgagcuggagaaggaccugcaccugaagggcuaccacacccugagccagggcagccugcccaacuaccccaagagcgugaagugcuaccugagcagaacccccggcagaauccccagcgagagacaccagaucggcaaccugaagaaguacuaccugcugaacgccgccagccugcugcccgugcuggcccuggagcugagagacggcgagaaggugcuggaccugugcgccgcccccggcggcaagagcaucgcccugcugcagugcgccugccccggcuaccugcacugcaacgaguacgacagccugagacugagauggcugagacagacccuggagagcuucaucccccagccccugaucaacgugaucaaggugagcgagcuggacggcagaaagaugggcgacgcccagcccgagauguucgacaaggugcugguggacgcccccugcagcaacgacagaagcuggcuguucagcagcgacagccagaaggccagcugcagaaucagccagagaagaaaccugccccugcugcagaucgagcugcugagaagcgccaucaaggcccugagacccggcggcauccugguguacagcaccugcacccugagcaaggccgagaaccaggacgugaucagcgagauccugaacagccacggcaacaucaugcccauggacaucaagggcaucgccagaaccugcagccacgacuucaccuucgcccccaccggccaggagugcggccugcuggugauccccgacaagggcaaggccuggggccccauguacguggccaagcugaagaagagcuggagcaccggcaagugguaa

SEQ ID NO: 20770 - RNA, 1413 nt, Artificial Sequence
  NSUN5__Homo_sapiens__NP_001161819
augggccuguacgccgccgccgccggcgugcuggccggcguggagagcagacagggcagcaucaagggccugguguacagcagcaacuuccagaacgugaagcagcuguacgcccuggugugcgagacccagagauacagcgccgugcuggacgccgugaucgccagcgccggccugcugagagccgagaagaagcugagaccccaccuggccaaggugcugguguacgagcugcugcugggcaagggcuucagaggcggcggcggcagauggaaggcccugcugggcagacaccaggccagacugaaggccgagcuggccagacugaaggugcacagaggcgugagcagaaacgaggaccugcuggaggugggcagcagacccggccccgccagccagcugcccagauucgugagagugaacacccugaagaccugcagcgacgacgugguggacuacuucaagagacagggcuucagcuaccagggcagagccagcagccuggacgaccugagagcccugaagggcaagcacuuccugcuggacccccugaugcccgagcugcugguguuccccgcccagaccgaccugcacgagcacccccuguacagagccggccaccugauccugcaggacagagccagcugccugcccgccaugcugcuggaccccccccccggcagccacgugaucgacgccugcgccgcccccggcaacaagaccagccaccuggccgcccugcugaagaaccagggcaagaucuucgccuucgaccuggacgccaagagacuggccagcauggccacccugcuggccagagccggcgugagcugcugcgagcuggccgaggaggacuuccuggccgugagccccagcgaccccagauaccacgaggugcacuacauccugcuggaccccagcugcagcggcagcggcaugcccagcagacagcuggaggagcccggcgccggcacccccagccccgugagacugcacgcccuggccggcuuccagcagagagcccugugccacgcccugaccuuccccagccugcagagacugguguacagcaccugcagccugugccaggaggagaacgaggacguggugagagacgcccugcagcagaaccccggcgccuucagacuggcccccgcccugcccgccuggccccacagaggccugagcaccuuccccggcgccgagcacugccugagagccagccccgagaccacccugagcagcggcuucuucguggccgugaucgagagaguggaggugcccagccugaccggccagagcaucagcaccagaacccacacccagcccagccccaaggagaaggaggagaccgccaagagcagaagcagaugccugcacaccgcccugcacaucgccgaggcccccggcuaa

SEQ ID NO: 20771 - RNA, 2157 nt, Artificial Sequence
  NSUN7__Homo_sapiens__NP_078953
augcugaacagcaccggcgagcuggaguucagcaacgaggaggaccccgagaucaucagccagcugaccagccugccccugagcggcggcaagagcagcgccggcgugcccgagaagaccggcuaccccgacagcguguacgugauggccgccaacaucuuccagggcaucagaaucgagaagagcgcccagaaggugcugaucaaguacggcaacgagccccugagaagccugagcgagagcgaggaccagagcuuccagagacugagcuacgagcuggccuucagcgcccugaaguaccaggacauccuggagaccauccugaucgacagcugcaucuuccccagcaccaccauccccgaccaccugagcagccugaucaucgugaugcuguacgacuuccaggacagaaaguuccagaccagagugcugagcgacaacgaggagcccaucagcgaggugcaggagguggagaaccugcugaacagcuucaagaucaagcuggccgccgcccuggccagaugcagaaucaagcacgacgcccugagcaucuaccacauccugcccgagaccgugagaaagcaggagcugagagccagcacccugccccuguacgccuggaucaacaccugcaagaucagccccgaggagguguacaacaaccugaagagaagaggcuacaacaaggugaagagcgugcugcacaucgacgacaagguguucgccguggaccagcacugcuacgacgugcugaucuuccccagccaccugaagaacgaccugaucaacaucgaccuguucaaggacuacaagcugaucuuccaggacaagagcagaagccuggccgugcacagcgugaaggcccugcugaacauggacgacgacgugcugauggugaacaccggcagcugguacaccgugagccacaugagcauccugaccaacaacaacaccagcaagguguucgugugcggcgugcagagccaggccaaggaccccgaccugaagacccuguucaccaagaucggcugcaagaacaucgagauccugcacgagaaguucaucaacaucgagagcaaggaccacagacugcagaaggugaaggugauccugcugcugcccagaugcagcggccugggcgugagcaaccccguggaguucauccugaacgagcacgaggacaccgaguuccugaaggaccacagccagggcggcaucagcguggacaagcugcacgugcuggcccagcagcaguacgagcagcugacccacgccaugaaguucaccaaggcccaggccgugguguacugcaccugcagcguguuccccgaggagaacgaggccguggugaagaaggcccuggaguuccaggaccugggcaacaagggccagcccuacagacugagcccccccgugcugccccugugcagccugaaggagauccagcugagcaccgacaaguucuucagaauggagcccagcgagaucaccaacggcugcuuccugagcauccugaccagagagagagaccccagcgagaccgugagcgugaacgacgugcuggccagagccgccgccaagggccugcuggacggcaucgagcugggcaagagcagcaagagagagaagaagaagaagaagagcaagaccagccugaccaagggcgccaccaccgacaacggcauccagaugaagaucgccgaguuccugaacagagagaccaaggccagcgccaaccugagcgagaccgugaccaagcccccccugccccagaagaacaccgcccaggugggcgccagcagccagaccagaaagcccaacaagcuggccccccaccccgccgugcccgccuucgugaagaacaccugccccagcagacccagagagagacagacccacuuccugagacccagacccgaggacagaaugguggcccugaagcccaucgagaucgugcugccccccguguucaugcccuucagcagcccccagggcaucagaagcagaaugcccacccagcaccuguacugcagauggguggcccccaaggcccuggugcccaccugccugcccacccacagccugagcagaaaggaggagaagcccaaggacgacacccccagcagccugcugagaccccccagaagauggcuguaa

SEQ ID NO: 20772 - RNA, 1833 nt, Artificial Sequence
  NT5C1B__Homo_sapiens__NP_001002006
augagccagaccagccugaagcagaagaagaacgagcccggcaugagaagcagcaaggagagccuggaggccgagaagagaaaggagagcgacaagaccggcgugagacugagcaaccagaugagaagagccgugaaccccaaccacagccugagaugcugccccuuccagggccacagcagcugcagaagaugccugugcgccgccgagggcaccgcccugggccccugccacaccaucagaaucuacauccacaugugccugcugugggagcagggccagcagaucaccaugaugagaggcagccaggagagcagccugagaaagaccgacagcagaggcuaccuggugagaagccaguggagcagaaucagcagaagccccagcaccaaggcccccagcaucgacgagcccagaagcagaaacaccagcgccaagcugcccagcagcagcaccagcagcagaacccccagcaccagccccagccugcacgacagcagcccccccccccugagcggccagcccagccugcagccccccgccagcccccagcugcccagaagccuggacagcagaccccccaccccccccgagcccgaccccggcagcagaagaagcaccaagaugcaggagaaccccgaggccugggcccagggcaucgugagagagaucagacagaccagagacagccagccccuggaguacagcagaaccagccccaccgaguggaagagcagcagccagagaagaggcaucuaccccgccagcacccagcuggacagaaacagccugagcgagcagcagcagcagcagagagaggacgaggacgacuacgaggccgccuacugggccagcaugagaagcuucuacgagaagaaccccagcugcagcagacccuggccccccaagcccaagaacgccaucaccaucgcccugagcagcugcgcccuguucaacaugguggacggcagaaagaucuacgagcaggagggccuggagaaguacauggaguaccagcugaccaacgagaacgugauccugacccccggccccgccuucagauucgugaaggcccugcaguacgugaacgccagacugagagaccuguaccccgacgagcaggaccuguucgacaucgugcugaugaccaacaaccacgcccaggugggcgugagacugaucaacagcgugaaccacuacggccugcugaucgacagauucugccugaccggcggcaaggaccccaucggcuaccugaaggccuaccugaccaaccuguacaucgccgccgacagcgagaaggugcaggaggccauccaggagggcaucgccagcgccaccauguucgacggcgccaaggacauggccuacugcgacacccagcugagaguggccuucgacggcgacgccgugcuguucagcgacgagagcgagcacuucaccaaggagcacggccuggacaaguucuuccaguacgacacccugugcgagagcaagccccuggcccagggcccccugaagggcuuccuggaggaccugggcagacugcagaagaaguucuacgccaagaacgagagacugcugugccccaucagaaccuaccuggugaccgccagaagcgccgccagcagcggcgccagagugcugaagacccugagaagauggggccuggagaucgacgaggcccuguuccuggccggcgcccccaagagccccauccuggugaagaucagaccccacaucuucuucgacgaccacauguuccacaucgagggcgcccagagacugggcagcaucgccgccuacggcuucaacaagaaguucagcagcuaa

SEQ ID NO: 20773 - RNA, 1953 nt, Artificial Sequence
  NT5C1B-RDH14__Homo_sapiens__NP_001186032
augagccagaccagccugaagcagaagaagaacgagcccggcaugagaagcagcaaggagagccuggaggccgagaagagaaaggagagcgacaagaccggcgugagacugagcaaccagggcagccaggagagcagccugagaaagaccgacagcagaggcuaccuggugagaagccaguggagcagaaucagcagaagccccagcaccaaggcccccagcaucgacgagcccagaagcagaaacaccagcgccaagguggagcugcccagcagcagcaccagcagcagaacccccagcaccagccccagccugcacgacagcagcccccccccccugagcggccagcccagccugcagccccccgccagcccccagcugcccagaagccuggacagcagaccccccaccccccccgagcccgaccccggcagcagaagaagcaccaagaugcaggagaaccccgaggccugggcccagggcaucgugagagagaucagacagaccagagacagccagccccuggaguacagcagaaccagccccaccgaguggaagagcagcagccagagaagaggcaucuaccccgccagcacccagcuggacagaaacagccugagcgagcagcagcagcagcagagagaggacgaggacgacuacgaggccgccuacugggccagcaugagaagcuucuacgagaagaaccccagcugcagcagacccuggccccccaagcccaagaacgccaucaccaucgcccugagcagcugcgcccuguucaacaugguggacggcagaaagaucuacgagcaggagggccuggagaaguacauggaguaccagcugaccaacgagaacgugauccugacccccggccccgccuucagauucgugaaggcccugcaguacgugaacgccagacugagagaccuguaccccgacgagcaggaccuguucgacaucgugcugaugaccaacaaccacgcccaggugggcgugagacugaucaacagcgugaaccacuacggccugcugaucgacagauucugccugaccggcggcaaggaccccaucggcuaccugaaggccuaccugaccaaccuguacaucgccgccgacagcgagaaggugcaggaggccauccaggagggcaucgccagcgccaccauguucgacggcgccaaggacauggccuacugcgacacccagcugagaguggccuucgacggcgacgccgugcuguucagcgacgagagcgagcacuucaccaaggagcacggccuggacaaguucuuccaguacgacacccugugcgagagcaagccccuggcccaggaggagcccagacuggacgugcugaucaacaacgccggcaucuuccagugccccuacaugaagaccgaggacggcuucgagaugcaguucggcgugaaccaccugggccacuuccugcugaccaaccugcugcugggccugcugaagagcagcgcccccagcagaaucgugguggugagcagcaagcuguacaaguacggcgacaucaacuucgacgaccugaacagcgagcagagcuacaacaagagcuucugcuacagcagaagcaagcuggccaacauccuguucaccagagagcuggccagaagacuggagggcaccaacgugaccgugaacgugcugcaccccggcaucgugagaaccaaccugggcagacacauccacaucccccugcuggugaagccccuguucaaccuggugagcugggccuucuucaagacccccguggagggcgcccagaccagcaucuaccuggccagcagccccgagguggagggcgugagcggcagauacuucggcgacugcaaggaggaggagcugcugcccaaggccauggacgagagcguggccagaaagcugugggacaucagcgaggugauggugggccugcugaaguaa

SEQ ID NO: 20774 - RNA, 1686 nt, Artificial Sequence
  NT5C2__Homo_sapiens__NP_036361
augagcaccagcuggagcgacagacugcagaacgccgccgacaugcccgccaacauggacaagcacgcccugaagaaguacagaagagaggccuaccacagaguguucgugaacagaagccuggccauggagaagaucaagugcuucggcuucgacauggacuacacccuggccguguacaagagccccgaguacgagagccugggcuucgagcugaccguggagagacuggugagcaucggcuacccccaggagcugcugagcuucgccuacgacagcaccuuccccaccagaggccugguguucgacacccuguacggcaaccugcugaagguggacgccuacggcaaccugcuggugugcgcccacggcuucaacuucaucagaggccccgagaccagagagcaguaccccaacaaguucauccagagagacgacaccgagagauucuacauccugaacacccuguucaaccugcccgagaccuaccugcuggccugccugguggacuucuucaccaacugccccagauacaccagcugcgagaccggcuucaaggacggcgaccuguucaugagcuacagaagcauguuccaggacgugagagacgccguggacugggugcacuacaagggcagccugaaggagaagaccguggagaaccuggagaaguacguggugaaggacggcaagcugccccugcugcugagcagaaugaaggaggugggcaagguguuccuggccaccaacagcgacuacaaguacaccgacaagaucaugaccuaccuguucgacuucccccacggccccaagcccggcagcagccacagacccuggcagagcuacuucgaccugauccugguggacgccagaaagccccuguucuucggcgagggcaccgugcugagacagguggacaccaagaccggcaagcugaagaucggcaccuacaccggcccccugcagcacggcaucguguacagcggcggcagcagcgacaccaucugcgaccugcugggcgccaagggcaaggacauccuguacaucggcgaccacaucuucggcgacauccugaagagcaagaagagacagggcuggagaaccuuccuggugauccccgagcuggcccaggagcugcacguguggaccgacaagagcagccuguucgaggagcugcagagccuggacaucuuccuggccgagcuguacaagcaccuggacagcagcagcaacgagagacccgacaucagcagcauccagagaagaaucaagaaggugacccacgacauggacaugugcuacggcaugaugggcagccuguucagaagcggcagcagacagacccuguucgccagccaggugaugagauacgccgaccuguacgccgccagcuucaucaaccugcuguacuaccccuucagcuaccuguucagagccgcccacgugcugaugccccacgagagcaccguggagcacacccacguggacaucaacgagauggagagcccccuggccaccagaaacagaaccagcguggacuucaaggacaccgacuacaagagacaccagcugaccagaagcaucagcgagaucaagccccccaaccuguucccccuggccccccaggagaucacccacugccacgacgaggacgacgacgaggaggaggaggaggaggaggaguaa

SEQ ID NO: 20775 - RNA, 1011 nt, Artificial Sequence
  NT5C3A__Homo_sapiens__NP_001002010
augagagcccccagcauggacagagccgccguggccagagugggcgccguggccagcgccagcgugugcgcccugguggccggcguggugcuggcccaguacaucuucacccugaagagaaagaccggcagaaagaccaagaucaucgagaugaugcccgaguuccagaagagcagcgugagaaucaagaaccccaccagaguggaggagaucaucugcggccugaucaagggcggcgccgccaagcugcagaucaucaccgacuucgacaugacccugagcagauucagcuacaagggcaagagaugccccaccugccacaacaucaucgacaacugcaagcuggugaccgacgagugcagaaagaagcugcugcagcugaaggagaaguacuacgccaucgagguggaccccgugcugaccguggaggagaaguaccccuacaugguggagugguacaccaagagccacggccugcuggugcagcaggcccugcccaaggccaagcugaaggagaucguggccgagagcgacgugaugcugaaggagggcuacgagaacuucuucgacaagcugcagcagcacagcauccccguguucaucuucagcgccggcaucggcgacgugcuggaggaggugaucagacaggccggcguguaccaccccaacgugaagguggugagcaacuucauggacuucgacgagaccggcgugcugaagggcuucaagggcgagcugauccacguguucaacaagcacgacggcgcccugagaaacaccgaguacuucaaccagcugaaggacaacagcaacaucauccugcugggcgacagccagggcgaccugagaauggccgacggcguggccaacguggagcacauccugaagaucggcuaccugaacgacagaguggacgagcugcuggagaaguacauggacagcuacgacaucgugcuggugcaggacgagagccuggagguggccaacagcauccugcagaagauccuguaa

SEQ ID NO: 20776 - RNA, 486 nt, Artificial Sequence
  NT5C__Homo_sapiens__NP_001239306
auggccagaagcgugagagugcugguggacauggacggcgugcuggccgacuucgaggccggccugcugagaggcuucagaagaagauuccccgaggagccccacgugccccuggagcagagaagaggcuuccuggccagagagcaguacagagcccugagacccgaccuggccgacaagguggccagcguguacgaggcccccggcuucuuccuggaccuggagcccauccccggcgcccuggacgccgugagagagaugaacgaccugcccgacacccagguguucaucugcaccagcccccugcugaaguaccaccacugcgugggcgagaaggaggagacccccagcugggagcacauccuguucaccugcugccacaacagacaccuggugcugccccccaccagaagaagacugcugagcuggagcgacaacuggagagagauccuggacagcaagagaggcgccgcccagagagaguaa

SEQ ID NO: 20777 - RNA, 1368 nt, Artificial Sequence
  NT5DC1__Homo_sapiens__NP_689942
auggcccagcacuucagccuggccgccugcgacguggugggcuucgaccuggaccacacccugugcagauacaaccugcccgagagcgccccccugaucuacaacagcuucgcccaguuccuggugaaggagaagggcuacgacaaggagcugcugaacgugacccccgaggacugggacuucugcugcaagggccuggcccuggaccuggaggacggcaacuuccugaagcuggccaacaacggcaccgugcugagagccagccacggcaccaagaugaugacccccgaggugcuggccgaggccuacggcaagaaggaguggaagcacuuccugagcgacaccggcauggccugcagaagcggcaaguacuacuucuacgacaacuacuucgaccugcccggcgcccugcugugcgccagagugguggacuaccugaccaagcugaacaacggccagaagaccuucgacuucuggaaggacaucguggccgccauccagcacaacuacaagaugagcgccuucaaggagaacugcggcaucuacuuccccgagaucaagagagaccccggcagauaccugcacagcugccccgagagcgugaagaaguggcugagacagcugaagaacgccggcaagauccugcugcugaucaccagcagccacagcgacuacugcagacugcugugcgaguacauccugggcaacgacuucaccgaccuguucgacaucgugaucaccaacgcccugaagcccggcuucuucagccaccugcccagccagagacccuucagaacccuggagaacgacgaggagcaggaggcccugcccagccuggacaagcccggcugguacagccagggcaacgccgugcaccuguacgagcugcugaagaagaugaccggcaagcccgagcccaaggugguguacuucggcgacagcaugcacagcgacaucuuccccgccagacacuacagcaacugggagaccgugcugauccuggaggagcugagaggcgacgagggcaccagaagccagagacccgaggagagcgagccccuggagaagaagggcaaguacgagggccccaaggccaagccccugaacaccagcagcaagaaguggggcagcuucuucaucgacagcgugcugggccuggagaacaccgaggacagccugguguacaccuggagcugcaagagaaucagcaccuacagcaccaucgccauccccagcaucgaggccaucgccgagcugccccuggacuacaaguucaccagauucagcagcagcaacagcaagaccgccggcuacuaccccaaccccccccuggugcugagcagcgacgagacccugaucagcaaguaa

SEQ ID NO: 20778 - RNA, 1647 nt, Artificial Sequence
  NT5DC3__Homo_sapiens__NP_001026871
augaccauggccgccgccgccgugguggccagaggcgccggcgccagagccgccaccgccgccgcccugagaggcggcugcggcaccgccgccagaggcagacccugcgccggccccgccagaccccugugcaccgcccccggcaccgcccccgacaugaagagauaccugugggagagauacagagaggccaagagaagcaccgaggagcuggugcccagcaucaugagcaaccugcugaaccccgacgccaucuucagcaacaacgagaugagccugagcgacaucgagaucuacggcuucgacuacgacuacacccugguguucuacagcaagcaccugcacacccugaucuucaacgccgccagagaccugcugaucaacgagcacagauaccccgccgagaucagaaaguacgaguacgaccccaacuucgccaucagaggccugcacuacgacgugcagagagccgugcugaugaagaucgacgccuuccacuacauccagcugggcaccguguacagaggccugagcguggugcccgacgaggaggugaucgagauguacgagggcagccacgugccccuggagcagaugagcgacuucuacggcaagagcagccacggcaacaccaugaagcaguucauggacaucuucagccugcccgagaugacccugcugagcugcgugaacgaguacuuccugaagaacaacaucgacuacgagcccgugcaccuguacaaggacgugaaggacagcaucagagacgugcacaucaagggcaucauguacagagccaucgaggccgacaucgagaaguacaucugcuacgccgagcagaccagagccgugcuggccaagcuggccgaccacggcaagaagauguuccugaucaccaacagccccagcagcuucguggacaagggcaugagcuacaucgugggcaaggacuggagagaccuguucgacguggugaucgugcaggccgagaagcccaacuucuucaacgacaagagaagacccuucagaaagaugaacgagaagggcgugcugcugugggacaagauccacaagcugcagaagggccagaucuacaagcagggcaaccuguacgaguuccugaagcugaccggcuggagaggcagcagagugcuguacuucggcgaccacaucuacagcgaccuggccgaccugacccugaagcacggcuggagaaccggcgccaucauccccgagcugagaagcgagcugaagaucaugaacaccgagcaguacauccagaccaugaccuggcugcagacccugaccggccugcuggagcagaugcaggugcacagagacgccgagagccagcuggugcugcaggaguggaagaaggagagaaaggagaugagagagaugaccaagagcuucuucaacgcccaguucggcagccuguucagaaccgaccagaaccccaccuacuuccugagaagacugagcagauucgccgacaucuacauggccagccugagcugccugcugaacuacgacgugagccacaccuucuaccccagaagaaccccccugcagcacgagcugcccgccuggagcgagagaccccccaccuucggcaccccccugcugcaggaggcccaggccaaguaa

SEQ ID NO: 20779 - RNA, 1575 nt, Artificial Sequence
  NT5E__Homo_sapiens__NP_001191742
augugccccagagccgccagagcccccgccacccugcugcuggcccugggcgccgugcuguggcccgccgccggcgccugggagcugaccauccugcacaccaacgacgugcacagcagacuggagcagaccagcgaggacagcagcaagugcgugaacgccagcagaugcaugggcggcguggccagacuguucaccaaggugcagcagaucagaagagccgagcccaacgugcugcugcuggacgccggcgaccaguaccagggcaccaucugguucaccguguacaagggcgccgagguggcccacuucaugaacgcccugagauacgacgccauggcccugggcaaccacgaguucgacaacggcguggagggccugaucgagccccugcugaaggaggccaaguuccccauccugagcgccaacaucaaggccaagggcccccuggccagccagaucagcggccuguaccugcccuacaaggugcugcccgugggcgacgagguggugggcaucgugggcuacaccagcaaggagacccccuuccugagcaaccccggcaccaaccugguguucgaggacgagaucaccgcccugcagcccgagguggacaagcugaagacccugaacgugaacaagaucaucgcccugggccacagcggcuucgagauggacaagcugaucgcccagaaggugagaggcguggacgugguggugggcggccacagcaacaccuuccuguacaccggcaacccccccagcaaggaggugcccgccggcaaguaccccuucaucgugaccagcgacgacggcagaaaggugcccguggugcaggccuacgccuucggcaaguaccugggcuaccugaagaucgaguucgacgagagaggcaacgugaucagcagccacggcaaccccauccugcugaacagcagcauccccgaggaccccagcaucaaggccgacaucaacaaguggagaaucaagcuggacaacuacagcacccaggagcugggcaagaccaucguguaccuggacggcagcagccagagcugcagauucagagagugcaacaugggcaaccugaucugcgacgccaugaucaacaacaaccugagacacaccgacgagauguucuggaaccacgugagcaugugcauccugaacggcggcggcaucagaagccccaucgacgagagaaacaacggcauccacgugguguacgaccugagcagaaagcccggcgacagaguggugaagcuggacgugcugugcaccaagugcagagugcccagcuacgacccccugaagauggacgagguguacaaggugauccugcccaacuuccuggccaacggcggcgacggcuuccagaugaucaaggacgagcugcugagacacgacagcggcgaccaggacaucaacguggugagcaccuacaucagcaagaugaaggugaucuaccccgccguggagggcagaaucaaguucagcaccggcagccacugccacggcagcuucagccugaucuuccugagccugugggccgugaucuucgugcuguaccaguaa

SEQ ID NO: 20780 - RNA, 687 nt, Artificial Sequence
  NT5M__Homo_sapiens__NP_064586
augaucagacugggcggcuggugcgccagaagacugugcagcgccgccgugcccgccggcagaagaggcgccgccggcggccugggccuggccggcggcagagcccugagagugcugguggacauggacggcgugcuggccgacuucgagggcggcuuccugagaaaguucagagccagauuccccgaccagcccuucaucgcccuggaggacagaagaggcuucugggugagcgagcaguacggcagacugagacccggccugagcgagaaggccaucagcaucugggagagcaagaacuucuucuucgagcuggagccccugcccggcgccguggaggccgugaaggagauggccagccugcagaacaccgacguguucaucugcaccagccccaucaagauguucaaguacugccccuacgagaaguacgccuggguggagaaguacuucggccccgacuuccuggagcagaucgugcugaccagagacaagaccguggugagcgccgaccugcugaucgacgacagacccgacaucaccggcgccgagcccacccccagcugggagcacgugcuguucaccgccugccacaaccagcaccugcagcugcagccccccagaagaagacugcacagcugggccgacgacuggaaggccauccuggacagcaagagacccugcuaa

SEQ ID NO: 20781 - RNA, 933 nt, Artificial Sequence
  NTAN1__Homo_sapiens__NP_775745
augccccugcugguggagggcagaagagugagacugccccagagcgccggcgaccuggugagagcccaccccccccuggaggagagagccagacugcugagaggccagagcgugcagcaggugggcccccagggccugcuguacgugcagcagagagagcuggccgugaccagccccaaggacggcagcaucagcauccugggcagcgacgacgccaccaccugccacaucguggugcugagacacaccggcaacggcgccaccugccugacccacugcgacggcaccgacaccaaggccgaggugccccugaucaugaacagcaucaagagcuucagcgaccacgcccagugcggcagacuggaggugcaccuggugggcggcuucagcgacgacagacagcugagccagaagcugacccaccagcugcugagcgaguucgacagacaggaggacgacauccaccuggugacccugugcgugaccgagcugaacgacagagaggagaacgagaaccacuuccccgugaucuacggcaucgccgugaacaucaagaccgccgagaucuacagagccagcuuccaggacagaggccccgaggagcagcugagagccgccagaacccuggccggcggccccaugaucagcaucuacgacgccgagaccgagcagcugagaaucggccccuacagcuggacccccuucccccacguggacuucuggcugcaccaggacgacaagcagauccuggagaaccugagcaccagcccccuggccgagcccccccacuucguggagcacaucagaagcacccugauguuccugaagaagcaccccagccccgcccacacccuguucagcggcaacaaggcccugcuguacaagaagaacgaggacggccugugggagaagaucagcagccccggcagcuaa

SEQ ID NO: 20782 - RNA, 813 nt, Artificial Sequence
  NTF3__Homo_sapiens__NP_001096124
auggugaccuucgccaccauccugcaggugaacaaggugaugagcauccuguucuacgugaucuuccuggccuaccugagaggcauccagggcaacaacauggaccagagaagccugcccgaggacagccugaacagccugaucaucaagcugauccaggccgacauccugaagaacaagcugagcaagcagaugguggacgugaaggagaacuaccagagcacccugcccaaggccgaggcccccagagagcccgagagaggcggccccgccaagagcgccuuccagcccgugaucgccauggacaccgagcugcugagacagcagagaagauacaacagccccagagugcugcugagcgacagcaccccccuggagccccccccccuguaccugauggaggacuacgugggcagccccgugguggccaacagaaccagcagaagaaagagauacgccgagcacaagagccacagaggcgaguacagcgugugcgacagcgagagccugugggugaccgacaagagcagcgccaucgacaucagaggccaccaggugaccgugcugggcgagaucaagaccggcaacagccccgugaagcaguacuucuacgagaccagaugcaaggaggccagacccgugaagaacggcugcagaggcaucgacgacaagcacuggaacagccagugcaagaccagccagaccuacgugagagcccugaccagcgagaacaacaagcuggugggcuggagauggaucagaaucgacaccagcugcgugugcgcccugagcagaaagaucggcagaaccuaa

SEQ ID NO: 20783 - RNA, 663 nt, Artificial Sequence
  NTF4__Homo_sapiens__XP_011525310
augagacaccacaccagagugcugagagagaugcugccccugcccagcugcagccugcccauccugcugcuguuccugcugcccagcgugcccaucgagagccagcccccccccagcacccugccccccuuccuggcccccgagugggaccugcugagccccagaguggugcugagcagaggcgcccccgccggccccccccugcuguuccugcuggaggccggcgccuucagagagagcgccggcgcccccgccaacagaagcagaagaggcgugagcgagaccgcccccgccagcagaagaggcgagcuggccgugugcgacgccgugagcggcugggugaccgacagaagaaccgccguggaccugagaggcagagagguggaggugcugggcgaggugcccgccgccggcggcagcccccugagacaguacuucuucgagaccagaugcaaggccgacaacgccgaggagggcggccccggcgccggcggcggcggcugcagaggcguggacagaagacacugggugagcgagugcaaggccaagcagagcuacgugagagcccugaccgccgacgcccagggcagagugggcuggagauggaucagaaucgacaccgccugcgugugcacccugcugagcagaaccggcagagccuaa

SEQ ID NO: 20784 - RNA, 939 nt, Artificial Sequence
  NTHL1__Homo_sapiens__NP_002519
augugcagcccccaggagagcggcaugaccgcccugagcgccagaaugcugaccagaagcagaagccugggccccggcgccggccccagaggcugcagagaggagcccggcccccugagaagaagagaggccgccgccgaggccagaaagagccacagccccgugaagagacccagaaaggcccagagacugagaguggccuacgagggcagcgacagcgagaagggcgagggcgccgagccccugaaggugcccgugugggagccccaggacuggcagcagcagcuggugaacaucagagccaugagaaacaagaaggacgcccccguggaccaccugggcaccgagcacugcuacgacagcagcgccccccccaaggugagaagauaccaggugcugcugagccugaugcugagcagccagaccaaggaccaggugaccgccggcgccaugcagagacugagagccagaggccugaccguggacagcauccugcagaccgacgacgccacccugggcaagcugaucuaccccgugggcuucuggagaagcaaggugaaguacaucaagcagaccagcgccauccugcagcagcacuacggcggcgacauccccgccagcguggccgagcugguggcccugcccggcgugggccccaagauggcccaccuggccauggccguggccuggggcaccgugagcggcaucgccguggacacccacgugcacagaaucgccaacagacugagauggaccaagaaggccaccaagagccccgaggagaccagagccgcccuggaggaguggcugcccagagagcuguggcacgagaucaacggccugcuggugggcuucggccagcagaccugccugcccgugcaccccagaugccacgccugccugaaccaggcccugugccccgccgcccagggccuguaa

SEQ ID NO: 20785 - RNA, 1035 nt, Artificial Sequence
  NTM__Homo_sapiens__NP_001041674
augaagaccauccagcccaagaugcacaacagcaucagcugggccaucuucaccggccuggccgcccugugccuguuccagggcgugcccgugagaagcggcgacgccaccuuccccaaggccauggacaacgugaccgugagacagggcgagagcgccacccugagaugcaccaucgacaacagagugaccagaguggccuggcugaacagaagcaccauccuguacgccggcaacgacaaguggugccuggaccccagaguggugcugcugagcaacacccagacccaguacagcaucgagauccagaacguggacguguacgacgagggccccuacaccugcagcgugcagaccgacaaccaccccaagaccagcagagugcaccugaucgugcaggugagccccaagaucguggagaucagcagcgacaucagcaucaacgagggcaacaacaucagccugaccugcaucgccaccggcagacccgagcccaccgugaccuggagacacaucagccccaaggccgugggcuucgugagcgaggacgaguaccuggagauccagggcaucaccagagagcagagcggcgacuacgagugcagcgccagcaacgacguggccgcccccguggugagaagagugaaggugaccgugaacuacccccccuacaucagcgaggccaagggcaccggcgugcccgugggccagaagggcacccugcagugcgaggccagcgccgugcccagcgccgaguuccagugguacaaggacgacaagagacugaucgagggcaagaagggcgugaagguggagaacagacccuuccugagcaagcugaucuucuucaacgugagcgagcacgacuacggcaacuacaccugcguggccagcaacaagcugggccacaccaacgccagcaucaugcuguucggccccggcgccgugagcgaggugagcaacggcaccagcagaagagccggcugcguguggcugcugccccugcuggugcugcaccugcugcugaaguucuaa

SEQ ID NO: 20786 - RNA, 1815 nt, Artificial Sequence
  NTN1__Homo_sapiens__XP_006721658
augaugagagccgugugggaggcccuggccgcccuggccgccguggccugccuggugggcgccgugagaggcggccccggccugagcauguucgccggccaggccgcccagcccgaccccugcagcgacgagaacggccaccccagaagaugcauccccgacuucgugaacgccgccuucggcaaggacgugagagugagcagcaccugcggcagaccccccgccagauacugcguggugagcgagagaggcgaggagagacugagaagcugccaccugugcaacgccagcgaccccaagaaggcccacccccccgccuuccugaccgaccugaacaacccccacaaccugaccugcuggcagagcgagaacuaccugcaguucccccacaacgugacccugacccugagccugggcaagaaguucgaggugaccuacgugagccugcaguucugcagccccagacccgagagcauggccaucuacaagagcauggacuacggcagaaccugggugcccuuccaguucuacagcacccagugcagaaagauguacaacagaccccacagagcccccaucaccaagcagaacgagcaggaggccgugugcaccgacagccacaccgacaugagaccccugagcggcggccugaucgccuucagcacccuggacggcagacccagcgcccacgacuucgacaacagccccgugcugcaggacugggugaccgccaccgacaucagaguggccuucagcagacugcacaccuucggcgacgagaacgaggacgacagcgagcuggccagagacagcuacuucuacgccgugagcgaccugcaggugggcggcagaugcaagugcaacggccacgccgccagaugcgugagagacagagacgacagccuggugugcgacugcagacacaacaccgccggccccgagugcgacagaugcaagcccuuccacuacgacagacccuggcagagagccaccgccagagaggccaacgagugcguggccugcaacugcaaccugcacgccagaagaugcagauucaacauggagcuguacaagcugagcggcagaaagagcggcggcgugugccugaacugcagacacaacaccgccggcagacacugccacuacugcaaggagggcuacuacagagacaugggcaagcccaucacccacagaaaggccugcaaggccugcgacugccaccccgugggcgccgccggcaagaccugcaaccagaccaccggccagugccccugcaaggacggcgugaccggcaucaccugcaacagaugcgccaagggcuaccagcagagcagaagccccaucgcccccugcaucaagauccccguggccccccccaccaccgccgccagcagcguggaggagcccgaggacugcgacagcuacugcaaggccagcaagggcaagcugaagaucaacaugaagaaguacugcaagaaggacuacgccgugcagauccacauccugaaggccgacaaggccggcgacugguggaaguucaccgugaacaucaucagcguguacaagcagggcaccagcagaaucagaagaggcgaccagagccuguggaucagaagcagagacaucgccugcaagugccccaagaucaagccccugaagaaguaccugcugcugggcaacgccgaggacagccccgaccagagcggcaucguggccgacaagagcagccuggugauccaguggagagacaccugggccagaagacugagaaaguuccagcagagagagaagaagggcaagugcaagaaggccuaa

SEQ ID NO: 20787 - RNA, 1887 nt, Artificial Sequence
  NTN4__Homo_sapiens__NP_067052
augggcagcugcgccagacugcugcugcuguggggcugcaccgugguggccgccggccugagcggcguggccggcgugagcagcagaugcgagaaggccugcaaccccagaaugggcaaccuggcccugggcagaaagcugugggccgacaccaccugcggccagaacgccaccgagcuguacugcuucuacagcgagaacaccgaccugaccugcagacagcccaagugcgacaagugcaacgccgccuacccccaccuggcccaccugcccagcgccauggccgacagcagcuucagauuccccagaaccugguggcagagcgccgaggacgugcacagagagaagauccagcuggaccuggaggccgaguucuacuucacccaccugaucgugauguucaagagccccagacccgccgccauggugcuggacagaagccaggacuucggcaagaccuggaagcccuacaaguacuucgccaccaacugcagcgccaccuucggccuggaggacgacguggugaagaagggcgccaucugcaccagcaaguacagcagccccuuccccugcaccggcggcgaggugaucuucaaggcccugagcccccccuacgacaccgagaaccccuacagcgccaaggugcaggagcagcugaagaucaccaaccugagagugcagcugcugaagagacagagcugccccugccagagaaacgaccugaacgaggagccccagcacuucacccacuacgccaucuacgacuucaucgugaagggcagcugcuucugcaacggccacgccgaccagugcauccccgugcacggcuucagacccgugaaggcccccggcaccuuccacauggugcacggcaagugcaugugcaagcacaacaccgccggcagccacugccagcacugcgccccccuguacaacgacagacccugggaggccgccgacggcaagaccggcgcccccaacgagugcagaaccugcaagugcaacggccacgccgacaccugccacuucgacgugaacgugugggaggccagcggcaacagaagcggcggcgugugcgacgacugccagcacaacaccgagggccaguacugccagagaugcaagcccggcuucuacagagaccugagaagacccuucagcgcccccgacgccugcaagcccugcagcugccaccccgugggcagcgccgugcugcccgccaacagcgugaccuucugcgaccccagcaacggcgacugccccugcaagcccggcguggccggcagaagaugcgacagaugcauggugggcuacuggggcuucggcgacuacggcugcagacccugcgacugcgccggcagcugcgaccccaucaccggcgacugcaucagcagccacaccgacaucgacugguaccacgaggugcccgacuucagacccgugcacaacaagagcgagcccgccugggagugggaggacgcccagggcuucagcgcccugcugcacagcggcaagugcgagugcaaggagcagacccugggcaacgccaaggccuucugcggcaugaaguacagcuacgugcugaagaucaagauccugagcgcccacgacaagggcacccacguggaggugaacgugaagaucaagaaggugcugaagagcaccaagcugaagaucuucagaggcaagagaacccuguaccccgagagcuggaccgacagaggcugcaccugccccauccugaaccccggccuggaguaccugguggccggccacgaggacaucagaaccggcaagcugaucgugaacaugaagagcuucgugcagcacuggaagcccagccugggcagaaaggugauggacauccugaagagagagugcaaguaa

SEQ ID NO: 20788 - RNA, 1578 nt, Artificial Sequence
  NTNG1__Homo_sapiens__XP_011539324
auguaccugagcagauuccugagcauccacgcccugugggugaccgugagcagcgugaugcagcccuacccccugguguggggccacuacgaccugugcaagacccagaucuacaccgaggagggcaaggugugggacuacauggccugccagcccgagagcaccgacaugaccaaguaccugaaggugaagcuggacccccccgacaucaccugcggcgacccccccgagaccuucugcgccaugggcaaccccuacaugugcaacaacgagugcgacgccagcacccccgagcuggcccacccccccgagcugauguucgacuucgagggcagacaccccagcaccuucuggcagagcgccaccuggaaggaguaccccaagccccugcaggugaacaucacccugagcuggagcaagaccaucgagcugaccgacaacaucgugaucaccuucgagagcggcagacccgaccagaugauccuggagaagagccuggacuacggcagaaccuggcagcccuaccaguacuacgccaccgacugccuggacgccuuccacauggaccccaagagcgugaaggaccugagccagcacaccgugcuggagaucaucugcaccgaggaguacagcaccggcuacaccaccaacagcaagaucauccacuucgagaucaaggacagauucgccuucuucgccggccccagacugagaaacauggccagccuguacggccagcuggacaccaccaagaagcugagagacuucuucaccgugaccgaccugagaaucagacugcugagacccgccgugggcgagaucuucguggacgagcugcaccuggccagauacuucuacgccaucagcgacaucaaggugagaggcagaugcaagugcaaccugcacgccaccgugugcguguacgacaacagcaagcugaccugcgagugcgagcacaacaccaccggccccgacugcggcaagugcaagaagaacuaccagggcagacccuggagccccggcagcuaccugcccauccccaagggcaccgccaacaccugcauccccagcaucagcagcaucggcaacccccccaaguucaacagaaucuggcccaacaucagcagccuggaggugagcaaccccaagcagguggcccccaagcuggcccugagcaccgugagcagcgugcagguggccaaccacaagagagagugcuacugcaacccccugggcagcauccacgacagaugcaacggcagcggcuucugcgagugcaagaccggcaccaccggccccaagugcgacgagugccugcccggcaacagcuggcacuacggcugccagcccaacgugugcgacaacgagcugcugcacugccagaacggcggcaccugccacaacaacgugagaugccugugccccgccgccuacaccggcauccugugcgagaagcugagaugcgaggaggccggcagcugcggcagcgacagcggccagggcgcccccccccacggcagccccgcccugcugcugcugaccacccugcugggcaccgccagcccccugguguucuaa

SEQ ID NO: 20789 - RNA, 1593 nt, Artificial Sequence
  NTNG2__Homo_sapiens__NP_115925
augcugcaccugcuggcccuguuccugcacugccugccccuggccagcggcgacuacgacaucugcaagagcugggugaccaccgacgagggccccaccugggaguucuacgccugccagcccaaggugaugagacugaaggacuacgugaaggugaagguggagcccagcggcaucaccugcggcgacccccccgagagauucugcagccacgagaaccccuaccugugcagcaacgagugcgacgccagcaaccccgaccuggcccacccccccagacugauguucgacaaggaggaggagggccuggccaccuacuggcagagcaucaccuggagcagauaccccagcccccuggaggccaacaucacccugagcuggaacaagaccguggagcugaccgacgacguggugaugaccuucgaguacggcagacccaccgugauggugcuggagaagagccuggacaacggcagaaccuggcagcccuaccaguucuacgccgaggacugcauggaggccuucggcaugagcgccagaagagccagagacaugagcagcagcagcgcccacagagugcugugcaccgaggaguacagcagaugggccggcagcaagaaggagaagcacgugagauucgaggugagagacagauucgccaucuucgccggccccgaccugagaaacauggacaaccuguacaccagacuggagagcgccaagggccugaaggaguucuucacccugaccgaccugagaaugagacugcugagacccgcccugggcggcaccuacgugcagagagagaaccuguacaaguacuucuacgccaucagcaacaucgaggugaucggcagaugcaagugcaaccugcacgccaaccugugcagcaugagagagggcagccugcagugcgagugcgagcacaacaccaccggccccgacugcggcaagugcaagaagaacuucagaaccagaagcuggagagccggcagcuaccugccccugccccacggcagccccaacgccugcgccaccgccggcagcuucggcaacugcgagugcuacggccacagcaacagaugcagcuacaucgacuuccugaacguggugaccugcgugagcugcaagcacaacaccagaggccagcacugccagcacugcagacugggcuacuacagaaacggcagcgccgagcuggacgacgagaacgugugcaucgagugcaacugcaaccagaucggcagcgugcacgacagaugcaacgagaccggcuucugcgagugcagagagggcgccgccggccccaagugcgacgacugccugcccacccacuacuggagacagggcugcuaccccaacgugugcgacgacgaccagcugcugugccagaacggcggcaccugccugcagaaccagagaugcgccugccccagaggcuacaccggcgugagaugcgagcagcccagaugcgaccccgccgacgacgacggcggccuggacugcgacagagcccccggcgccgcccccagacccgccacccugcugggcugccugcugcugcugggccuggccgccagacugggcagauaa

SEQ ID NO: 20790 - RNA, 573 nt, Artificial Sequence
  NTPCR__Homo_sapiens__NP_115700
auggccagacacguguuccugaccggcccccccggcgugggcaagaccacccugauccacaaggccagcgaggugcugaagagcagcggcgugcccguggacggcuucuacaccgaggaggugagacagggcggcagaagaaucggcuucgacguggugacccugagcggcaccagaggcccccugagcagagugggccuggagcccccccccggcaagagagagugcagagugggccaguacgugguggaccugaccagcuucgagcagcuggcccugcccgugcugagaaacgccgacugcagcagcggccccggccagagagugugcgugaucgacgagaucggcaagauggagcuguucagccagcuguucauccaggccgugagacagacccugagcacccccggcaccaucauccugggcaccauccccgugcccaagggcaagccccuggcccugguggaggagaucagaaacagaaaggacgugaagguguucaacgugaccaaggagaacagaaaccaccugcugcccgacaucgugaccugcgugcagagcagcagaaaguaa

SEQ ID NO: 20791 - RNA, 2283 nt, Artificial Sequence
  NTRK1__Homo_sapiens__NP_001007793
augaaggaggccgcccugaucugccuggcccccagcgugccccccauccugaccgugaagagcugggacaccaugcagcugagagccgccagaagcagaugcaccaaccugcuggccgccagcuacaucgagaaccagcagcaccugcagcaccuggagcugagagaccugagaggccugggcgagcugagaaaccugaccaucgugaagagcggccugagauucguggcccccgacgccuuccacuucacccccagacugagcagacugaaccugagcuucaacgcccuggagagccugagcuggaagaccgugcagggccugagccugcaggagcuggugcugagcggcaacccccugcacugcagcugcgcccugagauggcugcagagaugggaggaggagggccugggcggcgugcccgagcagaagcugcagugccacggccagggcccccuggcccacaugcccaacgccagcugcggcgugcccacccugaaggugcaggugcccaacgccagcguggacgugggcgacgacgugcugcugagaugccagguggagggcagaggccuggagcaggccggcuggauccugaccgagcuggagcagagcgccaccgugaugaagagcggcggccugcccagccugggccugacccuggccaacgugaccagcgaccugaacagaaagaacgugaccugcugggccgagaacgacgugggcagagccgaggugagcgugcaggugaacgugagcuuccccgccagcgugcagcugcacaccgccguggagaugcaccacuggugcauccccuucagcguggacggccagcccgcccccagccugagauggcuguucaacggcagcgugcugaacgagaccagcuucaucuucaccgaguuccuggagcccgccgccaacgagaccgugagacacggcugccugagacugaaccagcccacccacgugaacaacggcaacuacacccugcuggccgccaaccccuucggccaggccagcgccagcaucauggccgccuucauggacaaccccuucgaguucaaccccgaggaccccauccccgacaccaacagcaccagcggcgaccccguggagaagaaggacgagacccccuucggcgugagcguggccgugggccuggccguguucgccugccuguuccugagcacccugcugcuggugcugaacaagugcggcagaagaaacaaguucggcaucaacagacccgccgugcuggcccccgaggacggccuggccaugagccugcacuucaugacccugggcggcagcagccugagccccaccgagggcaagggcagcggccugcagggccacaucaucgagaacccccaguacuucagcgacgccugcgugcaccacaucaagagaagagacaucgugcugaagugggagcugggcgagggcgccuucggcaagguguuccuggccgagugccacaaccugcugcccgagcaggacaagaugcugguggccgugaaggcccugaaggaggccagcgagagcgccagacaggacuuccagagagaggccgagcugcugaccaugcugcagcaccagcacaucgugagauucuucggcgugugcaccgagggcagaccccugcugaugguguucgaguacaugagacacggcgaccugaacagauuccugagaagccacggccccgacgccaagcugcuggccggcggcgaggacguggcccccggcccccugggccugggccagcugcuggccguggccagccagguggccgccggcaugguguaccuggccggccugcacuucgugcacagagaccuggccaccagaaacugccuggugggccagggccugguggugaagaucggcgacuucggcaugagcagagacaucuacagcaccgacuacuacagagugggcggcagaaccaugcugcccaucagauggaugccccccgagagcauccuguacagaaaguucaccaccgagagcgacguguggagcuucggcguggugcugugggagaucuucaccuacggcaagcagcccugguaccagcugagcaacaccgaggccaucgacugcaucacccagggcagagagcuggagagacccagagccugcccccccgagguguacgccaucaugagaggcugcuggcagagagagccccagcagagacacagcaucaaggacgugcacgccagacugcaggcccuggcccaggccccccccguguaccuggacgugcugggcuaa

SEQ ID NO: 20792 - RNA, 1662 nt, Artificial Sequence
  NTRK2__Homo_sapiens__NP_001018075
augagcagcuggaucagauggcacggccccgccauggccagacuguggggcuucugcuggcugguggugggcuucuggagagccgccuucgccugccccaccagcugcaagugcagcgccagcagaaucuggugcagcgaccccagccccggcaucguggccuuccccagacuggagcccaacagcguggaccccgagaacaucaccgagaucuucaucgccaaccagaagagacuggagaucaucaacgaggacgacguggaggccuacgugggccugagaaaccugaccaucguggacagcggccugaaguucguggcccacaaggccuuccugaagaacagcaaccugcagcacaucaacuucaccagaaacaagcugaccagccugagcagaaagcacuucagacaccuggaccugagcgagcugauccuggugggcaaccccuucaccugcagcugcgacaucauguggaucaagacccugcaggaggccaagagcagccccgacacccaggaccuguacugccugaacgagagcagcaagaacaucccccuggccaaccugcagauccccaacugcggccugcccagcgccaaccuggccgcccccaaccugaccguggaggagggcaagagcaucacccugagcugcagcguggccggcgaccccgugcccaacauguacugggacgugggcaaccuggugagcaagcacaugaacgagaccagccacacccagggcagccugagaaucaccaacaucagcagcgacgacagcggcaagcagaucagcugcguggccgagaaccuggugggcgaggaccaggacagcgugaaccugaccgugcacuucgcccccaccaucaccuuccuggagagccccaccagcgaccaccacuggugcauccccuucaccgugaagggcaaccccaagcccgcccugcagugguucuacaacggcgccauccugaacgagagcaaguacaucugcaccaagauccacgugaccaaccacaccgaguaccacggcugccugcagcuggacaaccccacccacaugaacaacggcgacuacacccugaucgccaagaacgaguacggcaaggacgagaagcagaucagcgcccacuucaugggcuggcccggcaucgacgacggcgccaaccccaacuaccccgacgugaucuacgaggacuacggcaccgccgccaacgacaucggcgacaccaccaacagaagcaacgagauccccagcaccgacgugaccgacaagaccggcagagagcaccugagcguguacgccgugguggugaucgccagcguggugggcuucugccugcuggugaugcuguuccugcugaagcuggccagacacagcaaguucggcaugaaggacuucagcugguucggcuucggcaaggugaagagcagacagggcgugggccccgccagcgugaucagcaacgacgacgacagcgccagcccccugcaccacaucagcaacggcagcaacacccccagcagcagcgagggcggccccgacgccgugaucaucggcaugaccaagauccccgugaucgagaacccccaguacuucggcaucaccaacagccagcugaagcccgacaccuggcccagaggcagccccaagaccgccuaa

SEQ ID NO: 20793 - RNA, 1839 nt, Artificial Sequence
  NTRK3__Homo_sapiens__NP_001007157
auggacgugagccugugccccgccaagugcagcuucuggagaaucuuccugcugggcagcguguggcuggacuacgugggcagcgugcuggccugccccgccaacugcgugugcagcaagaccgagaucaacugcagaagacccgacgacggcaaccuguucccccugcuggagggccaggacagcggcaacagcaacggcaacgccagcaucaacaucaccgacaucagcagaaacaucaccagcauccacaucgagaacuggagaagccugcacacccugaacgccguggacauggagcuguacaccggccugcagaagcugaccaucaagaacagcggccugagaagcauccagcccagagccuucgccaagaacccccaccugagauacaucaaccugagcagcaacagacugaccacccugagcuggcagcuguuccagacccugagccugagagagcugcagcuggagcagaacuucuucaacugcagcugcgacaucagauggaugcagcuguggcaggagcagggcgaggccaagcugaacagccagaaccuguacugcaucaacgccgacggcagccagcugccccuguucagaaugaacaucagccagugcgaccugcccgagaucagcgugagccacgugaaccugaccgugagagagggcgacaacgccgugaucaccugcaacggcagcggcagcccccugcccgacguggacuggaucgugaccggccugcagagcaucaacacccaccagaccaaccugaacuggaccaacgugcacgccaucaaccugacccuggugaacgugaccagcgaggacaacggcuucacccugaccugcaucgccgagaacguggugggcaugagcaacgccagcguggcccugaccguguacuacccccccagaguggugagccuggaggagcccgagcugagacuggagcacugcaucgaguucguggugagaggcaaccccccccccacccugcacuggcugcacaacggccagccccugagagagagcaagaucauccacguggaguacuaccaggagggcgagaucagcgagggcugccugcuguucaacaagcccacccacuacaacaacggcaacuacacccugaucgccaagaacccccugggcaccgccaaccagaccaucaacggccacuuccugaaggagcccuuccccgagagcaccgacaacuucauccuguucgacgaggugagccccaccccccccaucaccgugacccacaagcccgaggaggacaccuucggcgugagcaucgccgugggccuggccgccuucgccugcgugcugcugguggugcuguucgugaugaucaacaaguacggcagaagaagcaaguucggcaugaagggccccguggccgugaucagcggcgaggaggacagcgccagcccccugcaccacaucaaccacggcaucaccacccccagcagccuggacgccggccccgacaccguggugaucggcaugaccagaauccccgugaucgagaacccccaguacuucagacagggccacaacugccacaagcccgacaccuggguguucagcaacaucgacaaccacggcauccugaaccugaaggacaacagagaccaccuggugcccagcacccacuacaucuacgaggagcccgaggugcagagcggcgaggugagcuaccccagaagccacggcuucagagagaucaugcugaaccccaucagccugcccggccacagcaagccccugaaccacggcaucuacguggaggacgugaacguguacuucagcaagggcagacacggcuucuaa

SEQ ID NO: 20794 - RNA, 513 nt, Artificial Sequence
  NTS__Homo_sapiens__NP_006174
augauggccggcaugaagauccagcuggugugcaugcugcugcuggccuucagcagcuggagccugugcagcgacagcgaggaggagaugaaggcccuggaggccgacuuccugaccaacaugcacaccagcaagaucagcaaggcccacgugcccagcuggaagaugacccugcugaacgugugcagccuggugaacaaccugaacagccccgccgaggagaccggcgaggugcacgaggaggagcugguggccagaagaaagcugcccaccgcccuggacggcuucagccuggaggccaugcugaccaucuaccagcugcacaagaucugccacagcagagccuuccagcacugggagcugauccaggaggacauccuggacaccggcaacgacaagaacggcaaggaggaggugaucaagagaaagauccccuacauccugaagagacagcuguacgagaacaagcccagaagacccuacauccugaagagagacagcuacuacuacuaa

SEQ ID NO: 20795 - RNA, 1257 nt, Artificial Sequence
  NTSR1__Homo_sapiens__NP_002522
augagacugaacagcagcgcccccggcacccccggcacccccgccgccgaccccuuccagagagcccaggccggccuggaggaggcccugcuggcccccggcuucggcaacgccagcggcaacgccagcgagagagugcuggccgcccccagcagcgagcuggacgugaacaccgacaucuacagcaaggugcuggugaccgccguguaccuggcccuguucguggugggcaccgugggcaacaccgugaccgccuucacccuggccagaaagaagagccugcagagccugcagagcaccgugcacuaccaccugggcagccuggcccugagcgaccugcugacccugcugcuggccaugcccguggagcuguacaacuucaucugggugcaccaccccugggccuucggcgacgccggcugcagaggcuacuacuuccugagagacgccugcaccuacgccaccgcccugaacguggccagccugagcguggagagauaccuggccaucugccaccccuucaaggccaagacccugaugagcagaagcagaaccaagaaguucaucagcgccaucuggcuggccagcgcccugcuggccgugcccaugcuguucaccaugggcgagcagaacagaagcgccgacggccagcacgccggcggccuggugugcacccccaccauccacaccgccaccgugaagguggugauccaggugaacaccuucaugagcuucaucuuccccaugguggugaucagcgugcugaacaccaucaucgccaacaagcugaccgugauggugagacaggccgccgagcagggccaggugugcaccgugggcggcgagcacagcaccuucagcauggccaucgagcccggcagagugcaggcccugagacacggcgugagagugcugagagccguggugaucgccuucguggugugcuggcugcccuaccacgugagaagacugauguucugcuacaucagcgacgagcaguggacccccuuccuguacgacuucuaccacuacuucuacauggugaccaacgcccuguucuacgugagcagcaccaucaaccccauccuguacaaccuggugagcgccaacuucagacacaucuuccuggccacccuggccugccugugccccguguggagaagaagaagaaagagacccgccuucagcagaaaggccgacagcgugagcagcaaccacacccugagcagcaacgccaccagagagacccuguacuaa

SEQ ID NO: 20796 - RNA, 1233 nt, Artificial Sequence
  NTSR2__Homo_sapiens__NP_036476
auggagaccagcagccccagaccccccagacccagcagcaaccccggccugagccuggacgccagacugggcguggacaccagacugugggccaaggugcuguucaccgcccuguacgcccugaucugggcccugggcgccgccggcaacgcccugagcgugcacguggugcugaaggccagagccggcagagccggcagacugagacaccacgugcugagccuggcccuggccggccugcugcugcugcuggugggcgugcccguggagcuguacagcuucgugugguuccacuaccccuggguguucggcgaccugggcugcagaggcuacuacuucgugcacgagcugugcgccuacgccaccgugcugagcguggccggccugagcgccgagagaugccuggccgugugccagccccugagagccagaagccugcugacccccagaagaaccagauggcugguggcccugagcugggccgccagccugggccuggcccugcccauggccgugaucaugggccagaagcacgagcuggagaccgccgacggcgagcccgagcccgccagcagagugugcaccgugcuggugagcagaaccgcccugcagguguucauccaggugaacgugcuggugagcuucgugcugccccuggcccugaccgccuuccugaacggcgugaccgugagccaccugcuggcccugugcagccaggugcccagcaccagcacccccggcagcagcacccccagcagacuggagcugcugagcgaggagggccugcugagcuucaucguguggaagaagaccuucauccagggcggccaggugagccuggugagacacaaggacgugagaagaaucagaagccugcagagaagcgugcaggugcugagagccaucguggugauguacgugaucugcuggcugcccuaccacgccagaagacugauguacugcuacgugcccgacgacgccuggaccgacccccuguacaacuucuaccacuacuucuacauggugaccaacacccuguucuacgugagcagcgccgugaccccccugcuguacaacgccgugagcagcagcuucagaaagcuguuccuggaggccgugagcagccugugcggcgagcaccaccccaugaagagacugccccccaagccccagagccccacccugauggacaccgccagcggcuucggcgacccccccgagaccagaaccuaa

SEQ ID NO: 20797 - RNA, 1986 nt, Artificial Sequence
  NUAK1__Homo_sapiens__NP_055655
auggagggcgccgccgcccccguggccggcgacagacccgaccugggccugggcgcccccggcagccccagagaggccguggccggcgccaccgccgcccuggagcccagaaagccccacggcgugaagagacaccaccacaagcacaaccugaagcacagauacgagcugcaggagacccugggcaagggcaccuacggcaaggugaagagagccaccgagagauucagcggcagagugguggccaucaagagcaucagaaaggacaagaucaaggacgagcaggacauggugcacaucagaagagagaucgagaucaugagcagccugaaccacccccacaucaucagcaucuacgagguguucgagaacaaggacaagaucgugaucaucauggaguacgccagcaagggcgagcuguacgacuacaucagcgagagaagaagacugagcgagagagagaccagacacuucuucagacagaucgugagcgccgugcacuacugccacaagaacggcguggugcacagagaccugaagcuggagaacauccugcuggacgacaacugcaacaucaagaucgccgacuucggccugagcaaccuguaccagaaggacaaguuccugcagaccuucugcggcagcccccuguacgccagccccgagaucgugaacggcagacccuacagaggccccgagguggacagcugggcccugggcgugcugcuguacacccugguguacggcaccaugcccuucgacggcuucgaccacaagaaccugaucagacagaucagcagcggcgaguacagagagcccacccagcccagcgacgccagaggccugaucagauggaugcugauggugaaccccgacagaagagccaccaucgaggacaucgccaaccacuggugggugaacuggggcuacaagagcagcgugugcgacugcgacgcccugcacgacagcgagagcccccugcuggccagaaucaucgacuggcaccacagaagcaccggccugcaggccgacaccgaggccaagaugaagggccuggccaagcccaccaccagcgaggugaugcuggagagacagagaagccugaagaagagcaagaaggagaacgacuucgcccagagcggccaggacgccgugcccgagagccccagcaagcugagcagcaagagacccaagggcauccugaagaagagaagcaacagcgagcacagaagccacagcaccggcuucaucgagggcguggugggccccgcccugcccagcaccuucaagauggagcaggaccugugcagaaccggcgugcugcugcccagcagccccgaggccgaggugcccggcaagcugagccccaagcagagcgccaccaugcccaagaagggcauccugaagaagacccagcagagagagagcggcuacuacagcagccccgagagaagcgagagcagcgagcugcuggacagcaacgacgugaugggcagcagcauccccagccccagcccccccgaccccgccagagugaccagccacagccugagcugcagaagaaagggcauccugaagcacagcagcaaguacagcgccggcaccauggaccccgcccuggugagccccgagaugcccacccuggagagccugagcgagcccggcgugcccgccgagggccugagcagaagcuacagcagacccagcagcgugaucagcgacgacagcgugcugagcagcgacagcuucgaccugcuggaccugcaggagaacagacccgccagacagagaaucagaagcugcgugagcgccgagaacuuccugcagauccaggacuucgagggccugcagaacagacccagaccccaguaccugaagagauacagaaacagacuggccgacagcagcuucagccugcugaccgacauggacgacgugacccagguguacaagcaggcccuggagaucugcagcaagcugaacuaa

SEQ ID NO: 20798 - RNA, 2019 nt, Artificial Sequence
  NUAK2__Homo_sapiens__NP_112214
augcugugcuucaccgccagaagcggcaccgccguggcccccagacccggcgccggccccgugcccagagccagcgcccugcccgcccagcccaccgacagccccgccgcccuggcccaccugcugcuggccauggagagccugguguucgccagaagaagcggccccacccccagcgccgccgagcuggccagaccccuggccgagggccugaucaagagccccaagccccugaugaagaagcaggccgugaagagacaccaccacaagcacaaccugagacacagauacgaguuccuggagacccugggcaagggcaccuacggcaaggugaagaaggccagagagagcagcggcagacugguggccaucaagagcaucagaaaggacaagaucaaggacgagcaggaccugaugcacaucagaagagagaucgagaucaugagcagccugaaccacccccacaucaucgccauccacgagguguucgagaacagcagcaagaucgugaucgugauggaguacgccagcagaggcgaccuguacgacuacaucagcgagagacagcagcugagcgagagagaggccagacacuucuucagacagaucgugagcgccgugcacuacugccaccagaacagaguggugcacagagaccugaagcuggagaacauccugcuggacgccaacggcaacaucaagaucgccgacuucggccugagcaaccuguaccaccagggcaaguuccugcagaccuucugcggcagcccccuguacgccagccccgagaucgugaacggcaagcccuacaccggccccgagguggacagcuggagccugggcgugcugcuguacauccuggugcacggcaccaugcccuucgacggccacgaccacaagauccuggugaagcagaucagcaacggcgccuacagagagccccccaagcccagcgacgccugcggccugaucagauggcugcugauggugaaccccaccagaagagccacccuggaggacguggccagccacuggugggugaacuggggcuacgccaccagagugggcgagcaggaggccccccacgagggcggccaccccggcagcgacagcgccagagccagcauggccgacuggcugagaagaagcagcagaccccugcuggagaacggcgccaaggugugcagcuucuucaagcagcacgcccccggcggcggcagcaccacccccggccuggagagacagcacagccugaagaagagcagaaaggagaacgacauggcccagagccugcacagcgacaccgccgacgacaccgcccacagacccggcaagagcaaccugaagcugcccaagggcauccugaagaagaaggugagcgccagcgccgagggcgugcaggaggacccccccgagcugagccccauccccgccagccccggccaggccgccccccugcugcccaagaagggcauccugaagaagcccagacagagagagagcggcuacuacagcagccccgagcccagcgagagcggcgagcugcuggacgccggcgacguguucgugagcggcgaccccaaggagcagaagcccccccaggccagcggccugcugcugcacagaaagggcauccugaagcugaacggcaaguucagccagaccgcccuggagcuggccgcccccaccaccuucggcagccuggacgagcuggccccccccagaccccuggccagagccagcagacccagcggcgccgugagcgaggacagcauccugagcagcgagagcuucgaccagcuggaccugcccgagagacugcccgagcccccccugagaggcugcgugagcguggacaaccugaccggccuggaggagccccccagcgagggccccggcagcugccugagaagauggagacaggacccccugggcgacagcugcuucagccugaccgacugccaggaggugaccgccaccuacagacaggcccugagagugugcagcaagcugaccuaa

SEQ ID NO: 20799 - RNA, 1920 nt, Artificial Sequence
  NUB1__Homo_sapiens__NP_001230280
augaagaccaacggcggcagaugcagaaucagagcccugugcuggagcagaagagaguggagaggcgccggcauggcccagaagaaguaccugcaggccaagcugacccaguuccugagagaggacagaauccagcuguggaagccccccuacaccgacgagaacaagaaggugggccuggcccugaaggaccuggccaagcaguacagcgacagacuggagugcugcgagaacgagguggagaaggugaucgaggagaucagaugcaaggccaucgagagaggcaccggcaacgacaacuacagaaccaccggcaucgccaccaucgagguguuccugccccccagacugaagaaggacagaaagaaccugcuggagaccagacugcacaucaccggcagagagcugagaagcaagaucgccgagaccuucggccugcaggagaacuacaucaagaucgugaucaacaagaagcagcugcagcugggcaagacccuggaggagcagggcguggcccacaacgugaaggccauggugcuggagcugaagcagagcgaggaggacgccagaaagaacuuccagcuggaggaggaggagcagaacgaggccaagcugaaggagaagcagauccagagaaccaagagaggccuggagauccuggccaagagagccgccgagaccgugguggaccccgagaugacccccuaccuggacaucgccaaccagaccggcagaagcaucagaaucccccccagcgagagaaaggcccugaugcuggccaugggcuaccacgagaagggcagagccuuccugaagagaaaggaguacggcaucgcccugcccugccugcuggacgccgacaaguacuucugcgagugcugcagagagcugcuggacaccguggacaacuacgccgugcugcagcuggacaucguguggugcuacuucagacuggagcagcuggagugccuggacgacgccgagaagaagcugaaccuggcccagaagugcuucaagaacugcuacggcgagaaccaccagagacuggugcacaucaagggcaacugcggcaaggagaaggugcuguuccugagacuguaccugcugcagggcaucagaaacuaccacagcggcaacgacguggaggccuacgaguaccugaacaaggccagacagcuguucaaggagcuguacaucgaccccagcaagguggacaaccugcugcagcugggcuucaccgcccaggaggccagacugggccugagagccugcgacggcaacguggaccacgccgccacccacaucaccaacagaagagaggagcuggcccagaucagaaaggaggagaaggagaagaagagaagaagacuggagaacaucagauuccugaagggcaugggcuacagcacccacgccgcccagcaggugcugcacgccgccagcggcaaccuggacgaggcccugaagauccugcugagcaacccccagaugugguggcugaacgacagcaaccccgagaccgacaacagacaggagagccccagccaggagaacaucgacagacugguguacaugggcuucgacgcccugguggccgaggccgcccugagaguguucagaggcaacgugcagcuggccgcccagacccuggcccacaacggcggcagccugccccccgagcugccccugagccccgaggacagccugagcccccccgccaccagccccagcgacagcgccggcaccagcagcgccagcaccgacgaggacauggagaccgaggccgugaacgagauccuggaggacauccccgagcacgaggaggacuaccuggacagcacccuggaggacgaggagaucaucaucgccgaguaccugagcuacguggagaacagaaagagcgccaccaagaagaacuaa

SEQ ID NO: 20800 - RNA, 930 nt, Artificial Sequence
  NUBP1__Homo_sapiens__NP_001265435
auggaggaggugccccacgacugccccggcgccgacagcgcccaggccggcagaggcgccagcugccagggcugccccaaccagagacugugcgccagcggcgccggcgccacccccgacaccgccaucgaggagaucaaggagaagaugaagaccgugaagcacaagauccuggugcugagcggcaagggcggcgugggcaagagcaccuucagcgcccaccuggcccacggccuggccgaggacgagaacacccagaucgcccugcuggacaucgacaucugcggccccagcauccccaagaucaugggccuggagggcgagcaguacguggaggacaaccugggcgugaugagcgugggcuuccugcugagcagccccgacgacgccgugaucuggagaggccccaagaagaacggcaugaucaagcaguuccugagagacguggacuggggcgagguggacuaccugaucguggacaccccccccggcaccagcgacgagcaccugagcguggugagauaccuggccaccgcccacaucgacggcgccgugaucaucaccaccccccaggaggugagccugcaggacgugagaaaggagaucaacuucugcagaaaggugaagcugcccaucaucggcgugguggagaacaugagcggcuucaucugccccaagugcaagaaggagagccagaucuucccccccaccaccggcggcgccgagcugaugugccaggaccuggaggugccccugcugggcagagugccccuggacccccugaucggcaagaacugcgacaagggccagagcuucuucaucgacgcccccgacagccccgccacccuggccuacagaagcaucauccagagaauccaggaguucugcaaccugcaccagagcaaggaggagaaccugaucagcagcuaa

SEQ ID NO: 20801 - RNA, 816 nt, Artificial Sequence
  NUBP2__Homo_sapiens__NP_036357
auggaggccgccgccgagcccggcaaccuggccggcgugagacacaucauccuggugcugagcggcaagggcggcgugggcaagagcaccaucagcaccgagcuggcccuggcccugagacacgccggcaagaaggugggcauccuggacguggaccugugcggccccagcauccccagaaugcugggcgcccagggcagagccgugcaccagugcgacagaggcugggcccccguguuccuggacagagagcagagcaucagccugaugagcgugggcuuccugcuggagaagcccgacgaggccgugguguggagaggccccaagaagaacgcccugaucaagcaguucgugagcgacguggccuggggcgagcuggacuaccuggugguggacaccccccccggcaccagcgacgagcacauggccaccaucgaggcccugagacccuaccagccccugggcgcccugguggugaccaccccccaggccgugagcgugggcgacgugagaagagagcugaccuucugcagaaagaccggccugagagugaugggcaucguggagaacaugagcggcuucaccugcccccacugcaccgagugcaccagcguguucagcagaggcggcggcgaggagcuggcccagcuggccggcgugcccuuccugggcagcgugccccuggaccccgcccugaugagaacccuggaggagggccacgacuucauccaggaguuccccggcagccccgccuucgccgcccugaccagcaucgcccagaagauccuggacgccacccccgccugccugcccuaa

SEQ ID NO: 20802 - RNA, 672 nt, Artificial Sequence
  NUBPL__Homo_sapiens__NP_001188502
augagcaaggccaucggccugcuggacguggacguguacggccccagcgugcccaagaugaugaaccugaagggcaaccccgagcugagccagagcaaccugaugagaccccugcugaacuacggcaucgccugcaugagcaugggcuuccugguggaggagagcgagcccgugguguggagaggccugauggugaugagcgccaucgagaagcugcugagacagguggacuggggccagcuggacuaccuggugguggacaugccccccggcaccggcgacgugcagcugagcgugagccagaacauccccaucaccggcgccgugaucgugagcaccccccaggacaucgcccugauggacgcccacaagggcgccgagauguucagaagagugcacgugcccgugcugggccuggugcagaacaugagcguguuccagugccccaagugcaagcacaagacccacaucuucggcgccgacggcgccagaaagcuggcccagacccugggccuggaggugcugggcgacaucccccugcaccugaacaucagagaggccagcgacaccggccagcccaucguguucagccagcccgagagcgacgaggccaaggccuaccugagaaucgccguggagguggugagaagacugcccagccccagcgaguaa

SEQ ID NO: 20803 - RNA, 1386 nt, Artificial Sequence
  NUCB1__Homo_sapiens__NP_006175
augccccccagcggccccagaggcacccugcugcugcugccccugcugcugcugcugcugcugagagccgugcuggccgugccccuggagagaggcgcccccaacaaggaggagacccccgccaccgagagccccgacaccggccuguacuaccacagauaccugcaggaggugaucgacgugcuggagaccgacggccacuucagagagaagcugcaggccgccaacgccgaggacaucaagagcggcaagcugagcagagagcuggacuucgugagccaccacgugagaaccaagcuggacgagcugaagagacaggaggugagcagacugagaaugcugcugaaggccaagauggacgccgagcaggaccccaacgugcagguggaccaccugaaccugcugaagcaguucgagcaccuggacccccagaaccagcacaccuucgaggccagagaccuggagcugcugauccagaccgccaccagagaccuggcccaguacgacgccgcccaccacgaggaguucaagagauacgagaugcugaaggagcacgagagaagaagauaccuggagagccugggcgaggagcagagaaaggaggccgagagaaagcuggaggagcagcagagaagacacagagagcaccccaaggugaacgugcccggcagccaggcccagcugaaggaggugugggaggagcuggacggccuggaccccaacagauucaaccccaagaccuucuucauccugcacgacaucaacagcgacggcgugcuggacgagcaggagcuggaggcccuguucaccaaggagcuggagaagguguacgaccccaagaacgaggaggacgacaugagagagauggaggaggagagacugagaaugagagagcacgugaugaagaacguggacaccaaccaggacagacuggugacccuggaggaguuccuggccagcacccagagaaaggaguucggcgacaccggcgagggcugggagaccguggagaugcaccccgccuacaccgaggaggagcugagaagauucgaggaggagcuggccgccagagaggccgagcugaacgccaaggcccagagacugagccaggagaccgaggcccugggcagaagccagggcagacuggaggcccagaagagagagcugcagcaggccgugcugcacauggagcagagaaagcagcagcagcagcagcagcagggccacaaggcccccgccgcccaccccgagggccagcugaaguuccaccccgacaccgacgacgugcccgugcccgcccccgccggcgaccagaaggagguggacaccagcgagaagaagcugcuggagagacugcccgagguggaggugccccagcaccuguaa

SEQ ID NO: 20804 - RNA, 1263 nt, Artificial Sequence
  NUCB2__Homo_sapiens__NP_005004
augagauggagaaccauccugcugcaguacugcuuccugcugaucaccugccugcugaccgcccuggaggccgugcccaucgacaucgacaagaccaaggugcagaacauccaccccguggagagcgccaagaucgagccccccgacaccggccuguacuacgacgaguaccugaagcaggugaucgacgugcuggagaccgacaagcacuucagagagaagcugcagaaggccgacaucgaggagaucaagagcggcagacugagcaaggagcuggaccuggugagccaccacgugagaaccaagcuggacgagcugaagagacaggaggugggcagacugagaaugcugaucaaggccaagcuggacagccugcaggacaucggcauggaccaccaggcccugcugaagcaguucgaccaccugaaccaccugaaccccgacaaguucgagagcaccgaccuggacaugcugaucaaggccgccaccagcgaccuggagcacuacgacaagaccagacacgaggaguucaagaaguacgagaugaugaaggagcacgagagaagagaguaccugaagacccugaacgaggagaagagaaaggaggaggagagcaaguucgaggagaugaagaagaagcacgagaaccaccccaaggugaaccaccccggcagcaaggaccagcugaaggaggugugggaggagaccgacggccuggaccccaacgacuucgaccccaagaccuucuucaagcugcacgacgugaacagcgacggcuuccuggacgagcaggagcuggaggcccuguucaccaaggagcuggagaagguguacgaccccaagaacgaggaggacgacaugguggagauggaggaggagagacugagaaugagagagcacgugaugaacgagguggacaccaacaaggacagacuggugacccuggaggaguuccugaaggccaccgagaagaaggaguuccuggagcccgacagcugggagacccuggaccagcagcaguucuucaccgaggaggagcugaaggaguacgagaacaucaucgcccugcaggagaacgagcugaagaagaaggccgacgagcugcagaagcagaaggaggagcugcagagacagcacgaccagcuggaggcccagaagcuggaguaccaccaggugauccagcagauggagcagaagaagcugcagcagggcaucccccccagcggccccgccggcgagcugaaguucgagccccacaucuaa

SEQ ID NO: 20805 - RNA, 732 nt, Artificial Sequence
  NUCKS1__Homo_sapiens__NP_073568
augagcagacccgugagaaacagaaaggugguggacuacagccaguuccaggagagcgacgacgccgacgaggacuacggcagagacagcggcccccccaccaagaagaucagaagcagccccagagaggccaagaacaagagaagaagcggcaagaacagccaggaggacagcgaggacagcgaggacaaggacgugaagaccaagaaggacgacagccacagcgccgaggacagcgaggacgagaaggaggaccacaagaacgugagacagcagagacaggccgccagcaaggccgccagcaagcagagagagaugcugauggaggacgugggcagcgaggaggagcaggaggaggaggacgaggcccccuuccaggagaaggacagcggcagcgacgaggacuuccugauggaggacgacgacgacagcgacuacggcagcagcaagaagaagaacaagaagauggugaagaagagcaagcccgagagaaaggagaagaagaugcccaagcccagacugaaggccaccgugacccccagccccgugaagggcaagggcaaggugggcagacccaccgccagcaaggccagcaaggagaagacccccagccccaaggaggaggacgaggagcccgagagcccccccgagaagaagaccagcaccagccccccccccgagaagagcggcgacgagggcagcgaggacgaggcccccagcggcgaggacuaa

SEQ ID NO: 20806 - RNA, 1665 nt, Artificial Sequence
  NUDCD1__Homo_sapiens__NP_001121683
augcuguaccugcagggcuggagcaugcccgccguggccgaggugaagcugagagacgaccaguacacccuggagcacaugcacgccuucggcauguacaacuaccugcacugcgacagcugguaccaggacagcguguacuacaucgacacccugggcagaaucaugaaccugaccgugaugcuggacaccgcccugggcaagcccagagagguguucagacugcccaccgaccugaccgccugcgacaacagacugugcgccagcauccacuucagcagcagcaccugggugacccugagcgacggcaccggcagacuguacgugaucggcaccggcgagagaggcaacagcgccagcgagaagugggagaucauguucaacgaggagcugggcgaccccuucaucaucauccacagcaucagccugcugaacgccgaggagcacagcaucgccacccugcugcugagaaucgagaaggaggagcuggacaugaagggcagcggcuucuacgugagccuggagugggugaccaucagcaagaagaaccaggacaacaagaaguacgagaucaucaagagagacauccugagaggcaagagcgugccccacuacgccgccaucgagcccgacggcaacggccugaugaucgugagcuacaagagccugaccuucgugcaggccggccaggaccuggaggagaacauggacgaggacaucagcgagaagaucaaggagccccuguacuacuggcagcagaccgaggacgaccugaccgugaccaucagacugcccgaggacagcaccaaggaggacauccagauccaguuccugcccgaccacaucaacaucgugcugaaggaccaccaguuccuggagggcaagcuguacagcagcaucgaccacgagagcagcaccuggaucaucaaggagagcaacagccuggagaucagccugaucaagaagaacgagggccugaccuggcccgagcuggugaucggcgacaagcagggcgagcugaucagagacagcgcccagugcgccgccaucgccgagagacugaugcaccugaccagcgaggagcugaaccccaaccccgacaaggagaagccccccugcaacgcccaggagcuggaggagugcgacaucuucuucgaggagagcagcagccugugcagauucgacggcaacacccugaagaccacccacguggugaaccugggcagcaaccaguaccuguucagcgugaucguggaccccaaggagaugcccugcuucugccugagacacgacguggacgcccugcuguggcagccccacagcagcaagcaggacgacaugugggagcacaucgccaccuucaacgcccugggcuacgugcaggccagcaagagagacaagaaguucuucgccugcgcccccaacuacagcuacgccgcccugugcgagugccugagaagaguguucaucuacagacagcccgcccccaugagcaccgugcuguacaacagaaaggagggcagacaggugggccagguggccaagcagcagguggccagccuggagaccaacgaccccauccugggcuuccaggccaccaacgagagacuguucgugcugaccaccaagaaccuguuccugaucaaggugaacaccgagaacuaa

SEQ ID NO: 20807 - RNA, 1086 nt, Artificial Sequence
  NUDCD3__Homo_sapiens__NP_056147
auggagaccggcgccgccgagcuguacgaccaggcccugcugggcauccugcagcacgugggcaacgugcaggacuuccugagagugcuguucggcuuccuguacagaaagaccgacuucuacagacugcugagacaccccagcgacagaaugggcuucccccccggcgccgcccaggcccuggugcugcagguguucaagaccuucgaccacauggccagacaggacgacgagaagagaagacaggagcuggaggagaagaucagaagaaaggaggaggaggaggccaagaccgugagcgccgccgccgccgagaaggagcccgugcccgugcccgugcaggagaucgagaucgacagcaccaccgagcuggacggccaccaggagguggagaaggugcagccccccggccccgugaaggagauggcccacggcagccaggaggccgaggcccccggcgccguggccggcgccgccgaggugcccagagagccccccauccugcccagaauccaggagcaguuccagaagaaccccgacagcuacaacggcgccgugagagagaacuacaccuggagccaggacuacaccgaccuggaggugagagugcccgugcccaagcacguggugaagggcaagcaggugagcguggcccugagcagcagcagcaucagaguggccaugcuggaggagaacggcgagagagugcugauggagggcaagcugacccacaagaucaacaccgagagcagccuguggagccuggagcccggcaagugcgugcuggugaaccugagcaaggugggcgaguacugguggaacgccauccuggagggcgaggagcccaucgacaucgacaagaucaacaaggagagaagcauggccaccguggacgaggaggagcaggccgugcuggacagacugaccuucgacuaccaccagaagcugcagggcaagccccagagccacgagcugaaggugcacgagaugcugaagaagggcugggacgccgagggcagccccuucagaggccagagauucgaccccgccauguucaacaucagccccggcgccgugcaguucuaa

SEQ ID NO: 20808 - RNA, 1008 nt, Artificial Sequence
  NUDC__Homo_sapiens__XP_011538831
augaucagcaacuacagaaacggcagcgagcuggugugcuucaacagcggcgugggcugcuuccugaucggcugcgacugggccuucaccgugcuggugaacaccuucuucagcuuccugagaagaaagaccgacuucuucaucggcggcgaggagggcauggccgagaagcugaucacccagaccuucagccaccacaaccagcuggcccagaagaccagaagagagaagagagccagacaggaggccgagagaagagagaaggccgagagagccgccagacuggccaaggaggccaagagcgagaccagcggcccccagaucaaggagcugaccgacgaggaggccgagagacugcagcuggagaucgaccagaagaaggacgccgagaaccacgaggcccagcugaagaacggcagccuggacagccccggcaagcaggacaccgaggaggacgaggaggaggacgagaaggacaagggcaagcugaagcccaaccugggcaacggcgccgaccugcccaacuacagauggacccagacccugagcgagcuggaccuggccgugcccuucugcgugaacuucagacugaagggcaaggacauggugguggacauccagagaagacaccugagagugggccugaagggccagcccgccaucaucgacggcgagcuguacaacgaggugaagguggaggagagcagcuggcugaucgaggacggcaagguggugaccgugcaccuggagaagaucaacaagauggagugguggagcagacuggugagcagcgaccccgagaucaacaccaagaagaucaaccccgagaacagcaagcugagcgaccuggacagcgagaccagaagcaugguggagaagaugauguacgaccagagacagaagagcaugggccugcccaccagcgacgagcagaagaagcaggagauccugaagaaguucauggaccagcaccccgagauggacuucagcaaggccaaguucaacuaa

SEQ ID NO: 20809 - RNA, 495 nt, Artificial Sequence
  NUDT10__Homo_sapiens__NP_001291892
augaagugcaagcccaaccagaccagaaccuacgaccccgagggcuucaagaagagagccgccugccugugcuucagaagcgagagagaggacgaggugcugcuggugagcagcagcagauaccccgacagauggaucgugcccggcggcggcauggagcccgaggaggagcccggcggcgccgccgugagagagguguacgaggaggccggcgugaagggcaagcugggcagacugcugggcguguucgagcagaaccaggaccccaagcacagaaccuacguguacgugcugaccgugaccgagcugcuggaggacugggaggacagcgugagcaucggcagaaagagagagugguucaagguggaggacgccaucaaggugcugcagugccacaagcccgugcacgccgaguaccuggagaagcugaagcugggcggcagccccaccaacggcaacagcauggcccccagcagccccgacagcgaccccuaa

SEQ ID NO: 20810 - RNA, 495 nt, Artificial Sequence
  NUDT11__Homo_sapiens__NP_060629
augaagugcaagcccaaccagaccagaaccuacgaccccgagggcuucaagaagagagccgccugccugugcuucagaagcgagagagaggacgaggugcugcuggugagcagcagcagauaccccgacagauggaucgugcccggcggcggcauggagcccgaggaggagcccggcggcgccgccgugagagagguguacgaggaggccggcgugaagggcaagcugggcagacugcugggcguguucgagcagaaccaggacagaaagcacagaaccuacguguacgugcugaccgugaccgagcugcuggaggacugggaggacagcgugagcaucggcagaaagagagagugguucaagguggaggacgccaucaaggugcugcagugccacaagcccgugcacgccgaguaccuggagaagcugaagcugggcggcagccccaccaacggcaacagcauggcccccagcagccccgacagcgaccccuaa

SEQ ID NO: 20811 - RNA, 495 nt, Artificial Sequence
  NUDT15__Homo_sapiens__NP_060753
augaccgccagcgcccagcccagaggcagaagacccggcgugggcgugggcgugguggugaccagcugcaagcaccccagaugcgugcugcugggcaagagaaagggcagcgugggcgccggcagcuuccagcugcccggcggccaccuggaguucggcgagaccugggaggagugcgcccagagagagaccugggaggaggccgcccugcaccugaagaacgugcacuucgccagcguggugaacagcuucaucgagaaggagaacuaccacuacgugaccauccugaugaagggcgagguggacgugacccacgacagcgagcccaagaacguggagcccgagaagaacgagagcugggagugggugcccugggaggagcugcccccccuggaccagcuguucuggggccugagaugccugaaggagcagggcuacgaccccuucaaggaggaccugaaccaccuggugggcuacaagggcaaccaccuguaa

SEQ ID NO: 20812 - RNA, 1128 nt, Artificial Sequence
  NUDT19__Homo_sapiens__NP_001099040
augagcagcagccugagacccggccccagcagauggagaagagccgccagcaucgugcuggccgccggcuggagcagacccgagaccgccaccccccccagcagacccccccccgccgagggcuucagacugcugcugcugcagagaagcccccaccagggcuucaugcccggcgcccacguguucagcggcggcgugcuggacgccgccgacagaagcgccgacuggcugggccuguucgccccccaccacggcccccccagauucggccugggccccgcccccuucagcagaaccgccuuccccagccugcccgacaccgacgaccacaagaccgacaacaccggcacccugcccgaggacguggccuucagaaucugcgccgugagagaggccuucgaggaggccggcgugcugcugcugagacccagaaccagcccccccggccccgcccccggccccggccuggcccuggagcccccccccggccuggccagcuggagagacagagugagacaggaccccagacacuuccugagacugugcgcccaccuggacugcacccccgacaucugggcccugcacaacuggagcgccuggcugacccccuuccugagaggcaccaccagaagauucgacaccgccuucuuccugugcugccugagagagcccccccccguguaccccgaccuggccgagguggugggcuaccaguggagcagccccagcgaggccaccgagagcuuccugagcaaggagaucuggcugccccccccccaguucuacgaggugagaagacuggccaacuucgccagccugagcgaccugcacaaguucugccugggcagagcccuggagggccuggagagauggcugcccaucauccugcugaccgccgacggcauggugcaccugcugcccggcgacgagcuguaccuggaggacagcgacuuccuggagaaccugaugagcaccgagaagaagaccgaggagaucaugaaggagggcaagcaguuccacagaaucgugaccuaccacagacaccuguacgacauccacgugaccgugcagcccaaguacaagcacguguaccccaagaacagcguggugagaaagagccaccuguaa

SEQ ID NO: 20813 - RNA, 471 nt, Artificial Sequence
  NUDT1__Homo_sapiens__NP_945191
augggcgccagcagacuguacacccuggugcuggugcugcagccccagagagugcugcugggcaugaagaagagaggcuucggcgccggcagauggaacggcuucggcggcaaggugcaggagggcgagaccaucgaggacggcgccagaagagagcugcaggaggagagcggccugaccguggacgcccugcacaaggugggccagaucguguucgaguucgugggcgagcccgagcugauggacgugcacguguucugcaccgacagcauccagggcacccccguggagagcgacgagaugagacccugcugguuccagcuggaccagauccccuucaaggacauguggcccgacgacagcuacugguucccccugcugcugcagaagaagaaguuccacggcuacuucaaguuccagggccaggacaccauccuggacuacacccugagagagguggacaccguguaa

SEQ ID NO: 20814 - RNA, 684 nt, Artificial Sequence
  NUDT21__Homo_sapiens__NP_008937
augagcguggugccccccaacagaagccagaccggcuggcccagaggcgugacccaguucggcaacaaguacauccagcagaccaagccccugacccuggagagaaccaucaaccuguacccccugaccaacuacaccuucggcaccaaggagccccuguacgagaaggacagcagcguggccgccagauuccagagaaugagagaggaguucgacaagaucggcaugagaagaaccguggagggcgugcugaucgugcacgagcacagacugccccacgugcugcugcugcagcugggcaccaccuucuucaagcugcccggcggcgagcugaaccccggcgaggacgagguggagggccugaagagacugaugaccgagauccugggcagacaggacggcgugcugcaggacugggugaucgacgacugcaucggcaacugguggagacccaacuucgagcccccccaguaccccuacauccccgcccacaucaccaagcccaaggagcacaagaagcuguuccuggugcagcugcaggagaaggcccuguucgccgugcccaagaacuacaagcugguggccgccccccuguucgagcuguacgacaacgcccccggcuacggccccaucaucagcagccugccccagcugcugagcagauucaacuucaucuacaacuaa

SEQ ID NO: 20815 - RNA, 444 nt, Artificial Sequence
  NUDT2__Homo_sapiens__NP_671702
auggcccugagagccugcggccugaucaucuucagaagaugccugauccccaagguggacaacaacgccaucgaguuccugcugcugcaggccagcgacggcauccaccacuggaccccccccaagggccacguggagcccggcgaggacgaccuggagaccgcccugagagagacccaggaggaggccggcaucgaggccggccagcugaccaucaucgagggcuucaagagagagcugaacuacguggccagaaacaagcccaagaccgugaucuacuggcuggccgaggugaaggacuacgacguggagaucagacugagccacgagcaccaggccuacagauggcugggccuggaggaggccugccagcuggcccaguucaaggagaugaaggccgcccugcaggagggccaccaguuccugugcagcaucgaggccuaa

SEQ ID NO: 20816 - RNA, 519 nt, Artificial Sequence
  NUDT3__Homo_sapiens__NP_006694
augaugaagcugaagagcaaccagaccagaaccuacgacggcgacggcuacaagaagagagccgccugccugugcuucagaagcgagagcgaggaggaggugcugcuggugagcagcagcagacaccccgacagauggaucgugcccggcggcggcauggagcccgaggaggagcccagcguggccgccgugagagaggugugcgaggaggccggcgugaagggcacccugggcagacuggugggcaucuucgagaaccaggagagaaagcacagaaccuacguguacgugcugaucgugaccgaggugcuggaggacugggaggacagcgugaacaucggcagaaagagagagugguucaagaucgaggacgccaucaaggugcugcaguaccacaagcccgugcaggccagcuacuucgagacccugagacagggcuacagcgccaacaacggcacccccgugguggccaccaccuacagcgugagcgcccagagcagcaugagcggcaucagauaa

SEQ ID NO: 20817 - RNA, 951 nt, Artificial Sequence
  NUDT6__Homo_sapiens__NP_009014
augagacagccccugagcuggggcagauggagagccaugcuggccagaaccuacggccccggccccagcgccggcuacagaugggccagcggcgcccagggcuacgugagaaacccccccgugggcgccugcgaccugcagggcgagcuggacagauucggcggcaucagcgugagacuggccagacuggacgcccuggacagacuggacgccgccgccuuccagaagggccugcaggccgccgugcagcaguggagaagcgagggcagaaccgccguguggcugcacauccccauccugcagagcagauucaucgcccccgccgccagccugggcuucugcuuccaccacgccgagagcgacagcagcacccugacccuguggcugagagagggccccagcagacugcccggcuacgccagccaccaggugggcguggccggcgccguguucgacgagagcaccagaaagauccugguggugcaggacagaaacaagcugaagaacauguggaaguuccccggcggccugagcgagcccgaggaggacaucggcgacaccgccgugagagagguguucgaggagaccggcaucaagagcgaguucagaagcgugcugagcaucagacagcagcacaccaaccccggcgccuucggcaagagcgacauguacaucaucugcagacugaagcccuacagcuucaccaucaacuucugccaggaggagugccugagaugcgaguggauggaccugaacgaccuggccaagaccgagaacaccacccccaucaccagcagaguggccagacugcugcuguacggcuacagagagggcuucgacaagaucgaccugaccguggaggagcugcccgccguguacaccggccuguucuacaagcuguaccacaaggagcugcccgagaacuacaagaccaugaagggcaucgacuaa

SEQ ID NO: 20818 - RNA, 717 nt, Artificial Sequence
  NUDT7__Homo_sapiens__NP_001099133
augagcagacugggccugcccgaggagcccgugagaaacagccugcuggacgacgccaaggccagacugagaaaguacgacaucggcggcaaguacagccaccugcccuacaacaaguacagcgugcugcugccccugguggccaaggagggcaagcugcaccugcuguucaccgugagaagcgagaagcugagaagagcccccggcgaggugugcuuccccggcggcaagagagaccccaccgacauggacgacgccgccaccgcccugagagaggcccaggaggaggugggccugagaccccaccagguggagguggugugcugccuggugcccugccugaucgacaccgacacccugaucacccccuucgugggccugaucgaccacaacuuccaggcccagcccaaccccgccgaggugaaggacguguuccuggugccccuggccuacuuccugcacccccaggugcacgaccagcacuacgugaccagacugggccacagauucaucaaccacaucuucgaguacaccaaccccgaggacggcgugaccuaccagaucaagggcaugaccgccaaccuggccgugcugguggccuucaucauccuggagaagaagcccaccuucgaggugcaguucaaccugaacgacgugcuggccagcagcgaggagcuguuccugaaggugcacaagaaggccaccagcagacuguaa

SEQ ID NO: 20819 - RNA, 1395 nt, Artificial Sequence
  NUF2__Homo_sapiens__NP_663735
auggagacccugagcuuccccagauacaacguggccgagaucgugauccacaucagaaacaagauccugaccggcgccgacggcaagaaccugaccaagaacgaccuguaccccaaccccaagcccgaggugcugcacaugaucuacaugagagcccugcagaucguguacggcaucagacuggagcacuucuacaugaugcccgugaacagcgaggugauguacccccaccugauggagggcuuccugcccuucagcaaccuggugacccaccuggacagcuuccugcccaucugcagagugaacgacuucgagaccgccgacauccugugccccaaggccaagagaaccagcagauuccugagcggcaucaucaacuucauccacuucagagaggccugcagagagaccuacauggaguuccuguggcaguacaagagcagcgccgacaagaugcagcagcugaacgccgcccaccaggaggcccugaugaagcuggagagacuggacagcgugcccguggaggagcaggaggaguucaagcagcugagcgacggcauccaggagcugcagcagagccugaaccaggacuuccaccagaagaccaucgugcugcaggagggcaacagccagaagaagagcaacaucagcgagaagaccaagagacugaacgagcugaagcugagcguggugagccugaaggagauccaggagagccugaagaccaagaucguggacagccccgagaagcugaagaacuacaaggagaagaugaaggacaccgugcagaagcugaagaacgccagacaggaggugguggagaaguacgagaucuacggcgacagcguggacugccugcccagcugccagcuggaggugcagcuguaccagaagaagauccaggaccugagcgacaacagagagaagcuggccagcauccugaaggagagccugaaccuggaggaccagaucgagagcgacgagagcgagcugaagaagcugaagaccgaggagaacagcuucaagagacugaugaucgugaagaaggagaagcuggccaccgcccaguucaagaucaacaagaagcacgaggacgugaagcaguacaagagaaccgugaucgaggacugcaacaaggugcaggagaagagaggcgccguguacgagagagugaccaccaucaaccaggagauccagaagaucaagcugggcauccagcagcugaaggacgccgccgagagagagaagcugaagagccaggagaucuuccugaaccugaagaccgcccuggagaaguaccacgacggcaucgagaaggccgccgaggacagcuacgccaagaucgacgagaagaccgccgagcugaagagaaagauguucaagaugagcaccuaa

SEQ ID NO: 20820 - RNA, 1488 nt, Artificial Sequence
  NUFIP1__Homo_sapiens__NP_036477
auggccgagcccaccagcgacuucgagacccccaucggcuggcacgccagccccgagcugacccccacccugggcccccugagcgacaccgccccccccagagacagcuggauguucugggccaugcugcccccccccccccccccccugaccagcagccugcccgccgccggcagcaagcccagcagcgagagccagccccccauggaggcccagagccugcccggcgcccccccccccuucgacgcccagauccugcccggcgcccagccccccuucgacgcccagagcccccuggacagccagccccagcccagcggccagcccuggaacuuccacgccagcaccagcugguacuggagacagagcagcgacagauuccccagacaccagaagagcuucaaccccgccgugaagaacagcuacuaccccagaaaguacgacgccaaguucaccgacuucagccugccccccagcagaaagcagaagaagaagaagagaaaggagcccguguuccacuucuucugcgacaccugcgacagaggcuucaagaaccaggagaaguacgacaagcacaugagcgagcacaccaagugccccgagcuggacugcagcuucaccgcccacgagaagaucgugcaguuccacuggagaaacaugcacgcccccggcaugaagaagaucaagcuggacacccccgaggagaucgccagauggagagaggagagaagaaagaacuaccccacccuggccaacaucgagagaaagaagaagcugaagcuggagaaggagaagagaggcgccgugcugaccaccacccaguacggcaagaugaagggcaugagcagacacagccagauggccaagaucagaagccccggcaagaaccacaaguggaagaacgacaacagcagacagagagccgugaccggcagcggcagccaccugugcgaccugaagcuggagggcccccccgaggccaacgccgacccccugggcgugcugaucaacagcgacagcgagagcgacaaggaggagaagccccagcacagcgugauccccaaggaggugacccccgcccugugcagccugaugagcagcuacggcagccugagcggcagcgagagcgagcccgaggagacccccaucaagaccgaggccgacgugcuggccgagaaccaggugcuggacagcagcgcccccaagagccccagccaggacgugaaggccaccgugagaaacuucagcgaggccaagagcgagaacagaaagaagagcuucgagaagaccaaccccaagagaaagaaggacuaccacaacuaccagacccuguucgagcccagaacccaccaccccuaccugcuggagaugcugcuggcccccgacaucagacacgagagaaacgugauccugcagugcgugagauacaucaucaagaaggacuucuucggccuggacaccaacagcgccaagagcaaggacguguaa

SEQ ID NO: 20821 - RNA, 2088 nt, Artificial Sequence
  NUFIP2__Homo_sapiens__NP_065823
auggaggagaagcccggccagccccagccccagcaccaccacagccaccaccacccccaccaccacccccagcagcagcagcagcagccccaccaccaccaccacuacuacuucuacaaccacagccacaaccaccaccaccaccaccaccaccagcagccccaccaguaccugcagcacggcgccgagggcagccccaaggcccagcccaagccccugaagcacgagcagaagcacacccugcagcagcaccaggagacccccaagaagaagaccggcuacggcgagcugaacggcaacgccggcgagagagagaucagccugaagaaccugagcagcgacgaggccaccaaccccaucagcagagugcugaacggcaaccagcaggugguggacaccagccugaagcagaccgugaaggccaacaccuucggcaaggccggcaucaagaccaagaacuucauccagaagaacagcauggacaagaagaacggcaagagcuacgagaacaagagcggcgagaaccagagcguggacaagagcgacaccauccccauccccaacggcguggugaccaacaacagcggcuacaucaccaacggcuacaugggcaagggcgccgacaacgacggcagcggcagcgagagcggcuacaccacccccaagaagagaaaggccagaagaaacagcgccaagggcugcgagaaccugaacaucgugcaggacaagaucaugcagcaggagaccagcgugcccacccugaagcagggccuggagaccuucaagcccgacuacagcgagcagaagggcaacagaguggacggcagcaagcccaucuggaaguacgagaccggccccggcggcaccagcagaggcaagcccgccgugggcgacaugcugagaaagagcagcgacagcaagcccggcgugagcagcaagaaguucgacgacagacccaagggcaagcacgccagcgccguggccagcaaggaggacagcuggacccuguucaagcccccccccguguuccccguggacaacagcagcgccaagaucgugcccaagaucagcuacgccagcaaggugaaggagaaccugaacaagaccauccagaacagcagcgugagccccaccagcagcagcagcagcagcagcagcaccggcgagacccagacccagagcagcagcagacugagccaggugcccaugagcgcccugaagagcgugaccagcgccaacuucagcaacggccccgugcuggccggcaccgacggcaacguguacccccccggcggccagccccugcugaccaccgccgccaacacccugacccccaucagcagcggcaccgacagcgugcugcaggacaugagccugaccagcgccgccguggagcagaucaagaccagccuguucaucuaccccagcaacaugcagaccaugcugcugagcaccgcccagguggaccugcccagccagaccgaccagcagaaccugggcgacaucuuccagaaccaguggggccugagcuucaucaacgagcccagcgccggccccgagaccgugaccggcaagagcagcgagcacaaggugauggaggugaccuuccagggcgaguaccccgccacccuggugagccagggcgccgagaucauccccagcggcaccgagcaccccguguuccccaaggccuacgagcuggagaagagaaccagcccccaggugcugggcagcauccugaagagcggcaccaccagcgagagcggcgcccugagccuggagcccagccacaucggcgaccugcagaaggccgacaccagcagccagggcgcccugguguuccugagcaaggacuacgagaucgagagccagaacccccuggccagccccaccaacacccugcugggcagcgccaaggagcagagauaccagagaggccuggagagaaacgacagcuggggcagcuucgaccugagagccgccaucguguaccacaccaaggagauggagagcaucuggaaccugcagaagcaggaccccaagagaaucaucaccuacaacgaggccauggacagccccgaccaguaa

SEQ ID NO: 20822 - RNA, 2391 nt, Artificial Sequence
  NUGGC__Homo_sapiens__NP_001010906
auggccgagaccaaggacguguucggccaggagccccaccccguggaggacgaccuguacaaggagagaaccagaaagagaagaaagagcgacagagaccagagauucagagccuuccccagcauggagcagagcgcccugaaggaguacgagaagcuggagagcagaaccagaagagugcugagcaacaccuaccagaagcugauccagagcguguuccuggacgacagcauccccaacggcgugaaguaccugaucaacagacugcuggcccugaucgagaagcccaccguggaccccaucuacaucgcccuguucggcagcaccggcgccggcaagagcagccugaucaacgccaucauccagcaggccauguuccugcccgugagcggcgagagcaucugcaccagcugcaucgugcaggugagcagcggcugcugcgugcaguacgaggccaagauccaccugcugagcgaccaggaguggagagaggagcugaagaaccugaccaagcugcugcacagaaccgaggagcugagcagagaggaggccgacgccuggaacagagacgaggccguggaggaggccaccuggaagcugcagaugaucuacggcaacggcgccgagagcaagaacuacgaggagcugcugagagccaagcccaagagaaagauccccaccagcagagugaucacccugaaggccgaggaggccgaggagcugagcaucaagcuggaccccuacaucagaacccagagaagagacugggacggcgaggccgccgagaugagaaucuggccccugaucaagcacguggaggugacccugcccaagagcgaccugauccccgagggcguggugcugguggacauccccggcaccggcgacuucaacagcaagagagacgagauguggaagaagaccaucgacaagugcagcgugaucugggugaucagcgacaucgagagagugagcggcggccaggcccacgaggaccugcugaacgagagcaucaaggccugccagagaggcuucugcagagacguggcccugguggugaccaagauggacaagcugcaccugcccgaguaccugagagagagaaaggccggcaaccaggccauccagagccagagagaggccgugcuggagagaaacgagaugaucaagcugcagagaaccagaauccugaaggagaagcugaagagaaagcugcccgccgacuucaaggugcuggaggccagcgaccugguguacaccgugagcgcccaggaguacuggcagcaggcccugcugaccgaggaggagaccgagauccccaagcugagagaguacaucagaaagagccugcuggacaagaagaagagaaccgugaccaaguacgugaccgaggccuucggccugcugcugcugaccgacagcuucaacagcacccagaaccugcccaacgagcaccugcacaugagcgugcugagaagauucgccgaggagaagguggagcugcuggagaaggccaucgcccagugcuucgccugcauggagcagccccugcaggagggcgugagaaccgccagaaccagcuacagaugcauccugagagccugccuggugagaagcaagggcaaccagggcuuccaccagacccugaaggccgugugccugaagaacggcaucuacgccagcagaacccuggccagaaucgaccugaacgaggcccugacccagcccguguacgaccagaucgaccccguguucggcagcaucuucagaaccggcaagcccaccggcagcgcccugaugccccacaucgacgccuucaagcagagccugcaggagaagaugaccgagaucggcaucagaagcggcuggaaguacgacagcugcaagaagaacuuccugauccaggagaucagcgccauccugggcggccuggaggaccacauccugagaagaaagagaagaaucuacgagagccugaccgccagcgugcagagcgaccugaagcugugcuacgaggaggccgcccagaucaccggcaagaaggccugcgagagaaugaaggacgccaucagaagaggcguggacagacagguggccgagggcauguucgagagagcccaggagagaaugcagcaccaguuccagcagcugaagaccggcaucguggagaaggugaagggcagcaucaccaccaugcuggcccuggccagcagccagggcgacggccuguacaaggagcuggccgacgugggcagcgaguacaaggagauggagaagcugcacagaagccugagagagguggccgagaacgccagacugagaaagggcaugcaggaguuccugcugagagccagccccagcaaggccggcccccccggcaccagccuguaa

SEQ ID NO: 20823 - RNA, 6306 nt, Artificial Sequence
  NUMA1__Homo_sapiens__NP_001273490
augacccugcacgccaccagaggcgccgcccugcugagcugggugaacagccugcacguggccgaccccguggaggccgugcugcagcugcaggacugcagcaucuucaucaagaucaucgacagaauccacggcaccgaggagggccagcagauccugaagcagcccgugagcgagagacuggacuucgugugcagcuuccugcagaagaacagaaagcaccccagcagccccgagugccuggugagcgcccagaaggugcuggagggcagcgagcuggagcuggccaagaugaccaugcugcugcuguaccacagcaccaugagcagcaagagccccagagacugggagcaguucgaguacaagauccaggccgagcuggccgugauccugaaguucgugcuggaccacgaggacggccugaaccugaacgaggaccuggagaacuuccugcagaaggcccccgugcccagcaccugcagcagcaccuuccccgaggagcugagcccccccagccaccaggccaagagagagaucagauuccuggagcugcagaagguggccagcagcagcagcggcaacaacuuccugagcggcagccccgccagccccaugggcgacauccugcagaccccccaguuccagaugagaagacugaagaagcagcuggccgacgagagaagcaacagagacgagcuggagcuggagcuggccgagaacagaaagcugcugaccgagaaggacgcccagaucgccaugaugcagcagagaaucgacagacuggcccugcugaacgagaagcaggccgccagcccccuggagcccaaggagcuggaggagcugagagacaagaacgagagccugaccaugagacugcacgagacccugaagcagugccaggaccugaagaccgagaagagccagauggacagaaagaucaaccagcugagcgaggagaacggcgaccugagcuucaagcugagagaguucgccagccaccugcagcagcugcaggacgcccugaacgagcugaccgaggagcacagcaaggccacccaggaguggcuggagaagcaggcccagcuggagaaggagcugagcgccgcccugcaggacaagaagugccuggaggagaagaacgagauccugcagggcaagcugagccagcuggaggagcaccugagccagcugcaggacaaccccccccaggagaagggcgaggugcugggcgacgugcugcagcuggagacccugaagcaggaggccgccacccuggccgccaacaacacccagcugcaggccagaguggagaugcuggagaccgagagaggccagcaggaggccaagcugcuggccgagagaggccacuucgaggaggagaagcagcagcugagcagccugaucaccgaccugcagagcagcaucagcaaccugagccaggccaaggaggagcuggagcaggccagccaggcccacggcgccagacugaccgcccagguggccagccugaccagcgagcugaccacccugaacgccaccauccagcagcaggaccaggagcuggccggccugaagcagcaggccaaggagaagcaggcccagcuggcccagacccugcagcagcaggagcaggccagccagggccugagacaccagguggagcagcugagcagcagccugaagcagaaggagcagcagcugaaggagguggccgagaagcaggaggccaccagacaggaccacgcccagcagcuggccaccgccgccgaggagagagaggccagccugagagagagagacgccgcccugaagcagcuggaggcccuggagaaggagaaggccgccaagcuggagauccugcagcagcagcugcagguggccaacgaggccagagacagcgcccagaccagcgugacccaggcccagagagagaaggccgagcugagcagaaagguggaggagcugcaggccugcguggagaccgccagacaggagcagcacgaggcccaggcccagguggccgagcuggagcugcagcugagaagcgagcagcagaaggccaccgagaaggagagaguggcccaggagaaggaccagcugcaggagcagcugcaggcccugaaggagagccugaaggugaccaagggcagccuggaggaggagaagagaagagccgccgacgcccuggaggagcagcagagaugcaucagcgagcugaaggccgagaccagaagccugguggagcagcacaagagagagagaaaggagcuggaggaggagagagccggcagaaagggccuggaggccagacugcagcagcugggcgaggcccaccaggccgagaccgaggugcugagaagagagcuggccgaggccauggccgcccagcacaccgccgagagcgagugcgagcagcuggugaaggagguggccgccuggagagagagauacgaggacagccagcaggaggaggcccaguacggcgccauguuccaggagcagcugaugacccugaaggaggagugcgagaaggccagacaggagcugcaggaggccaaggagaagguggccggcaucgagagccacagcgagcugcagaucagcagacagcagaacgagcuggccgagcugcacgccaaccuggccagagcccugcagcaggugcaggagaaggaggugagagcccagaagcuggccgacgaccugagcacccugcaggagaagauggccgccaccagcaaggagguggccagacuggagacccuggugagaaaggccggcgagcagcaggagaccgccagcagagagcuggugaaggagcccgccagagccggcgacagacagcccgaguggcuggaggagcagcagggcagacaguucugcagcacccaggccgcccugcaggccauggagagagaggccgagcagaugggcaacgagcuggagagacugagagccgcccugauggagagccagggccagcagcaggaggagagaggccagcaggagagagagguggccagacugacccaggagagaggcagagcccaggccgaccuggcccuggagaaggccgccagagccgagcuggagaugagacugcagaacgcccugaacgagcagagaguggaguucgccacccugcaggaggcccuggcccacgcccugaccgagaaggagggcaaggaccaggagcuggccaagcugagaggccuggaggccgcccagaucaaggagcuggaggagcugagacagaccgugaagcagcugaaggagcagcuggccaagaaggagaaggagcacgccagcggcagcggcgcccagagcgaggccgccggcagaaccgagcccaccggccccaagcuggaggcccugagagccgaggugagcaagcuggagcagcagugccagaagcagcaggagcaggccgacagccuggagagaagccuggaggccgagagagccagcagagccgagagagacagcgcccuggagacccugcagggccagcuggaggagaaggcccaggagcugggccacagccagagcgcccuggccagcgcccagagagagcuggccgccuucagaaccaaggugcaggaccacagcaaggccgaggacgaguggaaggcccagguggccagaggcagacaggaggccgagagaaagaacagccugaucagcagccuggaggaggaggugagcauccugaacagacaggugcuggagaaggagggcgagagcaaggagcugaagagacuggugauggccgagagcgagaagagccagaagcuggaggagagacugagacugcugcaggccgagaccgccagcaacagcgccagagccgccgagagaagcagcgcccugagagaggaggugcagagccugagagaggaggccgagaagcagagaguggccagcgagaaccugagacaggagcugaccagccaggccgagagagccgaggagcugggccaggagcugaaggccuggcaggagaaguucuuccagaaggagcaggcccugagcacccugcagcuggagcacaccagcacccaggcccuggugagcgagcugcugcccgccaagcaccugugccagcagcugcaggccgagcaggccgccgccgagaagagacacagagaggagcuggagcagagcaagcaggccgccggcggccugagagccgagcugcugagagcccagagagagcugggcgagcugaucccccugagacagaagguggccgagcaggagagaaccgcccagcagcugagagccgagaaggccagcuacgccgagcagcugagcaugcugaagaaggcccacggccugcuggccgaggagaacagaggccugggcgagagagccaaccugggcagacaguuccuggagguggagcuggaccaggccagagagaaguacgugcaggagcuggccgccgugagagccgacgccgagaccagacuggccgaggugcagagagaggcccagagcaccgccagagagcuggaggugaugaccgccaaguacgagggcgccaaggugaaggugcuggaggagagacagagauuccaggaggagagacagaagcugaccgcccagguggaggagcugagcaagaagcuggccgacagcgaccaggccagcaaggugcagcagcagaagcugaaggccgugcaggcccagggcggcgagagccagcaggaggcccagagacugcaggcccagcugaacgagcugcaggcccagcugagccagaaggagcaggccgccgagcacuacaagcugcagauggagaaggccaagacccacuacgacgccaagaagcagcagaaccaggagcugcaggagcagcugagaagccuggagcagcugcagaaggagaacaaggagcugagagccgaggccgagagacugggccacgagcugcagcaggccggccugaagaccaaggaggccgagcagaccugcagacaccugaccgcccaggugagaagccuggaggcccagguggcccacgccgaccagcagcugagagaccugggcaaguuccagguggccaccgacgcccugaagagcagagagccccaggccaagccccagcuggaccugagcaucgacagccuggaccugagcugcgaggagggcaccccccugagcaucaccagcaagcugcccagaacccagcccgacggcaccagcgugcccggcgagcccgccagccccaucagccagagacugccccccaagguggagagccuggagagccuguacuucacccccauccccgccagaagccaggccccccuggagagcagccuggacagccugggcgacguguuccuggacagcggcagaaagaccagaagcgccagaagaagaaccacccagaucaucaacaucaccaugaccaagaagcuggacguggaggagcccgacagcgccaacagcagcuucuacagcaccagaagcgcccccgccagccaggccagccugagagccaccagcagcacccagagccuggccagacugggcagccccgacuacggcaacagcgcccugcugagccugcccggcuacagacccaccaccagaagcagcgccagaagaagccaggccggcgugagcagcggcgccccccccggcagaaacagcuucuacaugggcaccugccaggacgagcccgagcagcuggacgacuggaacagaaucgccgagcugcagcagagaaacagagugugccccccccaccugaagaccugcuacccccuggagagcagacccagccugagccugggcaccaucaccgacgaggagaugaagaccggcgacccccaggagacccugagaagagccagcaugcagcccauccagaucgccgagggcaccggcaucaccaccagacagcagagaaagagagugagccuggagccccaccagggccccggcacccccgagagcaagaaggccaccagcugcuuccccagacccaugacccccagagacagacacgagggcagaaagcagagcaccaccgaggcccagaagaaggccgcccccgccagcaccaagcaggccgacagaagacagagcauggccuucagcauccugaacacccccaagaagcugggcaacagccugcugagaagaggcgccagcaagaaggcccugagcaaggccagccccaacaccagaagcggcaccagaagaagccccagaaucgccaccaccaccgccagcgccgccaccgccgccgccaucggcgccacccccagagccaagggcaaggccaagcacuaa

SEQ ID NO: 20824 - RNA, 1779 nt, Artificial Sequence
  NUMB__Homo_sapiens__NP_001005745
augaacaagcugagacagagcuucagaagaaagaaggacguguacgugcccgaggccagcagaccccaccaguggcagaccgacgaggagggcgugagaaccggcaagugcagcuuccccgugaaguaccugggccacguggagguggacgagagcagaggcaugcacaucugcgaggacgccgugaagagacugaaggccaccggcaagaaggccgugaaggccgugcugugggugagcgccgacggccugagagugguggacgagaagaccaaggaccugaucguggaccagaccaucgagaaggugagcuucugcgcccccgacagaaacuucgacagagccuucagcuacaucugcagagacggcaccaccagaagauggaucugccacugcuucauggccgugaaggacaccggcgagagacugagccacgccgugggcugcgccuucgccgccugccuggagagaaagcagaagagagagaaggagugcggcgugaccgccaccuucgacgccagcagaaccaccuucaccagagagggcagcuucagagugaccaccgccaccgagcaggccgagagagaggagaucaugaagcagaugcaggacgccaagaaggccgagaccgacaagaucguggugggcagcagcguggcccccggcaacaccgcccccagccccagcagccccaccagccccaccagcgacgccaccaccagccuggagaugaacaacccccacgccauccccagaagacacgcccccaucgagcagcuggccagacagggcagcuucagaggcuuccccgcccugagccagaagaugagccccuucaagagacagcugagccugagaaucaacgagcugcccagcaccaugcagagaaagaccgacuuccccaucaagaacgccgugcccgagguggagggcgaggccgagagcaucagcagccugugcagccagaucaccaacgccuucagcacccccgaggaccccuucagcagcgcccccaugaccaagcccgugaccgugguggccccccagagccccaccuuccagggcaccgaguggggccagagcagcggcgccgccagccccggccuguuccaggccggccacagaagaacccccagcgaggccgacagauggcuggaggaggugagcaagagcgugagagcccagcagccccaggccagcgccgccccccugcagcccgugcugcagccccccccccccaccgccaucagccagcccgccagccccuuccagggcaacgccuuccugaccagccagcccgugcccgugggcguggugcccgcccugcagcccgccuucgugcccgcccagagcuaccccguggccaacggcaugcccuaccccgcccccaacgugcccguggugggcaucacccccagccagaugguggccaacguguucggcaccgccggccacccccaggccgcccacccccaccagagccccagccuggugagacagcagaccuucccccacuacgaggccagcagcgccaccaccagccccuucuucaagccccccgcccagcaccugaacggcagcgccgccuucaacggcguggacgacggcagacuggccagcgccgacagacacaccgaggugcccaccggcaccugccccguggaccccuucgaggcccagugggccgcccuggagaacaagagcaagcagagaaccaaccccagccccaccaaccccuucagcagcgaccugcagaagaccuucgagaucgagcuguaa

SEQ ID NO: 20825 - RNA, 1707 nt, Artificial Sequence
  NUMBL__Homo_sapiens__NP_001276909
augaacaagcugagacagagccugagaagaagaaagcccgccuacgugcccgaggccagcagaccccaccaguggcaggccgacgaggacgccgugagaaagggcaccugcagcuuccccgugagauaccugggccacguggagguggaggagagcagaggcaugcacgugugcgaggacgccgugaagaagcugaaggccaugggcagaaagagcgugaagagcgugcugugggugagcgccgacggccugagagugguggacgacaagaccaaggaccugcugguggaccagaccaucgagaaggugagcuucugcgcccccgacagaaaccuggacaaggccuucagcuacaucugcagagacggcaccaccagaagauggaucugccacugcuuccuggcccugaaggacagcggcgagagacugagccacgccgugggcugcgccuucgccgccugccuggagagaaagcagagaagagagaaggagugcggcgugaccgccgccuucgacgccagcagaaccagcuucgccagagagggcagcuucagacugagcggcggcggcagacccgccgagagagaggcccccgacaagaagaaggccgaggccgccgccgcccccaccguggcccccggccccgcccagcccggccacgugagccccacccccgccaccaccagccccggcgagaagggcgaggccggcacccccguggccgccggcaccaccgccgccgccauccccagaagacacgccccccuggagcagcuggugagacagggcagcuucagaggcuuccccgcccugagccagaagaacagccccuucaagagacagcugagccugagacugaacgagcugcccagcacccugcagagaagaaccgacuuccaggugaagggcaccgugcccgagauggagccccccggcgccggcgacagcgacagcaucaacgcccugugcacccagaucagcagcagcuucgccagcgccggcgcccccgcccccggccccccccccgccaccaccggcaccagcgccuggggcgagcccagcgugccccccgccgccgccuuccagcccggccacaagagaacccccagcgaggccgagagauggcuggaggaggugagccagguggccaaggcccagcagcagcagcagcagcagcagcagcagcagcagcagcagcagcagcagcagcagcaggccgccagcguggcccccgugcccaccaugccccccgcccugcagcccuuccccgcccccgugggccccuucgacgccgcccccgcccagguggccguguuccugccccccccccacaugcagccccccuucgugcccgccuaccccggccugggcuacccccccaugcccagagugcccguggugggcaucacccccagccagaugguggccaacgccuucugcagcgccgcccagcugcagccccagcccgccacccugcugggcaaggccggcgccuuccccccccccgccauccccagcgcccccggcagccaggccagacccagacccaacggcgcccccuggccccccgagcccgcccccgcccccgcccccgagcuggaccccuucgaggcccagugggccgcccuggagggcaaggccaccguggagaagcccagcaaccccuucagcggcgaccugcagaagaccuucgagaucgagcuguaa

SEQ ID NO: 20826 - RNA, 4521 nt, Artificial Sequence
  NUP153__Homo_sapiens__NP_001265138
auggccagcggcgccggcggcgugggcggcggcggcggcggcaagaucagaaccagaagaugccaccagggccccaucaagcccuaccagcagggcagacagcagcaccagggcauccugagcagagugaccgagagcgugaagaacaucgugcccggcuggcugcagagauacuucaacaagaacgaggacgugugcagcugcagcaccgacaccagcgaggugcccagauggcccgagaacaaggaggaccaccugguguacgccgacgaggagagcagcaacaucaccgacggcagaaucacccccgagcccgccgugagcaacaccgaggagcccagcaccaccagcaccgccagcaacuaccccgacgugcugaccagacccagccugcacagaagccaccugaacuucagcaugcuggagagccccgcccugcacugccagcccagcaccagcagcgccuuccccaucggcagcagcggcuucagccuggugaaggagaucaaggacagcaccagccagcacgacgacgacaacaucagcaccaccagcggcuucagcagcagagccagcgacaaggacaucaccgugagcaagaacaccagccugcccccccuguggagccccgaggccgagagaagccacagccugagccagcacaccgccaccagcagcaagaagcccgccuucaaccugagcgccuucggcacccugagccccagccugggcaacagcagcauccugaagaccagccagcugggcgacagccccuucuaccccggcaagaccaccuacggcggcgccgccgccgccgugagacagagcaagcugagaaacacccccuaccaggcccccgugagaagacagaugaaggccaagcagcugagcgcccagagcuacggcgugaccagcagcaccgccagaagaauccugcagagccuggagaagaugagcagcccccuggccgacgccaagagaauccccagcaucgugagcagcccccugaacagcccccuggacagaagcggcaucgacaucaccgacuuccaggccaagagagagaagguggacagccaguacccccccgugcagagacugaugacccccaagcccgugagcaucgccaccaacagaagcguguacuucaagcccagccugacccccagcggcgaguucagaaagaccaaccagagaaucgacaacaagugcagcaccggcuacgagaagaacaugacccccggccagaacagagagcagagagagagcggcuucagcuaccccaacuucagccugcccgccgccaacggccugagcagcggcgugggcggcggcggcggcaagaugagaagagagagaaccagauucguggccagcaagccccuggaggaggagagacagggccugaccgugcugcccaagcugaucagcagcagcugcgcccaggccaucauccccagcuggccccugaaggugcugagacugcaggagauggaggugcccgugcugcccaagaucagccugcccaucaccagcagcagccugcccaccuucaacuucagcagccccgagaucaccaccagcagccccagccccaucaacagcagccaggcccugaccaacaaggugcagaugaccagccccagcagcaccggcagccccauguucaaguucagcagccccaucgugaagagcaccgaggccaacgugcugccccccagcagcaucggcuucaccuucagcgugcccguggccaagaccgccgagcugagcggcagcagcagcacccuggagcccaucaucagcagcagcgcccaccacgugaccaccgugaacagcaccaacugcaagaagaccccccccgaggacugcgagggccccuucagacccgccgagauccugaaggagggcagcgugcuggacauccugaagagccccggcuucgccagccccaagaucgacagcguggccgcccagcccaccgccaccagccccgugguguacaccagacccgccaucagcagcuucagcagcagcggcaucggcuucggcgagagccugaaggccggcagcagcuggcagugcgacaccugccugcugcagaacaaggugaccgacaacaagugcaucgccugccaggccgccaagcugagccccagagacaccgccaagcagaccggcaucgagacccccaacaagagcggcaagaccacccugagcgccagcggcaccggcuucggcgacaaguucaagcccgugaucggcaccugggacugcgacaccugccuggugcagaacaagcccgaggccaucaagugcguggccugcgagacccccaagcccggcaccugcgugaagagagcccugacccugaccguggugagcgagagcgccgagaccaugaccgccagcagcagcagcugcaccgugaccaccggcacccugggcuucggcgacaaguucaagagacccaucggcagcugggagugcagcgugugcugcgugagcaacaacgccgaggacaacaagugcgugagcugcaugagcgagaagcccggcagcagcgugcccgccagcagcagcagcaccgugcccgugagccugcccagcggcggcagccugggccuggagaaguucaagaagcccgagggcagcugggacugcgagcugugccuggugcagaacaaggccgacagcaccaagugccuggccugcgagagcgccaagcccggcaccaagagcggcuucaagggcuucgacaccagcagcagcagcagcaacagcgccgccagcagcagcuucaaguucggcgugagcagcagcagcagcggccccagccagacccugaccagcaccggcaacuucaaguucggcgaccagggcggcuucaagaucggcgugagcagcgacagcggcagcaucaaccccaugagcgagggcuucaaguucagcaagcccaucggcgacuucaaguucggcgugagcagcgagagcaagcccgaggaggugaagaaggacagcaagaacgacaacuucaaguucggccugagcagcggccugagcaaccccgugagccugacccccuuccaguucggcgugagcaaccugggccaggaggagaagaaggaggagcugcccaagagcagcagcgccggcuucagcuucggcaccggcgugaucaacagcacccccgcccccgccaacaccaucgugaccagcgagaacaagagcagcuucaaccugggcaccaucgagaccaagagcgccagcguggcccccuucaccugcaagaccagcgaggccaagaaggaggagaugcccgccaccaagggcggcuucagcuucggcaacguggagcccgccagccugcccagcgccagcguguucgugcugggcagaaccgaggagaagcagcaggagcccgugaccagcaccagccugguguucggcaagaaggccgacaacgaggagcccaagugccagcccguguucagcuucggcaacagcgagcagaccaaggacgagaacagcagcaagagcaccuucagcuucagcaugaccaagcccagcgagaaggagagcgagcagcccgccaaggccaccuucgccuucggcgcccagaccagcaccaccgccgaccagggcgccgccaagcccguguucagcuuccugaacaacagcagcagcagcagcagcacccccgccaccagcgccggcggcggcaucuucggcagcagcaccagcagcagcaacccccccguggccaccuucguguucggccagagcagcaaccccgugagcagcagcgccuucggcaacaccgccgagagcagcaccagccagagccugcuguucagccaggacagcaagcuggccaccaccagcagcaccggcaccgccgugacccccuucguguucggccccggcgccagcagcaacaacaccaccaccagcggcuucggcuucggcgccaccaccaccagcagcagcgccggcagcagcuucguguucggcaccggccccagcgcccccagcgccagccccgccuucggcgccaaccagacccccaccuucggccagagccagggcgccagccagcccaacccccccggcuucggcagcaucagcagcagcaccgcccuguuccccaccggcagccagcccgccccccccaccuucggcaccgugagcagcagcagccagccccccguguucggccagcagcccagccagagcgccuucggcagcggcaccacccccaacagcagcagcgccuuccaguucggcagcagcaccaccaacuucaacuucaccaacaacagccccagcggcguguucaccuucggcgccaacagcagcacccccgccgccagcgcccagcccagcggcagcggcggcuuccccuucaaccagagccccgccgccuucaccgugggcagcaacggcaagaacguguucagcagcagcggcaccagcuucagcggcagaaagaucaagaccgccgugagaagaagaaaguaa

SEQ ID NO: 20827 - RNA, 3984 nt, Artificial Sequence
  NUP155__Homo_sapiens__NP_001265241
augcccagcagccugcugggcgccgccaugcccgccagcaccagcgccgccgcccugcaggaggcccuggagaacgccggcagacugaucgacagacagcugcaggaggacagaauguaccccgaccugagcgagcugcugauggugagcgcccccaacaaccccaccgugagcggcaugagcgacauggacuacccccugcagggccccggccugcugagcgugcccaaccugcccgagaucagcagcaucagaagagugccccugccccccgagcugguggagcaguucggccacaugcagugcaacugcaugaugggcguguucccccccaucagcagagccuggcugaccaucgacagcgacaucuucauguggaacuacgaggacggcggcgaccuggccuacuucgacggccugagcgagaccauccuggccgugggccuggugaagcccaaggccggcaucuuccagccccacgugagacaccugcuggugcuggccacccccguggacaucgugauccugggccugagcuacgccaaccugcagaccggcagcggcgugcugaacgacagccugagcggcggcaugcagcugcugcccgacccccuguacagccugcccaccgacaacaccuaccugcugaccaucaccagcaccgacaacggcagaaucuuccuggccggcaaggacggcugccuguacgagguggccuaccaggccgaggccggcugguucagccagagaugcagaaagaucaaccacagcaagagcagccugagcuuccuggugcccagccugcugcaguucaccuucagcgaggacgaccccauccugcagaucgccaucgacaacagcagaaacauccuguacaccagaagcgagaagggcgugauccagguguacgaccugggccaggacggccagggcaugagcagaguggccagcgugagccagaacgccaucgugagcgccgccggcaacaucgccagaaccaucgacagaagcguguucaagcccaucgugcagaucgccgugaucgagaacagcgagagccuggacugccagcugcuggccgugacccacgccggcgugagacuguacuucagcaccugccccuucagacagccccuggccagacccaacacccugacccuggugcacgugagacugccccccggcuucagcgccagcagcaccguggagaagcccagcaaggugcacagagcccuguacagcaagggcauccugcugauggccgccagcgagaacgaggacaacgacauccuguggugcgugaaccacgacaccuuccccuuccagaagcccaugauggagacccagaugaccgccggcguggacggccacagcugggcccugagcgccaucgacgagcugaagguggacaagaucaucaccccccugaacaaggaccacauccccaucaccgacagccccgugguggugcagcagcacaugcugccccccaagaaguucgugcugcugagcgcccagggcagccugauguuccacaagcugagacccguggaccagcugagacaccugcuggugagcaacgugggcggcgacggcgaggagaucgagagauucuucaagcugcaccaggaggaccaggccugcgccaccugccugauccuggccugcagcaccgccgccugcgacagagaggugagcgccugggccaccagagccuucuucagauacggcggcgaggcccagaugagauuccccaccacccugcccccccccagcaacgugggccccauccugggcagccccguguacagcagcagccccgugcccagcggcagccccuaccccaaccccagcuuccugggcacccccagccacggcauccagccccccgccaugagcacccccgugugcgcccugggcaaccccgccacccaggccaccaacaugagcugcgugaccggccccgagaucguguacagcggcaagcacaacggcaucugcaucuacuucagcagaaucaugggcaacaucugggacgccagccuggugguggagagaaucuucaagagcggcaacagagagaucaccgccaucgagagcagcgugcccugccagcugcuggagagcgugcugcaggagcugaagggccugcaggaguuccuggacagaaacagccaguucgccggcggcccccugggcaaccccaacaccaccgccaaggugcagcagagacugaucggcuucaugagacccgagaacggcaacccccagcagaugcagcaggagcugcagagaaaguuccacgaggcccagcugagcgagaagaucagccugcaggccauccagcagcuggugagaaagagcuaccaggcccuggcccuguggaagcugcugugcgagcaccaguucaccaucaucguggccgagcugcagaaggccaacgagcugcugcagagaagcagacaggugcagaacaagaccgagaaggagagaaugcugagagagagccugaaggaguaccagaagaucagcaaccagguggaccugagcaacgugugcgcccaguacagacaggugagauucuacgagggcgugguggagcugagccugaccgccgccgagaagaaggacccccagggccugggccugcacuucuacaagcacggcgagcccgaggaggacaucgugggccugcaggccuuccaggagagacugaacagcuacaagugcaucaccgacacccugcaggagcuggugaaccagagcaaggccgccccccagagccccagcgugcccaagaagcccggcccccccgugcugagcagcgaccccaacaugcugagcaacgaggaggccggccaccacuucgagcagaugcugaagcugagccagagaagcaaggacgagcuguucagcaucgcccuguacaacuggcugauccagguggaccuggccgacaagcugcugcagguggccagccccuuccuggagccccaccuggugagaauggccaagguggaccagaacagagugagauacauggaccugcuguggagauacuacgagaagaacagaagcuucagcaacgccgccagagugcugagcagacuggccgacaugcacagcaccgagaucagccugcagcagagacuggaguacaucgccagagccauccugagcgccaagagcagcaccgccaucagcagcaucgccgccgacggcgaguuccugcacgagcuggaggagaagauggagguggccagaauccagcugcagauccaggagacccugcagagacaguacagccaccacagcagcgugcaggacgccgugagccagcuggacagcgagcugauggacaucaccaagcuguacggcgaguucgccgaccccuucaagcuggccgagugcaagcuggccaucauccacugcgccggcuacagcgaccccauccuggugcagacccuguggcaggacaucaucgagaaggagcugagcgacagcgugacccugagcagcagcgacagaaugcacgcccugagccugaagaucgugcugcugggcaagaucuacgccggcacccccagauucuucccccuggacuucaucgugcaguuccuggagcagcaggugugcacccugaacugggacgugggcuucgugauccagaccaugaacgagaucggcgugccccugcccagacugcuggagguguacgaccagcuguucaagagcagagaccccuucuggaacagaaugaagaagccccugcaccugcuggacugcauccacgugcugcugaucagauacguggagaaccccagccaggugcugaacugcgagagaagaagauucaccaaccugugccuggacgccgugugcggcuaccugguggagcugcagagcaugagcagcagcguggccgugcaggccaucaccggcaacuucaagagccugcaggccaagcuggagagacugcacuaa

SEQ ID NO: 20828 - RNA, 6039 nt, Artificial Sequence
  NUP205__Homo_sapiens__NP_055950
auggccaccccccuggccgugaacagcgccgccagccuguggggccccuacaaggacaucuggcacaaggugggcaacgcccuguggagaagacagcccgaggccgugcaccugcuggacaagauccugaagaagcacaagcccgacuucaucagccuguucaagaacccccccaagaacgugcagcagcacgagaaggugcagaaggccagcaccgagggcguggccauccagggccagcagggcaccagacugcugcccgagcagcugaucaaggaggccuucauccugagcgaccuguucgacaucggcgagcuggccgccguggagcugcugcuggccggcgagcaccagcagccccacuuccccggccugaccagaggccugguggccgugcugcuguacugggacggcaagagaugcaucgccaacagccugaaggcccugauccagagcagaagaggcaagaccuggacccuggagcugagccccgagcuggccagcaugaccaccagauucaccgacgagcugauggagcagggccugaccuacaaggugcugacccuggugagccagaucgacgugaacaacgaguucgagaagcugcagagagagagaggccugggcagcgagaagcacagaaaggaggugagcgaccugaucaaggagugcagacagagccuggccgagagccuguucgccugggccugccagagcccccugggcaaggaggacacccugcugcugaucggccaccuggagagagugaccguggaggccaacggcagccuggacgccgugaaccuggcccugcugauggcccugcuguacugcuucgacaucagcuucaucgagcagagcaccgaggagagagacgacaugauccaccagcugccccugcugaccgagaagcaguacaucgccaccauccacagcagacugcaggacagccagcuguggaagcugcccggccugcaggccaccgugagacuggccugggcccuggcccugagaggcaucagccagcugcccgacgugaccgcccuggccgaguucaccgaggccgacgaggccauggccgagcuggccaucgccgacaacguguuccuguuccugauggagagcgugguggugagcgaguacuucuaccaggaggaguucuacaucagaagagugcacaaccugaucaccgacuuccuggcccugaugcccaugaaggugaagcagcugagaaacagagccgacgaggacgccagaaugauccacaugagcaugcagaugggcaacgagccccccaucagccugagaagagaccuggagcaccugaugcugcugaucggcgagcuguacaagaagaaccccuuccaccuggagcuggcccuggaguacuggugccccaccgagccccugcagacccccaccaucaugggcagcuaccugggcguggcccaccagagacccccccagagacagguggugcugagcaaguucgugagacagaugggcgaccugcugccccccaccaucuacauccccuaccugaagaugcugcagggccuggccaacggcccccagugcgcccacuacugcuucagccugcugaaggugaacggcagcagccacguggagaacauccagggcgccggcggcagccccgugagcugggagcacuucuuccacagccugaugcuguaccacgagcaccugagaaaggaccugcccagcgccgacagcgugcaguacagacaccugcccagcagaggcaucacccagaaggagcaggacggccugaucgccuuccugcagcugaccagcaccaucaucaccuggagcgagaacgccagacuggcccugugcgagcacccccaguggacccccgugguggugauccugggccugcugcagugcagcaucccccccgugcugaaggccgagcugcugaagacccuggccgccuucggcaagagccccgagaucgccgccagccuguggcagagccuggaguacacccagauccugcagaccgugagaauccccagccagagacaggccaucggcaucgagguggagcugaacgagaucgagagcagaugcgaggaguacccccugaccagagccuucugccagcugaucagcacccugguggagagcagcuuccccagcaaccugggcgccggccugagaccccccggcuucgaccccuaccugcaguuccugagagacagcguguuccugagauucagaaccagagccuacagaagagccgccgagaagugggagguggccgagguggugcuggagguguucuacaagcugcugagagacuacgagccccagcuggaggacuucguggaccaguucguggagcugcagggcgaggagaucaucgccuacaagccccccggcuucagccugauguaccaccugcugaacgagagccccaugcuggagcuggcccugagccugcuggaggagggcgugaagcagcuggacaccuacgcccccuuccccggcaagaagcaccuggagaaggccgugcagcacugccuggcccugcugaaccugacccugcagaaggagaaccuguucauggaccugcugagagagagccagcuggcccugaucgugugcccccuggagcagcugcugcagggcaucaaccccagaaccaagaaggccgacaacguggugaacaucgccagauaccuguaccacggcaacaccaaccccgagcuggccuucgagagcgccaagauccugugcugcaucagcugcaacagcaacauccagaucaagcuggugggcgacuucacccacgaccagagcaucagccagaagcugauggccggcuucguggagugccuggacugcgaggacgccgaggaguucgugagacuggaggagggcagcgagcuggagaagaagcugguggccaucagacacgagaccagaauccacauccugaaccugcugaucaccagccuggagugcaacccccccaaccuggcccuguaccugcugggcuucgagcugaagaagcccgugagcaccaccaaccugcaggaccccggcgugcugggcugccccagaaccugccugcacgccauccugaacauccuggagaagggcaccgagggcagaaccggccccguggccgugagagagagcccccagcuggccgagcugugcuaccaggugaucuaccagcugugcgccugcagcgacaccagcggccccaccaugagauaccugagaaccagccaggacuuccuguucagccagcugcaguaccugcccuucagcaacaaggaguacgagaucagcaugcugaaccagaugagcuggcugaugaagaccgccagcaucgagcugagagugaccagccugaacagacagagaagccacacccagagacugcugcaccugcugcuggacgacaugcccgugaagcccuacagcgacggcgagggcggcaucgaggacgagaacagaagcgugagcggcuuccugcacuucgacaccgccaccaaggugagaagaaagauccugaacauccuggacagcaucgacuucagccaggagauccccgagccccugcagcuggacuucuucgacagagcccagaucgagcaggugaucgccaacugcgagcacaagaaccugagaggccagaccgugugcaacgugaagcugcugcacagagugcugguggccgaggugaacgcccugcagggcauggccgccaucggccagagaccccugcugauggaggagaucagcaccgugcugcaguacguggugggcagaaacaagcugcugcagugccugcacgccaagagacacgcccuggagagcuggagacagcugguggagaucauccugaccgccugcccccaggaccugauccaggccgaggacagacagcugaucaucagagacauccugcaggacgugcacgacaagauccuggacgacgaggccgcccaggagcugaugcccgugguggccggcgccguguucacccugaccgcccaccugagccaggccgugcugaccgagcagaagcagaccagcgugcugggccccgccgaggcccacuacgccuucaugcuggacagcugcuucaccagccccccccccgaggagaacccccuggugggcuucgccagcaucggcgacagcagccuguacaucauccugaagaagcugcuggacuucauccugaagaccggcggcggcuuccagagagugagaacccaccuguacggcagccugcuguacuaccugcagaucgcccagagacccgacgagcccgacacccuggaggccgccaagaagaccaugugggagagacugaccgcccccgaggacguguucagcaagcugcagagagagaacaucgccaucaucgagagcuacggcgccgcccugauggagguggugugcagagacgccugcgacggccacgagaucggcagaaugcuggcccuggcccugcuggacagaaucgugagcguggacaagcagcagcaguggcugcuguaccugagcaacagcggcuaccugaaggugcugguggacagccugguggaggacgacagaacccugcagagccugcugaccccccagcccccccugcugaaggcccuguacaccuacgagagcaagauggccuuccugaccagaguggccaagauccagcagggcgcccuggagcugcugagaagcggcgugaucgugagacuggcccagugccagguguacgacaugagacccgagaccgacccccagagcauguucggcaugagagacccccccauguucauccccacccccguggacagauacagacagauccugcugcccgcccugcagcugugccaggugauccugaccagcagcauggcccagcaccugcaggccgccggccaggugcugcaguuccugaucagccacagcgacaccauccaggccauccugagaugccaggacgugagcgccggcagccugcaggagcuggcccugcugaccggcaucaucagcaaggccgcccugcccggcauccugagcgagcuggacguggacgugaacgagggcagccugauggagcugcagggccacaucggcagauuccagagacagugccugggccugcugagcagauucggcggcagcgacagacugagacaguucaaguuccaggacgacaacguggagggcgacaaggugagcaagaaggacgagaucgagcuggccaugcagcagaucugcgccaacgugauggaguacugccagagccugaugcugcagagcagccccaccuuccagcacgccgugugccuguucacccccagccugagcgagaccgugaacagagacggccccagacaggacacccaggcccccguggugcccuacuggagacugcccggccugggcaucaucaucuaccugcugaagcagagcgccaacgacuucuucagcuacuacgacagccacagacagagcgugagcaagcugcagaacguggagcagcugccccccgacgagaucaaggagcugugccagagcgugaugcccgccggcguggacaagaucagcaccgcccagaaguacgugcuggccagaagaagacuggugaaggugaucaacaacagagccaagcugcugagccugugcagcuucaucaucgagaccugccuguucauccuguggagacaccuggaguacuaccugcugcacugcaugcccaccgacagccaggacagccuguucgccagcagaacccuguucaagagcagaagacugcaggacagcuucgccagcgagaccaaccuggacuucagaagcggccuggccaucgugagccagcacgaccuggaccagcugcaggccgacgccaucaacgccuucggcgagagccugcagaagaagcugcuggacaucgagggccuguacagcaaggugagaagcagauacagcuucauccaggcccuggugagaagaaucagaggccugcugagaaucagcagaaacuaa

SEQ ID NO: 20829 - RNA, 5664 nt, Artificial Sequence
  NUP210__Homo_sapiens__NP_079199
auggccgccagaggcagaggccugcugcugcugacccugagcgugcugcuggccgccggccccagcgccgccgccgccaagcugaacauccccaaggugcugcugcccuucaccagagccaccagagugaacuucacccuggaggccagcgagggcugcuacagauggcugagcaccagacccgagguggccagcaucgagccccugggccuggacgagcagcagugcagccagaaggccguggugcaggccagacugacccagcccgccagacugaccagcaucaucuucgccgaggacaucaccaccggccaggugcugagaugcgacgccaucguggaccugauccacgacauccagaucgugagcaccaccagagagcuguaccuggaggacagcccccuggagcugaagauccaggcccuggacagcgagggcaacaccuucagcacccuggccggccugguguucgaguggaccaucgugaaggacagcgaggccgacagauucagcgacagccacaacgcccugagaauccugaccuuccuggagagcaccuacaucccccccagcuacaucagcgagauggagaaggccgccaagcagggcgacaccauccuggugagcggcaugaagaccggcagcagcaagcugaaggccagaauccaggaggccguguacaagaacgugagacccgccgaggugagacugcugauccuggagaacauccugcugaaccccgccuacgacguguaccugauggugggcaccagcauccacuacaaggugcagaagaucagacagggcaagaucaccgagcugagcaugcccagcgaccaguacgagcugcagcugcagaacagcauccccggccccgagggcgaccccgccagacccguggccgugcuggcccaggacaccagcauggugaccgcccugcagcugggccagagcagccuggugcugggccacagaagcaucagaaugcagggcgccagcagacugcccaacagcaccaucuacgugguggagcccggcuaccugggcuucaccgugcaccccggcgacagaugggugcuggagaccggcagacuguacgagaucaccaucgagguguucgacaaguucagcaacaagguguacgugagcgacaacaucagaaucgagaccgugcugcccgccgaguucuucgaggugcugagcagcagccagaacggcagcuaccacagaaucagagcccugaagagaggccagaccgccaucgacgccgcccugaccagcgugguggaccaggacggcggcgugcacauccugcaggugcccguguggaaccagcaggagguggagauccacauccccaucacccuguaccccagcauccugaccuuccccuggcagcccaagaccggcgccuaccaguacaccaucagagcccacggcggcagcggcaacuucagcuggagcagcagcagccaccugguggccaccgugaccgugaagggcgugaugaccaccggcagcgacaucggcuucagcgugauccaggcccacgacgugcagaacccccugcacuucggcgagaugaagguguacgugaucgagccccacagcauggaguucgcccccugccagguggaggccagagugggccaggcccuggagcugccccugagaaucagcggccugaugcccggcggcgccagcgagguggugacccugagcgacugcagccacuucgaccuggccguggagguggagaaccagggcguguuccagccccugcccggcagacugccccccggcagcgagcacugcagcggcaucagagugaaggccgaggcccagggcagcaccacccugcuggugagcuacagacacggccacgugcaccugagcgccaagaucaccaucgccgccuaccugccccugaaggccguggaccccagcagcguggcccuggugacccugggcagcagcaaggagaugcuguucgagggcggccccagacccuggauccuggagcccagcaaguucuuccagaacgugaccgccgaggacaccgacagcaucggccuggcccuguucgccccccacagcagcagaaacuaccagcagcacuggauccuggugaccugccaggcccugggcgagcaggugaucgcccugagcgugggcaacaagcccagccugaccaaccccuuccccgccguggagcccgccguggugaaguucgugugcgccccccccagcagacugacccuggcccccguguacaccagcccccagcuggacaugagcugcccccugcugcagcagaacaagcagguggugcccgugagcagccacagaaaccccagacuggaccuggccgccuacgaccaggagggcagaagauucgacaacuucagcagccugagcauccagugggagagcaccagacccgugcuggccagcaucgagcccgagcugcccaugcagcuggugagccaggacgacgagagcggccagaagaagcugcacggccugcaggccauccuggugcacgaggccagcggcaccaccgccaucaccgccaccgccaccggcuaccaggagagccaccugagcagcgccagaaccaagcagccccacgacccccuggugccccugagcgccagcaucgagcugauccugguggaggacgugagagugagccccgaggaggugaccaucuacaaccaccccggcauccaggccgagcugagaaucagagagggcagcggcuacuucuuccugaacaccagcaccgccgacguggugaagguggccuaccaggaggccagaggcguggccauggugcacccccugcugcccggcagcagcaccaucaugauccacgaccugugccugguguuccccgcccccgccaaggccgugguguacgugagcgacauccaggagcuguacaucagagugguggacaagguggagaucggcaagaccgugaaggccuacgugagagugcuggaccugcacaagaagcccuuccuggccaaguacuuccccuucauggaccugaagcugagagccgccagccccaucaucacccugguggcccuggacgaggcccuggacaacuacaccaucaccuuccugaucagaggcguggccaucggccagaccagccugaccgccagcgugaccaacaaggccggccagagaaucaacagcgccccccagcagaucgagguguucccccccuucagacugaugcccagaaaggugacccugcugaucggcgccaccaugcaggugaccagcgagggcggcccccagccccagagcaacauccuguucagcaucagcaacgagagcguggcccuggugagcgccgccggccuggugcagggccuggccaucggcaacggcaccgugagcggccuggugcaggccguggacgccgagaccggcaagguggugaucaucagccaggaccuggugcagguggaggugcugcugcugagagccgugagaaucagagcccccaucaugagaaugagaaccggcacccagaugcccaucuacgugaccggcaucaccaaccaccagaaccccuucagcuucggcaacgccgugcccggccugaccuuccacuggagcgugaccaagagagacgugcuggaccugagaggcagacaccacgaggccagcaucagacugcccagccaguacaacuucgccaugaacgugcugggcagagugaagggcagaaccggccugagagugguggugaaggccguggaccccaccagcggccagcuguacggccuggccagagagcugagcgacgagauccaggugcagguguucgagaagcugcagcugcugaaccccgagaucgaggccgagcagauccugaugagccccaacagcuacaucaagcugcagaccaacagagacggcgccgccagccugagcuacagagugcuggacggccccgagaaggugcccguggugcacguggacgagaagggcuuccuggccagcggcagcaugaucggcaccagcaccaucgaggugaucgcccaggagcccuucggcgccaaccagaccaucaucguggccgugaaggugagccccgugagcuaccugagagugagcaugagccccgugcugcacacccagaacaaggaggcccugguggccgugccccugggcaugaccgugaccuucaccgugcacuuccacgacaacagcggcgacguguuccacgcccacagcagcgugcugaacuucgccaccaacagagacgacuucgugcagaucggcaagggccccaccaacaacaccugcguggugagaaccgugagcgugggccugacccugcugagagugugggacgccgagcaccccggccugagcgacuucaugccccugcccgugcugcaggccaucagccccgagcugagcggcgccaugguggugggcgacgugcugugccuggccaccgugcugaccagccuggagggccugagcggcaccuggagcagcagcgccaacagcauccugcacaucgaccccaagaccggcguggccguggccagagccgugggcagcgugaccguguacuacgagguggccggccaccugagaaccuacaaggaggugguggugagcgugccccagagaaucauggccagacaccugcaccccauccagaccagcuuccaggaggccaccgccagcaaggugaucguggccgugggcgacagaagcagcaaccugagaggcgagugcacccccacccagagagaggugauccaggcccugcaccccgagacccugaucagcugccagagccaguucaagcccgccguguucgacuuccccagccaggacguguucaccguggagccccaguucgacaccgcccugggccaguacuucugcagcaucaccaugcacagacugaccgacaagcagagaaagcaccugagcaugaagaagaccgcccugguggugagcgccagccugagcagcagccacuucagcaccgagcaggugggcgccgaggugcccuucagccccggccuguucgccgaccaggccgagauccugcugagcaaccacuacaccagcagcgagaucagaguguucggcgcccccgaggugcuggagaaccuggaggugaagagcggcagccccgccgugcuggccuucgccaaggagaagagcuucggcuggcccagcuucaucaccuacaccgugggcgugcuggaccccgccgccggcagccagggcccccugagcaccacccugaccuucagcagccccgugaccaaccaggccaucgccauccccgugaccguggccuucgugguggacagaagaggccccggccccuacggcgccagccuguuccagcacuuccuggacagcuaccaggugauguucuucacccuguucgcccugcuggccggcaccgccgugaugaucaucgccuaccacaccgugugcacccccagagaccuggccgugcccgccgcccugacccccagagccagccccggccacagcccccacuacuucgccgccagcagccccaccagccccaacgcccugccccccgccagaaaggccagcccccccagcggccuguggagccccgccuacgccagccacuaa

SEQ ID NO: 20830 - RNA, 6273 nt, Artificial Sequence
  NUP214__Homo_sapiens__NP_005076
augggcgacgagauggacgccaugauccccgagagagagaugaaggacuuccaguucagagcccugaagaaggugagaaucuucgacagccccgaggagcugcccaaggagagaagcagccugcuggccgugagcaacaaguacggccugguguucgccggcggcgccagcggccugcagaucuuccccaccaagaaccugcugauccagaacaagcccggcgacgaccccaacaagaucguggacaaggugcagggccugcuggugcccaugaaguuccccauccaccaccuggcccugagcugcgacaaccugacccugagcgccugcaugaugagcagcgaguacggcagcaucaucgccuucuucgacgugagaaccuucagcaacgaggccaagcagcagaagagacccuucgccuaccacaagcugcugaaggacgccggcggcauggugaucgacaugaaguggaaccccaccgugcccagcaugguggccgugugccuggccgacggcagcaucgccgugcugcaggugaccgagaccgugaaggugugcgccacccugcccagcaccguggccgugaccagcgugugcuggagccccaagggcaagcagcuggccgugggcaagcagaacggcaccguggugcaguaccugcccacccugcaggagaagaaggugauccccugcccccccuucuacgagagcgaccaccccgugagagugcuggacgugcuguggaucggcaccuacguguucgccaucguguacgccgccgccgacggcacccuggagaccagccccgacguggugauggcccugcugcccaagaaggaggagaagcaccccgagaucuucgugaacuucauggagcccugcuacggcagcugcaccgagagacagcaccacuacuaccugagcuacaucgaggagugggaccuggugcuggccgccagcgccgccagcaccgaggugagcauccuggccagacagagcgaccagaucaacugggagagcuggcugcuggaggacagcagcagagccgagcugcccgugaccgacaagagcgacgacagccugcccaugggcguggugguggacuacaccaaccagguggagaucaccaucagcgacgagaagacccugccccccgcccccgugcugaugcugcugagcaccgacggcgugcugugccccuucuacaugaucaaccagaaccccggcgugaagagccugaucaagacccccgagagacugagccuggagggcgagagacagcccaagagccccggcagcacccccaccacccccaccagcagccaggccccccagaagcuggacgccagcgccgccgccgcccccgccagccugccccccagcagccccgccgcccccaucgccaccuucagccugcugcccgccggcggcgcccccaccguguucagcuucggcagcagcagccugaagagcagcgccaccgugaccggcgagccccccagcuacagcagcggcagcgacagcagcaaggccgcccccggccccggccccagcaccuucagcuucgugccccccagcaaggccagccuggcccccacccccgccgccagccccguggcccccagcgccgccagcuucagcuucggcagcagcggcuucaagcccacccuggagagcacccccgugcccagcgugagcgcccccaacaucgccaugaagcccagcuucccccccagcaccagcgccgugaaggugaaccugagcgagaaguucaccgccgccgccaccagcacccccgugagcagcagccagagcgccccccccaugagccccuucagcagcgccagcaagcccgccgccagcggcccccugagccaccccaccccccugagcgccccccccagcagcgugccccugaagagcagcgugcugcccagccccagcggcagaagcgcccagggcagcagcagccccgugcccagcauggugcagaagagccccagaaucaccccccccgccgccaagcccggcagcccccaggccaagagccugcagcccgccguggccgagaagcagggccaccaguggaaggacagcgaccccgugauggccggcaucggcgaggagaucgcccacuuccagaaggagcuggaggagcugaaggccagaaccagcaaggccugcuuccaggugggcaccagcgaggagaugaagaugcugagaaccgagagcgacgaccugcacaccuuccugcuggagaucaaggagaccaccgagagccugcacggcgacaucagcagccugaagaccacccugcuggagggcuucgccggcguggaggaggccagagagcagaacgagagaaacagagacagcggcuaccugcaccugcuguacaagagaccccuggaccccaagagcgaggcccagcugcaggagaucagaagacugcaccaguacgugaaguucgccgugcaggacgugaacgacgugcuggaccuggagugggaccagcaccuggagcagaagaagaagcagagacaccugcuggugcccgagagagagacccuguucaacacccuggccaacaacagagagaucaucaaccagcagagaaagagacugaaccaccugguggacagccugcagcagcugagacuguacaagcagaccagccuguggagccugagcagcgccgugcccagccagagcagcauccacagcuucgacagcgaccuggagagccugugcaacgcccugcugaagaccaccaucgagagccacaccaagagccugcccaaggugcccgccaagcugagccccaugaagcaggcccagcugagaaacuuccuggccaagagaaagaccccccccgugagaagcaccgcccccgccagccugagcagaagcgccuuccugagccagagauacuacgaggaccuggacgaggugagcagcaccagcagcgugagccagagccuggagagcgaggacgccagaaccagcugcaaggacgacgaggccguggugcaggcccccagacacgcccccguggugagaacccccagcauccagcccagccugcugccccacgccgcccccuucgccaagagccaccuggugcacggcagcagccccggcgugaugggcaccagcguggccaccagcgccagcaagaucaucccccagggcgccgacagcaccaugcuggccaccaagaccgugaagcacggcgcccccagccccagccaccccaucagcgccccccaggccgccgccgccgccgcccugagaagacagauggccagccaggcccccgccgugaacacccugaccgagagcacccugaagaacgugccccagguggugaacgugcaggagcugaagaacaaccccgccacccccagcaccgccaugggcagcagcgugcccuacagcaccgccaagaccccccaccccgugcugacccccguggccgccaaccaggccaagcagggcagccugaucaacagccugaagcccagcggccccacccccgccagcggccagcugagcagcggcgacaaggccagcggcaccgccaagaucgagaccgccgugaccagcacccccagcgccagcggccaguucagcaagcccuucagcuucagccccagcggcaccggcuucaacuucggcaucaucacccccacccccagcagcaacuucaccgccgcccagggcgccacccccagcaccaaggagagcagccagcccgacgccuucagcagcggcggcggcagcaagcccagcuacgaggccauccccgagagcagcccccccagcggcaucaccagcgccagcaacaccacccccggcgagcccgccgccagcagcagcagacccguggcccccagcggcaccgcccugagcaccaccagcagcaagcuggagaccccccccagcaagcugggcgagcugcuguuccccagcagccuggccggcgagacccugggcagcuucagcggccugagagugggccaggccgacgacagcaccaagcccaccaacaaggccagcagcaccagccugaccagcacccagcccaccaagaccagcggcgugcccagcggcuucaacuucaccgccccccccgugcugggcaagcacaccgagccccccgugaccagcagcgccaccaccaccagcguggccccccccgccgccaccagcaccagcagcaccgccguguucggcagccugcccgugaccagcgccggcagcagcggcgugaucagcuucggcggcaccagccugagcgccggcaagaccagcuucagcuucggcagccagcagaccaacagcaccgugccccccagcgcccccccccccaccaccgccgccaccccccugcccaccagcuuccccacccugagcuucggcagccugcugagcagcgccaccacccccagccugcccaugagcgccggcagaagcaccgaggaggccaccagcagcgcccugcccgagaagcccggcgacagcgaggugagcgccagcgccgccagccugcuggaggagcagcagagcgcccagcugccccaggcccccccccagaccagcgacagcgugaagaaggagcccgugcuggcccagcccgccgugagcaacagcggcaccgccgccagcagcaccagccugguggcccugagcgccgaggccacccccgccaccaccggcgugcccgacgccagaaccgaggccgugccccccgccagcagcuucagcgugcccggccagaccgccgugaccgccgccgccaucagcagcgccggccccguggccguggagaccagcagcacccccaucgccagcagcaccaccagcaucguggcccccggccccagcgccgaggccgccgccuucggcaccgugaccagcggcagcagcguguucgcccagccccccgccgccagcagcagcagcgccuucaaccagcugaccaacaacaccgccaccgcccccagcgccacccccguguucggccagguggccgccagcaccgcccccagccuguucggccagcagaccggcagcaccgccagcaccgccgccgccaccccccaggugagcagcagcggcuucagcagccccgccuucggcaccaccgcccccggcguguucggccagaccaccuucggccaggccagcguguucggccagagcgccagcagcgccgccagcguguucagcuucagccagcccggcuucagcagcgugcccgccuucggccagcccgccagcagcacccccaccagcaccagcggcagcguguucggcgccgccagcagcaccagcagcagcagcagcuucagcuucggccagagcagccccaacaccggcggcggccuguucggccagagcaacgcccccgccuucggccagagccccggcuucggccagggcggcagcguguucggcggcaccagcgccgccaccaccaccgccgccaccagcggcuucagcuucugccaggccagcggcuucggcagcagcaacaccggcagcguguucggccaggccgccagcaccggcggcaucguguucggccagcagagcagcagcagcagcggcagcguguucggcagcggcaacaccggcagaggcggcggcuucuucagcggccugggcggcaagcccagccaggacgccgccaacaagaaccccuucagcagcgccagcggcggcuucggcagcaccgccaccagcaacaccagcaaccuguucggcaacagcggcgccaagaccuucggcggcuucgccagcagcagcuucggcgagcagaagcccaccggcaccuucagcagcggcggcggcagcguggccagccagggcuucggcuucagcagccccaacaagaccggcggcuucggcgccgcccccguguucggcagcccccccaccuucggcggcagccccggcuucggcggcgugcccgccuucggcagcgcccccgccuucaccagcccccugggcagcaccggcggcaagguguucggcgagggcaccgccgccgccagcgccggcggcuucggcuucggcagcagcagcaacaccaccagcuucggcacccuggccagccagaacgcccccaccuucggcagccugagccagcagaccagcggcuucggcacccagagcagcggcuucagcggcuucggcagcggcaccggcggcuucagcuucggcagcaacaacagcagcgugcagggcuucggcggcuggagaagcuaa

SEQ ID NO: 20831 - RNA, 930 nt, Artificial Sequence
  NUP35__Homo_sapiens__NP_001274513
augaugcugggcagccccaccagccccaagcccggcgugaacgcccaguuccugcccggcuuccugaugggcgaccugcccgcccccgugaccccccagcccagaagcaucagcggccccagcgugggcgugauggagaugagaagcccccugcuggccggcggcagccccccccagcccguggugcccgcccacaaggacaagagcggcgccccccccgugagaagcaucuacgacgacaucagcagccccggccugggcagcaccccccugaccagcagaagacagcccaacaucagcgugaugcagagcccccuggugggcgugaccagcacccccggcaccggccagagcauguucagccccgccagcaucggccagcccagaaagaccacccugagccccgcccagcuggaccccuucuacacccagggcgacagccugaccagcgaggaccaccuggacgacagcugggugaccguguucggcuucccccaggccagcgccagcuacauccugcugcaguucgcccaguacggcaacauccugaagcacgugaugagcaacaccggcaacuggaugcacaucagauaccagagcaagcugcaggccagaaaggcccugagcaaggacggcagaaucuucggcgagagcaucaugaucggcgugaagcccugcaucgacaagagcgugauggagagcagcgacagaugcgcccugagcagccccagccuggccuucaccccccccaucaagacccugggcacccccacccagcccggcagcacccccagaaucagcaccaugagaccccuggccaccgccuacaaggccagcaccagcgacuaccaggugaucagcgacagacagacccccaagaaggacgagagccuggugagcaaggccauggaguacauguucggcugguaa

SEQ ID NO: 20832 - RNA, 981 nt, Artificial Sequence
  NUP37__Homo_sapiens__NP_076962
augaagcaggacgccagcagaaacgccgccuacaccguggacugcgaggacuacgugcacgugguggaguucaaccccuucgagaacggcgacagcggcaaccugaucgccuacggcggcaacaacuacguggugaucggcaccugcaccuuccaggaggaggaggccgacguggagggcauccaguacaagacccugagaaccuuccaccacggcgugagaguggacggcaucgccuggagccccgagaccagacuggacagccugccccccgugaucaaguucugcaccagcgccgccgacaugaagaucagacuguucaccagcgaccugcaggacaagaacgaguacaaggugcuggagggccacaccgacuucaucaacggccugguguucgaccccaaggagggccaggagaucgccagcgugagcgacgaccacaccugcagaaucuggaaccuggagggcgugcagaccgcccacuucgugcugcacagccccggcaugagcgugugcuggcaccccgaggagaccuucaagcugaugguggccgagaagaacggcaccaucagauucuacgaccugcuggcccagcaggccauccugagccuggagagcgagcaggugccccugaugagcgcccacuggugccugaagaacaccuucaaggugggcgccguggccggcaacgacuggcugaucugggacaucaccagaagcagcuacccccagaacaagagacccgugcacauggacagagccugccuguucagauggagcaccaucagcgagaaccuguucgccaccaccggcuaccccggcaagauggccagccaguuccagauccaccaccugggccacccccagcccauccugaugggcagcguggccgugggcagcggccugagcuggcacagaacccugccccugugcgugaucggcggcgaccacaagcugcuguucugggugaccgagguguaa

SEQ ID NO: 20833 - RNA, 1143 nt, Artificial Sequence
  NUP43__Homo_sapiens__NP_942590
auggaggagaucuacgccaaguucgugagccagaagaucagcaagaccagauggagaccccugccccccggcagccugcagaccgccgagaccuucgccaccggcagcugggacaacgaggagaacuacaucagccuguggagcaucggcgacuucggcaaccuggacagcgacggcggcuucgagggcgaccaccagcugcugugcgacaucagacaccacggcgacgugauggaccugcaguucuucgaccaggagagaaucguggccgccagcagcaccggcugcgugaccguguuccugcaccaccccaacaaccagacccugagcgugaaccagcaguggaccaccgcccacuaccacaccggccccggcagccccagcuacagcagcgcccccugcaccggcguggugugcaacaaccccgagaucgugaccgugggcgaggacggcagaaucaaccuguucagagccgaccacaaggaggccgugagaaccaucgacaacgccgacagcagcacccugcacgccgugaccuuccugagaacccccgagauccugaccgugaacagcaucggccagcugaagaucugggacuucagacagcagggcaacgagcccagccagauccugagccugaccggcgacagagugccccugcacugcguggacagacaccccaaccagcagcacgugguggccaccggcggccaggacggcaugcugagcaucugggacgugagacagggcaccaugcccgugagccugcugaaggcccacgaggccgagaugugggaggugcacuuccaccccagcaaccccgagcaccuguucaccugcagcgaggacggcagccuguggcacugggacgccagcaccgacgugcccgagaagagcagccuguuccaccagggcggcagaagcagcaccuuccugagccacagcaucagcaaccaggccaacgugcaccagagcgugaucagcagcuggcugagcaccgaccccgccaaggacagaaucgagaucaccagccugcugcccagcagaagccugagcgugaacacccuggacgugcugggccccugccuggugugcggcaccgacgccgaggccaucuacgugaccagacaccuguucagcuaa

SEQ ID NO: 20834 - RNA, 1323 nt, Artificial Sequence
  NUP50__Homo_sapiens__XP_005261370
auggccagcgaggaggugcugaagaacagagccaucaagaaggccaagagaagaaacgugggcuucgagagcgacaccggcggcgccuucaagggcuucaagggccugguggugcccagcggcggcggcagauucagcggcuucggcagcggcgccggcggcaagccccuggagggccugagcaacggcaacaacaucaccagcgccccccccuucgccagcgccaaggccgccgccgaccccaagguggccuucggcagccuggccgccaacggccccaccacccugguggacaaggugagcaaccccaagaccaacggcgacagccagcagcccagcagcagcggccuggccagcagcaaggccugcgugggcaacgccuaccacaagcagcuggccgcccugaacugcagcgugagagacuggaucgugaagcacgugaacaccaacccccugugcgaccugacccccaucuucaaggacuacgagaaguaccuggccaacaucgagcagcagcacggcaacagcggcagaaacagcgagagcgagagcaacaagguggccgccgagacccagagccccagccuguucggcagcaccaagcugcagcaggagagcaccuuccuguuccacggcaacaagaccgaggacacccccgacaagaagauggagguggccagcgagaagaagaccgaccccagcagccugggcgccaccagcgccagcuucaacuucggcaagaagguggacagcagcgugcugggcagccugagcagcgugccccugaccggcuucagcuucagccccggcaacagcagccuguucggcaaggacaccacccagagcaagcccgugagcagccccuuccccaccaagccccuggagggccaggccgagggcgacagcggcgagugcaagggcggcgacgaggaggagaacgacgagccccccaaggugguggugaccgaggugaaggaggaggacgccuucuacagcaagaagugcaagcuguucuacaagaaggacaacgaguucaaggagaagggcaucggcacccugcaccugaagcccaccgccaaccagaagacccagcugcuggugagagccgacaccaaccugggcaacauccugcugaacgugcugaucccccccaacaugcccugcaccagaaccggcaagaacaacgugcugaucgugugcgugcccaacccccccaucgacgagaagaacgccaccaugcccgugaccaugcugaucagagugaagaccagcgaggacgccgacgagcugcacaagauccugcuggagaagaaggacgccuaa

SEQ ID NO: 20835 - RNA, 1569 nt, Artificial Sequence
  NUP62__Homo_sapiens__NP_001180286
augagcggcuucaacuucggcggcaccggcgcccccaccggcggcuucaccuucggcaccgccaagaccgccaccaccacccccgccaccggcuucagcuucagcaccagcggcaccggcggcuucaacuucggcgcccccuuccagcccgccaccagcacccccagcaccggccuguucagccuggccacccagacccccgccacccagaccaccggcuucaccuucggcaccgccacccuggccagcggcggcaccggcuucagccugggcaucggcgccagcaagcugaaccugagcaacaccgccgccacccccgccauggccaaccccagcggcuucggccugggcagcagcaaccugaccaacgccaucagcagcaccgugaccagcagccagggcaccgcccccaccggcuucguguucggccccagcaccaccagcguggcccccgccaccaccagcggcggcuucagcuucaccggcggcagcaccgcccagcccagcggcuucaacaucggcagcgccggcaacagcgcccagcccaccgcccccgccacccugcccuucacccccgccacccccgccgccaccaccgccggcgccacccagcccgccgcccccacccccaccgccaccaucaccagcaccggccccagccuguucgccagcaucgccaccgcccccaccagcagcgccaccaccggccugagccugugcacccccgugaccaccgccggcgcccccaccgccggcacccagggcuucagccugaaggcccccggcgccgccagcggcaccagcaccaccaccagcaccgccgccaccgccaccgccaccaccaccagcagcagcagcaccaccggcuucgcccugaaccugaagccccuggcccccgccggcauccccagcaacaccgccgccgccgugaccgccccccccggccccggcgccgccgccggcgccgccgccagcagcgccaugaccuacgcccagcuggagagccugaucaacaaguggagccuggagcuggaggaccaggagagacacuuccugcagcaggccacccaggugaacgccugggacagaacccugaucgagaacggcgagaagaucaccagccugcacagagagguggagaaggugaagcuggaccagaagagacuggaccaggagcuggacuucauccugagccagcagaaggagcuggaggaccugcugagcccccuggaggagcuggugaaggagcagagcggcaccaucuaccugcagcacgccgacgaggagagagagaagaccuacaagcuggccgagaacaucgacgcccagcugaagagaauggcccaggaccugaaggacaucaucgagcaccugaacaccagcggcgcccccgccgacaccagcgacccccugcagcagaucugcaagauccugaacgcccacauggacagccugcaguggaucgaccagaacagcgcccugcugcagagaaagguggaggaggugaccaaggugugcgagggcagaagaaaggagcaggagagaagcuucagaaucaccuucgacuaa

SEQ ID NO: 20836 - RNA, 1833 nt, Artificial Sequence
  NUP85__Homo_sapiens__NP_001290205
auggugcccagcugccccuucaucuacaucaucagaaaggacguggacguguacagccagauccugagaaagcuguucaacgagagccacggcaucuuccugggccugcagagaaucgacgaggagcugaccggcaagagcagaaagagccagcuggugagagugagcaagaacuacagaagcgugaucagagccugcauggaggagaugcaccagguggccaucgccgccaaggaccccgccaacggcagacaguucagcagccaggugagcauccugagcgccauggagcugaucuggaaccugugcgagauccuguucaucgagguggcccccgccggcccccugcugcugcaccugcuggacugggugagacugcacgugugcgagguggacagccugagcgccgacgugcugggcagcgagaaccccagcaagcacgacagcuucuggaaccuggugaccauccuggugcugcagggcagacuggacgaggccagacagaugcugagcaaggaggccgacgccagccccgccagcgccggcaucugcagaaucaugggcgaccugaugagaaccaugcccauccugagccccggcaacacccagacccugaccgagcuggagcugaaguggcagcacuggcacgaggagugcgagagauaccugcaggacagcaccuucgccaccagcccccaccuggagagccugcugaagaucaugcugggcgacgaggccgcccugcuggagcagaaggagcugcugagcaacugguaccacuuccuggugaccagacugcuguacagcaaccccaccgugaagcccaucgaccugcacuacuacgcccagagcagccuggaccuguuccugggcggcgagagcagccccgagccccuggacaacauccugcuggccgccuucgaguucgacauccaccaggugaucaaggagugcagcaucgcccugagcaacuggugguucguggcccaccugaccgaccugcuggaccacugcaagcugcugcagagccacaaccuguacuucggcagcaacaugagagaguuccugcugcuggaguacgccagcggccuguucgcccaccccagccuguggcagcugggcguggacuacuucgacuacugccccgagcugggcagagugagccuggagcugcacaucgagagaaucccccugaacaccgagcagaaggcccugaaggugcugagaaucugcgagcagagacagaugaccgagcaggugagaagcaucugcaagauccuggccaugaaggccgugagaaacaacagacugggcagcgcccugagcuggagcaucagagccaaggacgccgccuucgccacccuggugagcgacagauuccugagagacuacugcgagagaggcugcuucagcgaccuggaccugaucgacaaccugggccccgccaugaugcugagcgacagacugaccuuccugggcaaguacagagaguuccacagaauguacggcgagaagagauucgccgacgccgccagccugcugcugagccugaugaccagcagaaucgcccccagaagcuucuggaugacccugcugaccgacgcccugccccugcuggagcagaagcaggugaucuucagcgccgagcagaccuacgagcugaugagaugccuggaggaccugaccagcagaagacccgugcacggcgagagcgacaccgagcagcugcaggacgacgacaucgagaccaccaagguggagaugcugagacugagccuggccagaaaccuggccagagccaucaucagagagggcagccuggagggcagcuaa

SEQ ID NO: 20837 - RNA, 2226 nt, Artificial Sequence
  NUP88__Homo_sapiens__NP_002523
auggccgccgccgagggccccgugggcgacggcgagcuguggcagaccuggcugcccaaccacgugguguuccugagacugagagagggccugaagaaccagagccccaccgaggccgagaagcccgccagcagcagccugcccagcagcccccccccccagcugcugaccagaaacgugguguucggccugggcggcgagcuguuccugugggacggcgaggacagcagcuuccugguggugagacugagaggccccagcggcggcggcgaggagcccgcccugagccaguaccagagacugcugugcaucaaccccccccuguucgagaucuaccaggugcugcugagccccacccagcaccacguggcccugaucggcaucaagggccugauggugcuggagcugcccaagagauggggcaagaacagcgaguucgagggcggcaagagcaccgugaacugcagcaccacccccguggccgagagauucuucaccagcagcaccagccugacccugaagcacgccgccugguaccccagcgagauccuggacccccacguggugcugcugaccagcgacaacgugaucagaaucuacagccugagagagccccagacccccaccaacgugaucauccugagcgaggccgaggaggagagccuggugcugaacaagggcagagccuacaccgccagccugggcgagaccgccguggccuucgacuucggcccccuggccgccgugcccaagacccuguucggccagaacggcaaggacgaggugguggccuacccccuguacauccuguacgagaacggcgagaccuuccugaccuacaucagccugcugcacagccccggcaacaucggcaagcugcugggcccccugcccaugcaccccgccgccgaggacaacuacggcuacgacgccugcgccgugcugugccugcccugcgugcccaacauccuggugaucgccaccgagagcggcaugcuguaccacugcguggugcuggagggcgaggaggaggacgaccacaccagcgagaagagcugggacagcagaaucgaccugauccccagccuguacguguucgagugcguggagcuggagcuggcccugaagcuggccagcggcgaggacgaccccuucgacagcgacuucagcugccccgugaagcugcacagagaccccaagugccccagcagauaccacugcacccacgaggccggcgugcacagcgugggccugaccuggauccacaagcugcacaaguuccugggcagcgacgaggaggacaaggacagccugcaggagcugagcaccgagcagaagugcuucguggagcacauccugugcaccaagccccugcccugcagacagcccgcccccaucagaggcuucuggaucgugcccgacauccugggccccaccaugaucugcaucaccagcaccuacgagugccugaucuggccccugcugagcaccgugcaccccgccagccccccccugcugugcaccagagaggacguggagguggccgagagcccccugagagugcuggccgagacccccgacagcuucgagaagcacaucagaagcauccugcagagaagcguggccaaccccgccuuccugaaggccagcgagaaggacaucgcccccccccccgaggagugccugcagcugcugagcagagccacccagguguucagagagcaguacauccugaagcaggaccuggccaaggaggagauccagagaagagugaagcugcugugcgaccagaagaagaagcagcuggaggaccugagcuacugcagagaggagagaaagagccugagagagauggccgagagacuggccgacaaguacgaggaggccaaggagaagcaggaggacaucaugaacagaaugaagaagcugcugcacagcuuccacagcgagcugcccgugcugagcgacagcgagagagacaugaagaaggagcugcagcugauccccgaccagcugagacaccugggcaacgccaucaagcaggugaccaugaagaaggacuaccagcagcagaagauggagaaggugcugagccugcccaagcccaccaucauccugagcgccuaccagagaaagugcauccagagcauccugaaggaggagggcgagcacaucagagagauggugaagcagaucaacgacaucagaaaccacgugaacuucuaa

SEQ ID NO: 20838 - RNA, 2460 nt, Artificial Sequence
  NUP93__Homo_sapiens__XP_005256320
auggacaccgagggcuucggcgagcugcugcagcaggccgagcagcuggccgccgagaccgagggcaucagcgagcugccccacguggagagaaaccugcaggagauccagcaggccggcgagagacugagaagcagaacccugaccagaaccagccaggagaccgccgacgugaaggccagcgugcugcugggcagcagaggccuggacaucagccacaucagccagagacuggagagccugagcgccgccaccaccuucgagccccuggagcccgugaaggacaccgacauccagggcuuccugaagaacgagaaggacaacgcccugcugagcgccaucgaggagagcagaaagagaaccuucggcauggccgaggaguaccacagagagagcaugcugguggagugggagcaggugaagcagagaauccugcacacccugcuggccagcggcgaggacgcccuggacuucacccaggagagcgagcccagcuacaucagcgacgugggcccccccggcagaagcagccuggacaacaucgagauggccuacgccagacagaucuacaucuacaacgagaagaucgugaacggccaccugcagcccaaccugguggaccugugcgccagcguggccgagcuggacgacaagagcaucagcgacauguggaccauggugaagcagaugaccgacgugcugcugacccccgccaccgacgcccugaagaacagaagcagcguggaggugagaauggaguucgugagacaggcccuggccuaccuggagcagagcuacaagaacuacacccuggugaccguguucggcaaccugcaccaggcccagcugggcggcgugcccggcaccuaccagcuggugagaagcuuccugaacaucaagcugcccgccccccugcccggccugcaggacggcgagguggagggccaccccgugugggcccugaucuacuacugcaugagaugcggcgaccugcuggccgccagccagguggugaacagagcccagcaccagcugggcgaguucaagaccugguuccaggaguacaugaacagcaaggacagaagacugagccccgccaccgagaacaagcugagacugcacuacagaagagcccugagaaacaacaccgaccccuacaagagagccguguacugcaucaucggcagaugcgacgugaccgacaaccagagcgagguggccgacaagaccgaggacuaccuguggcugaagcugaaccaggugugcuucgacgacgacggcaccagcagcccccaggacagacugacccugagccaguuccagaagcagcugcuggaggacuacggcgagagccacuucaccgugaaccagcagcccuuccuguacuuccaggugcuguuccugaccgcccaguucgaggccgccguggccuuccuguucagaauggagagacugagaugccacgccgugcacguggcccuggugcuguucgagcugaagcugcugcugaagagcagcggccagagcgcccagcugcugagccacgagcccggcgacccccccugccugagaagacugaacuucgugagacugcugaugcuguacaccagaaaguucgagagcaccgaccccagagaggcccugcaguacuucuacuuccugagagacgagaaggacagccagggcgagaacauguuccugagaugcgugagcgagcuggugaucgagagcagagaguucgacaugauccugggcaagcuggagaacgacggcagcagaaagcccggcgugaucgacaaguucaccagcgacaccaagcccaucaucaacaagguggccagcguggccgagaacaagggccuguucgaggaggccgccaagcuguacgaccuggccaagaacgccgacaaggugcuggagcugaugaacaagcugcugagccccguggugccccagaucagcgccccccagagcaacaaggagagacugaagaacauggcccugagcaucgccgagagauacagagcccagggcaucagcgccaacaaguucguggacagcaccuucuaccugcugcuggaccugaucaccuucuucgacgaguaccacagcggccacaucgacagagccuucgacaucaucgagagacugaagcuggugccccugaaccaggagagcguggaggagagaguggccgccuucagaaacuucagcgacgagaucagacacaaccugagcgaggugcugcuggccaccaugaacauccuguucacccaguucaagagacugaagggcaccagccccagcagcagcagcagaccccagagagugaucgaggacagagacagccagcugagaagccaggccagaacccugaucaccuucgccggcaugauccccuacagaaccagcggcgacaccaacgccagacuggugcagauggaggugcugaugaacuaa

SEQ ID NO: 20839 - RNA, 2814 nt, Artificial Sequence
  NUP98__Homo_sapiens__NP_005378
auguucaacaagagcuucggcacccccuucggcggcggcaccggcggcuucggcaccaccagcaccuucggccagaacaccggcuucggcaccaccagcggcggcgccuucggcaccagcgccuucggcagcagcaacaacaccggcggccuguucggcaacagccagaccaagcccggcggccuguucggcaccagcagcuucagccagcccgccaccagcaccagcaccggcuucggcuucggcaccagcaccggcaccgccaacacccuguucggcaccgccagcaccggcaccagccuguucagcagccagaacaacgccuucgcccagaacaagcccaccggcuucggcaacuucggcaccagcaccagcagcggcggccuguucggcaccaccaacaccaccagcaaccccuucggcagcaccagcggcagccuguucggccccagcagcuucaccgccgcccccaccggcaccaccaucaaguucaacccccccaccggcaccgacaccauggugaaggccggcgugagcaccaacaucagcaccaagcaccagugcaucaccgccaugaaggaguacgagagcaagagccuggaggagcugagacuggaggacuaccaggccaacagaaagggcccccagaaccaggugggcgccggcaccaccaccggccuguucggcagcagccccgccaccagcagcgccaccggccuguucagcagcagcaccaccaacagcggcuucgccuacggccagaacaagaccgccuucggcaccagcaccaccggcuucggcaccaaccccggcggccuguucggccagcagaaccagcagaccaccagccuguucagcaagcccuucggccaggccaccaccacccagaacaccggcuucagcuucggcaacaccagcaccaucggccagcccagcaccaacaccaugggccuguucggcgugacccaggccagccagcccggcggccuguucggcaccgccaccaacaccagcaccggcaccgccuucggcaccggcaccggccuguucggccagaccaacaccggcuucggcgccgugggcagcacccuguucggcaacaacaagcugaccaccuucggcagcagcaccaccagcgcccccagcuucggcaccaccagcggcggccuguucggcaacaagcccacccugacccugggcaccaacaccaacaccagcaacuucggcuucggcaccaacaccagcggcaacagcaucuucggcagcaagcccgcccccggcacccugggcaccggccugggcgccggcuucggcaccgcccugggcgccggccaggccagccuguucggcaacaaccagcccaagaucggcggcccccugggcaccggcgccuucggcgcccccggcuucaacaccaccaccgccacccugggcuucggcgccccccaggcccccguggcccugaccgaccccaacgccagcgccgcccagcaggccgugcugcagcagcacaucaacagccugaccuacagccccuucggcgacagcccccuguucagaaaccccaugagcgaccccaagaagaaggaggagagacugaagcccaccaaccccgccgcccagaaggcccugaccacccccacccacuacaagcugacccccagacccgccaccagagugagacccaaggcccugcagaccaccggcaccgccaagagccaccuguucgacggccuggacgacgacgagcccagccuggccaacggcgccuucaugcccaagaagagcaucaagaagcuggugcugaagaaccugaacaacagcaaccuguucagccccgugaacagagacagcgagaaccuggccagccccagcgaguaccccgagaacggcgagagauucagcuuccugagcaagcccguggacgagaaccaccagcaggacggcgacgaggacagccuggugagccacuucuacaccaaccccaucgccaagcccaucccccagacccccgagagcgccggcaacaagcacagcaacagcaacagcguggacgacaccaucguggcccugaacaugagagccgcccugagaaacggccuggagggcagcagcgaggagaccagcuuccacgacgagagccugcaggacgacagagaggagaucgagaacaacagcuaccacaugcaccccgccggcaucauccugaccaaggugggcuacuacaccauccccagcauggacgaccuggccaagaucaccaacgagaagggcgagugcaucgugagcgacuucaccaucggcagaaagggcuacggcagcaucuacuucgagggcgacgugaaccugaccaaccugaaccuggacgacaucgugcacaucagaagaaaggagguggugguguaccuggacgacaaccagaagccccccgugggcgagggccugaacagaaaggccgaggugacccuggacggcguguggcccaccgacaagaccagcagaugccugaucaagagccccgacagacuggccgacaucaacuacgagggcagacuggaggccgugagcagaaagcagggcgcccaguucaaggaguacagacccgagaccggcagcuggguguucaaggugagccacuucagcaaguacggccugcaggacagcgacgaggaggaggaggagcaccccagcaagaccagcaccaagaagcugaagaccgccccccugccccccgccagccagaccaccccccugcagauggcccugaacggcaagcccgccccccccccccagguggagaagaagggccaguaa

SEQ ID NO: 20840 - RNA, 1272 nt, Artificial Sequence
  NUPL2__Homo_sapiens__NP_031368
auggccaucugccaguucuuccugcagggcagaugcagauucggcgacagaugcuggaacgagcaccccggcgccagaggcgccggcggcggcagacagcagccccagcagcagcccagcggcaacaacagaagaggcuggaacaccaccagccagagauacagcaacgugauccagcccagcagcuucagcaagagcacccccuggggcggcagcagagaccaggagaagcccuacuucagcagcuucgacagcggcgccagcaccaacagaaaggagggcuucggccugagcgagaaccccuucgccagccugagccccgacgagcagaaggacgagaagaagcugcuggagggcaucgugaaggacauggaggugugggagagcagcggccaguggauguucagcguguacagccccgugaagaagaagcccaacaucagcggcuucaccgacaucagccccgaggagcugagacuggaguaccacaacuuccugaccagcaacaaccugcagagcuaccugaacagcgugcagagacugaucaaccaguggagaaacagagugaacgagcugaagagccugaacaucagcaccaagguggcccugcugagcgacgugaaggacggcgugaaccaggccgcccccgccuucggcuucggcagcagccaggccgccaccuucaugagccccggcuuccccgugaacaacagcagcagcgacaacgcccagaacuucagcuucaagaccaacagcggcuucgccgccgccagcagcggcagccccgccggcuucggcagcagccccgccuucggcgccgccgccagcaccagcagcggcaucagcaccagcgcccccgccuucggcuucggcaagcccgaggugaccagcgccgccagcuucagcuucaagagccccgccgccagcagcuucggcagccccggcuucagcggccugcccgccagccuggccaccggccccgugagagcccccguggcccccgccuucggcggcggcagcagcguggccggcuucggcagccccggcagccacagccacaccgccuucagcaagcccagcagcgacaccuucggcaacagcagcaucagcaccagccugagcgccagcagcagcaucaucgccaccgacaacgugcuguucacccccagagacaagcugaccguggaggagcuggagcaguuccagagcaagaaguucacccugggcaagaucccccugaagccccccccccuggagcugcugaacguguaa

SEQ ID NO: 20841 - RNA, 303 nt, Artificial Sequence
  NUPR1__Homo_sapiens__NP_001035948
auggccaccuucccccccgccaccagcgccccccagcagccccccggccccgaggacgaggacagcagccuggacgagagcgaccuguacagccuggcccacagcuaccugggcccccugaucaugcccaugcccaccagcccccugacccccgcccuggugaccggcggcggcggcagaaagggcagaaccaagagagaggccgccgccaacaccaacagacccagccccggcggccacgagagaaagcuggugaccaagcugcagaacagcgagagaaagaagagaggcgccagaagauaa

SEQ ID NO: 20842 - RNA, 882 nt, Artificial Sequence
  NUS1__Homo_sapiens__NP_612468
augaccggccuguacgagcugguguggagagugcugcacgcccugcugugccugcacagaacccugaccagcuggcugagagugagauucggcaccuggaacuggaucuggagaagaugcugcagagccgccagcgccgccgugcuggccccccugggcuucacccugagaaagccccccgccgugggcagaaacagaagacaccacagacaccccagaggcggcagcugccuggccgccgcccaccacagaaugagauggagagccgacggcagaagccuggagaagcugcccgugcacaugggccuggugaucaccgagguggagcaggagcccagcuucagcgacaucgccagccuggugguguggugcauggccgugggcaucagcuacaucagcguguacgaccaccagggcaucuucaagagaaacaacagcagacugauggacgagauccugaagcagcagcaggagcugcugggccuggacugcagcaaguacagccccgaguucgccaacagcaacgacaaggacgaccaggugcugaacugccaccuggccgugaaggugcugagccccgaggacggcaaggccgacaucgugagagccgcccaggacuucugccagcugguggcccagaagcagaagagacccaccgaccuggacguggacacccuggccagccugcugagcagcaacggcugccccgaccccgaccuggugcugaaguucggccccguggacagcacccugggcuuccugcccuggcacaucagacugaccgagaucgugagccugcccagccaccugaacaucagcuacgaggacuucuucagcgcccugagacaguacgccgccugcgagcagagacugggcaaguaa

SEQ ID NO: 20843 - RNA, 1320 nt, Artificial Sequence
  NUSAP1__Homo_sapiens__NP_001230071
augaucauccccagccuggaggagcuggacagccugaaguacagcgaccugcagaaccuggccaagagccugggccugagagccaaccugagagccaccaagcugcugaaggcccugaagggcuacaucaagcacgaggccagaaagggcaacgagaaccaggacgagagccagaccagcgccagcagcugcgacgagaccgagauccagaucagcaaccaggaggaggccgagagacagccccugggccacgugaccaagaccagaagaagaugcaagaccgugagaguggaccccgacagccagaaccacagcgagaucaagaucagcaaccccaccgaguuccagaaccacgagaagcaggagagccaggaccugagagccaccgccaaggugcccagcccccccgacgagcaccaggaggccgagaacgccgugagcagcggcaacagagacagcaaggugcccagcgagggcaagaagagccuguacaccgacgagagcagcaagcccggcaagaacaagagaaccgccaucaccacccccaacuucaagaagcugcacgaggcccacuucaaggagauggagagcaucgaccaguacaucgagagaaagaagaagcacuucgaggagcacaacagcaugaacgagcugaagcagcccaucaacaagggcggcgugagaacccccgugccccccagaggcagacugagcguggccagcacccccaucagccagagaagaagccagggcagaagcugcggccccgccagccagagcacccugggccugaagggcagccugaagagaagcgccaucagcgccgccaagaccggcgugagauucagcgccgccaccaaggacaacgagcacaagagaagccugaccaagacccccgccagaaagagcgcccacgugaccgugagcggcggcacccccaagggcgaggccgugcugggcacccacaagcugaagaccaucaccggcaacagcgccgccgugaucacccccuucaagcugaccaccgaggccacccagacccccgugagcaacaagaagcccguguucgaccugaaggccagccugagcagaccccugaacuacgagccccacaagggcaagcugaagcccuggggccagagcaaggagaacaacuaccugaaccagcacgugaacagaaucaacuucuacaagaagaccuacaagcagccccaccugcagaccaaggaggagcagagaaagaagagagagcaggagagaaaggagaagaaggccaaggugcugggcaugagaagaggccugauccuggccgaggacuaa

SEQ ID NO: 20844 - RNA, 384 nt, Artificial Sequence
  NUTF2__Homo_sapiens__XP_005255828
augggcgacaagcccaucugggagcagaucggcagcagcuucauccagcacuacuaccagcuguucgacaacgacagaacccagcugggcgccaucuacaucgacgccagcugccugaccugggagggccagcaguuccagggcaaggccgccaucguggagaagcugagcagccugcccuuccagaagauccagcacagcaucaccgcccaggaccaccagcccacccccgacagcugcaucaucagcaugguggugggccagcugaaggccgacgaggaccccaucaugggcuuccaccagauguuccugcugaagaacaucaacgacgccugggugugcaccaacgacauguucagacuggcccugcacaacuucggcuaa

SEQ ID NO: 20845 - RNA, 3483 nt, Artificial Sequence
  NUTM1__Homo_sapiens__NP_001271221
augguggugacccugggccccggccccgacugccugauccuggaggccagcagacagccccagcuggugcccaagcccgagagaauggccagcgacggcgccagcgcccugcccggccccgacaugagcaugaagcccagcgccgcccugagccccagccccgcccugcccuuccugccccccaccagcgacccccccgaccacccccccagagagccccccccccagcccaucaugcccagcguguucagccccgacaacccccugaugcugagcgccuuccccagcagccugcuggugaccggcgacggcggccccugccugagcggcgccggcgccggcaaggugaucgugaaggugaagaccgagggcggcagcgccgagcccagccagacccagaacuucauccugacccagaccgcccugaacagcaccgcccccggcacccccugcggcggccuggagggccccgccccccccuucgugaccgccagcaacgugaagaccauccugcccagcaaggccgugggcgugagccaggagggcccccccggccugcccccccagccccccccccccguggcccagcuggugcccaucgugccccuggagaaggccuggcccggcccccacggcaccaccggcgagggcggccccguggccacccugagcaagcccagccugggcgacagaagcaagaucagcaaggacguguacgagaacuucagacaguggcagagauacaaggcccuggccagaagacaccugagccagagccccgacaccgaggcccugagcugcuuccugauccccgugcugagaagccuggccagacugaagcccaccaugacccuggaggagggccugccccuggccgugcaggagugggagcacaccagcaacuucgacagaaugaucuucuacgagauggccgagagauucauggaguucgaggccgaggagaugcagauccagaacacccagcugaugaacggcagccagggccugagccccgccaccccccugaagcuggacccccugggcccccuggccagcgaggugugccagcagcccguguacauccccaagaaggccgccagcaagaccagagcccccagaagaagacagagaaaggcccagagaccccccgcccccgaggcccccaaggagaucccccccgaggccgugaaggaguacguggacaucauggaguggcuggugggcacccaccuggccaccggcgagagcgacggcaagcaggaggaggagggccagcagcaggaggaggagggcauguaccccgaccccggccugcugagcuacaucaacgagcugugcagccagaagguguucgugagcaagguggaggccgugauccacccccaguuccuggccgaccugcugagccccgagaagcagagagacccccuggcccugaucgaggagcuggagcaggaggagggccugacccuggcccagcuggugcagaagagacugauggcccuggaggaggaggaggacgccgaggccccccccagcuucagcggcgcccagcuggacagcagccccagcggcagcguggaggacgaggacggcgacggcagacugagacccagccccggccugcagggcgccggcggcgccgccugccugggcaaggugagcagcagcggcaagagagccagagaggugcacggcggccaggagcaggcccuggacagccccagaggcaugcacagagacggcaacacccugcccagccccagcagcugggaccugcagcccgagcuggccgccccccagggcacccccggcccccugggcguggagagaagaggcagcggcaaggugaucaaccaggugagccugcaccaggacggccaccugggcggcgccggcccccccggccacugccugguggccgacagaaccagcgaggcccugccccugugcuggcagggcggcuuccagcccgagagcacccccagccuggacgccggccuggccgagcuggccccccugcagggccagggccuggagaagcaggugcugggccugcagaagggccagcagaccggcggcagaggcgugcugccccagggcaaggagccccuggccgugcccugggagggcagcagcggcgccauguggggcgacgacagaggcacccccauggcccagagcuacgaccagaaccccagccccagagccgccggcgagagagacgacgugugccugagccccggcguguggcugagcagcgagauggacgccgugggccuggagcugcccgugcagaucgaggaggugaucgagagcuuccagguggagaagugcgugaccgaguaccaggagggcugccagggccugggcagcagaggcaacaucagccugggccccggcgagacccuggugcccggcgacaccgagagcagcgugauccccugcggcggcaccguggccgccgccgcccuggagaagagaaacuacugcagccugcccggcccccugagagccaacagccccccccugagaagcaaggagaaccaggagcagagcugcgagaccgugggccaccccagcgaccugugggccgagggcugcuucccccugcuggagagcggcgacagcacccugggcagcagcaaggagacccugccccccaccugccagggcaaccugcugaucaugggcaccgaggacgccagcagccugcccgaggccagccaggaggccggcagcagaggcaacagcuucagcccccugcuggagaccaucgagcccgugaacauccuggacgugaaggacgacugcggccugcagcugagagugagcgaggacaccugcccccugaacgugcacagcuacgacccccagggcgagggcagaguggaccccgaccugagcaagcccaagaaccuggccccccugcaggagagccaggagagcuacaccaccggcacccccaaggccaccagcagccaccagggccugggcagcacccugcccagaagaggcaccagaaacgccaucgugcccagagagaccagcgugagcaagacccacagaagcgccgacagagccaagggcaaggagaagaagaagaaggaggccgaggaggaggacgaggagcugagcaacuucgccuaccugcuggccagcaagcugagccugagccccagagagcacccccugagcccccaccacgccagcggcggccagggcagccagagagccagccaccugcugcccgccggcgccaagggccccagcaagcugcccuaccccguggccaagagcggcaagagagcccuggccggcggccccgcccccaccgagaagaccccccacagcggcgcccagcugggcgugcccagagagaagccccuggcccugggcguggugagacccagccagcccagaaagagaagaugcgacagcuucgugaccggcagaagaaagaagagaagaagaagccaguaa

SEQ ID NO: 20846 - RNA, 2637 nt, Artificial Sequence
  NUTM2A__Homo_sapiens__XP_011538424
auggaggugaagggccccagcggcagaagcuucugcugcgagagcgagggccaguucaagagcugccugaagagacacacccccagccugcugcugcccagcagcuggaagggcaacagcggcagcugccugauggccaaggcccugcacagaaugagccccacccccaacagcugcccccugccccugccccugugcagaaugagcggcgugcugugcagcagaaaccuguucaccuucaaguucagccuguuccagcuggacagcggcgccagcggcgagcccggccacagccugggccugacccugggcuucagccacugcggcaacugccagaccgccguggugagcgcccagcccgagggcauggccagcaacggcgccuaccccgcccugggccccggcgugaccgccaaccccggcaccagccugagcguguucaccgcccugcccuucaccacccccgcccccggccccgcccacggcccccugcuggugaccgccggcgccccccccggcggcccccuggugcugagcacccugcccagcaccccccuggugaccgagcaggacggcugcggccccagcggcgccggcgccagcaacguguucgugcagaugagaaccgaggugggccccgugaaggccgcccaggcccagacccuggugcugacccaggccccccugguguggcaggcccccggcgcccugugcggcggcguggugugcccccccccccugcugcuggccgccgcccccguggugcccgugauggccgcccagguggugggcggcacccaggccugcgagggcggcuggagccagggccugccccugccccccccccccccccccgccgcccagcugccccccaucgugagccagggcaacgccggccccuggccccagggcgcccacggcgagggcagccuggccagcagccaggccaaggccccccccgacgacagcugcaaccccagaagcguguacgagaacuucagacuguggcagcacuacaagccccuggccagaagacaccugccccagagccccgacaccgaggcccugagcugcuuccugauccccgugcugagaagccuggccagaagaaagcccaccaugacccuggaggagggccuguggagagccaugagagaguggcagcacaccagcaacuucgacagaaugaucuucuacgagauggccgagaaguuccuggaguucgaggccgaggaggagaugcagauccagaagagccaguggaugaagggcccccagugccugcccccccccgccacccccagacuggagcccagaggcccccccgcccccgagguggugaagcagcccguguaccugcccagcaaggccggccccaaggcccccaccgccugccugcccccccccagaccccagagacccgugaccaaggccagaagacccccccccagaccccacagaagagccgagaccaaggccagacugcccccccccagaccccagagacccgccgagaccaaggugcccgaggagaucccccccgagguggugcaggaguacguggacaucauggaggagcugcugggccccagccugggcgccaccggcgagcccgagaagcagagagaggagggcgaggugaagcagccccaggaggaggacuggaccccccccgaccccggccugcugagcuacaccgacaagcugugcagccagaaggacuucgugaccaagguggaggccgugauccacccccaguuccuggaggagcugcugagccccgacccccagauggacuuccuggcccugagccaggagcuggagcaggaggagggccugacccuggcccagcugguggagaagagacugcugccccugaaggagaagcagcacgccagagccgcccccagcagaggcaccgccagacuggacagcagcagcagcaaguucgccgccggccagggcgccgagagagacgugcccgugccccagcagggcgugggcauggagaccugccccccccagaccaccgccagagacagccagggcagaggcagagcccacaccggcauggccagaagcaaggacagcguggugcugcugggcugccaggacagccccggccugagagccgccagacccaccagccccccccaggaccacagacccaccugccccggcgugggcaccaaggacgcccuggaccugcccggcggcagccccgugagagagagccacggccuggcccagggcagcagcgaggaggaggagcugcccagccuggccuuccugcugggcagccagcacaagcugcugcccugguggcugccccagagccccgugcccgccagcggccugcugagccccgagaaguggggcccccagggcacccaccaguuccccagcgccgagagaagaggccugaaccuggcccccagccccgccaacaaggccaagaagagaccccuguucggcagccugagccccgccgagaagaccccccaccccggccccggccugagagugagcggcgagcagagccugaccuggggccugggcggccccagccagagccagaagagaaagggcgacccccuggugagcagaaaggagaagaagcagagaugcagccaguaa

SEQ ID NO: 20847 - RNA, 2637 nt, Artificial Sequence
  NUTM2B__Homo_sapiens__XP_005270192
auggaggugaagggccccagcggcagaagcuucugcugcgagagcgagggccaguucaagagcugccugaagagacacacccccagccugcugcugcccagcagcuggaagggcaacagcggcagcugccugauggccgaggcccugcacagaaccagccccacccccaacagcugcccccugccccugccccugugcagaaugagcggcgugcugugcagcagaaaccuguucaccuucaaguucagccuguuccagcuggacagcggcgccagcggcgagcccggccacagccugggccugacccugggcuucagcuacugcggcaacugccagaccgccguggugagcgcccagcccgagggcauggccagcaacggcgccuaccccgugcugggccccggcgugaccgccaaccccggcaccagccugagcguguucaccgcccugcccuucaccacccccgcccccggccccgcccacggcccccugcuggugaccgccggcgccccccccggcggcccccuggugcugagcaccuuccccagcaccccccuggugaccgagcaggacggcugcggccccagcggcgccggcgccagcaacguguucgugcagaugagaaccgaggugggccccgugaaggccgcccaggcccagacccuggugcugacccaggccccccugguguggcaggcccccggcgcccugugcggcggcguggugugcccccccccccugcugcuggccgccgcccccguggugcccgugauggccgcccagguggugggcggcacccaggccugcgagggcggcuggagccagggccugccccugccccccccccccccccccgccgcccagcugccccccaucgugagccagggcaacgccggccccuggccccagggcgcccacggcgagagcagccuggccagcagccaggccaaggccccccccgacgacagcugcaaccccagaagcguguacgagaacuucagacuguggcagcacuacaagccccuggccagaagacaccugccccagagccccgacaccgaggcccugagcugcuuccugauccccgugcugagaagccuggccagaagaaagcccaccaugacccuggaggagggccuguggagagccaugagagaguggcagcacaccagcaacuucgacagaaugaucuucuacgagauggccgagaaguuccuggaguucgaggccgaggaggagaugcagauccagaagagccaguggaugaagggcccccagugccugcccccccccgccacccccagacuggagcccagaggcccccccgcccccgagguggugaagcagcccguguaccugcccagcaaggccggccccaaggcccccaccgccugccugcccccccccagaccccagagacccgugaccaaggccagaagacccccccccagaccccacagaagagccgagaccaaggccagacugcccccccccagaccccagagacccgccgagaccaaggugcccgaggagaucccccccgagguggugcaggaguacguggacaucauggaggagcugcugggccccagccugggcgccaccggcgagcccgagaagcagagagaggagggcaaggugaagcagccccaggaggaggacuggaccccccccgaccccggccugcugagcuacaucgacaagcugugcagccagaaggacuucgugaccaagguggaggccgugauccacccccaguuccuggaggagcugcugagccccgacccccagauggacuuccuggcccugagccaggaccuggagcaggaggagggccugacccuggcccagcugguggagaagagacugcccccccugaaggagaagcagcacgccagagccgcccccagcagaggcaccgccagacuggacagcagcagcagcaaguucgccgccggccagggcgccgagagagacgugcccgacccccagcagggcgugggcauggagaccugccccccccagaugaccgccagagacagccagggcagaggcagagcccacaccggcauggccagaagcgaggacagcguggugcugcugggcugccaggacagccccggccugagagccgccuggcccaccagccccccccaggaccacagacccaccugccccggcgugggcaccaaggacgcccuggaccugcccggcggcagccccgugagagagagccacggccuggcccagggcagcagcgaggaggaggagcugcccagccuggccuuccugcugggcagccagcacaagcugcugcccugguggcugccccagagccccgugcccgccagcggccugcugagccccgagaaguggggcccccagggcacccaccagagccccagcgccgagagaagaggccugaaccuggcccccagccccgccaacaaggccaagaagagaccccuguucggcagccugagccccgccgagaagacccccuaccccggccccggccugagagugagcggcgagcagagccugaccuggggccugggcggccccagccagagccagaagagaaagggcgacccccuggugagcagaaaggagaagaagcagcacugcagccaguaa

SEQ ID NO: 20848 - RNA, 2004 nt, Artificial Sequence
  NVL__Homo_sapiens__NP_001230075
augaagagaaagggcaagcugaagaacaagggcagcaagagaaagaaggaggaccugcaggagguggacggcgagaucgaggccgugcugcagaagaaggccaaggccagaggccuggaguuccagaucagcaacgugaaguucgaggacgugggcggcaacgacaugacccugaaggaggugugcaagaugcugauccacaugagacaccccgagguguaccaccaccugggcguggugccccccagaggcgugcugcugcacggcccccccggcugcggcaagacccugcuggcccacgccaucgccggcgccgagugcagcggcaugaucaccgcccacugcagcuucgacuucagcggcagcaacgacccccccgccagcgccagccaggagcuggaccugcccauccugaagguggccgcccccgagaucgugagcggcgugagcggcgagagcgagcagaagcugagagagcuguucgagcaggccgugagcaacgcccccugcaucaucuucaucgacgagaucgacgccaucacccccaagagagagguggccagcaaggacauggagagaagaaucguggcccagcugcugaccugcauggacgaccugaacaacguggccgccaccgccagagugcuggugaucggcgccaccaacagacccgacagccuggaccccgcccugagaagagccggcagauucgacagagagaucugccugggcauccccgacgaggccagcagagagagaauccugcagacccugugcagaaagcugagacugccccaggccuucgacuucugccaccuggcccaccugacccccggcuucgugggcgccgaccugauggcccugugcagagaggccgccaugugcgccgugaacagagugcugaugaagcugcaggagcagcagaagaagaaccccgagauggaggaccugcccagcaagggcgugcaggaggagagacugggcaccgagcccaccagcgagacccaggacgagcugcagagacugcugggccugcugagagaccaggacccccugagcgaggagcagaugcagggccugugcaucgagcugaacgacuucaucguggcccugagcagcgugcagcccagcgccaagagagagggcuucgugaccgugcccaacgugaccugggccgacaucggcgcccuggaggacaucagagaggagcugaccauggccauccuggcccccgugagaaaccccgaccaguucaaggcccugggccuggugacccccgccggcgugcugcuggccggcccccccggcugcggcaagacccugcuggccaaggccguggccaacgagagcggccugaacuucaucagcgugaagggccccgagcugcugaacauguacgugggcgagagcgagagagccgugagacagguguuccagagagccaagaacagcgcccccugcgugaucuucuucgacgagguggacgcccugugccccagaagaagcgacagagagaccggcgccagcgugagaguggugaaccagcugcugaccgagauggacggccuggaggccagacagcagguguucaucauggccgccaccaacagacccgacaucaucgaccccgccauccugagacccggcagacuggacaagacccuguucgugggccugcccccccccgccgacagacuggccauccugaagaccaucaccaagaacggcaccaagcccccccuggacgccgacgugaaccuggaggccaucgccggcgaccugagaugcgacugcuacaccggcgccgaccugagcgcccuggugagagaggccagcaucugcgcccugagacaggagauggccagacagaagagcggcaacgagaagggcgagcugaaggugagccacaagcacuucgaggaggccuucaagaaggugagaagcagcaucagcaagaaggaccagaucauguacgagagacugcaggagagccugagcagauaa

SEQ ID NO: 20849 - RNA, 4299 nt, Artificial Sequence
  NWD1__Homo_sapiens__NP_001007526
augcagagaggcaagcccugcagagcccugcccacccugaagugccagaccuucugccagagacacggccugauguucgaggugguggaccugagauggggcaucagaaacaucgaggccaccgaccaccugaccaccgagcugugccuggaggagguggacagaugcuggaagaccagcaucggccccgccuucguggcccugaucggcgaccaguacggccccugccugauccccagcagaaucgacgagaaggagugggaggugcugagagaccaccugaccgccagacccagcgaccuggagcugguggccagauacuuccagagagacgagaacgccuucccccccaccuacgugcugcaggcccccggcaccggcgaggccugcgagcccgaggaggccacccugaccagcgugcugagaagcggcgcccaggaggccagaagacugggccugaucacccaggagcaguggcagcacuaccacagaagcgugaucgagugggagaucgagagaagccugcugagcagcgaggacagagagcagggcgccaccguguuccugagagagauccaggaccugcacaagcacauccuggaggacugcgcccugagaaugguggacagacuggccgacggcugccuggacgccgacgcccagaaccugcugagcagccugaagagccacaucaccgacaugcaccccggcgugcugaagacccacagacugcccuggagcagagaccuggugaaccccaagaacaagacccacgccugcuaccugaaggagcugggcgagcaguucguggugagagccaaccaccaggugcugaccagacugagagagcuggacaccgccggccaggagcuggccuggcuguaccaggagaucagacaccaccuguggcagagcagcgaggugauccagaccuucugcggcagacaggagcugcuggccagacugggccagcagcugagacacgacgacagcaagcagcacaccccccuggugcuguucggcccccccggcaucggcaagaccgcccugaugugcaagcuggccgagcagaugcccagacugcugggccacaagaccgugaccgugcugagacugcugggcaccagccagaugagcagcgacgccagaggccugcugaagagcaucugcuuccaggugugccuggccuacggccugccccugccccccgcccaggugcuggacgcccacaccagaguggugcaguucuuccacacccugcugcacaccgugagcugcagaaacuucgagagccuggugcugcugcuggacgccauggacgaccuggacagcgugagacacgccagaagagugcccuggcugccccugaacugcccccccagagugcaccugauccugagcgccugcagcggcgcccugggcgugcuggacacccugcagagagugcugcuggaccccgaggccuacugggaggugaagccccugagcggcaaccagggccagcagaugauccagcugcugcuggccgccgccagaagaacccugagccccgugcacaccgaccugcugugggccagccugcccgagugcggcaaccccggcagacugagacuggccuucgaggaggccagaaagugggccagcuucaccgugcccgugccccuggccaccaccgccgaggaggccacccaccagcugugcaccagacuggagcagacccacggccagcugcugguggcccacgugcugggcuacaucgugagcagcagacacggccugagcgaggccgagcugaaggacgugcugagccuggacgacgaggugcugcaggacguguacagagacuggaccccccccagcaaggagcugcugagauuccccccccugcugugggugagacugagaagagaccugggcuacuaccuggccagaagacccguggacggcuucacccugcuggccaucgcccacagacagcugguggagguggugagagagagauaccugagcggcagcgagagagccaagagacacggcgugcuggccgacuucuucagcggcaccuggagccagggcaccaagaagcugaucacccugccccuggugggcaagccccugaaccuggacagaaagguggccccccagccccugugguucagccacaccguggccaaccugagaaagcugaaggagcugcccuaccaccugcugcacagcggcagacuggaggagcugaagcaggaggugcugggcagcaugagcuggaucagcugcagaggcaucagcggcggcaucgaggaccugcuggacgacuucgaccugugcgccccccaccuggacagccccgaggugggccuggugagagaggcccugcagcugugcagacccgccguggagcugagaggcauggagagaagccugcuguacaccgagcugcuggccagacugcacuucuucgccaccagccaccccgcccuggugggccagcugugccagcaggcccagagcugguuccagcugugcgcccaccccgugcuggugccccugggcggcuuccugcagccccccggcggcccccugagagccacccugagcggcugccacaagggcaucaccgccauggccuggggcguggaggagaagcugcuggugaucggcacccaggacggcaucauggccgugugggacauggaggagcagcacgugauccacaugcugaccggccacaccggcgaggugagaugcgugaagaucuucgccaagggcacccuggccaacagcgccagcaaggacuacacccugcaccuguggaaccugcugagcggccaggagaaguucaccaucugggacggcggcagcaagaaccccgccgagccccagaucuggaaccugcacguggacgaggcccacaaggugguguacagcgccagcggcagcaagaucaacgccuggaaccuggagaccgccgagcccguguuccacauccugggcgacgccagcgaccccuggaugugcauggccgugcuggccagccaggccacccugcugaccgugagcagagacggcguggugagccuguggagcagcgccaccggcaagcugcagggcaagcagcacaugagcagcaucaaggaggagacccccaccugcgccgugagcgugcagaagcagggcaagcuggugaccggcuucagcaacggcagcaucagccuggugagcagcaagggcgacagacugcuggagaagcugcccgacgccgugagauuccugguggugagcgaggacgagagccugcuggccgccggcuucggcagaagcgugagaaucuuccuggccgacagcagaggcuucagaagauucauggccauggaccuggagcacgaggacaugguggagaccgccguguucggcaccgagaacaaccugaucaucaccggcagccuggacgcccugauccagguguggagccugagcgagcagggcacccugcuggacauccuggagggcgugggcgcccccgugagccugcuggccagaggcggcgcccugguggccagcgccagcccccagagcagcagcuucaaggugugggaccugagcgacgcccacagaagcagagugcccgcccccuuccuggacagaaccggccugaccgccgugagccacaacggcagcuacguguacuuccccaagaucggcgacaagaacaaggugaccaucugggaccuggccgagggcgaggagcaggacagccuggacaccagcagcgagaucagaugccuggagguggccgagcagagaaagcugcuguucaccggccuggugagcggcguggugcugguguucccccugaacagcagacaggacgugaucugcauccccccccccgaggccagaaaggccaucaacugcaugagccugagcaagugcgaggacagacuggccaucgccuacgacaacaucgugcuggugcuggacaucaccagcggcgaccccugccccgugaucgacggccccagauacaccuucuacacccagcugcccgagacccugagcagcguggccauccugaccgacuacagagugguguacagcaugaccaacggcgaccuguuccuguacgagugcgccaccagcaaggccuucccccuggagacccacagaagcagaguggccugcguggaggugagccacaaggagcagcugguggugagcggcagcgaggacgcccugcugugccugugggaccugcaggccagaaaguggaaguucgagaugagcuacaccgcccccugcuaa

SEQ ID NO: 20850 - RNA, 1071 nt, Artificial Sequence
  NXF1__Homo_sapiens__NP_001074960
auggccgacgagggcaagagcuacagcgagcacgacgacgagagagugaacuucccccagagaaagaagaagggcagaggccccuucagauggaaguacggcgagggcaacagaagaagcggcagaggcggcagcggcaucagaagcagcagacuggaggaggacgacggcgacguggccaugagcgacgcccaggacggccccagagugagauacaaccccuacaccaccagacccaacagaagaggcgacaccuggcacgacagagacagaauccacgugaccgugagaagagacagagccccccccgagagaggcggcgccggcaccagccaggacggcaccagcaagaacugguucaagaucaccauccccuacggcagaaaguacgacaaggccuggcugcugagcaugauccagagcaagugcagcgugcccuucacccccaucgaguuccacuacgagaacaccagagcccaguucuucguggaggacgccagcaccgccagcgcccugaaggccgugaacuacaagauccuggacagagagaacagaagaaucagcaucaucaucaacagcagcgcccccccccacaccauccugaacgagcugaagcccgagcagguggagcagcugaagcugaucaugagcaagagauacgacggcagccagcaggcccuggaccugaagggccugagaagcgaccccgaccugguggcccagaacaucgacguggugcugaacagaagaagcugcauggccgccacccugagaaucaucgaggagaacauccccgagcugcugagccugaaccugagcaacaacagacuguacagacuggacgacaugagcagcaucgugcagaaggcccccaaccugaagauccugaaccugagcggcaacgagcugaagagcgagagagagcuggacaagaucaagggccugaagcuggaggagcuguggcuggacggcaacagccugugcgacaccuucagagaccagagcaccuacaucagaagcgugguggccugcgugagcccccccggcgaccugcacccccugggcggcuaa

SEQ ID NO: 20851 - RNA, 1881 nt, Artificial Sequence
  NXF2B__Homo_sapiens__NP_001093156
augugcagcacccugaagaagugcggcaccuacagaaccgagguggccgagugccacgaccacggcagcaccuuccagggcagaaagaagggcggcagcagcuucagagacaacuucgacaagagaagcugccacuacgagcacggcggcuacgagagaccccccagccacugccaggagaacgacggcagcguggagaugagagacgugcacaaggaccagcagcugagacacacccccuacagcaucagaugcgagagaagaaugaaguggcacagcgaggacgagaucagaaucaccaccuggagaaacagaaagccccccgagagaaagaugagccagaacacccaggacggcuacaccagaaacugguucaaggugaccauccccuacggcaucaaguacgacaaggccuggcugaugaacagcauccagagccacugcagcgacagauucacccccguggacuuccacuacgugagaaacagagccugcuucuucgugcaggacgccagcgccgccagcgcccugaaggacgugagcuacaagaucuacgacgacgagaaccagaagaucugcaucuucgugaaccacagcaccgcccccuacagcgugaagaacaagcugaagcccggccagauggagaugcugaagcugaccaugaacaagagauacaacgugagccagcaggcccuggaccugcagaaccugagauucgaccccgaccugaugggcagagacaucgacaucauccugaacagaagaaacugcauggccgccacccugaagaucaucgagagaaacuuccccgagcugcugagccugaaccugugcaacaacaagcuguaccagcuggacggccugagcgacaucaccgagaaggcccccaaggugaagacccugaaccugagcaagaacaagcuggagagcgccugggagcugggcaaggugaagggccugaagcuggaggagcuguggcuggagggcaacccccugugcagcaccuucagcgaccagagcgccuacgugagcgccaucagagacugcuuccccaagcugcugagacuggacggcagagagcugagcgcccccgugaucguggacaucgacagcagcgagaccaugaagcccugcaaggagaacuucaccggcagcgagacccugaagcaccuggugcugcaguuccugcagcaguacuacagcaucuacgacagcggcgacagacagggccugcugggcgccuaccacgacgaggccugcuucagccuggccauccccuucgaccccaaggacagcgcccccagcagccugugcaaguacuucgaggacagcagaaacaugaagacccugaaggaccccuaccugaagggcgagcugcugagaagaaccaagagagacaucguggacagccugagcgcccugcccaagacccagcacgaccugagcagcauccugguggacguguggugccagaccgagagaaugcugugcuucagcgugaacggcguguucaaggagguggagggccagagccagggcagcgugcuggccuucaccagaaccuucaucgccacccccggcagcagcagcagccugugcaucgugaacgacgagcuguucgugagagacgccagcccccaggagacccagagcgccuucagcauccccgugagcacccugagcagcagcagcgagcccagccugagccaggagcagcaggagauggugcaggccuucagcgcccagagcggcaugaagcuggaguggagccagaagugccugcaggacaacgaguggaacuacaccagagccggccaggccuucaccaugcugcagaccgagggcaagauccccgccgaggccuucaagcagaucagcuaa

SEQ ID NO: 20852 - RNA, 1596 nt, Artificial Sequence
  NXF3__Homo_sapiens__NP_071335
augagccugcccagcggccacaccaccggccacaccgaccagguggugcagagaagagccagaugcugggacaucuaccagagaagauucagcagcagaagcgagcccgugaaccccggcaugcacagcagcagccaccagcagcaggacggcgacgccgccaugcacggcgcccacauggacagccccgugagauacacccccuacaccaucagccccuacaacagaaagggcagcuucagaaagcaggaccagacccacgugaacauggagagagagcagaagccccccgagagaagaauggagggcaacaugcccgacggcacccugggcagcugguucaagaucaccgugcccuucggcaucaaguacaacgagaaguggcugcugaaccugauccagaacgagugcagcgugcccuucgugcccguggaguuccacuacgagaacaugcacgccagcuucuucguggagaacgccagcaucgccuacgcccugaagaacgugagcggcaagaucugggacgaggacaacgagaagaucagcaucuucgugaaccccgccggcaucccccacuucgugcacagagagcugaagagcgagaagguggagcagaucaagcuggccaugaaccagcagugcgacgugagccaggaggcccuggacauccagagacugcccuucuaccccgacauggugaacagagacaccaagauggccagcaaccccagaaagugcauggccgccagccuggacgugcacgaggagaacauccccaccgugaugagcgccggcgagauggacaaguggaagggcaucgagcccggcgagaagugcgccgacagaagccccgugugcaccaccuucagcgacaccagcagcaacaucaacagcauccuggagcuguuccccaagcugcugugccuggacggccagcagagccccagagccacccugugcggcaccgaggcccacaagagacugcccaccugcaagggcagcuucuucggcagcgagaugcugaagaaccuggugcugcaguuccugcagcaguacuaccugaucuacgacagcggcgacagacagggccugcugagcgccuaccacgacgaggccugcuucagccugagcauccccuucaaccccgaggacagcgcccccagcagcuucugcaaguucuucaaggacagcagaaacaucaagauccugaaggaccccuaccugagaggcgagcugcugaagcacaccaagcuggacaucguggacagccugagcgcccugcccaagacccagcacgaccugagcagcuuccugguggacaugugguaccagaccgaguggaugcugugcuucagcgugaacggcguguucaaggagguggagggccagagccagggcagcgugcuggccuucaccagaaccuucaucgccacccccggcagcagcagcagccugugcaucgugaacgacaagcuguucgugagagacaccagccaccagggcacccagagcgcccuguucacccuggugcccaccgccuucagcagcagcgugcccgccuucagccaggagcagcagaagaugcugcccagcuaa

SEQ ID NO: 20853 - RNA, 1098 nt, Artificial Sequence
  NXF5__Homo_sapiens__NP_116564
augagaagaaacacccaggacgagaacaugagaaagugguucaaggugaccauccccuacggcaucaaguacgacaaggccuggcugaugaacagcauccagagcaacugcagcgugcccuucacccccguggacuuccacuacaucagaaacagagccugcuucuucgugcagguggccagcgccgccagcgcccugaaggacgugagcuacaagaucuacgacgacgagaaccagaagaucugcaucuucgugagccacuucaccgcccccuacagcgugaagaacaagcugaagcccggccagauggagaugcugaagcugaccaugaacaagagauacaacgugagccagcaggcccuggaccugcagaaccugagauucgaccccgaccugaugggcagagacaucgacaucauccugaacagaagaaacugcauggccgccacccugaagaucaccgagagaaacuuccccgagcugcugagccugaaccugugcaacaacaagcuguaccagcuggacggccugagcgacaucaccgagaaggcccccaaggugaagacccugaaccugagcaagaacaagcuggagagcgccugggagcugggcaaggugaagggccugaagcuggaggagcuguggcuggagggcaacccccugugcagcaccuucagcgaccagagcgccuacgugagcgccaucagagacugcuuccccaagcugcugagacuggacggcagagagcugagcgcccccgugaucguggacaucgacagcagcgagaccaugaagcccugcaaggagaacuucaccggcagcgagacccugaagcaccuggugcugcaguuccugcagcagagcaaccugugcaaguacuucaaggacagcagaaacaucaagauccugaaggaccccuaccugcagagaaagcugcugaagcacaccaagugccccagaaacguggacagccugagcgcccugcccgagacccagcacgacuucaccagcauccugguggacaugugguaccagaccgugaacaccugcuuccugcccagagccggccccgagagccagagccugagaccccuguaa

SEQ ID NO: 20854 - RNA, 984 nt, Artificial Sequence
  NXN__Homo_sapiens__NP_001192248
auggccgacgugagccugcacagaaaccccgccacccugaagcuguggaacaaguacagaaucagcaacauccccagccugaucuuccuggacgccaccaccggcaagguggugugcagaaacggccugcuggugaucagagacgaccccgagggccuggaguuccccuggggccccaagcccuucagagaggugaucgccggcccccugcugagaaacaacggccagagccuggagagcagcagccuggagggcagccacgugggcguguacuucagcgcccacuggugcccccccugcagaagccugaccagagugcugguggagagcuacagaaagaucaaggaggccggccagaacuucgagaucaucuucgugagcgccgacagaagcgaggagagcuucaagcaguacuucagcgagaugcccuggcuggccgugcccuacaccgacgaggccagaagaagcagacugaacagacuguacggcauccagggcauccccacccugaucaugcuggacccccagggcgaggugaucaccagacagggcagaguggaggugcugaacgacgaggacugcagagaguuccccuggcaccccaagcccgugcuggagcugagcgacagcaacgccgcccagcugaacgagggccccugccuggugcuguucguggacagcgaggacgacggcgagagcgaggccgccaagcagcugauccagcccaucgccgagaagaucaucgccaaguacaaggccaaggaggaggaggccccccugcuguucuucguggccggcgaggacgacaugaccgacagccugagagacuacaccaaccugcccgaggccgccccccugcugaccauccuggacaugagcgccagagccaaguacgugauggacguggaggagaucacccccgccaucguggaggccuucgugaacgacuuccuggccgagaagcugaagcccgagcccaucuaa

SEQ ID NO: 20855 - RNA, 639 nt, Artificial Sequence
  NXNL1__Homo_sapiens__NP_612463
auggccagccuguucagcggcagaauccugaucagaaacaacagcgaccaggacgagcuggacaccgaggccgaggugagcagaagacuggagaacagacuggugcugcuguucuucggcgccggcgccugcccccagugccaggccuucgugcccauccugaaggacuucuucgugagacugaccgacgaguucuacgugcugagagccgcccagcuggcccugguguacgugagccaggacagcaccgaggagcagcaggaccuguuccugaaggacaugcccaagaaguggcuguuccugcccuucgaggacgaccugagaagagaccugggcagacaguucagcguggagagacugcccgccgugguggugcugaagcccgacggcgacgugcugaccagagacggcgccgacgagauccagagacugggcaccgccugcuucgccaacuggcaggaggccgccgaggugcuggacagaaacuuccagcugcccgaggaccuggaggaccaggagcccagaagccugaccgagugccugagaagacacaaguacagaguggagaaggccgccagaggcggcagagaccccggcggcggcggcggcgaggagggcggcgccggcggccuguucuaa

SEQ ID NO: 20856 - RNA, 471 nt, Artificial Sequence
  NXNL2__Homo_sapiens__NP_001155097
augguggacauccugggcgagagacaccuggugaccugcaagggcgccaccguggaggccgaggccgcccugcagaacaaggugguggcccuguacuucgccgccgccagaugcgcccccagcagagacuucaccccccugcugugcgacuucuacaccgcccugguggccgaggccagaagacccgcccccuucgaggugguguucgugagcgccgacggcagcagccaggagaugcuggacuucaugagagagcugcacggcgccuggcuggcccugcccuuccacgaccccuacagacacgagcugagaaagagauacaacgugaccgccauccccaagcuggugaucgugaagcagaacggcgaggugaucaccaacaagggcagaaagcagaucagagagagaggccuggccugcuuccaggacuggguggaggccgccgacaucuuccagaacuucagcguguaa

SEQ ID NO: 20857 - RNA, 1218 nt, Artificial Sequence
  NXPE1__Homo_sapiens__NP_689528
augagcagccccgcccugaccgccggcgccagcggcaaggugauggacuucaacaacggcaccuaccuggugagcuucacccuguucugggagggccaggugagccugagccugcugcugauccaccccagcgagggcgccagcgcccuguggagagccagaaaccagggcuacgacaagaucaucuucaagggcaaguucgugaacggcaccagccacguguucaccgagugcggccugacccugaacagcaacgccgagcugugcgaguaccuggacgacagagaccaggaggccuucuacugcaugaagccccagcacaugcccugcgaggcccugaccuacaugaccaccagaaacagagaggugagcuaccugaccgacaaggagaacagccuguuccacagaagcaaggugggcguggagaugaugaaggacagaaagcacaucgacgugaccaacugcaacaagagagagaagaucgaggagaccugccaggugggcaugaagccccccgugcccggcggcuacacccugcagggcaaguggaucaccaccuucugcaaccaggugcagcuggacaccaucaagaucaacggcugccugaagggcaagcugaucuaccugcugggcgacagcacccugagacaguggaucuacuacuuccccaagguggugaagacccugaaguucuucgaccugcacgagaccggcaucuucaagaagcaccugcugcuggacgccgagagacacacccagauccaguggaagaagcacagcuaccccuucgugaccuuccagcuguacagccugaucgaccacgacuacauccccagagagaucgacagacugagcggcgacaagaacaccgccaucgugaucaccuucggccagcacuucagacccuuccccaucgacaucuucaucagaagagccaucggcgugcagaaggccaucgagagacuguuccugagaagccccgccaccaaggugaucaucaagaccgagaacaucagagagaugcacaucgagaccgagagauucggcgacuuccacggcuacauccacuaccugaucaugaaggacaucuucaaggaccugaacgugggcaucaucgacgccugggacaugaccaucgccuacggcaccgacaccauccacccccccgaccacgugaucggcaaccagaucaacauguuccugaacuacaucugcuaa

SEQ ID NO: 20858 - RNA, 1680 nt, Artificial Sequence
  NXPE2__Homo_sapiens__NP_872301
augguggagaagauccugauccacagaauccugacccuguuccccaacgccaucgccagaaagcugcugcugaugcugaccuucauccugaucuucuggaucaucuaccuggccagcaaggaccacaccaaguucagcuucaaccuggagaaccacaucauccugaaccagggcaacaucuucaagaaguacagccacagcgagaccccccugugccccgccgugagccccaaggagaccgagcugagaaucaaggacaucauggagaagcuggaccagcagaucccccccagacccuucacccacgugaacaccaccaccagcgccacccacagcaccgccaccauccugaacccccaggacaccuacugcagaggcgaccagcuggacauccugcuggaggugagagaccaccugggccacagaaagcaguacggcggcgacuuccugagagccagaauguacagcaccgcccugauggccggcgccagcggcaaggugaccgacuucaacaacggcaccuaccuggugagcuucacccuguucugggagggccaggugagccugagccugcugcugauccaccccagcgagggcgugagcgcccuguggagagccagaaaccagggcugcgacagaaucaucuucaccggccuguucgccaacagaagcagcaacguguucaccgagugcggccugacccugaacaccaacgccgagcugugccaguacauggacgacagagaccaggaggccuucuacugcgugagaccccagcacaugcccugcgaggcccugacccacaugaccaccagaaccagaaacaucagcuaccugagcaaggaggaguggagacuguuccacagaagcaacaucggcguggagaugaugaagaacuucacccccaucgaggugauccccugcaacaagagcgagaacaucaagaagaacugccagaucggcaugaagacccccuuccccagcggcuacacccugaagaagauguggaucaccgccuucugcaagcagaucaaguucaacgagaccaagaacaucaacgacugccuggagagaaagcugaucuaccugaugggcgacagcacccugcaccaguggaucuacuaccugcagaaggccgugaagacccugaaguacuucgaccaccacggcgccggcaucuucaagacccacgugcugcuggacguggagagacacauccugauccaguggaagaagcacggccaccccuucgugaccaagaagcuguucagcgugaaggacgagaacuacauccccagagagaucgaccagguggccggcgacaagaacaccgccaucgugaucacccugggccagcacuucagacccuuccccaucaacaucuucaucagaagagccaucaacauccagaaggccaucgagagacuguuccugagaagccccgagaccaaggugauccugaagaccgagaacaccagagagaucgagcagaacgccgagauguucagcgacuuccacggcuacauccagaaccugaucaucagagacaucuucguggaccugaacgugggcaucaucgacgccugggacaugaccaucgccuacugcaccaacaacgcccacccccccgacuacgugauccagaaccagaucggcauguuccugaacuacaucugcuaa

SEQ ID NO: 20859 - RNA, 1635 nt, Artificial Sequence
  NXPE4__Homo_sapiens__NP_001071107
augaagaucagcaugaucaacuacaagagccugcuggcccugcuguucauccuggccagcuggaucaucuucaccguguuccagaacagcaccaagguguggagcgcccugaaccugagcaucagccugcacuacuggaacaacagcaccaagagccuguuccccaagaccccccugaucagccugaagccccugaccgagaccgagcugagaaucaaggagaucaucgagaagcuggaccagcagaucccccccagacccuucacccacgugaacaccaccaccagcgccacccacagcaccgccaccauccugaaccccagagacaccuacugcagaggcgaccagcugcacauccugcuggaggugagagaccaccugggcagaagaaagcaguacggcggcgacuuccugagagccagaaugagcagccccgcccugauggccggcgccagcggcaaggugaccgacuucaacaacggcaccuaccuggugagcuucacccuguucugggagggccaggugagccugagccugcugcugauccaccccagcgagggcgugagcgcccuguggagcgccagaaaccagggcuacgacagagugaucuucaccggccaguucgugaacggcaccagccaggugcacagcgagugcggccugauccugaacaccaacgccgagcugugccaguaccuggacaacagagaccaggagggcuucuacugcgugagaccccagcacaugcccugcgccgcccugacccacauguacagcaagaacaagaaggugagcuaccugagcaagcaggagaagagccuguucgagagaagcaacgugggcguggagaucauggagaaguucaacaccaucagcgugagcaagugcaacaaggagaccguggccaugaaggagaagugcaaguucggcaugaccagcaccauccccagcggccacguguggagaaacaccuggaaccccgugagcugcagccuggccaccgugaagaugaaggagugccugagaggcaagcugaucuaccugaugggcgacagcaccaucagacaguggauggaguacuucaaggccagcaucaacacccugaagagcguggaccugcacgagagcggcaagcugcagcaccagcuggccguggaccuggacagaaacaucaacauccaguggcagaaguacugcuacccccugaucggcagcaugaccuacagcgugaaggagauggaguaccugaccagagccaucgacagaaccggcggcgagaagaacaccgugaucgugaucagccugggccagcacuucagacccuuccccaucgacguguucaucagaagagcccugaacgugcacaaggccauccagcaccugcugcugagaagccccgacaccauggugaucaucaagaccgagaacaucagagagauguacaacgacgccgagagauucagcgacuuccacggcuacauccaguaccugaucaucaaggacaucuuccaggaccugagcgugagcaucaucgacgccugggacaucaccaucgccuacggcaccaacaacgugcaccccccccagcacguggugggcaaccagaucaacauccugcugaacuacaucugcuaa

SEQ ID NO: 20860 - RNA, 816 nt, Artificial Sequence
  NXPH1__Homo_sapiens__NP_689958
augcaggccgccugcugguacgugcuguuccugcugcagcccaccguguaccuggugaccugcgccaaccugaccaacggcggcaagagcgagcugcugaagagcggcagcagcaagagcacccugaagcacaucuggaccgagagcagcaaggaccugagcaucagcagacugcugagccagaccuucagaggcaaggagaacgacaccgaccuggaccugagauacgacacccccgagcccuacagcgagcaggaccugugggacuggcugagaaacagcaccgaccugcaggagcccagacccagagccaagagaagacccaucgugaagaccggcaaguucaagaagauguucggcuggggcgacuuccacagcaacaucaagaccgugaagcugaaccugcugaucaccggcaagaucguggaccacggcaacggcaccuucagcguguacuucagacacaacagcaccggccagggcaacgugagcgugagccuggugccccccaccaagaucguggaguucgaccuggcccagcagaccgugaucgacgccaaggacagcaagagcuucaacugcagaaucgaguacgagaagguggacaaggccaccaagaacacccugugcaacuacgaccccagcaagaccugcuaccaggagcagacccagagccacgugagcuggcugugcagcaagcccuucaaggugaucugcaucuacaucagcuucuacagcaccgacuacaagcuggugcagaaggugugccccgacuacaacuaccacagcgacacccccuacuuccccagcggcuaa

SEQ ID NO: 20861 - RNA, 795 nt, Artificial Sequence
  NXPH2__Homo_sapiens__NP_009157
augagacugagaccccugccccuggugguggugcccggccugcugcagcugcuguucugcgacagcaaggagguggugcacgccaccgagggccuggacugggaggacaaggacgcccccggcacccuggugggcaacguggugcacagcagaaucaucagcccccugagacuguucgugaagcagagccccgugcccaagcccggccccauggccuacgccgacagcauggagaacuucugggacuggcuggccaacaucaccgagauccaggagccccuggccagaaccaagagaagacccaucgugaagaccggcaaguucaagaagauguucggcuggggcgacuuccacagcaacaucaagaccgugaagcugaaccugcugaucaccggcaagaucguggaccacggcaacggcaccuucagcguguacuucagacacaacagcaccggccugggcaacgugagcgugagccuggugccccccagcaaggugguggaguucgaggugagcccccagagcacccuggagaccaaggagagcaagagcuucaacugcagaaucgaguacgagaagaccgacagagccaagaagaccgcccugugcaacuucgaccccagcaagaucugcuaccaggagcagacccagagccacgugagcuggcugugcagcaagcccuucaaggugaucugcaucuacaucgccuucuacagcguggacuacaagcuggugcagaaggugugccccgacuacaacuaccacagcgagacccccuaccugagcagcggcuaa

SEQ ID NO: 20862 - RNA, 423 nt, Artificial Sequence
  NXT1__Homo_sapiens__XP_011527532
auggccagcguggacuucaagaccuacguggaccaggccugcagagccgccgaggaguucgugaacguguacuacaccaccauggacaagagaagaagacugcugagcagacuguacaugggcaccgccacccugguguggaacggcaacgccgugagcggccaggagagccugagcgaguucuucgagaugcugcccagcagcgaguuccagaucagcgugguggacugccagcccgugcacgacgaggccacccccagccagaccaccgugcugguggugaucugcggcagcgugaaguucgagggcaacaagcagagagacuucaaccagaacuucauccugaccgcccaggccagccccagcaacaccguguggaagaucgccagcgacugcuucagauuccaggacugggccagcuaa

SEQ ID NO: 20863 - RNA, 429 nt, Artificial Sequence
  NXT2__Homo_sapiens__NP_001229546
auggccaccagccuggacuucaagaccuacguggaccaggccugcagagccgccgaggaguucgugaacaucuacuacgagaccauggacaagagaagaagagcccugaccagacuguaccuggacaaggccacccugaucuggaacggcaacgccgugagcggccuggacgcccugaacaacuucuucgacacccugcccagcagcgaguuccaggugaacaugcuggacugccagcccgugcacgagcaggccacccagagccagaccaccgugcugguggugaccagcggcaccgugaaguucgacggcaacaagcagcacuucuucaaccagaacuuccugcugaccgcccagagcacccccaacaacaccguguggaagaucgccagcgacugcuucagauuccaggacuggagcagcagcuaa

SEQ ID NO: 20864 - RNA, 1962 nt, Artificial Sequence
  NYAP2__Homo_sapiens__NP_065915
augaucagcagcaagaugaugagcagcaaccccgaggaggacccccuggacaccuuccugcaguacaucgaggacaugggcaugaaggccuacgacggccuggugauccagaacgccagcgacaucgccagagagaacgacagacugagaaacgagaccaaccuggccuaccugaaggagaagaacgagaagagaagaagacaggaggaggccaucaagagaaucggcggcgaggugggcagaggccacgagggcagcuacgugggcaagcacuucagaaugggcuucaugaccaugcccgccccccaggacagacugccccaccccugcagcagcggcuucagcgugagaagccagagccugcacagcgugggcggcaccgacgacgacagcagcugcggcagcagaagacagcccccccccaagcccaagagagaccccagcaccaagcugagcaccagcagcgagaccgugagcagcaccgccgccagcaagagcggcaagacccccgagagaaccgaggccagcgccaagcccagaccccacagcgacgaguacagcaagaagauccccccccccaagcccaagagaaaccccaacacccagcugagcaccagcuucgacgagaccuacaucaagaagcacggccccagaagaaccagccugcccagagacagcagccugagccagaugggcagccccgccggcgaccccgaggaggaggagcccguguacaucgagauggugggcaacauccugagagacuucagaaaggaggacgacgaccagagcgaggccguguacgaggagaugaaguaccccaucuucgacgaccugggccaggacgccaagugcgacuucgaccaccacagcugcagcagccagugcgccacccccaccgugcccgaccuggacuucgccaaggccagcgugcccugcccccccaagggccugcugugcgacauccccccccccuuccccaaccugcugagccacagacccccccugcugguguucccccccgcccccgugcacugcagccccaacagcgacgagagcccccugaccccccuggaggugaccaagcugcccgugcuggagaacgugagcuacaugaagcagcccgccggcgccagccccagcacccugcccagccacgugcccggccacgccaagcuggagaaggagcaggccgccgcccugggccccgccagcgccacccccgcccugagcagcagcccccccccccccagcacccuguacagaacccagagcccccacggcuaccccaagagccacagcaccagccccagccccgugagcaugggcagaagccugaccccccugagccugaagagacccccccccuacgacgccgugcacagcggcagccugagcagaagcagccccagcgugccccacagcacccccagacccgugagccaggacggcgccaagauggugaacgccgccgugaacaccuacggcgccgcccccggcggcagcagaagcagaacccccaccagcccccuggaggagcugaccagccuguucagcagcggcagaagccugcugagaaagagcagcagcggcagaagaagcaaggagcccgccgagaagagcaccgaggagcugaaggugagaagccacagcaccgagccccugcccaagcuggacaacaaggagagaggccaccacggcgccagcagcagcagagagcccgugaaggcccaggagugggacggcacccccggcacccccguggugaccagcagacugggcagaugcagcgugagccccacccugcuggccggcaaccacagcagcgagcccaaggugagcugcaagcugggcagaagcgccagcaccagcggcgugcccccccccagcgugaccccccugagacagagcagcgaccugcagcagagccaggugcccagcagccuggccaacagagacuaa

SEQ ID NO: 20865 - RNA, 1446 nt, Artificial Sequence
  NYX__Homo_sapiens__NP_072089
augaagggcagaggcaugcuggugcugcugcugcacgccguggugcugggccugcccagcgccugggccgugggcgccugcgccagagccugccccgccgccugcgccugcagcaccguggagagaggcugcagcgugagaugcgacagagccggccugcugagagugcccgccgagcugcccugcgaggccgugagcaucgaccuggacagaaacggccugagauuccugggcgagagagccuucggcacccugcccagccugagaagacugagccugagacacaacaaccugagcuucaucacccccggcgccuucaagggccugcccagacuggccgagcugagacuggcccacaacggcgaccugagauaccugcacgccagaaccuucgccgcccugagcagacugagaagacuggaccuggccgccugcagacuguucagcgugcccgagagacugcuggccgagcugcccgcccugagagagcuggccgccuucgacaaccuguucagaagagugcccggcgcccugagaggccuggccaaccugacccacgcccaccuggagagaggcagaaucgaggccguggccagcagcagccugcagggccugagaagacugagaagccugagccugcaggccaacagagugagagccgugcacgccggcgccuucggcgacugcggcgugcuggagcaccugcugcugaacgacaaccugcuggccgagcugcccgccgacgccuucagaggccugagaagacugagaacccugaaccugggcggcaacgcccuggacagaguggccagagccugguucgccgaccuggccgagcuggagcugcuguaccuggacagaaacagcaucgccuucguggaggagggcgccuuccagaaccugagcggccugcuggcccugcaccugaacggcaacagacugaccgugcuggccuggguggccuuccagcccggcuucuuccugggcagacuguuccuguucagaaaccccuggugcugcgacugcagacuggaguggcugagagacuggauggagggcagcggcagagugaccgacgugcccugcgccagccccggcagcguggccggccuggaccugagccaggugaccuucggcagaagcagcgacggccugugcguggaccccgaggagcugaaccugaccaccagcagccccggccccagccccgagcccgccgccaccaccgugagcagauucagcagccugcugagcaagcugcuggcccccagagugcccguggaggaggccgccaacaccaccggcggccuggccaacgccagccugagcgacagccugagcagcagaggcgugggcggcgccggcagacagcccugguuccugcuggccagcugccugcugcccagcguggcccagcacgugguguucggccugcagauggacuaa

SEQ ID NO: 20866 - RNA, 459 nt, Artificial Sequence
  OARD1__Homo_sapiens__NP_659500
auggccagcagccugaacgaggaccccgagggcagcagaaucaccuacgugaagggcgaccuguucgccugccccaagaccgacagccuggcccacugcaucagcgaggacugcagaaugggcgccggcaucgccgugcuguucaagaagaaguucggcggcgugcaggagcugcugaaccagcagaagaagagcggcgagguggccgugcugaagagagacggcagauacaucuacuaccugaucaccaagaagagagccagccacaagcccaccuacgagaaccugcagaagagccuggaggccaugaagagccacugccugaagaacggcgugaccgaccugagcaugcccagaaucggcugcggccuggacagacugcagugggagaacgugagcgccaugaucgaggagguguucgaggccaccgacaucaagaucaccguguacacccuguaa

SEQ ID NO: 20867 - RNA, 1245 nt, Artificial Sequence
  OAS1__Homo_sapiens__NP_001027581
augauggaccugagaaacacccccgccaagagccuggacaaguucaucgaggacuaccugcugcccgacaccugcuucagaaugcagaucaaccacgccaucgacaucaucugcggcuuccugaaggagagaugcuucagaggcagcagcuaccccgugugcgugagcaagguggugaagggcggcagcagcggcaagggcaccacccugagaggcagaagcgacgccgaccuggugguguuccugagcccccugaccaccuuccaggaccagcugaacagaagaggcgaguucauccaggagaucagaagacagcuggaggccugccagagagagagagccuucagcgugaaguucgaggugcaggcccccagauggggcaaccccagagcccugagcuucgugcugagcagccugcagcugggcgagggcguggaguucgacgugcugcccgccuucgacgcccugggccagcugaccggcggcuacaagcccaacccccagaucuacgugaagcugaucgaggagugcaccgaccugcagaaggagggcgaguucagcaccugcuucaccgagcugcagagagacuuccugaagcagagacccaccaagcugaagagccugaucagacuggugaagcacugguaccagaacugcaagaagaagcugggcaagcugcccccccaguacgcccuggagcugcugaccguguacgccugggagagaggcagcaugaagacccacuucaacaccgcccagggcuucagaaccgugcuggagcuggugaucaacuaccagcagcugugcaucuacuggaccaaguacuacgacuucaagaaccccaucaucgagaaguaccugagaagacagcugaccaagcccagacccgugauccuggaccccgccgaccccaccggcaaccugggcggcggcgaccccaagggcuggagacagcuggcccaggaggccgaggccuggcugaacuaccccugcuucaagaacugggacggcagccccgugagcagcuggauccugcugacccagcacacccccggcagcauccaccccaccggcagaagaggccuggaccugcaccacccccugaacgccagcgccagcuggggcaagggccugcagugcuaccuggaccaguuccugcacuuccaggugggccugcugauccagagaggccagagcagcagcgugagcuggugcaucauccaggacagaacccaggugagcuaa

SEQ ID NO: 20868 - RNA, 519 nt, Artificial Sequence
  OAS2__Homo_sapiens__NP_001027903
augggcaacggcgagagccagcugagcagcgugcccgcccagaagcugggcugguucauccaggaguaccugaagcccuacgaggagugccagacccugaucgacgagauggugaacaccaucugcgacgugcugcaggagcccgagcaguucccccuggugcagggcguggccaucggcggcagcuacggcagaaagaccgugcugagaggcaacagcgacggcacccuggugcuguucuucagcgaccugaagcaguuccaggaccagaagagaagccagagagacauccuggacaagaccggcgacaagcugaaguucugccuguucaccaaguggcugaagaacaacuucgagauccagaagagccuggacggcuucaccauccagguguucaccaagaaccagagaaucagcuucgaggugcuggccgccuucaacgcccugagcaagcacugcugggugagcggcgagaagagccagagaagcggcugccagaccgcccugugcaaccuguaa

SEQ ID NO: 20869 - RNA, 3264 nt, Artificial Sequence
  OAS3__Homo_sapiens__NP_006178
auggaccuguacagcacccccgccgccgcccuggacagauucguggccagaagacugcagcccagaaaggaguucguggagaaggccagaagagcccugggcgcccuggccgccgcccugagagagagaggcggcagacugggcgccgccgcccccagagugcugaagaccgugaagggcggcagcagcggcagaggcaccgcccugaagggcggcugcgacagcgagcuggugaucuuccuggacugcuucaagagcuacguggaccagagagccagaagagccgagauccugagcgagaugagagccagccuggagagcugguggcagaaccccgugcccggccugagacugaccuuccccgagcagagcgugcccggcgcccugcaguucagacugaccagcguggaccuggaggacuggauggacgugagccuggugcccgccuucaacgugcugggccaggccggcagcggcgugaagcccaagccccagguguacagcacccugcugaacagcggcugccagggcggcgagcacgccgccugcuucaccgagcugagaagaaacuucgugaacaucagacccgccaagcugaagaaccugauccugcuggugaagcacugguaccaccaggugugccugcagggccuguggaaggagacccugccccccguguacgcccuggagcugcugaccaucuucgccugggagcagggcugcaagaaggacgccuucagccuggccgagggccugagaaccgugcugggccugauccagcagcaccagcaccugugcguguucuggaccgugaacuacggcuucgaggaccccgccgugggccaguuccugcagagacagcugaagagacccagacccgugauccuggaccccgccgaccccaccugggaccugggcaacggcgccgccuggcacugggaccugcuggcccaggaggccgccagcugcuacgaccaccccugcuuccugagaggcaugggcgaccccgugcagagcuggaagggccccggccugcccagagccggcugcagcggccugggccaccccauccagcuggaccccaaccagaagacccccgagaacagcaagagccugaacgccguguaccccagagccggcagcaagccccccagcugccccgcccccggccccaccggcgccgccagcaucgugcccagcgugcccggcauggcccuggaccugagccagauccccaccaaggagcuggacagauucauccaggaccaccugaagcccagcccccaguuccaggagcaggugaagaaggccaucgacaucauccugagaugccugcacgagaacugcgugcacaaggccagcagagugagcaagggcggcagcuucggcagaggcaccgaccugagagacggcugcgacguggagcugaucaucuuccugaacugcuucaccgacuacaaggaccagggccccagaagagccgagauccuggacgagaugagagcccagcuggagagcugguggcaggaccaggugcccagccugagccugcaguuccccgagcagaacgugcccgaggcccugcaguuccagcuggugagcaccgcccugaagagcuggaccgacgugagccugcugcccgccuucgacgccgugggccagcugagcagcggcaccaagcccaacccccagguguacagcagacugcugaccagcggcugccaggagggcgagcacaaggccugcuucgccgagcugagaagaaacuucaugaacaucagacccgugaagcugaagaaccugauccugcuggugaagcacugguacagacagguggccgcccagaacaagggcaagggccccgcccccgccagccugccccccgccuacgcccuggagcugcugaccaucuucgccugggagcagggcugcagacaggacugcuucaacauggcccagggcuucagaaccgugcugggccuggugcagcagcaccagcagcugugcguguacuggaccgugaacuacagcaccgaggaccccgccaugagaaugcaccugcugggccagcugagaaagcccagaccccuggugcuggaccccgccgaccccaccuggaacgugggccacggcagcugggagcugcuggcccaggaggccgccgcccugggcaugcaggccugcuuccugagcagagacggcaccagcgugcagcccugggacgugaugcccgcccugcuguaccagacccccgccggcgaccuggacaaguucaucagcgaguuccugcagcccaacagacaguuccuggcccaggugaacaaggccguggacaccaucugcagcuuccugaaggagaacugcuucagaaacagccccaucaaggugaucaagguggugaagggcggcagcagcgccaagggcaccgcccugagaggcagaagcgacgccgaccuggugguguuccugagcugcuucagccaguucaccgagcagggcaacaagagagccgagaucaucagcgagaucagagcccagcuggaggccugccagcaggagagacaguucgaggugaaguucgaggugagcaagugggagaaccccagagugcugagcuucagccugaccagccagaccaugcuggaccagagcguggacuucgacgugcugcccgccuucgacgcccugggccagcuggugagcggcagcagacccagcagccagguguacguggaccugauccacagcuacagcaacgccggcgaguacagcaccugcuucaccgagcugcagagagacuucaucaucagcagacccaccaagcugaagagccugaucagacuggugaagcacugguaccagcagugcaccaagaucagcaagggcagaggcagccugcccccccagcacggccuggagcugcugaccguguacgccugggagcagggcggcaaggacagccaguucaacauggccgagggcuucagaaccgugcuggagcuggugacccaguacagacagcugugcaucuacuggaccaucaacuacaacgccaaggacaagaccgugggcgacuuccugaagcagcagcugcagaagcccagacccaucauccuggaccccgccgaccccaccggcaaccugggccacaacgccagaugggaccugcuggccaaggaggccgccgccugcaccagcgcccugugcugcaugggcagaaacggcauccccauccagcccuggcccgugaaggccgccguguaa

SEQ ID NO: 20870 - RNA, 1545 nt, Artificial Sequence
  OASL__Homo_sapiens__NP_003724
auggcccugaugcaggagcuguacagcacccccgccagcagacuggacagcuucguggcccaguggcugcagccccacagagaguggaaggaggaggugcuggacgccgugagaaccguggaggaguuccugagacaggagcacuuccagggcaagagaggccuggaccaggacgugagagugcugaagguggugaaggugggcagcuucggcaacggcaccgugcugagaagcaccagagagguggagcugguggccuuccugagcugcuuccacagcuuccaggaggccgccaagcaccacaaggacgugcugagacugaucuggaagaccauguggcagagccaggaccugcuggaccugggccuggaggaccugagaauggagcagagagugcccgacgcccugguguucaccauccagaccagaggcaccgccgagcccaucaccgugaccaucgugcccgccuacagagcccugggccccagccugcccaacagccagcccccccccgagguguacgugagccugaucaaggccugcggcggccccggcaacuucugccccagcuucagcgagcugcagagaaacuucgugaagcacagacccaccaagcugaagagccugcugagacuggugaagcacugguaccagcaguacgugaaggccagaagccccagagccaaccugcccccccuguacgcccuggagcugcugaccaucuacgccugggagaugggcaccgaggaggacgagaacuucaugcuggacgagggcuucaccaccgugauggaccugcugcuggaguacgaggugaucugcaucuacuggaccaaguacuacacccugcacaacgccaucaucgaggacugcgugagaaagcagcugaagaaggagagacccaucauccuggaccccgccgaccccacccugaacguggccgagggcuacagaugggacaucguggcccagagagccagccagugccugaagcaggacugcugcuacgacaacagagagaaccccaucagcagcuggaacgugaagagagccagagacauccaccugaccguggagcagagaggcuaccccgacuucaaccugaucgugaaccccuacgagcccaucagaaaggugaaggagaagaucagaagaaccagaggcuacagcggccugcagagacugagcuuccaggugcccggcagcgagagacagcugcugagcagcagaugcagccuggccaaguacggcaucuucagccacacccacaucuaccugcuggagaccauccccagcgagauccagguguucgugaagaaccccgacggcggcagcuacgccuacgccaucaaccccaacagcuucauccugggccugaagcagcagaucgaggaccagcagggccugcccaagaagcagcagcagcuggaguuccagggccaggugcugcaggacuggcugggccugggcaucuacggcauccaggacagcgacacccugauccugagcaagaagaagggcgaggcccuguuccccgccagcuaa

SEQ ID NO: 20871 - RNA, 906 nt, Artificial Sequence
  OAT__Homo_sapiens__NP_001165285
augaacaccggcguggaggccggcgagaccgccugcaagcuggccagaaaguggggcuacaccgugaagggcauccagaaguacaaggccaagaucguguucgccgccggcaacuucuggggcagaacccugagcgccaucagcagcagcaccgaccccaccagcuacgacggcuucggccccuucaugcccggcuucgacaucauccccuacaacgaccugcccgcccuggagagagcccugcaggaccccaacguggccgccuucaugguggagcccauccagggcgaggccggcgugguggugcccgaccccggcuaccugaugggcgugagagagcugugcaccagacaccaggugcuguucaucgccgacgagauccagaccggccuggccagaaccggcagauggcuggccguggacuacgagaacgugagacccgacaucgugcugcugggcaaggcccugagcggcggccuguaccccgugagcgccgugcugugcgacgacgacaucaugcugaccaucaagcccggcgagcacggcagcaccuacggcggcaacccccugggcugcagaguggccaucgccgcccuggaggugcuggaggaggagaaccuggccgagaacgccgacaagcugggcaucauccugagaaacgagcugaugaagcugcccagcgacguggugaccgccgugagaggcaagggccugcugaacgccaucgugaucaaggagaccaaggacugggacgccuggaaggugugccugagacugagagacaacggccugcuggccaagcccacccacggcgacaucaucagauucgcccccccccuggugaucaaggaggacgagcugagagagagcaucgagaucaucaacaagaccauccugagcuucuaa

SEQ ID NO: 20872 - RNA, 681 nt, Artificial Sequence
  OAZ1__Homo_sapiens__NP_001287949
auggugaagagcagccugcagagaauccugaacagccacugcuucgccagagagaaggagggcgacaagcccagcgccaccauccacgccagcagaaccaugccccugcugagccugcacagcagaggcggcagcagcagcgagagagugagccugcacugcugcagcaaccccggccccggccccagauggugcagcgacgccccccaccccccccugaagauccccggcggcagaggcaacagccagagagaccacaaccugagcgccaaccuguucuacagcgacgacagacugaacgugaccgaggagcugaccagcaacgacaagaccagaauccugaacgugcagagcagacugaccgacgccaagagaaucaacuggagaaccgugcugagcggcggcagccuguacaucgagauccccggcggcgcccugcccgagggcagcaaggacagcuucgccgugcugcuggaguucgccgaggagcagcugagagccgaccacguguucaucugcuuccacaagaacagagaggacagagccgcccugcugagaaccuucagcuuccugggcuucgagaucgugagacccggccacccccuggugcccaagagacccgacgccugcuucauggccuacaccuucgagagagagagcagcggcgaggaggaggaguaa

SEQ ID NO: 20873 - RNA, 570 nt, Artificial Sequence
  OAZ2__Homo_sapiens__NP_002528
augaucaacacccaggacagcagcauccugccccugagcaacugcccccagcugcagugcugcagacacaucgugcccggcccccuguggugcagcgacgccccccacccccugagcaagauccccggcggcagaggcggcggcagagaccccagccugagcgcccugaucuacaaggacgagaagcugaccgugacccaggaccugcccgugaacgacggcaagccccacaucgugcacuuccaguacgaggugaccgaggugaaggugagcagcugggacgccgugcugagcagccagagccuguucguggagauccccgacggccugcuggccgacggcagcaaggagggccugcuggcccugcuggaguucgccgaggagaagaugaaggugaacuacguguucaucugcuucagaaagggcagagaggacagagccccccugcugaagaccuucagcuuccugggcuucgagaucgugagacccggccaccccugcgugcccagcagacccgacgugauguucaugguguacccccuggaccagaaccugagcgacgaggacuaa

SEQ ID NO: 20874 - RNA, 1107 nt, Artificial Sequence
  OBFC1__Homo_sapiens__XP_006718039
augcagcccggcagcagcagaugcgaggaggagacccccagccugcuguggggccuggaccccguguuccuggccuucgccaagcuguacaucagagacauccuggacaugaaggagagcagacaggugcccggcguguuccuguacaacggccaccccaucaagcagguggacgugcugggcaccgugaucggcgugagagagagagacgccuucuacagcuacggcguggacgacagcaccggcgugaucaacugcaucugcuggaagaagcugaacaccgagagcgugagcgccgcccccagcgccgccagagagcugagccugaccagccagcugaagaagcugcaggagaccaucgagcagaagaccaagaucgagaucggcgacaccaucagagugagaggcagcaucagaaccuacagagaggagagagagauccacgccaccaccuacuacaagguggacgaccccguguggaacauccagaucgccagaaugcuggagcugcccaccaucuacagaaagguguacgaccagcccuuccacagcagcgcccuggagaaggaggaggcccugagcaaccccggcgcccuggaccugcccagccugaccagccugcugagcgagaaggccaaggaguuccugauggagaacagagugcagagcuucuaccagcaggagcuggagaugguggagagccugcugagccuggccaaccagcccgugauccacagcgccagcagcgaccaggugaacuucaagaaggacaccaccagcaaggccauccacagcaucuucaagaacgccauccagcugcugcaggagaagggccugguguuccagaaggacgacggcuucgacaaccuguacuacgugaccagagaggacaaggaccugcacagaaagauccacagaaucauccagcaggacugccagaagcccaaccacauggagaagggcugccacuuccugcacauccuggccugcgccagacugagcaucagacccggccugagcgaggccgugcugcagcaggugcuggagcugcuggaggaccagagcgacaucgugagcaccauggagcacuacuacaccgccuucuaa

SEQ ID NO: 20875 - RNA, 687 nt, Artificial Sequence
  OBP2A__Homo_sapiens__NP_001280118
augaagacccuguuccugggcgugacccugggccuggccgccgcccugagcuucacccuggaggaggaggacaucaccggcaccugguacgugaaggccauggugguggacaaggacuuccccgaggacagaagacccagaaaggugagccccgugaaggugaccgcccugggcggcggcaaccuggaggccaccuucaccuucaugagagaggacagaugcauccagaagaagauccugaugagaaagaccgaggagcccggcaaguucagcgccuacggcggcagaaagcugaucuaccugcaggagcugcccggcaccgacgacuacguguucuacugcaaggaccagagaagaggcggccugagauacaugggcaagcugguggccagcgcccccugcagagccgugccccugagcccccccuggcugaccuggcccccccaccugcaggugggcauccugauccccaccuggagacccuggaagaaccugagaaacuggugcagcaccagagacagcagaagaagaaccuucagcugccccugcagaagagaggccgccuucagcaacaccagacagccccccggccugcaccugcagagcccccccuaccaccagacccagagccccgaccaccuggaccugcccagcagccacgaccccagccugcugccccccaccuaa

SEQ ID NO: 20876 - RNA, 23907 nt, Artificial Sequence
  OBSCN__Homo_sapiens__NP_001092093
auggaccagccccaguucagcggcgcccccagauuccugaccagacccaaggccuucguggugagcgugggcaaggacgccacccugagcugccagaucgugggcaaccccaccccccaggugagcugggagaaggaccagcagcccguggccgccggcgccagauucagacuggcccaggacggcgaccuguacagacugaccauccuggaccuggcccugggcgacagcggccaguacgugugcagagccagaaacgccaucggcgaggccuucgccgccgugggccugcagguggacgccgaggccgccugcgccgagcaggccccccacuuccugcugagacccaccagcaucagagugagagagggcagcgaggccaccuucagaugcagagugggcggcagccccagacccgccgugagcuggagcaaggacggcagaagacugggcgagcccgacggccccagagugagaguggaggagcugggcgaggccagcgcccugagaaucagagccgccagacccagagacggcggcaccuacgaggugagagccgagaacccccugggcgccgccagcgccgccgccgcccuggugguggacagcgacgccgccgacaccgccagcagacccggcaccagcaccgccgcccugcuggcccaccugcagagaagaagagaggccaugagagccgagggcgcccccgccagcccccccagcaccggcaccagaaccugcaccgugaccgagggcaagcacgccagacugagcugcuacgugaccggcgagcccaagcccgagaccguguggaagaaggacggccagcuggugaccgagggcagaagacacgugguguacgaggacgcccaggagaacuucgugcugaagauccuguucugcaagcagagcgacagaggccuguacaccugcaccgccagcaaccuggugggccagaccuacagcagcgugcuggugguggugagagagcccgccgugcccuucaagaagagacugcaggaccuggaggugagagagaaggagagcgccaccuuccugugcgaggugccccagcccagcaccgaggccgccugguucaaggaggagaccagacugugggccagcgccaaguacggcaucgaggaggagggcaccgagagaagacugaccgugagaaacgugagcgccgacgacgacgccguguacaucugcgagacccccgagggcagcagaaccguggccgagcuggccgugcagggcaaccugcugagaaagcugcccagaaagaccgccgugagagugggcgacaccgccauguucugcguggagcuggccgugcccgugggccccgugcacuggcugagaaaccaggaggaggugguggccggcggcagaguggccaucagcgccgagggcaccagacacacccugaccaucagccagugcugccuggaggacgugggccagguggccuucauggccggcgacugccagaccagcacccaguucugcgugagcgcccccagaaagcccccccugcagccccccguggaccccguggugaaggccagaauggagagcagcgugauccugagcuggagcccccccccccacggcgagagacccgugaccaucgacggcuaccugguggagaagaagaagcugggcaccuacaccuggaucagaugccacgaggccgaguggguggccacccccgagcugaccguggccgacguggccgaggagggcaacuuccaguucagagugagcgcccugaacagcuucggccagagccccuaccuggaguuccccggcaccgugcaccuggcccccaagcuggccgugagaaccccccugaaggccgugcaggccguggagggcggcgaggugaccuucagcguggaccugaccguggccagcgccggcgagugguuccuggacggccaggcccugaaggccagcagcguguacgagauccacugcgacagaaccagacacacccugaccaucagagaggugcccgccagccugcacggcgcccagcugaaguucguggccaacggcaucgagagcagcaucagaauggaggugagagccgcccccggccugaccgccaacaagccccccgccgccgccgccagagaggugcuggccagacugcacgaggaggcccagcugcuggccgagcugagcgaccaggccgccgccgugaccuggcugaaggacggcagaacccugagccccggccccaaguacgaggugcaggccagcgccggcagaagagugcugcuggugagagacguggccagagacgacgccggccuguacgagugcgugagcagaggcggcagaaucgccuaccagcugagcgugcagggccuggccagauuccugcacaaggacauggccggcagcugcguggacgccguggccggcggccccgcccaguucgagugcgagaccagcgaggcccacgugcacgugcacugguacaaggacggcauggagcugggccacagcggcgagagauuccugcaggaggacgugggcaccagacacagacugguggccgccaccgugaccagacaggacgagggcaccuacagcugcagagugggcgaggacagcguggacuucagacugagagugagcgagcccaaggugguguucgccaaggagcagcuggccagaagaaagcugcaggccgaggccggcgccagcgccacccugagcugcgagguggcccaggcccagaccgaggugaccugguacaaggacggcaagaagcugagcagcagcagcaaggugugcauggaggccaccggcugcaccagaagacugguggugcagcaggccggccaggccgacgccggcgaguacagcugcgaggccggcggccagagacugagcuuccaccuggacgugaaggagcccaaggugguguucgccaaggaccagguggcccacagcgaggugcaggccgaggccggcgccagcgccacccugagcugcgagguggcccaggcccagaccgaggugaugugguacaaggacggcaagaagcugagcagcagccugaaggugcacguggaggccaagggcugcagaagaagacugguggugcagcaggccggcaagaccgacgccggcgacuacagcugcgaggccagaggccagagagugagcuucagacugcacaucaccgagcccaagaugauguucgccaaggagcagagcgugcacaacgaggugcaggccgaggccggcgccagcgccaugcugagcugcgagguggcccaggcccagaccgaggugaccugguacaaggacggcaagaagcugagcagcagcagcaaggugggcauggaggugaagggcugcaccagaagacuggugcugccccaggccggcaaggccgacgccggcgaguacagcugcgaggccggcggccagagagugagcuuccaccugcacaucaccgagcccaagggcguguucgccaaggagcagagcgugcacaacgaggugcaggccgaggccggcaccaccgccaugcugagcugcgagguggcccagccccagaccgaggugaccugguacaaggacggcaagaagcugagcagcagcagcaaggugagaauggaggugaagggcugcaccagaagacugguggugcagcaggugggcaaggccgacgccggcgaguacagcugcgaggccggcggccagagagugagcuuccagcugcacaucaccgagcccaaggccguguucgccaaggagcagcuggugcacaacgaggugagaaccgaggccggcgccagcgccacccugagcugcgagguggcccaggcccagaccgaggugaccugguacaaggacggcaagaagcugagcagcagcagcaaggugagaaucgaggccgccggcugcaugagacagcugguggugcagcaggccggccaggccgacgccggcgaguacaccugcgaggccggcggccagagacugagcuuccaccuggacgugagcgagcccaaggccguguucgccaaggagcagcuggcccacagaaaggugcaggccgaggccggcgccaucgccacccugagcugcgagguggcccaggcccagaccgaggugaccugguacaaggacggcaagaagcugagcagcagcagcaaggugagaauggaggccgugggcugcaccagaagacugguggugcagcaggccugccaggccgacaccggcgaguacagcugcgaggccggcggccagagacugagcuucagccuggacguggccgagcccaaggugguguucgccaaggagcagcccgugcacagagaggugcaggcccaggccggcgccagcaccacccugagcugcgagguggcccaggcccagaccgaggugaugugguacaaggacggcaagaagcugagcuucagcagcaaggugagaauggaggccgugggcugcaccagaagacugguggugcagcaggccggccaggccguggccggcgaguacagcugcgaggccggcagccagagacugagcuuccaccugcacguggccgagcccaaggccguguucgccaaggagcagcccgccagcagagaggugcaggccgaggccggcaccagcgccacccugagcugcgagguggcccaggcccagaccgaggugaccugguacaaggacggcaagaagcugagcagcagcagcaaggugagaauggaggccgugggcugcaccagaagacugguggugcaggaggccggccaggccgacgccggcgaguacagcugcaaggccggcgaccagagacugagcuuccaccugcacguggccgagcccaaggugguguucgccaaggagcagcccgcccacagagaggugcaggccgaggccggcgccagcgccacccugagcugcgagguggcccaggcccagaccgaggugaccugguacaaggacggcaagaagcugagcagcagcagcaaggugagaguggaggccgugggcugcaccagaagacugguggugcagcaggccggccaggccgaggccggcgaguacagcugcgaggccggcggccagcagcugagcuucagacugcagguggccgagcuggagccccagaucagcgagagacccugcagaagagagccccugguggugaaggagcacgaggacaucauccugaccgccacccuggccacccccagcgccgccaccgugaccuggcugaaggacggcguggagaucagaagaagcaagagacacgagaccgccagccagggcgacacccacacccugaccgugcacggcgcccaggugcuggacagcgccaucuacagcugcagagugggcgccgagggccaggacuuccccgugcagguggaggagguggccgccaaguucugcagacugcuggagcccgugugcggcgagcugggcggcaccgugacccuggccugcgagcugagccccgccugcgccgaggugguguggagaugcggcaacacccagcugagagugggcaagagauuccagaugguggccgagggccccgugagaagccugaccgugcugggccugagagccgaggacgccggcgaguacgugugcgagagcagagacgaccacaccagcgcccagcugaccgugagcgugcccagaguggugaaguucaugagcggccugagcaccgugguggccgaggagggcggcgaggccaccuuccagugcguggugagccccagcgacguggccguggugugguucagagacggcgcccugcugcagcccagcgagaaguucgccaucagccagagcggcgccagccacagccugaccaucagcgaccuggugcuggaggacgccggccagaucaccguggaggccgagggcgccagcagcagcgccgcccugagagugagagaggcccccgugcuguucaagaagaagcuggagccccagaccguggaggagagaagcagcgugacccuggagguggagcugaccagacccuggcccgagcugagauggaccagaaacgccaccgcccuggcccccggcaagaacguggagauccacgccgagggcgccagacacagacuggugcugcacaacgugggcuucgccgacagaggcuucuucggcugcgagacccccgacgacaagacccaggccaagcugaccguggagaugagacaggugagacuggugagaggccugcaggccguggaggccagagagcagggcaccgccaccauggaggugcagcugagccacgccgacguggacggcagcuggaccagagacggccugagauuccagcagggccccaccugccaccuggccgugagaggccccaugcacacccugacccugagcggccugagacccgaggacagcggccugaugguguucaaggccgagggcgugcacaccagcgccagacugguggugaccgagcugcccgugagcuucagcagaccccugcaggacguggugaccaccgagaaggagaaggugacccuggagugcgagcugagcagacccaacguggacgugagauggcugaaggacggcguggagcugagagccggcaagaccauggccaucgccgcccagggcgccugcagaagccugaccaucuacagaugcgaguucgccgaccagggcguguacgugugcgacgcccacgacgcccagagcagcgccagcgugaaggugcagggcagaaccuacacccugaucuacagaagagugcuggccgaggacgccggcgagauccaguucguggccgagaacgccgagagcagagcccagcugagagugaaggagcugcccgugacccuggugagaccccugagagacaagaucgccauggagaagcacagaggcgugcuggagugccaggugagcagagccagcgcccaggugagaugguucaagggcagccaggagcugcagcccggccccaaguacgagcuggugagcgacggccuguacagaaagcugaucaucagcgacgugcacgccgaggacgaggacaccuacaccugcgacgccggcgacgugaagaccagcgcccaguucuucguggaggagcagagcaucaccaucgugagaggccugcaggacgugaccgugauggagcccgcccccgccugguucgagugcgagaccagcauccccagcgugagaccccccaaguggcugcugggcaagaccgugcugcaggccggcggcaacgugggccuggagcaggagggcaccgugcacagacugaugcugagaagaaccugcagcaccaugaccggccccgugcacuucaccgugggcaagagcagaagcagcgccagacugguggugagcgacauccccguggugcugaccagaccccuggagcccaagaccggcagagagcugcagagcguggugcugagcugcgacuucagacccgcccccaaggccgugcagugguacaaggacgacaccccccugagccccagcgagaaguucaagaugagccuggagggccagauggccgagcugagaauccugagacugaugcccgccgacgccggcguguacagaugccaggccggcagcgcccacagcagcaccgaggugaccguggaggccagagaggugaccgugaccggcccccugcaggacgccgaggccaccgaggagggcugggccagcuucagcugcgagcugagccacgaggacgaggagguggaguggagccugaacggcaugccccuguacaacgacagcuuccacgagaucagccacaagggcagaagacacacccuggugcugaagagcauccagagagccgacgccggcaucgugagagccagcagccugaaggugagcaccagcgccagacuggaggugagagugaagcccgugguguuccugaaggcccuggacgaccugagcgccgaggagagaggcacccuggcccugcagugcgaggugagcgaccccgaggcccacgugguguggagaaaggacggcgugcagcugggccccagcgacaaguacgacuuccugcacaccgccggcaccagaggccugguggugcacgacgugagccccgaggacgccggccuguacaccugccacgugggcagcgaggagaccagagccagagugagagugcacgaccugcacgugggcaucaccaagagacugaagaccauggaggugcuggagggcgagagcugcagcuucgagugcgugcugagccacgagagcgccagcgaccccgccauguggaccgugggcggcaagaccgugggcagcagcagcagauuccaggccaccagacagggcagaaaguacauccugguggugagagaggccgcccccagcgacgccggcgaggugguguucagcgugagaggccugaccagcaaggccagccugaucgugagagagagacccgccgccaucaucaagccccuggaggaccaguggguggcccccggcgaggacguggagcugagaugcgagcugagcagagccggcacccccgugcacuggcugaaggacagaaaggccaucagaaagagccagaaguacgacguggugugcgagggcaccauggccaugcuggugaucagaggcgccagccugaaggacgccggcgaguacaccugcgagguggaggccagcaagagcaccgccagccugcacguggaggagaaggccaacugcuucaccgaggagcugaccaaccugcagguggaggagaagggcaccgccguguucaccugcaagaccgagcaccccgccgccaccgugaccuggagaaagggccugcuggagcugagagccagcggcaagcaccagcccagccaggagggccugacccugagacugaccaucagcgcccuggagaaggccgacagcgacaccuacaccugcgacaucggccaggcccagagcagagcccagcugcuggugcagggcagaagagugcacaucaucgaggaccuggaggacguggacgugcaggagggcagcagcgccaccuucagaugcagaaucagccccgccaacuacgagcccgugcacugguuccuggacaagaccccccugcacgccaacgagcugaacgagaucgacgcccagcccggcggcuaccacgugcugacccugagacagcuggcccugaaggacagcggcaccaucuacuucgaggccggcgaccagagagccagcgccgcccugagagugaccgagaagcccagcguguucagcagagagcugaccgacgccaccaucaccgagggcgaggaccugacccuggugugcgagaccagcaccugcgacauccccgugugcuggaccaaggacggcaagacccugagaggcagcgccagaugccagcugagccacgagggccacagagcccagcugcugaucaccggcgccacccugcaggacagcggcagauacaagugcgaggccggcggcgccugcagcagcagcaucgugagagugcacgccagacccgugagauuccaggaggcccugaaggaccuggaggugcuggagggcggcgccgccacccugagaugcgugcugagcagcguggccgcccccgugaaguggugcuacggcaacaacgugcugagacccggcgacaaguacagccugagacaggagggcgccaugcuggagcugguggugagaaaccugagaccccaggacagcggcagauacagcugcagcuucggcgaccagaccaccagcgccacccugaccgugaccgcccugcccgcccaguucaucggcaagcugagaaacaaggaggccaccgagggcgccaccgccacccugagaugcgagcugagcaaggccgcccccguggaguggagaaagggcagcgagacccugagagacggcgacagauacugccugagacaggacggcgccaugugcgagcugcagaucagaggccuggccaugguggacgccgccgaguacagcugcgugugcggcgaggagagaaccagcgccagccugaccaucagacccaugcccgcccacuucaucggcagacugagacaccaggagagcaucgagggcgccaccgccacccugagaugcgagcugagcaaggccgcccccguggaguggagaaagggcagagagagccugagagacggcgacagacacagccugagacaggacggcgccgugugcgagcugcagaucugcggccuggccguggccgacgccggcgaguacagcugcgugugcggcgaggagagaaccagcgccacccugaccgugaaggcccugcccgccaaguucaccgagggccugagaaacgaggaggccguggagggcgccaccgccaugcuguggugcgagcugagcaagguggcccccguggaguggagaaagggccccgagaaccugagagacggcgacagauacauccugagacaggagggcaccagaugcgagcugcagaucugcggccuggccauggccgacgccggcgaguaccugugcgugugcggccaggagagaaccagcgccacccugaccaucagagcccugcccgccagauucaucgaggacgugaagaaccaggaggccagagagggcgccaccgccgugcugcagugcgagcugaacagcgccgcccccguggaguggagaaagggcagcgagacccugagagacggcgacagauacagccugagacaggacggcaccaagugcgagcugcagaucagaggccuggccauggccgacaccggcgaguacagcugcgugugcggccaggagagaaccagcgccaugcugaccgugagagcccugcccaucaaguucaccgagggccugagaaacgaggaggccaccgagggcgccaccgccgugcugagaugcgagcugagcaagauggcccccguggagugguggaagggccacgagacccugagagacggcgacagacacagccugagacaggacggcgccagaugcgagcugcagaucagaggccugguggccgaggacgccggcgaguaccugugcaugugcggcaaggagagaaccagcgccaugcugaccgugagagccaugcccagcaaguucaucgagggccugagaaacgaggaggccaccgagggcgacaccgccacccuguggugcgagcugagcaaggccgcccccguggaguggagaaagggccacgagacccugagagacggcgacagacacagccugagacaggacggcagcagaugcgagcugcagaucagaggccuggccgugguggacgccggcgaguacagcugcgugugcggccaggagagaaccagcgccacccugaccgugagagcccugcccgccagauucaucgaggacgugaagaaccaggaggccagagagggcgccaccgccgugcugcagugcgagcugagcaaggccgcccccguggaguggagaaagggcagcgagacccugagaggcggcgacagauacagccugagacaggacggcaccagaugcgagcugcagauccacggccugagcguggccgacaccggcgaguacagcugcgugugcggccaggagagaaccagcgccacccugaccgugagagccccccagcccguguucagagagccccugcagagccugcaggccgaggagggcagcaccgccacccugcagugcgagcugagcgagcccaccgccaccgugguguggagcaagggcggccugcagcugcaggccaacggcagaagagagcccagacugcagggcugcaccgccgagcuggugcugcaggaccugcagagagaggacaccggcgaguacaccugcaccugcggcagccaggccaccagcgccacccugaccgugaccgccgcccccgugagauuccugagagagcugcagcaccaggagguggacgagggcggcaccgcccaccugugcugcgagcugagcagagccggcgccagcguggaguggagaaagggcagccugcagcuguuccccugcgccaaguaccagauggugcaggacggcgccgccgccgagcugcuggugagaggcguggagcaggaggacgccggcgacuacaccugcgacaccggccacacccagagcauggccagccugagcgugagagugcccagacccaaguucaagaccagacugcagagccuggagcaggagaccggcgacaucgccagacugugcugccagcugagcgacgccgagagcggcgccguggugcaguggcugaaggagggcguggagcugcacgccggccccaaguacgagaugagaagccagggcgccaccagagagcugcugauccaccagcuggaggccaaggacaccggcgaguacgccugcgugaccggcggccagaagaccgccgccagccugagagugaccgagcccgaggugaccaucgugagaggccugguggacgccgaggugaccgccgacgaggacguggaguucagcugcgaggugagcagagccggcgccaccggcgugcaguggugccugcagggccugccccugcagagcaacgaggugaccgagguggccgugagagacggcagaauccacacccugagacugaagggcgugacccccgaggacgccggcaccgugagcuuccaccugggcaaccacgccagcagcgcccagcugaccgugagagcccccgaggugaccauccuggagccccugcaggacgugcagcugagcgagggccaggacgccagcuuccagugcagacugagcagagccagcggccaggaggccagaugggcccugggcggcgugccccugcaggccaacgagaugaacgacaucaccguggagcagggcacccugcaccugcugacccugcacaaggugacccuggaggacgccggcaccgugagcuuccacgugggcaccugcagcagcgaggcccagcugaaggugaccgccaagaacaccguggugagaggccuggagaacguggaggcccuggagggcggcgaggcccuguucgagugccagcugagccagcccgagguggccgcccacaccuggcugcuggacgacgagcccgugcacaccagcgagaacgccgaggugguguucuucgagaacggccugagacaccugcugcugcugaagaaccugagaccccaggacagcugcagagugaccuuccuggccggcgacauggugaccagcgccuuccugaccgugagaggcuggagacuggagauccuggagccccugaagaacgccgccgugagagccggcgcccaggccugcuucaccugcacccugagcgaggccgugcccgugggcgaggccagcugguacaucaacggcgccgccgugcagcccgacgacagcgacuggaccgugaccgccgacggcagccaccacgcccugcugcugagaagcgcccagccccaccacgccggcgaggugaccuucgccugcagagacgccguggccagcgccagacugaccgugcugggccugcccgacccccccgaggacgccgaggugguggccagaagcagccacaccgugacccugagcugggccgcccccaugagcgacggcggcggcggccugugcggcuacagaguggaggugaaggagggcgccaccggccaguggagacugugccacgagcuggugcccggccccgagugcgugguggacggccuggcccccggcgagaccuacagauucagaguggccgccgugggccccgugggcgccggcgagcccgugcaccugccccagaccgugagacuggccgagccccccaagcccgugcccccccagcccagcgcccccgagagcagacagguggccgccggcgaggacgugagccuggagcuggaggugguggccgaggccggcgaggugaucuggcacaagggcauggagagaauccagcccggcggcagauucgagguggugagccagggcagacagcagaugcuggugaucaagggcuucaccgccgaggaccagggcgaguaccacugcggccuggcccagggcagcaucugccccgccgccgccaccuuccagguggcccugagccccgccagcguggacgaggccccccagcccagccugccccccgaggccgcccaggagggcgaccugcaccugcugugggaggcccuggccagaaagagaagaaugagcagagagcccacccuggacagcaucagcgagcugcccgaggaggacggcagaagccagagacugccccaggaggccgaggagguggcccccgaccugagcgagggcuacagcaccgccgacgagcuggccagaaccggcgacgccgaccugagccacaccagcagcgacgacgagagcagagccggcacccccagccuggugaccuaccugaagaaggccggcagacccggcaccagcccccuggccagcaaggugggcgcccccgccgcccccagcgugaagccccagcagcagcaggagccccuggccgccgugagacccccccugggcgaccugagcaccaaggaccugggcgaccccagcauggacaaggccgccgugaagauccaggccgccuucaagggcuacaaggugagaaaggagaugaagcagcaggagggccccauguucagccacaccuucggcgacaccgaggcccaggugggcgacgcccugagacuggagugcgugguggccagcaaggccgacgugagagccagauggcugaaggacggcguggagcugaccgacggcagacaccaccacaucgaccagcugggcgacggcaccugcagccugcugaucaccggccuggacagagccgacgccggcugcuacaccugccaggugagcaacaaguucggccaggugacccacagcgccugcgugguggugagcggcagcgagagcgaggccgagagcagcagcggcggcgagcuggacgacgccuucagaagagccgccagaagacugcacagacuguucagaaccaagagccccgccgaggugagcgacgaggagcuguuccugagcgccgacgagggccccgccgagcccgaggagcccgccgacuggcagaccuacagagaggacgagcacuucaucugcaucagauucgaggcccugaccgaggccagacaggccgugaccagauuccaggagauguucgccacccugggcaucggcguggagaucaagcugguggagcagggccccagaagaguggagaugugcaucagcaaggagacccccgcccccguggugccccccgagccccugcccagccugcugaccagcgacgccgcccccguguuccugaccgagcugcagaaccaggaggugcaggacggcuaccccgugagcuucgacugcguggugaccggccagcccaugcccagcgugagaugguucaaggacggcaagcugcuggaggaggacgaccacuacaugaucaacgaggaccagcagggcggccaccagcugaucaucaccgccguggugcccgccgacaugggcguguacagaugccuggccgagaacagcaugggcgugagcagcaccaaggccgagcugagaguggaccugaccagcaccgacuacgacaccgccgccgacgccaccgagagcagcagcuacuucagcgcccagggcuaccugagcagcagagagcaggagggcaccgagagcaccaccgacgagggccagcugccccaggugguggaggagcugagagaccugcagguggcccccggcaccagacuggccaaguuccagcugaaggugaagggcuaccccgcccccagacuguacugguucaaggacggccagccccugaccgccagcgcccacaucagaaugaccgacaagaagauccugcacacccuggagaucaucagcgugaccagagaggacagcggccaguacgccgccuacaucagcaacgccaugggcgccgccuacagcagcgccagacugcuggugagaggccccgacgagcccgaggagaagcccgccagcgacgugcacgagcagcuggugccccccagaaugcuggagagauucacccccaagaaggugaagaagggcagcagcaucaccuucagcgugaagguggagggcagacccgugcccaccgugcacuggcugagagaggaggccgagagaggcgugcuguggaucggccccgacacccccggcuacaccguggccagcagcgcccagcagcacagccuggugcugcuggacgugggcagacagcaccagggcaccuacaccugcaucgccagcaacgccgccggccaggcccugugcagcgccagccugcacgugagcggccugcccaagguggaggagcaggagaaggugaaggaggcccugaucagcaccuuccugcagggcaccacccaggccaucagcgcccagggccuggagaccgccagcuucgccgaccugggcggccagagaaaggaggagccccuggccgccaaggaggcccugggccaccugagccuggccgaggugggcaccgaggaguuccugcagaagcugaccagccagaucaccgagauggugagcgccaagaucacccaggccaagcugcaggugcccggcggcgacagcgacgaggacagcaagacccccagcgccagccccagacacggcagaagcagacccagcagcagcauccaggagagcagcagcgagagcgaggacggcgacgccagaggcgagaucuucgacaucuacguggugaccgccgacuaccugccccugggcgccgagcaggacgccaucacccugagagagggccaguacguggaggugcuggacgccgcccacccccugagauggcuggugagaaccaagcccaccaagagcagccccagcagacagggcugggugagccccgccuaccuggacagaagacugaagcugagccccgaguggggcgccgccgaggcccccgaguuccccggcgaggccgugagcgaggacgaguacaaggccagacugagcagcgugauccaggagcugcugagcagcgagcaggccuucguggaggagcugcaguuccugcagagccaccaccugcagcaccuggagagaugcccccacgugcccaucgccguggccggccagaaggccgugaucuucagaaacgugagagacaucggcagauuccacagcagcuuccugcaggagcugcagcagugcgacaccgacgacgacguggccaugugcuucaucaagaaccaggccgccuucgagcaguaccuggaguuccuggugggcagagugcaggccgagagcgugguggugagcaccgccauccaggaguucuacaagaaguacgccgaggaggcccugcuggccggcgaccccagccagccccccccccccccccugcagcacuaccuggagcagcccguggagagagugcagagauaccaggcccugcugaaggagcugaucagaaacaaggccagaaacagacagaacugcgcccugcuggagcaggccuacgccguggugagcgcccugccccagagagccgagaacaagcugcacgugagccugauggagaacuaccccggcacccugcaggcccugggcgagcccaucagacagggccacuucaucgugugggagggcgcccccggcgccagaaugcccuggaagggccacaacagacacguguuccuguucagaaaccaccuggugaucugcaagcccagaagagacagcagaaccgacaccgugagcuacguguucagaaacaugaugaagcugagcagcaucgaccugaacgaccagguggagggcgacgacagagccuucgagguguggcaggagagagaggacagcgugagaaaguaccugcugcaggccagaaccgccaucaucaagagcagcugggugaaggagaucugcggcauccagcagagacuggcccugcccguguggagaccccccgacuucgaggaggagcuggccgacugcaccgccgagcugggcgagaccgugaagcuggccugcagagugaccggcacccccaagcccgugaucagcugguacaaggacggcaaggccgugcagguggacccccaccacauccugaucgaggaccccgacggcagcugcgcccugauccuggacagccugaccggcguggacagcggccaguacaugugcuucgccgccagcgccgccggcaacugcagcacccugggcaagauccuggugcaggugccccccagauucgugaacaaggugagagccagccccuucguggagggcgaggacgcccaguucaccugcaccaucgagggcgcccccuacccccagaucagaugguacaaggacggcgcccugcugaccaccggcaacaaguuccagacccugagcgagcccagaagcggccugcuggugcuggugaucagagccgccagcaaggaggaccugggccuguacgagugcgagcuggugaacagacugggcagcgccagagccagcgccgagcugagaauccagagccccaugcugcaggcccaggagcagugccacagagagcagcugguggccgccguggaggacaccacccuggagagagccgaccaggaggugaccagcgugcugaagagacugcugggccccaaggcccccggccccagcaccggcgaccugaccggccccggccccugccccagaggcgcccccgcccugcaggagaccggcagccagccccccgugaccggcaccagcgaggcccccgccgugccccccagagugccccagccccugcugcacgagggccccgagcaggagcccgaggccaucgccagagcccaggaguggaccgugcccaucagaauggagggcgccgccuggcccggcgccggcaccggcgagcugcugugggacgugcacagccacguggugagagagaccacccagagaaccuacaccuaccaggccaucgacacccacaccgccagaccccccagcaugcaggugaccaucgaggacgugcaggcccagaccggcggcaccgcccaguucgaggccaucaucgagggcgacccccagcccagcgugaccugguacaaggacagcgugcagcugguggacagcaccagacugagccagcagcaggagggcaccaccuacagccuggugcugagacacguggccagcaaggacgccggcguguacaccugccuggcccagaacaccggcggccaggugcugugcaaggccgagcugcuggugcugggcggcgacaacgagcccgacagcgagaagcagagccacagaagaaagcugcacagcuucuacgaggugaaggaggagaucggcagaggcguguucggcuucgugaagagagugcagcacaagggcaacaagauccugugcgccgccaaguucaucccccugagaagcagaaccagagcccaggccuacagagagagagacauccuggccgcccugagccacccccuggugaccggccugcuggaccaguucgagaccagaaagacccugauccugauccuggagcugugcagcagcgaggagcugcuggacagacuguacagaaagggcguggugaccgaggccgaggugaagguguacauccagcagcugguggagggccugcacuaccugcacagccacggcgugcugcaccuggacaucaagcccagcaacauccugauggugcaccccgccagagaggacaucaagaucugcgacuucggcuucgcccagaacaucacccccgccgagcugcaguucagccaguacggcagccccgaguucgugagccccgagaucauccagcagaaccccgugagcgaggccagcgacaucugggccaugggcgugaucagcuaccugagccugaccugcagcagccccuucgccggcgagagcgacagagccacccugcugaacgugcuggagggcagagugagcuggagcagccccauggccgcccaccugagcgaggacgccaaggacuucaucaaggccacccugcagagagccccccaggccagacccagcgccgcccagugccugagccaccccugguuccugaagagcaugcccgccgaggaggcccacuucaucaacaccaagcagcugaaguuccugcuggccagaagcagauggcagagaagccugaugagcuacaagagcauccuggugaugagaagcauccccgagcugcugagaggcccccccgacagccccagccugggcguggccagacaccugugcagagacaccggcggcagcagcagcagcagcagcagcagcgacaacgagcuggcccccuucgccagagccaagagccugccccccagccccgugacccacagcccccugcugcaccccagaggcuuccugagacccagcgccagccugcccgaggaggccgaggccagcgagagaagcaccgaggcccccgccccccccgccagccccgagggcgccggcccccccgccgcccagggcugcgugcccagacacagcgugaucagaagccuguucuaccaccaggccggcgagagccccgagcacggcgcccuggcccccggcagcagaagacaccccgccagaagaagacaccugcugaagggcggcuacaucgccggcgcccugcccggccugagagagccccugauggagcacagagugcuggaggaggaggccgccagagaggagcaggccacccugcuggccaaggcccccagcuucgagaccgcccugagacugcccgccagcggcacccaccuggcccccggccacagccacagccuggagcacgacagccccagcacccccagacccagcagcgaggccugcggcgaggcccagagacugcccagcgcccccagcggcggcgcccccaucagagacaugggccacccccagggcagcaagcagcugcccagcaccggcggccaccccggcaccgcccagcccgagagacccagccccgacagccccuggggccagcccgcccccuucugccaccccaagcagggcagcgccccccaggagggcugcagcccccaccccgccguggcccccugcccccccggcagcuucccccccggcagcugcaaggaggccccccuggugcccagcagccccuuccugggccagccccaggccccccccgcccccgccaaggccagccccccccuggacagcaagaugggccccggcgacaucagccugcccggcagacccaagcccggccccugcagcagccccggcagcgccagccaggccagcagcagccaggugagcagccugagagugggcagcagccaggugggcaccgagcccggccccagccuggacgccgagggcuggacccaggaggccgaggaccugagcgacagcacccccacccugcagagaccccaggagcaggccaccaugagaaaguucagccugggcggcagaggcggcuacgccggcguggccggcuacggcaccuucgccuucggcggcgacgccggcggcaugcugggccagggccccaugugggccagaaucgccugggccgugagccagagcgaggaggaggagcaggaggaggccagagccgagagccagagcgaggagcagcaggaggccagagccgagagcccccugccccaggugagcgccagacccgugcccgaggugggcagagcccccaccagaagcagccccgagcccacccccugggaggacaucggccaggugagccuggugcagaucagagaccugagcggcgacgccgaggccgccgacaccaucagccuggacaucagcgagguggaccccgccuaccugaaccugagcgaccuguacgacaucaaguaccugcccuucgaguucaugaucuucagaaaggugcccaagagcgcccagcccgagccccccagccccauggccgaggaggagcuggccgaguuccccgagcccaccuggcccuggcccggcgagcugggcccccacgccggccuggagaucaccgaggagagcgaggacguggacgcccugcuggccgaggccgccgugggcagaaagagaaaguggagcagccccagcagaagccuguuccacuuccccggcagacaccugccccuggacgagcccgccgagcugggccugagagagagagugaaggccagcguggagcacaucagcagaauccugaagggcagacccgagggccuggagaaggagggcccccccagaaagaagcccggccuggccagcuucagacugagcggccugaagagcugggacagagcccccaccuuccugagagagcugagcgacgagaccguggugcugggccagagcgugacccuggccugccaggugagcgcccagcccgccgcccaggccaccuggagcaaggacggcgccccccuggagagcagcagcagagugcugaucagcgccacccugaagaacuuccagcugcugaccauccugguggugguggccgaggaccugggcguguacaccugcagcgugagcaacgcccugggcaccgugaccaccaccggcgugcugagaaaggccgagagacccagcagcagccccugccccgacaucggcgagguguacgccgacggcgugcugcugguguggaagcccguggagagcuacggccccgugaccuacaucgugcagugcagccuggagggcggcagcuggaccacccuggccagcgacaucuucgacugcugcuaccugaccagcaagcugagcagaggcggcaccuacaccuucagaaccgccugcgugagcaaggccggcaugggccccuacagcagccccagcgagcaggugcugcugggcggccccagccaccuggccagcgaggaggagagccagggcagaagcgcccagccccugcccagcaccaagaccuucgccuuccagacccagauccagagaggcagauucagcguggugagacagugcugggagaaggccagcggcagagcccuggccgccaagaucauccccuaccaccccaaggacaagaccgccgugcugagagaguacgaggcccugaagggccugagacacccccaccuggcccagcugcacgccgccuaccugagccccagacaccuggugcugauccuggagcugugcagcggccccgagcugcugcccugccuggccgagagagccagcuacagcgagagcgaggugaaggacuaccuguggcagaugcugagcgccacccaguaccugcacaaccagcacauccugcaccuggaccugagaagcgagaacaugaucaucaccgaguacaaccugcugaaggugguggaccugggcaacgcccagagccugagccaggagaaggugcugcccagcgacaaguucaaggacuaccuggagaccauggcccccgagcugcuggagggccagggcgccgugccccagaccgacaucugggccaucggcgugaccgccuucaucaugcugagcgccgaguaccccgugagcagcgagggcgccagagaccugcagagaggccugagaaagggccuggugagacugagcagaugcuacgccggccugagcggcggcgccguggccuuccugagaagcacccugugcgcccagcccuggggcagacccugcgccagcagcugccugcagugccccuggcugaccgaggagggccccgccugcagcagacccgcccccgugaccuuccccaccgccagacugagaguguucgugagaaacagagagaagagaagagcccugcuguacaagagacacaaccuggcccaggugagauaa

SEQ ID NO: 20877 - RNA, 3078 nt, Artificial Sequence
  OBSL1__Homo_sapiens__NP_001166879
augaaggccagcagcggcgaccagggcagcccccccugcuuccugagauuccccagacccgugagaguggugagcggcgccgaggccgagcugaagugcguggugcugggcgagcccccccccgugguggugugggagaagggcggccagcagcuggccgccagcgagagacugagcuuccccgccgacggcgccgagcacggccugcugcugaccgccgcccugcccaccgacgccggcguguacgugugcagagccagaaacgccgccggcgaggccuacgccgccgccgccgugaccgugcuggagccccccgccagcgaccccgagcugcagcccgccgagagaccccugcccagccccggcagcggcgagggcgcccccguguuccugaccggccccagaagccagugggugcugagaggcgccgagguggugcugaccugcagagccggcggccugcccgagcccacccuguacugggagaaggacggcauggcccuggacgaggugugggacagcagccacuucgcccugcagcccggcagagccgaggacggccccggcgccagccuggcccugagaauccuggccgccagacugcccgacagcggcguguacgugugccacgccagaaacgcccacggccacgcccaggccggcgcccugcugcaggugcaccagccccccgagagcccccccgccgaccccgacgaggcccccgcccccgugguggagccccugaagugcgcccccaagaccuucugggugaacgagggcaagcacgccaaguucagaugcuacgugaugggcaagcccgagcccgagaucgaguggcacugggagggcagaccccugcugcccgacagaagaagacugauguacagagacagagacggcggcuucgugcugaaggugcuguacugccaggccaaggacagaggccuguacgugugcgccgccagaaacagcgccggccagacccugagcgccgugcagcugcacgugaaggagcccagacugagauucaccagaccccugcaggacguggagggcagagagcacggcaucgccgugcuggagugcaaggugcccaacagcagaauccccaccgccugguucagagaggaccagagacugcugcccugcagaaaguacgagcagaucgaggagggcaccgugagaagacugaucauccacagacugaaggccgacgacgacggcaucuaccugugcgagaugagaggcagagugagaaccguggccaacgugaccgugaagggccccauccugaagagacugcccagaaagcuggacgugcuggagggcgagaacgccgugcugcugguggagacccuggaggccggcguggagggcagauggagcagagacggcgaggagcugcccgugaucugccagagcagcagcggccacaugcacgcccuggugcugcccggcgugaccagagaggacgccggcgaggugaccuucagccugggcaacagcagaaccaccacccugcugagagugaagugcgugaagcacagcccccccggcccccccauccuggccgagauguucaagggccacaagaacaccgugcugcugaccuggaagccccccgagcccgcccccgagacccccuucaucuacagacuggagagacaggaggugggcagcgaggacuggauccagugcuucagcaucgagaaggccggcgccguggaggugcccggcgacugcgugcccagcgagggcgacuacagauucagaaucugcaccgugagcggccacggcagaagcccccacgugguguuccacggcagcgcccaccuggugcccaccgccagacugguggccggccuggaggacgugcagguguacgacggcgaggacgccguguucagccuggaccugagcaccaucauccagggcaccugguuccugaacggcgaggagcugaagagcaacgagcccgagggccagguggagcccggcgcccugagauacagaaucgagcagaagggccugcagcacagacugauccugcacgccgugaagcaccaggacagcggcgcccuggugggcuucagcugccccggcgugcaggacagcgccgcccugaccauccaggagagccccgugcacauccugagcccccaggacagagugagccugaccuucaccaccagcgagagaguggugcugaccugcgagcugagcagaguggacuuccccgccaccugguacaaggacggccagaagguggaggagagcgagcugcugguggugaagauggacggcagaaagcacagacugauccugcccgaggccaaggugcaggacagcggcgaguucgagugcagaaccgagggcgugagcgccuucuucggcgugaccgugcaggacccccccgugcacaucguggaccccagagagcacguguucgugcacgccaucaccagcgagugcgugaugcuggccugcgagguggacagagaggacgcccccgugagaugguacaaggacggccaggagguggaggagagcgacuucguggugcuggagaacgagggcccccacagaagacuggugcugcccgccacccagcccagcgacggcggcgaguuccagugcguggccggcgacgagugcgccuacuucaccgugaccaucaccgacgugagcagcuggaucguguaccccagcggcaagguguacguggccgccgugagacuggagagaguggugcugaccugcgagcugugcagacccugggccgaggugagauggaccaaggacggcgaggaggugguggagagccccgcccugcugcugcagaaggaggacaccgugagaagacuggugcugcccgccgugcagcuggaggacagcggcgaguaccugugcgagaucgacgacgagagcgccagcuucaccgugaccgugaccgagagcuaccagagccaggacagcagcaacaacaaccccgagcugugcgugcugcugaagaagcccaagaccagaagacuguggagcagauucccccccuggagaagaaccgccggcaccgaguaa

SEQ ID NO: 20878 - RNA, 1434 nt, Artificial Sequence
  OC90__Homo_sapiens__NP_001073868
augaucgccuuccugcugaccagcgugcugaugaucccccacgccggcggccacccccuggacaccccccaccugccccaggagcugccccccggccugcccaacaacaucaacaucaccuucuucagcggcauguucaagaacguggagagcguggccgagaucuucgacugccugggcccccacuucaccuggcugcaggccguguucaccaacuuccccgugcugauccaguucgugaacggcaugaagugcguggccggccugugccccagagacuucgaggacuacggcugcaccugcagauucgagauggagggccugcccguggacgagagcgacagcugcugcuuccagcacagaagaugcuacgaggaggccgccgagauggacugccugcaggaccccgccaagcugagcaccgaggugaacugcgugagcaagaagaucaucugcgagagcaaggacaacugcgagcaccugcugugcaccugcgacaaggccgccaucgagugccuggccagaagcagccugaacagcagccugaaccugcuggacaccagcuucugccuggcccagacccccgagaccaccaucaaggaggaccugaccacccugcugcccagaguggugcccguggagcccaccgacaccagccugaccgcccugagcggcgaggaggccggccacgaccaggagggcgugggcgccgccagagccaccagcccccccggcagcgccgagaucguggccaccagagugaccgccaagaucgugacccuggugcccgccggcaucaagagccugggccuggccgugagcagcguggagaacgaccccgaggagaccaccgagaaggccugcgacagauucaccuuccugcaccugggcagcggcgacaacaugcaggugaugccccagcugggcgagaugcuguucugccugaccagcagaugccccgaggaguucgagagcuacggcugcuacugcggccaggagggcagaggcgagcccagagacgaccuggacagaugcugccugagccaccacugcugccuggagcaggugagaagacugggcugccugcuggagagacugcccuggagccccguggugugcguggaccacacccccaagugcggcggccagagccugugcgagaagcugcugugcgccugcgaccagaccgccgccgagugcaugaccagcgccagcuucaaccagagccugaagagccccagcagacugggcugccccggccagcccgccgccugcgaggacagccugcaccccgugcccgccgcccccacccugggcagcagcagcgaggaggacagcgaggaggaccccccccaggaggaccugggcagagccaagagauuccugagaaagagccugggcccccugggcaucggcccccugcacggcagauaa

SEQ ID NO: 20879 - RNA, 2517 nt, Artificial Sequence
  OCA2__Homo_sapiens__NP_000266
augcaccuggagggcagagacggcagaagauaccccggcgcccccgccguggagcugcugcagaccagcgugcccagcggccuggccgagcugguggccggcaagagaagacugcccagaggcgccggcggcgccgaccccagccacagcugccccagaggcgccgccggccagagcagcugggcccccgccggccaggaguucgccagcuuccugaccaagggcagaagccacagcagccugccccagaugagcagcagcagaagcaaggacagcugcuucaccgagaacaccccccugcugagaaacagccugcaggagaagggcagcagaugcauccccguguaccaccccgaguucaucaccgccgaggagagcugggaggacagcagcgccgacugggagagaagauaccugcugagcagagaggugagcggccugagcgccagcgccagcagcgagaagggcgaccugcuggacagcccccacaucagacugagacugagcaagcugagaagaugcgugcaguggcugaaggugaugggccuguucgccuucguggugcugugcagcauccuguucagccuguaccccgaccagggcaagcuguggcagcugcuggcccugagcccccuggagaacuacagcgugaaccugagcagccacguggacagcacccugcugcagguggaccuggccggcgcccugguggccagcggccccagcagacccggcagagaggagcacaucgugguggagcugacccaggccgacgcccugggcagcagauggagaagaccccagcaggugacccacaacuggaccguguaccugaaccccagaagaagcgagcacagcgugaugagcagaaccuucgaggugcugaccagagagaccgugagcaucagcaucagagccagccugcagcagacccaggccgugccccugcugauggcccaccaguaccugagaggcagcguggagacccaggugaccaucgccaccgccauccuggccggcguguacgcccugaucaucuucgagaucgugcacagaacccuggccgccaugcugggcagccuggccgcccuggccgcccuggccgugaucggcgacagacccagccugacccacgugguggaguggaucgacuucgagacccuggcccugcuguucggcaugaugauccugguggccaucuucagcgagaccggcuucuucgacuacugcgccgugaaggccuacagacugagcagaggcagagugugggccaugaucaucaugcugugccugaucgccgccgugcugagcgccuuccuggacaacgugaccaccaugcugcuguucacccccgugaccaucagacugugcgaggugcugaaccuggaccccagacaggugcugaucgccgaggugaucuucaccaacaucggcggcgccgccaccgccaucggcgacccccccaacgugaucaucgugagcaaccaggagcugagaaagaugggccuggacuucgccggcuucaccgcccacauguucaucggcaucugccuggugcugcuggugugcuucccccugcugagacugcuguacuggaacagaaagcuguacaacaaggagcccagcgagaucguggagcugaagcacgagauccacguguggagacugaccgcccagagaaucagccccgccagcagagaggagaccgccgugagaagacugcugcugggcaaggugcuggcccuggagcaccugcuggccagaagacugcacaccuuccacagacagaucagccaggaggacaagaacugggagaccaacauccaggagcugcagaagaagcacagaaucagcgacggcauccugcuggccaagugccugaccgugcugggcuucgugaucuucauguucuuccugaacagcuucgugcccggcauccaccuggaccugggcuggaucgccauccugggcgccaucuggcugcugauccuggccgacauccacgacuucgagaucauccugcacagaguggagugggccacccugcuguucuucgccgcccuguucgugcugauggaggcccuggcccaccugcaccugaucgaguacgugggcgagcagaccgcccugcugaucaagauggugcccgaggagcagagacugaucgccgccaucgugcugguggugugggugagcgcccuggccagcagccugaucgacaacauccccuucaccgccaccaugauccccgugcugcugaaccugagccacgaccccgaggugggccugcccgcccccccccugauguacgcccuggccuucggcgccugccugggcggcaacggcacccugaucggcgccagcgccaacguggugugcgccggcaucgccgagcagcacggcuacggcuucagcuucauggaguucuucagacugggcuuccccaugaugguggugagcugcaccgugggcaugugcuaccugcugguggcccacgugguggugggcuggaacuaa

SEQ ID NO: 20880 - RNA, 738 nt, Artificial Sequence
  OCIAD1__Homo_sapiens__NP_001073308
augaacggcagagccgacuucagagagcccaacgccgaggugcccagacccaucccccacaucggccccgacuacauccccaccgaggaggagagaagaguguucgccgagugcaacgacgagagcuucugguucagaagcgugccccuggccgccaccagcaugcugaucacccagggccugaucagcaagggcauccugagcagccaccccaaguacggcagcauccccaagcugauccuggccugcaucaugggcuacuucgccggcaagcugagcuacgugaagaccugccaggagaaguucaagaagcuggagaacagcccccugggcgaggcccugagaagcggccaggccagaagaagcagcccccccggccacuacuaccagaagagcaaguacgacagcagcgugagcggccagagcagcuucgugaccagccccgccgccgacaacaucgagaugcugccccacuacgagcccauccccuucagcagcagcaugaacgagagcgcccccaccggcaucaccgaccacaucgugcagggccccgaccccaaccuggaggagagccccaagagaaagaacaucaccuacgaggagcugagaaacaagaacagagagagcuacgaggugagccugacccagaagaccgaccccagcgugagacccaugcacgagagagugcccaagaaggaggugaaggugaacaaguacggcgacaccugggacgaguaa

SEQ ID NO: 20881 - RNA, 465 nt, Artificial Sequence
  OCIAD2__Homo_sapiens__NP_001014446
auggccagcgccagcgccagaggcaaccaggacaaggacgcccacuuccccccccccagcaagcagagccugcuguucugccccaagagcaagcugcacauccacagagccgagaucagcaagaucaugagagagugccaggaggagagcuucuggaagagagcccugcccuucagccuggugagcaugcuggugacccagggccugguguaccagggcuaccuggccgccaacagcagauucggcagccugcccaagguggcccuggccggccugcugggcuucggccugggcaaggugagcuacaucggcgugugccagagcaaguuccacuucuucgaggaccagcugagaggcgccggcuucggcccccagcacaacagacacugccugcugaccugcgaggagugcaagaucaagcacggccugagcgagaagggcgacagccagcccagcgccagcuaa

SEQ ID NO: 20882 - RNA, 135 nt, Artificial Sequence
  OCLM__Homo_sapiens__NP_071770
augggcauguaccccccccugcugcugaagaucuaccugagcagacacaucagcauccuguucuaccugaagauccuguacaagagcggcaucaucuggcugagcugguacagcuucauccugcuggugcuguaa

SEQ ID NO: 20883 - RNA, 1569 nt, Artificial Sequence
  OCLN__Homo_sapiens__NP_001192183
augagcagcagaccccuggagagccccccccccuacagacccgacgaguucaagcccaaccacuacgcccccagcaacgacaucuacggcggcgagaugcacgugagacccaugcugagccagcccgccuacagcuucuaccccgaggacgagauccugcacuucuacaaguggaccagcccccccggcgugaucagaauccugagcaugcugaucaucgugaugugcaucgccaucuucgccugcguggccagcacccuggccugggacagaggcuacggcaccagccugcugggcggcagcgugggcuaccccuacggcggcagcggcuucggcagcuacggcagcggcuacggcuacggcuacggcuacggcuacggcuacggcggcuacaccgaccccagagccgccaagggcuucaugcuggccauggccgccuucugcuucaucgccgcccuggugaucuucgugaccagcgugaucagaagcgagaugagcagaaccagaagauacuaccugagcgugaucaucgugagcgccauccugggcaucaugguguucaucgccaccaucguguacaucaugggcgugaaccccaccgcccagagcagcggcagccuguacggcagccagaucuacgcccugugcaaccaguucuacacccccgccgccaccggccuguacguggaccaguaccuguaccacuacugcgugguggacccccaggaggccaucgccaucgugcugggcuucaugaucaucguggccuucgcccugaucaucuucuucgccgugaagaccagaagaaagauggacagauacgacaagagcaacauccugugggacaaggagcacaucuacgacgagcagccccccaacguggaggagugggugaagaacgugagcgccggcacccaggacgugcccagcccccccagcgacuacguggagagaguggacagccccauggccuacagcagcaacggcaaggugaacgacaagagauucuaccccgagagcagcuacaagagcacccccgugcccgagguggugcaggagcugccccugaccagccccguggacgacuucagacagcccagauacagcagcggcggcaacuucgagacccccagcaagagagcccccgccaagggcagagccggcagaagcaagagaaccgagcaggaccacuacgagaccgacuacaccaccggcggcgagagcugcgacgagcuggaggaggacuggaucagagaguacccccccaucaccagcgaccagcagagacagcuguacaagagaaacuucgacaccggccugcaggaguacaagagccugcagagcgagcuggacgagaucaacaaggagcugagcagacuggacaaggagcuggacgacuacagagaggagagcgaggaguacauggccgccgccgacgaguacaacagacugaagcaggugaagggcagcgccgacuacaagagcaagaagaaccacugcaagcagcugaagagcaagcugagccacaucaagaagauggugggcgacuacgacagacagaagaccuaa

SEQ ID NO: 20884 - RNA, 330 nt, Artificial Sequence
  OCM2__Homo_sapiens__NP_006179
augagcaucaccgacgugcugagcgccgacgacaucgccgccgcccugcaggagugccaggaccccgacaccuucgagccccagaaguucuuccagaccagcggccugagcaagaugagcgccagccaggugaaggacguguucagauucaucgacaacgaccagagcggcuaccuggacgaggaggagcugaaguucuuccugcagaaguucgagagcggcgccagagagcugaccgagagcgagaccaagagccugauggccgccgccgacaacgacggcgacggcaagaucggcgccgaggaguuccaggagauggugcacagcuaa

SEQ ID NO: 20885 - RNA, 330 nt, Artificial Sequence
  OCM__Homo_sapiens__XP_011513787
augagcaucaccgacgugcugagcgccgacgacaucgccgccgcccugcaggagugcagagaccccgacaccuucgagccccagaaguucuuccagaccagcggccugagcaagaugagcgccaaccaggugaaggacguguucagauucaucgacaacgaccagagcggcuaccuggacgaggaggagcugaaguucuuccugcagaaguucgagagcggcgccagagagcugaccgagagcgagaccaagagccugauggccgccgccgacaacgacggcgacggcaagaucggcgccgaggaguuccaggagauggugcacagcuaa

SEQ ID NO: 20886 - RNA, 2706 nt, Artificial Sequence
  OCRL__Homo_sapiens__NP_000267
auggagcccccccugcccgugggcgcccagccccuggccaccguggagggcauggagaugaagggcccccugagagagcccugcgcccugacccuggcccagagaaacggccaguacgagcugaucauccagcugcacgagaaggagcagcacgugcaggacaucauccccaucaacagccacuucagaugcgugcaggaggccgaggagacccugcugaucgacaucgccagcaacagcggcugcaagaucagagugcagggcgacuggaucagagagagaagauucgagauccccgacgaggagcacugccugaaguuccugagcgccgugcuggccgcccagaaggcccagagccagcugcuggugcccgagcagaaggacagcagcagcugguaccagaagcuggacaccaaggacaagcccagcguguucagcggccugcugggcuucgaggacaacuucagcagcaugaaccuggacaagaagaucaacagccagaaccagcccaccggcauccacagagagcccccccccccccccuucagcgugaacaagaugcugcccagagagaaggaggccagcaacaaggagcagcccaaggugaccaacaccaugagaaagcuguucgugcccaacacccagagcggccagagagagggccugaucaagcacauccuggccaagagagagaaggaguacgugaacauccagaccuucagauucuucgugggcaccuggaacgugaacggccagagccccgacagcggccuggagcccuggcugaacugcgaccccaacccccccgacaucuacugcaucggcuuccaggagcuggaccugagcaccgaggccuucuucuacuucgagagcgugaaggagcaggaguggagcauggccguggagagaggccugcacagcaaggccaaguacaagaaggugcagcuggugagacuggugggcaugaugcugcugaucuucgccagaaaggaccagugcagauacaucagagacaucgccaccgagaccgugggcaccggcaucaugggcaagaugggcaacaagggcggcguggccgugagauucguguuccacaacaccaccuucugcaucgugaacagccaccuggccgcccacguggaggacuucgagagaagaaaccaggacuacaaggacaucugcgccagaaugagcuucguggugcccaaccagacccugccccagcugaacaucaugaagcacgagguggugaucuggcugggcgaccugaacuacagacugugcaugcccgacgccaacgaggugaagagccugaucaacaagaaggaccugcagagacugcugaaguucgaccagcugaacauccagagaacccagaagaaggccuucguggacuucaacgagggcgagaucaaguucauccccaccuacaaguacgacagcaagaccgacagaugggacagcagcggcaagugcagagugcccgccuggugcgacagaauccuguggagaggcaccaacgugaaccagcugaacuacagaagccacauggagcugaagaccagcgaccacaagcccgugagcgcccuguuccacaucggcgugaaggugguggacgagagaagauacagaaagguguucgaggacagcgugagaaucauggacagaauggagaacgacuuccugcccagccuggagcugagcagaagagaguucguguucgagaacgugaaguucagacagcugcagaaggagaaguuccagaucagcaacaacggccaggugcccugccacuucagcuucauccccaagcugaacgacagccaguacugcaagcccuggcugagagccgagcccuucgagggcuaccuggagcccaacgagaccguggacaucagccuggacguguacgugagcaaggacagcgugaccauccugaacagcggcgaggacaagaucgaggacauccuggugcugcaccuggacagaggcaaggacuacuuccugaccaucagcggcaacuaccugcccagcugcuucggcaccagccuggaggcccugugcagaaugaagagacccaucagagaggugcccgugaccaagcugaucgaccuggaggaggacagcuuccuggagaaggagaagagccugcugcagauggugccccuggacgagggcgccagcgagagaccccugcaggugcccaaggagaucuggcugcugguggaccaccuguucaaguacgccugccaccaggaggaccuguuccagacccccggcaugcaggaggagcugcagcagaucaucgacugccuggacaccagcauccccgagaccauccccggcagcaaccacagcguggccgaggcccugcugaucuuccuggaggcccugcccgagcccgugaucugcuacgagcuguaccagagaugccuggacagcgccuacgaccccagaaucugcagacaggugaucagccagcugcccagaugccacagaaacguguucagauaccugauggccuuccugagagagcugcugaaguucagcgaguacaacagcgugaacgccaacaugaucgccacccuguucaccagccugcugcugagacccccccccaaccugauggccagacagacccccagcgacagacagagagccauccaguuccugcugggcuuccugcugggcagcgaggaggacuaa

SEQ ID NO: 20887 - RNA, 840 nt, Artificial Sequence
  ODAM__Homo_sapiens__NP_060325
augaagaucaucauccugcugggcuuccugggcgccacccugagcgccccccugaucccccagagacugaugagcgccagcaacagcaacgagcugcugcugaaccugaacaacggccagcugcugccccugcagcugcagggcccccugaacagcuggaucccccccuucagcggcauccugcagcagcagcagcaggcccagauccccggccugagccaguucagccugagcgcccuggaccaguucgccggccugcugcccaaccagaucccccugaccggcgaggccagcuucgcccagggcgcccaggccggccagguggacccccugcagcugcagacccccccccagacccagcccggccccagccacgugaugcccuacguguucagcuucaagaugccccaggagcagggccagauguuccaguacuaccccguguacauggugcugcccugggagcagccccagcagaccgugcccagaagcccccagcagaccagacagcagcaguacgaggagcagauccccuucuacgcccaguucggcuacaucccccagcuggccgagcccgccaucagcggcggccagcagcagcuggccuucgacccccagcugggcaccgcccccgagaucgccgugaugagcaccggcgaggagauccccuaccugcagaaggaggccaucaacuucagacacgacagcgccggcguguucaugcccagcaccagccccaagcccagcaccaccaacguguucaccagcgccguggaccagaccaucacccccgagcugcccgaggagaaggacaagaccgacagccugagagagcccuaa

SEQ ID NO: 20888 - RNA, 999 nt, Artificial Sequence
  ODC1__Homo_sapiens__NP_001274117
augaugaccuucgacagcgagguggagcugaugaagguggccagagcccaccccaaggccaagcuggugcugagaaucgccaccgacgacagcaaggccgugugcagacugagcgugaaguucggcgccacccugagaaccagcagacugcugcuggagagagccaaggagcugaacaucgacguggugggcgugagcuuccacgugggcagcggcugcaccgaccccgagaccuucgugcaggccaucagcgacgccagaugcguguucgacaugggcgccgaggugggcuucagcauguaccugcuggacaucggcggcggcuuccccggcagcgaggacgugaagcugaaguucgaggagaucaccggcgugaucaaccccgcccuggacaaguacuuccccagcgacagcggcgugagaaucaucgccgagcccggcagauacuacguggccagcgccuucacccuggccgugaacaucaucgccaagaagaucgugcugaaggagcagaccggcagcgacgacgaggacgagagcagcgagcagaccuucauguacuacgugaacgacggcguguacggcagcuucaacugcauccuguacgaccacgcccacgugaagccccugcugcagaagagacccaagcccgacgagaaguacuacagcagcagcaucuggggccccaccugcgacggccuggacagaaucguggagagaugcgaccugcccgagaugcacgugggcgacuggaugcuguucgagaacaugggcgccuacaccguggccgccgccagcaccuucaacggcuuccagagacccaccaucuacuacgugaugagcggccccgccuggcagcugaugcagcaguuccagaaccccgacuucccccccgagguggaggagcaggacgccagcacccugcccgugagcugcgccugggagagcggcaugaagagacacagagccgccugcgccagcgccagcaucaacguguaa

SEQ ID NO: 20889 - RNA, 753 nt, Artificial Sequence
  ODF1__Homo_sapiens__NP_077721
auggccgcccugagcugccugcuggacagcgugagaagagacaucaagaagguggacagagagcugagacagcugagaugcaucgacgaguucagcaccagaugccugugcgaccuguacaugcaccccuacugcugcugcgaccugcaccccuaccccuacugccugugcuacagcaagagaagcagaagcugcggccugugcgaccuguaccccugcugccugugcgacuacaagcuguacugccugagacccagccugagaagccuggagagaaaggccaucagagccaucgaggacgagaagagagagcuggccaagcugagaagaaccaccaacagaauccuggccagcagcugcugcagcagcaacauccugggcagcgugaacgugugcggcuucgagcccgaccaggugaaggugagagugaaggacggcaaggugugcgugagcgccgagagagagaacagauacgacugccugggcagcaagaaguacagcuacaugaacaucugcaaggaguucagccugccccccugcguggacgagaaggacgugaccuacagcuacggccugggcagcugcgugaagaucgagagccccugcuaccccugcaccagccccugcagccccugcagccccugcagccccugcaaccccugcagccccugcaaccccugcagccccuacgaccccugcaaccccugcuaccccugcggcagcagauucagcugcagaaagaugauccuguaa

SEQ ID NO: 20890 - RNA, 762 nt, Artificial Sequence
  ODF3B__Homo_sapiens__NP_001014440
augggcagcgacgccugggugggccuguggagaccccacagacccagaggccccaucgccgcccacuacggcggccccggccccaaguacaagcugccccccaacaccggcuacgcccugcacgaccccagcagacccagagcccccgccuucaccuucggcgccagauuccccacccagcagaccaccugcggccccggccccggccaccuggugcccgccagaaugaccgugagaggcaccgacggcgcccccgccuacagcaucuacggcagacccagaagaagcgcccccuuccugacccccggccccggcagauacuuccccgagagagccggcaacgccaccuaccccagcgcccccagacacaccaucgcccccagaaacuggggcgugcaggccgagcagcagagccccggccccgccgccuacaccgugcccagccugcugggccccagagugaucggcaaggugagcgcccccaccugcagcaucuacggcagaagagccgccggcagcuucuucgaggaccugagcaagacccccggccccugcgccuaccagguggugagccccggcguguacaagagcagagccccccaguucaccauccuggccagaaccagccugccccaggacaacaccagaaagcccggccccgccgccuacaacguggaccagcacagaaagcccagaggcuggagcuucggcaucagacacagcgacuaccuggccccccuggugaccgacgccgacaacuaa

SEQ ID NO: 20891 - RNA, 774 nt, Artificial Sequence
  ODF4__Homo_sapiens__NP_694552
auggacgccgaguacagcggcaacgaguuccccagaagcgagggcgagagagaccagcaccagagacccggcaaggagagaaagagcggcgaggccggcuggggcaccggcgagcugggccaggacggcagacugcugagcagcacccugagccugagcagcaacagaagccugggccagagacagaacagcccccugcccuuccaguggagaaucacccacagcuucagauggauggcccaggugcuggccagcgagcugagccugguggccuucauccugcugcuggugguggccuucagcaagaaguggcuggaccugagcagaagccuguucuaccagagauggcccguggacgugagcaacagaauccacaccagcgcccacgugaugagcaugggccugcugcacuucuacaagagcagaagcugcagcgaccuggagaacggcaaggugaccuucaucuucagcacccugaugcuguuccccaucaacaucuggaucuucgagcuggagagaaacgugagcauccccaucggcuggagcuacuucaucggcuggcuggugcugauccuguacuucaccugcgccauccugugcuacuucaaccacaagagcuucuggagccugauccugagccaccccagcggcgccgugagcugcagcagcagcuucggcagcguggaggagagccccagagcccagaccaucaccgacacccccaucacccaggagggcgugcuggaccccgagcagaaggacacccacguguaa

SEQ ID NO: 20892 - RNA, 855 nt, Artificial Sequence
  OFCC1__Homo_sapiens__XP_011513347
auggccaagggcgagaaggccgagagcggcguggacaacaccgccggccugagcgagaaggagacccagaagaaccccagagcccccauggacgaggccgacgugaagagcgccgcccacagcagccagggcagcauccccaagaagaucggccccugcagcauggacuacgaccccaaccugcuggaggaggacgacgagcugcacagccagggcgacagccugaccgaccacagcgugaagggcaagagcaccguguggagaaucggcgaggccgaggacuacagccaggacaucagcuaccuggaggagcuggaggagcacagauucagcgugugcugcagcagcguggccgacagcagauacggcgacuucuucaagcaccugcacuucgugcuggugagcgccagcagcgagcugcagcugagccaguggcagagccagggcuucugguacaucauccugcugauguucuuccugugguuccugagacuguaccugcacuaccugggccaguggcuguuccugcaggccaucagcacccccgugaccaaguuccacuucagccugcacaucguggagcugugcuaccccaccagcagccugcacaucggcgaggagcugcccgugguggugaugggcccccugaugcugaacgccauccugcugcugcuggugcugaucagauggggcugccagcugcuguucgccagcugccccgacgugcugagcaagcugaucaucaccaugggccuguggaccauccuggacccccuggccguguucauccuggacacccugcugggcgacaacaaggugaccguggccagcagaaucgacgagcaggagauguaa

SEQ ID NO: 20893 - RNA, 3039 nt, Artificial Sequence
  OFD1__Homo_sapiens__NP_003602
augauggcccagagcaacauguucaccguggccgacgugcugagccaggacgagcugagaaagaagcuguaccagaccuucaaggacagaggcauccuggacacccugaagacccagcugagaaaccagcugauccacgagcugaugcaccccgugcugagcggcgagcugcagcccagaagcaucagcguggagggcagcagccugcugaucggcgccagcaacagccugguggccgaccaccugcagagaugcggcuacgaguacagccugagcguguucuuccccgagagcggccuggccaaggagaagguguucaccaugcaggaccugcugcagcugaucaagaucaaccccaccagcagccuguacaagagccuggugagcggcagcgacaaggagaaccagaagggcuuccugaugcacuuccugaaggagcuggccgaguaccaccaggccaaggagagcugcaacauggagacccagaccagcagcaccuucaacagagacagccuggccgagaagcugcagcugaucgacgaccaguucgccgacgccuacccccagagaaucaaguucgagagccuggagaucaagcugaacgaguacaagagagagaucgaggagcagcugagagccgagaugugccagaagcugaaguucuucaaggacaccgagaucgccaagaucaagauggaggccaagaagaaguacgagaaggagcugaccauguuccagaacgacuucgagaaggccugccaggccaagagcgaggcccuggugcugagagagaagagcacccuggagagaauccacaagcaccaggagaucgagaccaaggagaucuacgcccagagacagcugcugcugaaggacauggaccugcugagaggcagagaggccgagcugaagcagagaguggaggccuucgagcugaaccagaagcugcaggaggagaagcacaagagcaucaccgaggcccugagaagacaggagcagaacaucaagagcuucgaggagaccuacgacagaaagcugaagaacgagcugcugaaguaccagcuggagcugaaggacgacuacaucaucagaaccaacagacugaucgaggacgagagaaagaacaaggagaaggccgugcaccugcaggaggagcugaucgccaucaacagcaagaaggaggagcugaaccagagcgugaacagagugaaggagcuggagcuggagcuggagagcgugaaggcccagagccuggccaucaccaagcagaaccacaugcugaacgagaaggugaaggagaugagcgacuacagccugcugaaggaggagaagcuggagcugcuggcccagaacaagcugcugaagcagcagcuggaggagagcagaaacgagaaccugagacugcugaacagacuggcccagcccgcccccgagcuggccguguuccagaaggagcugagaaaggccgagaaggccaucgugguggagcacgaggaguucgagagcugcagacaggcccugcacaagcagcugcaggacgagaucgagcacagcgcccagcugaaggcccagauccugggcuacaaggccagcgugaagagccugaccacccagguggccgaccugaagcugcagcugaagcagacccagaccgcccuggagaacgagguguacugcaaccccaagcagagcgugaucgacagaagcgugaacggccugaucaacggcaacguggugcccugcaacggcgagaucagcggcgacuuccugaacaaccccuucaagcaggagaacgugcuggccagaaugguggccagcagaaucaccaacuaccccaccgccuggguggagggcagcagccccgacagcgaccuggaguucguggccaacaccaaggccagagugaaggagcugcagcaggaggccgagagacuggagaaggccuucagaagcuaccacagaagagugaucaagaacagcgccaagagcccccuggccgccaagagcccccccagccugcaccugcuggaggccuucaagaacaucaccagcagcagccccgagagacacaucuucggcgaggacagaguggugagcgagcagccccaggugggcacccuggaggagagaaacgacgugguggaggcccugaccggcagcgccgccagcagacugagaggcggcaccagcagcagaagacugagcagcaccccccugcccaaggccaagagaagccuggagagcgagauguaccuggagggccugggcagaagccacaucgccagccccagccccugccccgacagaaugccccugcccagccccaccgagagcagacacagccugagcaucccccccgugagcagcccccccgagcagaaggugggccuguacagaagacagaccgagcugcaggacaagagcgaguucagcgacguggacaagcuggccuucaaggacaacgaggaguucgagagcagcuucgagagcgccggcaacaugcccagacagcuggagaugggcggccugagccccgccggcgacaugagccacguggacgccgccgccgccgccgugccccugagcuaccagcaccccagcguggaccagaagcagaucgaggagcagaaggaggaggagaagaucagagagcagcaggugaaggagagaagacagagagaggagagaagacagagcaaccugcaggaggugcuggagagagagagaagagagcuggagaagcuguaccaggagagaaagaugaucgaggagagccugaagaucaagaucaagaaggagcuggagauggagaacgagcuggagaugagcaaccaggagaucaaggacaagagcgcccacagcgagaacccccuggagaaguacaugaagaucauccagcaggagcaggaccaggagagcgccgacaagagcagcaagaagauggugcaggagggcagccugguggacacccugcagagcagcgacaagguggagagccugaccggcuucagccacgaggagcuggacgacagcugguaa

SEQ ID NO: 20894 - RNA, 1284 nt, Artificial Sequence
  OGDH__Homo_sapiens__NP_001003941
auguuccaccugagaaccugcgccgccaagcugagaccccugaccgccagccagaccgugaagaccuucagccagaacagacccgccgccgccagaaccuuccagcagaucagaugcuacagcgcccccguggccgccgagcccuuccugagcggcaccagcagcaacuacguggaggagauguacugcgccuggcuggagaaccccaagagcgugcacaagagcugggacaucuucuucagaaacaccaacgccggcgccccccccggcaccgccuaccagagcccccugccccugagcagaggcagccuggccgccguggcccacgcccagagccugguggaggcccagcccaacguggacaagcugguggaggaccaccuggccgugcagagccugaucagagccuaccagaucagaggccaccacguggcccagcuggacccccugggcauccuggacgccgaccuggacagcagcgugcccgccgacaucaucagcagcaccgacaagcugggcuucuacggccuggacgagagcgaccuggacaagguguuccaccugcccaccaccaccuucaucggcggccaggagagcgcccugccccugagagagaucaucagaagacuggagauggccuacugccagcacaucggcguggaguucauguucaucaacgaccuggagcagugccaguggaucagacagaaguucgagacccccggcaucaugcaguucaccaacgaggagaagagaacccugcuggccagacuggugagaagcaccagauucgaggaguuccugcagagaaaguggagcagcgagaagagauucggccuggagggcugcgaggugcugauccccgcccugaagaccaucaucgacaagagcagcgagaacggcguggacuacgugaucaugggcaugccccacagaggcagacugaacgugcuggccaacgugaucagaaaggagcuggagcagaucuucugccaguucgacagcaagcuggaggccgccgacgagggcagcggcgacgugaaguaccaccugggcauguaccacagaagaaucaacagagugaccgacagaaacaucacccugagccugguggccaaccccagccaccuggaggccgccgaccccguggugaugggcaagaccaaggccgagcaguucuacugcggcgacaccgagggcaagaaggugagacccagagagagaagagccagacagaucgugaaggcccccugcagcagcauggaguucagaagccccaccuaa

SEQ ID NO: 20895 - RNA, 2862 nt, Artificial Sequence
  OGDHL__Homo_sapiens__NP_001137468
augagccagcugagacugcugcccagcagacugggcgugcaggccgccagacugcuggccgcccacgacgugcccguguucggcuggagaagcagaagcagcggcccccccgccaccuuccccagcagcaagggcggcggcggcagcagcuacauggaggagauguacuucgccuggcuggagaacccccagagcgugcacaagaucagaggccaccacguggcccagcuggacccccugggcauccuggacgccgaccuggacagcuucgugcccagcgaccugaucaccaccaucgacaagcuggccuucuacgaccugcaggaggccgaccuggacaaggaguuccagcugcccaccaccaccuucaucggcggcagcgagaacacccugagccugagagagaucaucagaagacuggagaacaccuacugccagcacaucggccuggaguucauguucaucaacgacguggagcagugccaguggaucagacagaaguucgagacccccggcgugaugcaguucagcagcgaggagaagagaacccugcuggccagacuggugagaagcaugagauucgaggacuuccuggccagaaaguggagcagcgagaagagauucggccuggagggcugcgaggugaugauccccgcccugaagaccaucaucgacaagagcagcgagaugggcaucgagaacgugauccugggcaugccccacagaggcagacugaacgugcuggccaacgugaucagaaaggaccuggagcagaucuucugccaguucgaccccaagcuggaggccgccgacgagggcagcggcgacgugaaguaccaccugggcauguaccacgagagaaucaacagagugaccaacagaaacaucacccugagccugguggccaaccccagccaccuggaggccguggaccccguggugcagggcaagaccaaggccgagcaguucuacagaggcgacgcccagggcaagaaggugaugagcauccuggugcacggcgacgccgccuucgccggccagggcgugguguacgagaccuuccaccugagcgaccugcccagcuacaccaccaacggcaccgugcacgugguggugaacaaccagaucggcuucaccaccgaccccagaauggccagaagcagccccuaccccaccgacguggccagaguggugaacgcccccaucuuccacgugaacgccgacgaccccgaggccgugaucuacgugugcagcguggccgccgaguggagaaacaccuucaacaaggacguggugguggaccuggugugcuacagaagaagaggccacaacgagauggacgagcccauguucacccagccccugauguacaagcagauccacagacaggugcccgugcugaagaaguacgccgacaagcugaucgccgagggcaccgugacccugcaggaguucgaggaggagaucgccaaguacgacagaaucugcgaggaggccuacggcagaagcaaggacaagaagauccugcacaucaagcacuggcuggacagccccuggcccggcuucuucaacguggacggcgagcccaagagcaugaccugccccgccaccggcauccccgaggacaugcugacccacaucggcagcguggccagcagcgugccccuggaggacuucaagauccacaccggccugagcagaauccugagaggcagagccgacaugaccaagaacagaaccguggacugggcccuggccgaguacauggccuucggcagccugcugaaggagggcauccacgugagacugagcggccaggacguggagagaggcaccuucagccacagacaccacgugcugcacgaccaggagguggacagaagaaccugcgugcccaugaaccaccuguggcccgaccaggcccccuacaccgugugcaacagcagccugagcgaguacggcgugcugggcuucgagcugggcuacgccauggccagccccaacgcccuggugcugugggaggcccaguucggcgacuuccacaacaccgcccagugcaucaucgaccaguucaucagcaccggccaggccaagugggugagacacaacggcaucgugcugcugcugccccacggcauggagggcaugggccccgagcacagcagcgccagacccgagagauuccugcagaugagcaacgacgacagcgacgccuaccccgccuucaccaaggacuucgaggugagccagcuguacgacugcaacuggaucguggugaacugcagcacccccgccaacuacuuccacgugcugagaagacagauccugcugcccuucagaaagccccugaucaucuucacccccaagagccugcugagacaccccgaggccaagagcagcuucgaccagauggugagcggcaccagcuuccagagagugauccccgaggacggcgccgccgccagagcccccgagcaggugcagagacugaucuucugcaccggcaagguguacuacgaccuggugaaggagagaagcagccaggaccuggaggagaagguggccaucaccagacuggagcagaucagccccuuccccuucgaccugaucaagcaggaggccgagaaguaccccggcgccgagcuggccuggugccaggaggagcacaagaacaugggcuacuacgacuacaucagccccagauucaugaccauccugagaagagccagacccaucugguacgugggcagagaccccgccgccgcccccgccaccggcaacagaaacacccaccuggugagccugaagaaguuccuggacaccgccuucaaccugcaggccuucgagggcaagaccuucuaa

SEQ ID NO: 20896 - RNA, 1629 nt, Artificial Sequence
  OGFOD1__Homo_sapiens__NP_060703
augaacggcaagagacccgccgagcccggccccgccagagugggcaagaagggcaagaaggaggugauggccgaguucagcgacgccgugaccgaggagacccugaagaagcagguggccgaggccuggagcagaagaacccccuucagccacgaggugaucgugauggacauggaccccuuccugcacugcgugauccccaacuucauccagagccaggacuuccuggagggccugcagaaggagcugaugaaccuggacuuccacgagaaguacaacgaccuguacaaguuccagcagagcgacgaccugaagaagagaagagagccccacaucagcacccugagaaagauccuguucgaggacuucagaagcuggcugagcgacaucagcaagaucgaccuggagagcaccaucgacaugagcugcgccaaguacgaguucaccgacgcccugcugugccacgacgacgagcuggagggcagaagaaucgccuucauccuguaccuggugccccccugggacagaagcaugggcggcacccuggaccuguacagcaucgacgagcacuuccagcccaagcagaucgugaagagccugauccccagcuggaacaagcugguguucuucgaggugagccccgugagcuuccaccaggugagcgaggugcugagcgaggagaagagcagacugagcaucagcggcugguuccacggccccagccugaccagaccccccaacuacuucgagccccccauccccagaagcccccacaucccccaggaccacgagauccuguacgacuggaucaaccccaccuaccuggacauggacuaccaggugcagauccaggaggaguucgaggagagcagcgagauccugcugaaggaguuccugaagcccgagaaguucaccaaggugugcgaggcccuggagcacggccacguggaguggagcagcagaggcccccccaacaagagauucuacgagaaggccgaggagagcaagcugcccgagauccugaaggagugcaugaagcuguucagaagcgaggcccuguuccugcugcugagcaacuucaccggccugaagcugcacuuccuggcccccagcgaggaggacgagaugaacgacaagaaggaggccgagaccaccgacaucaccgaggagggcaccagccacagcccccccgagcccgagaacaaccagauggccaucagcaacaacagccagcagagcaacgagcagaccgaccccgagcccgaggagaacgagaccaagaaggagagcagcgugcccaugugccagggcgagcugagacacuggaagaccggccacuacacccugauccacgaccacagcaaggccgaguucgcccuggaccugauccuguacugcggcugcgagggcugggagcccgaguacggcggcuucaccagcuacaucgccaagggcgaggacgaggagcugcugaccgugaaccccgagagcaacagccuggcccugguguacagagacagagagacccugaaguucgugaagcacaucaaccacagaagccuggagcagaagaagaccuuccccaacagaaccggcuucugggacuucagcuucaucuacuacgaguaa

SEQ ID NO: 20897 - RNA, 2034 nt, Artificial Sequence
  OGFR__Homo_sapiens__NP_031372
auggacgaccccgacugcgacagcaccugggaggaggacgaggaggacgccgaggacgccgaggacgaggacugcgaggacggcgaggccgccggcgccagagacgccgacgccggcgacgaggacgaggagagcgaggagcccagagccgccagacccagcagcuuccagagcagaaugaccggcagcagaaacuggagagccaccagagacaugugcagauacagacacaacuaccccgaccugguggagagagacugcaacggcgacacccccaaccugagcuucuacagaaacgagaucagauuccugcccaacggcugcuucaucgaggacauccugcagaacuggaccgacaacuacgaccugcuggaggacaaccacagcuacauccaguggcuguucccccugagagagcccggcgugaacuggcacgccaagccccugacccugagagagguggagguguucaagagcagccaggagauccaggagagacuggugagagccuacgagcugaugcugggcuucuacggcaucagacuggaggacagaggcaccggcaccgugggcagagcccagaacuaccagaagagauuccagaaccugaacuggagaagccacaacaaccugagaaucaccagaauccugaagagccugggcgagcugggccuggagcacuuccaggccccccuggugagauucuuccuggaggagacccuggugagaagagagcugcccggcgugagacagagcgcccuggacuacuucauguucgccgugagaugcagacaccagagaagacagcuggugcacuucgccugggagcacuucagacccagaugcaaguucguguggggcccccaggacaagcugagaagauucaagcccagcagccugccccacccccuggagggcagcagaaagguggaggaggagggcagccccggcgaccccgaccacgaggccagcacccagggcagaaccugcggccccgagcacagcaagggcggcggcagaguggacgagggcccccagcccagaagcguggagccccaggacgccggcccccuggagagaagccagggcgacgaggccggcggccacggcgaggacagacccgagccccugagccccaaggagagcaagaagagaaagcuggagcugagcagaagagagcagccccccaccgagcccggcccccagagcgccagcgagguggagaagaucgcccugaaccuggagggcugcgcccugagccagggcagccugagaaccggcacccaggaggugggcggccaggaccccggcgaggccgugcagcccugcagacagccccugggcgccagaguggccgacaaggugagaaagagaagaaagguggacgagggcgccggcgacagcgccgccguggccagcggcggcgcccagacccuggcccuggccggcagccccgcccccagcggccaccccaaggccggccacagcgagaacggcguggaggaggacaccgagggcagaaccggccccaaggagggcacccccggcagccccagcgagacccccggccccagccccgccggccccgccggcgacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccgagagccccagcgagacccccggccccagacccgccggccccgccggcgacgagcccgccgagagccccagcgagacccccggccccagacccgccggccccgccggcgacgagcccgccgagagccccagcgagacccccggccccagccccgccggccccaccagagacgagcccgccaaggccggcgaggccgccgagcugcaggacgccgagguggagagcagcgccaagagcggcaagcccuaa

SEQ ID NO: 20898 - RNA, 1038 nt, Artificial Sequence
  OGG1__Homo_sapiens__NP_002533
augcccgccagagcccugcugcccagaagaaugggccacagaacccuggccagcacccccgcccugugggccagcauccccugccccagaagcgagcugagacuggaccuggugcugcccagcggccagagcuucagauggagagagcagagccccgcccacuggagcggcgugcuggccgaccagguguggacccugacccagaccgaggagcagcugcacugcaccguguacagaggcgacaagagccaggccagcagacccacccccgacgagcuggaggccgugagaaaguacuuccagcuggacgugacccuggcccagcuguaccaccacuggggcagcguggacagccacuuccaggagguggcccagaaguuccagggcgugagacugcugagacaggaccccaucgagugccuguucagcuucaucugcagcagcaacaacaacaucgccagaaucaccggcaugguggagagacugugccaggccuucggccccagacugauccagcuggacgacgugaccuaccacggcuuccccagccugcaggcccuggccggccccgagguggaggcccaccugagaaagcugggccugggcuacagagccagauacgugagcgccagcgccagagccauccuggaggagcagggcggccuggccuggcugcagcagcugagagagagcagcuacgaggaggcccacaaggcccugugcauccugcccggcgugggcaccaagguggccgacugcaucugccugauggcccuggacaagccccaggccgugcccguggacgugcacauguggcacaucgcccagagagacuacagcuggcaccccaccaccagccaggccaagggccccagcccccagaccaacaaggagcugggcaacuucuucagaagccuguggggccccuacgccggcugggcccaggccgugcuguucagcgccgaccugagacagagcagacacgcccaggagccccccgccaagagaagaaagggcagcaagggccccgagggcuaa

SEQ ID NO: 20899 - RNA, 897 nt, Artificial Sequence
  OGN__Homo_sapiens__NP_054776
augaagacccugcagagcacccugcugcugcugcugcuggugccccugaucaagcccgccccccccacccagcaggacagcagaaucaucuacgacuacggcaccgacaacuucgaggagagcaucuucagccaggacuacgaggacaaguaccuggacggcaagaacaucaaggagaaggagaccgugaucauccccaacgagaagagccugcagcugcagaaggacgaggccaucaccccccugccccccaagaaggagaacgacgagaugcccaccugccugcugugcgugugccugagcggcagcguguacugcgaggagguggacaucgacgccgugcccccccugcccaaggagagcgccuaccuguacgccagauucaacaagaucaagaagcugaccgccaaggacuucgccgacauccccaaccugagaagacuggacuucaccggcaaccugaucgaggacaucgaggacggcaccuucagcaagcugagccugcuggaggagcugagccuggccgagaaccagcugcugaagcugcccgugcugccccccaagcugacccuguucaacgccaaguacaacaagaucaagagcagaggcaucaaggccaacgccuucaagaagcugaacaaccugaccuuccuguaccuggaccacaacgcccuggagagcgugccccugaaccugcccgagagccugagagugauccaccugcaguucaacaacaucgccagcaucaccgacgacaccuucugcaaggccaacgacaccagcuacaucagagacagaaucgaggagaucagacuggagggcaaccccaucgugcugggcaagcaccccaacagcuucaucugccugaagagacugcccaucggcagcuacuucuaa

SEQ ID NO: 20900 - RNA, 3141 nt, Artificial Sequence
  OGT__Homo_sapiens__NP_858058
auggccagcagcgugggcaacguggccgacagcaccgagcccaccaagagaaugcugagcuuccagggccuggccgagcuggcccacagagaguaccaggccggcgacuucgaggccgccgagagacacugcaugcagcuguggagacaggagcccgacaacaccggcgugcugcugcugcugagcagcauccacuuccagugcagaagacuggacagaagcgcccacuucagcacccuggccaucaagcagaacccccugcuggccgaggccuacagcaaccugggcaacguguacaaggagagaggccagcugcaggaggccaucgagcacuacagacacgcccugagacugaagcccgacuucaucgacggcuacaucaaccuggccgccgcccugguggccgccggcgacauggagggcgccgugcaggccuacgugagcgcccugcaguacaaccccgaccuguacugcgugagaagcgaccugggcaaccugcugaaggcccugggcagacuggaggaggccaaggccugcuaccugaaggccaucgagacccagcccaacuucgccguggccuggagcaaccugggcugcguguucaacgcccagggcgagaucuggcuggccauccaccacuucgagaaggccgugacccuggaccccaacuuccuggacgccuacaucaaccugggcaacgugcugaaggaggccagaaucuucgacagagccguggccgccuaccugagagcccugagccugagccccaaccacgccguggugcacggcaaccuggccugcguguacuacgagcagggccugaucgaccuggccaucgacaccuacagaagagccaucgagcugcagccccacuuccccgacgccuacugcaaccuggccaacgcccugaaggagaagggcagcguggccgaggccgaggacugcuacaacaccgcccugagacugugccccacccacgccgacagccugaacaaccuggccaacaucaagagagagcagggcaacaucgaggaggccgugagacuguacagaaaggcccuggagguguuccccgaguucgccgccgcccacagcaaccuggccagcgugcugcagcagcagggcaagcugcaggaggcccugaugcacuacaaggaggccaucagaaucagccccaccuucgccgacgccuacagcaacaugggcaacacccugaaggagaugcaggacgugcagggcgcccugcagugcuacaccagagccauccagaucaaccccgccuucgccgacgcccacagcaaccuggccagcauccacaaggacagcggcaacauccccgaggccaucgccagcuacagaaccgcccugaagcugaagcccgacuuccccgacgccuacugcaaccuggcccacugccugcagaucgugugcgacuggaccgacuacgacgagagaaugaagaagcuggugagcaucguggccgaccagcuggagaagaacagacugcccagcgugcacccccaccacagcaugcuguacccccugagccacggcuucagaaaggccaucgccgagagacacggcaaccugugccuggacaagaucaacgugcugcacaagccccccuacgagcaccccaaggaccugaagcugagcgacggcagacugagagugggcuacgugagcagcgacuucggcaaccaccccaccagccaccugaugcagagcauccccggcaugcacaaccccgacaaguucgagguguucugcuacgcccugagccccgacgacggcaccaacuucagagugaaggugauggccgaggccaaccacuucaucgaccugagccagauccccugcaacggcaaggccgccgacagaauccaccaggacggcauccacauccuggugaacaugaacggcuacaccaagggcgccagaaacgagcuguucgcccugagacccgcccccauccaggccauguggcugggcuaccccggcaccagcggcgcccuguucauggacuacaucaucaccgaccaggagaccagccccgccgagguggccgagcaguacagcgagaagcuggccuacaugccccacaccuucuucaucggcgaccacgccaacauguucccccaccugaagaagaaggccgugaucgacuucaagagcaacggccacaucuacgacaacagaaucgugcugaacggcaucgaccugaaggccuuccuggacagccugcccgacgugaagaucgugaagaugaagugccccgacggcggcgacaacgccgacagcagcaacaccgcccugaacaugcccgugauccccaugaacaccaucgccgaggccgugaucgagaugaucaacagaggccagauccagaucaccaucaacggcuucagcaucagcaacggccuggccaccacccagaucaacaacaaggccgccaccggcgaggaggugcccagaaccaucaucgugaccaccagaagccaguacggccugcccgaggacgccaucguguacugcaacuucaaccagcuguacaagaucgaccccagcacccugcagaugugggccaacauccugaagagagugcccaacagcgugcuguggcugcugagauuccccgccgugggcgagcccaacauccagcaguacgcccagaacaugggccugccccagaacagaaucaucuucagccccguggcccccaaggaggagcacgugagaagaggccagcuggccgacgugugccuggacaccccccugugcaacggccacaccaccggcauggacgugcugugggccggcacccccauggugaccaugcccggcgagacccuggccagcagaguggccgccagccagcugaccugccugggcugccuggagcugaucgccaagaacagacaggaguacgaggacaucgccgugaagcugggcaccgaccuggaguaccugaagaaggugagaggcaagguguggaagcagagaaucagcagcccccuguucaacaccaagcaguacaccauggagcuggagagacuguaccugcagaugugggagcacuacgccgccggcaacaagcccgaccacaugaucaagcccguggaggugaccgagagcgccuaa

SEQ ID NO: 20901 - RNA, 690 nt, Artificial Sequence
  OIP5__Homo_sapiens__NP_009211
auggccgcccagccccugagacacagaagcagaugcgccaccccccccagaggcgacuucugcggcggcaccgagagagccaucgaccaggccagcuucaccaccagcauggagugggacacccagguggugaagggcagcagcccccugggccccgccggccugggcgccgaggagcccgccgccggcccccagcugcccagcuggcugcagcccgagagaugcgccguguuccagugcgcccagugccacgccgugcuggccgacagcgugcaccuggccugggaccugagcagaagccugggcgccgugguguucagcagagugaccaacaacguggugcuggaggcccccuuccuggugggcaucgagggcagccugaagggcagcaccuacaaccugcuguucugcggcagcugcggcauccccgugggcuuccaccuguacagcacccacgccgcccuggccgcccugagaggccacuucugccugagcagcgacaagauggugugcuaccugcugaagaccaaggccaucgugaacgccagcgagauggacauccagaacgugccccugagcgagaagaucgccgagcugaaggagaagaucgugcugacccacaacagacugaagagccugaugaagauccugagcgaggugacccccgaccagagcaagcccgagaacuaa

SEQ ID NO: 20902 - RNA, 1638 nt, Artificial Sequence
  OIT3__Homo_sapiens__NP_689848
augccccccuuccugcugcugaccugccuguucaucaccggcaccagcgugagccccguggcccuggaccccugcagcgccuacaucagccugaacgagcccuggagaaacaccgaccaccagcuggacgagagccagggccccccccugugcgacaaccacgugaacggcgagugguaccacuucaccggcauggccggcgacgccaugcccaccuucugcauccccgagaaccacugcggcacccacgcccccguguggcugaacggcagccacccccuggagggcgacggcaucgugcagagacaggccugcgccagcuucaacggcaacugcugccuguggaacaccaccguggaggugaaggccugccccggcggcuacuacguguacagacugaccaagcccagcgugugcuuccacguguacugcggccacuucuacgacaucugcgacgaggacugccacggcagcugcagcgacaccagcgagugcaccugcgcccccggcaccgugcugggccccgacagacagaccugcuucgacgagaacgagugcgagcagaacaacggcggcugcagcgagaucugcgugaaccugaagaacagcuacagaugcgagugcggcgugggcagagugcugagaagcgacggcaagaccugcgaggacguggagggcugccacaacaacaacggcggcugcagccacagcugccugggcagcgagaagggcuaccagugcgagugccccagaggccuggugcugagcgaggacaaccacaccugccaggugcccgugcugugcaagagcaacgccaucgaggugaacauccccagagagcuggugggcggccuggagcuguuccugaccaacaccagcugcagaggcgugagcaacggcacccacgugaacauccuguucagccugaagaccugcggcaccgugguggacguggugaacgacaagaucguggccagcaaccuggugaccggccugcccaagcagacccccggcagcagcggcgacuucaucaucagaaccagcaagcugcugauccccgugaccugcgaguuccccagacuguacaccaucagcgagggcuacgugcccaaccugagaaacagcccccuggagaucaugagcagaaaccacggcaucuuccccuucacccuggagaucuucaaggacaacgaguucgaggagcccuacagagaggcccugcccacccugaagcugagagacagccuguacuucggcaucgagcccguggugcacgugagcggccuggagagccugguggagagcugcuucgccacccccaccagcaagaucgacgaggugcugaaguacuaccugaucagagacggcugcgugagcgacgacagcgugaagcaguacaccagcagagaccaccuggccaagcacuuccaggugcccguguucaaguucgugggcaaggaccacaaggagguguuccugcacugcagagugcuggugugcggcgugcuggacgagagaagcagaugcgcccagggcugccacagaagaaugagaagaggcgccggcggcgaggacagcgccggccugcagggccagacccugaccggcggccccaucagaaucgacugggaggacuaa

SEQ ID NO: 20903 - RNA, 717 nt, Artificial Sequence
  OLA1__Homo_sapiens__NP_001011708
augaucggccccaucaucgacaagcuggagaagguggccgugagaggcggcgacaagaagcugaagcccgaguacgacaucaugugcaaggugaagagcugggugaucgaccagaagaagcccgugagauucuaccacgacuggaacgacaaggagaucgaggugcugaacaagcaccuguuccugaccagcaagcccaugguguaccuggugaaccugagcgagaaggacuacaucagaaagaagaacaaguggcugaucaagaucaaggaguggguggacaaguacgaccccggcgcccuggugauccccuucagcggcgcccuggagcugaagcugcaggagcugagcgccgaggagagacagaaguaccuggaggccaacaugacccagagcgcccugcccaagaucaucaaggccggcuucgccgcccugcagcuggaguacuucuucaccgccggccccgacgaggugagagccuggaccaucagaaagggcaccaaggccccccaggccgccggcaagauccacaccgacuucgagaagggcuucaucauggccgaggugaugaaguacgaggacuucaaggaggagggcagcgagaacgccgugaaggccgccggcaaguacagacagcagggcagaaacuacaucguggaggacggcgacaucaucuucuucaaguucaacaccccccagcagcccaagaagaaguaa

SEQ ID NO: 20904 - RNA, 1458 nt, Artificial Sequence
  OLFM1__Homo_sapiens__NP_001269540
augagcgugccccugcugaagaucggcguggugcugagcaccauggccaugaucaccaacuggaugagccagacccugcccagccuggugggccugaacaccaccaagcugagcgccgccggcggcggcacccuggacagaagcaccggcgugcugcccaccaaccccgaggagagcuggcagguguacagcagcgcccaggacagcgagggcagaugcaucugcaccgugguggccccccagcagaccaugugcagcagagacgccagaaccaagcagcugagacagcugcuggagaaggugcagaacaugagccagagcaucgaggugcuggacagaagaacccagagagaccugcaguacguggagaagauggagaaccagaugaagggccuggagagcaaguucaagcagguggaggagagccacaagcagcaccuggccagacaguucaaggccaucaaggccaagauggacgagcugagaccccugauccccgugcuggaggaguacaaggccgacgccaagcuggugcugcaguucaaggaggaggugcagaaccugaccagcgugcugaacgagcugcaggaggagaucggcgccuacgacuacgacgagcugcagagcagagugagcaaccuggaggagagacugagagccugcaugcagaagcuggccugcggcaagcugaccggcaucagcgaccccgugaccgugaagaccagcggcagcagauucggcagcuggaugaccgacccccuggcccccgagggcgacaacagagugugguacauggacggcuaccacaacaacagauucgugagagaguacaagagcaugguggacuucaugaacaccgacaacuucaccagccacagacugccccaccccuggagcggcaccggccaggugguguacaacggcagcaucuacuucaacaaguuccagagccacaucaucaucagauucgaccugaagaccgagaccauccugaagaccagaagccuggacuacgccggcuacaacaacauguaccacuacgccuggggcggccacagcgacaucgaccugaugguggacgagagcggccugugggccguguacgccaccaaccagaacgccggcaacaucguggugagcagacuggaccccgugagccugcagacccugcagaccuggaacaccagcuaccccaagagaagcgccggcgaggccuucaucaucugcggcacccuguacgugaccaacggcuacagcggcggcaccaaggugcacuacgccuaccagaccaacgccagcaccuacgaguacaucgacauccccuuccagaacaaguacagccacaucagcaugcuggacuacaaccccaaggacagagcccuguacgccuggaacaacggccaccagauccuguacaacgugacccuguuccacgugaucagaagcgacgagcuguaa

SEQ ID NO: 20905 - RNA, 1365 nt, Artificial Sequence
  OLFM2__Homo_sapiens__NP_477512
auguggccccugaccgugccccccccccugcugcugcugcugugcagcggccuggccggccagacccuguuccagaaccccgaggagggcuggcagcuguacaccagcgcccaggcccccgacggcaagugcaucugcaccgccgugauccccgcccagagcaccugcagcagagacggcagaagcagagagcugagacagcugauggagaaggugcagaacgugagccagagcauggaggugcuggagcugagaaccuacagagaccugcaguacgugagaggcauggagacccugaugagaagccuggacgccagacugagagccgccgacggcagccugagcgccaagagcuuccaggagcugaaggacagaaugaccgagcugcugccccugagcagcgugcuggagcaguacaaggccgacaccagaaccaucgugagacugagagaggaggugagaaaccugagcggcagccuggccgccauccaggaggagaugggcgccuacggcuacgaggaccugcagcagagagugauggcccuggaggccagacugcacgccugcgcccagaagcugggcugcggcaagcugaccggcgugagcaaccccaucaccgugagagccaugggcagcagauucggcagcuggaugaccgacaccauggcccccagcgccgacagcagagugugguacauggacggcuacuacaagggcagaagagugcuggaguucagaacccugggcgacuucaucaagggccagaacuucauccagcaccugcugccccagcccugggccggcaccggccacgugguguacaacggcagccuguucuacaacaaguaccagagcaacgugguggugaaguaccacuucagaagcagaagcgugcuggugcagagaagccugcccggcgccggcuacaacaacaccuuccccuacagcuggggcggcuucagcgacauggacuucaugguggacgagagcggccugugggccguguacaccaccaaccagaacgccggcaacaucguggugagcagacuggacccccacacccuggaggugaugagaagcugggacaccggcuaccccaagagaagcgccggcgaggccuucaugaucugcggcgugcuguacgugaccaacagccaccuggccggcgccaagguguacuucgccuacuucaccaacaccagcagcuacgaguacaccgacgugcccuuccacaaccaguacagccacaucagcaugcuggacuacaaccccagagagagagcccuguacaccuggaacaacggccaccaggugcuguacaacgugacccuguuccacgugaucagcaccagcggcgaccccuaa

SEQ ID NO: 20906 - RNA, 1533 nt, Artificial Sequence
  OLFM4__Homo_sapiens__NP_006409
augagacccggccugagcuuccugcuggcccugcuguucuuccugggccaggccgccggcgaccugggcgacgugggcccccccauccccagccccggcuucagcagcuuccccggcguggacagcagcagcagcuucagcagcagcagcagaagcggcagcagcagcagcagaagccugggcagcggcggcagcgugagccagcuguucagcaacuucaccggcagcguggacgacagaggcaccugccagugcagcgugagccugcccgacaccaccuuccccguggacagaguggagagacuggaguucaccgcccacgugcugagccagaaguucgagaaggagcugagcaaggugagagaguacgugcagcugaucagcguguacgagaagaagcugcugaaccugaccgugagaaucgacaucauggagaaggacaccaucagcuacaccgagcuggacuucgagcugaucaagguggaggugaaggagauggagaagcuggugauccagcugaaggagagcuucggcggcagcagcgagaucguggaccagcuggagguggagaucagaaacaugacccugcugguggagaagcuggagacccuggacaagaacaacgugcuggccaucagaagagagaucguggcccugaagaccaagcugaaggagugcgaggccagcaaggaccagaacacccccguggugcaccccccccccacccccggcagcugcggccacggcggcguggugaacaucagcaagcccagcguggugcagcugaacuggagaggcuucagcuaccuguacggcgccuggggcagagacuacagcccccagcaccccaacaagggccuguacuggguggccccccugaacaccgacggcagacugcuggaguacuacagacuguacaacacccuggacgaccugcugcuguacaucaacgccagagagcugagaaucaccuacggccagggcagcggcaccgccguguacaacaacaacauguacgugaacauguacaacaccggcaacaucgccagagugaaccugaccaccaacaccaucgccgugacccagacccugcccaacgccgccuacaacaacagauucagcuacgccaacguggccuggcaggacaucgacuucgccguggacgagaacggccugugggugaucuacagcaccgaggccagcaccggcaacauggugaucagcaagcugaacgacaccacccugcaggugcugaacaccugguacaccaagcaguacaagcccagcgccagcaacgccuucauggugugcggcgugcuguacgccaccagaaccaugaacaccagaaccgaggagaucuucuacuacuacgacaccaacaccggcaaggagggcaagcuggacaucgugaugcacaagaugcaggagaaggugcagagcaucaacuacaaccccuucgaccagaagcuguacguguacaacgacggcuaccugcugaacuacgaccugagcgugcugcagaagccccaguaa

SEQ ID NO: 20907 - RNA, 2253 nt, Artificial Sequence
  OLFML2B__Homo_sapiens__NP_056256
auggccaagcccagacugcuggugcuguacuucgcccugaucguggugcccgccugggugagcagcaucgugcugaccggcaccagcgagccccccgacgcccagaccguggcccccgccgaggacgagacccugcagaacgaggccgacaaccaggagaacgugcugagccagcugcugggcgacuacgacaaggugaaggccaugagcgagggcagcgacugccagugcaagugcguggugagaccccugggcagagacgccugccagagaaucaacgccggcgccagcagaaaggaggacuucuacaccguggagaccaucaccagcggcagcagcugcaagugcgccugcguggccccccccagcgcccugaaccccugcgagggcgacuucagacugcagaagcugagagaggccgacagccaggaccugaagcugagcaccaucaucgacaugcuggagggcgccuucuacggccuggaccugcugaagcugcacagcgugaccaccaagcuggugggcagaguggacaagcuggaggaggaggugagcaagaaccugaccaaggagaacgagcagaucaaggaggacauggaggagaucagaaccgagaugaacaagagaggcaaggagaacugcagcgagaacauccuggacagcaugcccgacaucagaagcgcccugcagagagacgccgccgccgccuacgcccaccccgaguacgaggagagauuccugcaggaggagaccgugagccagcagaucaacagcaucgagcugcugcagaccagaccccuggcccugcccgagguggugaagagccagagaccccugcagagacaggugcaccugagaggcagacccgccagccagcccaccgugaucagaggcaucaccuacuacaaggccaaggugagcgaggaggagaacgacaucgaggagcagcaggacgaguucuucagcggcgacaacggcguggaccugcugaucgaggaccagcugcugagacacaacggccugaugaccagcgugaccagaagacccgccgccaccagacagggccacagcaccgccgugaccagcgaccugaacgccagaaccgcccccuggagcagcgcccugccccagcccagcaccagcgaccccagcaucgccaaccacgccagcgugggccccacccugcagaccaccagcgugagccccgaccccaccagagagagcgugcugcagcccagcccccaggugcccgccaccaccguggcccacaccgccacccagcagcccgccgcccccgccccccccgccgugagccccagagaggcccugauggaggccaugcacaccgugcccgugccccccaccaccgugagaaccgacagccugggcaaggacgcccccgccggcuggggcaccacccccgccagccccacccugagccccgaggaggaggacgacaucagaaacgugaucggcagaugcaaggacacccugagcaccaucaccggccccaccacccagaacaccuacggcagaaacgagggcgccuggaugaaggacccccuggccaaggacgagagaaucuacgugaccaacuacuacuacggcaacacccugguggaguucagaaaccuggagaacuucaagcagggcagauggagcaacagcuacaagcugcccuacagcuggaucggcaccggccacgugguguacaacggcgccuucuacuacaacagagccuucaccagaaacaucaucaaguacgaccugaagcagagauacguggccgccugggccaugcugcacgacguggccuacgaggaggccacccccuggagauggcagggccacagcgacguggacuucgccguggacgagaacggccuguggcugaucuaccccgcccuggacgacgagggcuucagccaggaggugaucgugcugagcaagcugaacgccgccgaccugagcacccagaaggagaccaccuggagaaccggccugagaagaaacuucuacggcaacugcuucgugaucugcggcgugcuguacgccguggacagcuacaaccagagaaacgccaacaucagcuacgccuucgacacccacaccaacacccagaucgugcccagacugcuguucgagaacgaguacagcuacaccacccagaucgacuacaaccccaaggacagacugcuguacgccugggacaacggccaccaggugaccuaccacgugaucuucgccuacuaa

SEQ ID NO: 20908 - RNA, 816 nt, Artificial Sequence
  OLIG1__Homo_sapiens__NP_620450
auguacuacgccgugagccaggccagagugaacgccgugcccggcaccaugcugagaccccagagacccggcgaccugcagcugggcgccagccuguacgagcuggugggcuacagacagccccccagcagcagcagcagcagcaccagcagcaccagcagcaccagcagcagcagcaccaccgccccccugcugcccaaggccgccagagagaagcccgaggcccccgccgagccccccggccccggccccggcagcggcgcccaccccggcggcagcgccagacccgacgccaaggaggagcagcagcagcagcugagaagaaagaucaacagcagagagagaaagagaaugcaggaccugaaccuggccauggacgcccugagagaggugauccugcccuacagcgccgcccacugccagggcgcccccggcagaaagcugagcaagaucgccacccugcugcuggccagaaacuacauccugcugcugggcagcagccugcaggagcugagaagagcccugggcgagggcgccggccccgccgcccccagacugcugcuggccggccugccccugcuggccgccgcccccggcagcgugcugcuggcccccggcgccgugggcccccccgacgcccugagacccgccaaguaccugagccuggcccuggacgagccccccugcggccaguucgcccugcccggcggcggcgccggcggccccggccugugcaccugcgccgugugcaaguucccccaccuggugcccgccagccugggccuggccgccgugcaggcccaguucagcaaguaa

SEQ ID NO: 20909 - RNA, 972 nt, Artificial Sequence
  OLIG2__Homo_sapiens__XP_005260965
auggacagcgacgccagccuggugagcagcagacccagcagccccgagcccgacgaccuguuccugcccgccagaagcaagggcagcagcggcagcgccuucaccggcggcaccgugagcagcagcacccccagcgacugcccccccgagcugagcgccgagcugagaggcgccaugggcagcgccggcgcccaccccggcgacaagcugggcggcagcggcuucaagagcagcagcagcagcaccagcagcagcaccagcagcgccgccgccagcagcaccaagaaggacaagaagcagaugaccgagcccgagcugcagcagcugagacugaagaucaacagcagagagagaaagagaaugcacgaccugaacaucgccauggacggccugagagaggugaugcccuacgcccacggccccagcgugagaaagcugagcaagaucgccacccugcugcuggccagaaacuacauccugaugcugaccaacagccuggaggagaugaagagacuggugagcgagaucuacggcggccaccacgccggcuuccaccccagcgccugcggcggccuggcccacagcgccccccugcccgccgccaccgcccaccccgccgccgccgcccacgccgcccaccaccccgccgugcaccaccccauccugccccccgccgccgccgccgccgccgccgccgccgccgccgccgccgugagcagcgccagccugcccggcagcggccugcccagcgugggcagcaucagacccccccacggccugcugaagagccccagcgccgccgccgccgccccccugggcggcggcggcggcggcagcggcgccagcggcggcuuccagcacuggggcggcaugcccugccccugcagcaugugccaggugccccccccccaccaccacgugagcgccaugggcgccggcagccugcccagacugaccagcgacgccaaguaa

SEQ ID NO: 20910 - RNA, 819 nt, Artificial Sequence
  OLIG3__Homo_sapiens__NP_786923
augaacagcgacagcagcagcgugagcagcagagccagcagccccgacauggacgagauguaccugagagaccaccaccacagacaccaccaccaccaggagagcagacugaacagcgugagcagcacccagggcgacaugaugcagaagaugcccggcgagagccugagcagagccggcgccaaggccgccggcgagagcagcaaguacaagaucaagaagcagcugagcgagcaggaccugcagcagcugagacugaagaucaacggcagagagagaaagagaaugcacgaccugaaccuggccauggacggccugagagaggugaugcccuacgcccacggccccagcgugagaaagcugagcaagaucgccacccugcugcuggccagaaacuacauccugaugcugaccagcagccuggaggagaugaagagacuggugggcgagaucuacggcggccaccacagcgccuuccacugcggcaccgugggccacagcgccggccaccccgcccacgccgccaacagcgugcaccccgugcaccccauccugggcggcgcccugagcagcggcaacgccagcagcccccugagcgccgccagccugcccgccaucggcaccaucagacccccccacagccugcugaaggcccccagcaccccccccgcccugcagcugggcagcggcuuccagcacugggccggccugcccugccccugcaccaucugccagaugcccccccccccccaccugagcgcccugagcaccgccaacauggccagacugagcgccgagagcaaggaccugcugaaguaa

SEQ ID NO: 20911 - RNA, 546 nt, Artificial Sequence
  OLR1__Homo_sapiens__NP_001166103
augaccuucgacgaccugaagauccagaccgugaaggaccagcccgacgagaagagcaacggcaagaaggccaagggccugcaguuccuguacagccccugguggugccuggccgccgccacccugggcgugcugugccugggccugguggugaccaucauggugcugggcaugcagcugagccaggugagcgaccugcugacccaggagcaggccaaccugacccaccagaagaagaagcuggagggccagaucagcgccagacagcaggccgaggaggccagccaggagagcgagaacgagcugaaggagaugaucgagacccuggccagaaagcugaacgagaagagcaaggagcagauggagcugcaccaccagaaccugaaccugcaggagacccugaagagaguggccaacugcagcggccugcaccccgccagcaacuuccuguuccaguucagcauccuggacggcgccgugagcgaggagccccagcugcccauggcccugggcggcagauucagcuucgacgccccccugaucuaa

SEQ ID NO: 20912 - RNA, 1266 nt, Artificial Sequence
  OMD__Homo_sapiens__NP_005005
augggcuuccugagccccaucuacgugaucuucuucuucuucggcgugaaggugcacugccaguacgagaccuaccagugggacgaggacuacgaccaggagcccgacgacgacuaccagaccggcuuccccuucagacagaacguggacuacggcgugcccuuccaccaguacacccugggcugcgugagcgagugcuucugccccaccaacuuccccagcagcauguacugcgacaacagaaagcugaagaccauccccaacauccccaugcacauccagcagcuguaccugcaguucaacgagaucgaggccgugaccgccaacagcuucaucaacgccacccaccugaaggagaucaaccugagccacaacaagaucaagagccagaagaucgacuacggcguguucgccaagcugcccaaccugcugcagcugcaccuggagcacaacaaccuggaggaguuccccuucccccugcccaagagccuggagagacugcugcugggcuacaacgagaucagcaagcugcagaccaacgccauggacggccuggugaaccugaccaugcuggaccugugcuacaacuaccugcacgacagccugcugaaggacaagaucuucgccaagauggagaagcugaugcagcugaaccugugcagcaacagacuggagagcaugccccccggccugcccagcagccugauguaccugagccuggagaacaacagcaucagcagcauccccgagaaguacuucgacaagcugcccaagcugcacacccugagaaugagccacaacaagcugcaggacauccccuacaacaucuucaaccugcccaacaucguggagcugagcgugggccacaacaagcugaagcaggccuucuacauccccagaaaccuggagcaccuguaccugcagaacaacgagaucgagaagaugaaccugaccgugaugugccccagcaucgacccccugcacuaccaccaccugaccuacaucagaguggaccagaacaagcugaaggagcccaucagcagcuacaucuucuucugcuucccccacauccacaccaucuacuacggcgagcagagaagcaccaacggccagaccauccagcugaagacccagguguucagaagauuccccgacgacgacgacgagagcgaggaccacgacgaccccgacaacgcccacgagagccccgagcaggagggcgccgagggccacuucgaccugcacuacuacgagaaccaggaguaa

SEQ ID NO: 20913 - RNA, 1323 nt, Artificial Sequence
  OMG__Homo_sapiens__NP_002535
auggaguaccagauccugaagaugagccugugccuguucauccugcuguuccugacccccggcauccugugcaucugcccccugcagugcaucugcaccgagagacacagacacguggacugcagcggcagaaaccugagcacccugcccagcggccugcaggagaacaucauccaccugaaccugagcuacaaccacuucaccgaccugcacaaccagcugacccaguacaccaaccugagaacccuggacaucagcaacaacagacuggagagccugcccgcccaccugcccagaagccuguggaacaugagcgccgccaacaacaacaucaagcugcuggacaagagcgacaccgccuaccaguggaaccugaaguaccuggacgugagcaagaacaugcuggagaagguggugcugaucaagaacacccugagaagccuggaggugcugaaccugagcagcaacaagcuguggaccgugcccaccaacaugcccagcaagcugcacaucguggaccugagcaacaacagccugacccagauccugcccggcacccugaucaaccugaccaaccugacccaccuguaccugcacaacaacaaguucaccuucauccccgaccagagcuucgaccagcuguuccagcugcaggagaucacccuguacaacaacagauggagcugcgaccacaagcagaacaucaccuaccugcugaaguggaugauggagaccaaggcccacgugaucggcacccccugcagcacccagaucagcagccugaaggagcacaacauguaccccacccccagcggcuucaccagcagccuguucaccgugagcggcaugcagaccguggacaccaucaacagccugagcguggugacccagcccaaggugaccaagauccccaagcaguacagaaccaaggagaccaccuucggcgccacccugagcaaggacaccaccuucaccagcaccgacaaggccuucgugcccuaccccgaggacaccagcaccgagaccaucaacagccacgaggccgccgccgccacccugaccauccaccugcaggacggcauggugaccaacaccagccugaccagcagcaccaagagcagccccacccccaugacccugagcaucaccagcggcaugcccaacaacuucagcgagaugccccagcagagcaccacccugaaccuguggagagaggagaccaccaccaacgugaagaccccccugcccagcguggccaacgccuggaaggugaacgccagcuuccugcugcugcugaacgugguggugaugcuggccguguaa

SEQ ID NO: 20914 - RNA, 492 nt, Artificial Sequence
  OMP__Homo_sapiens__NP_006180
auggccgaggacagaccccagcagccccagcuggacaugccccuggugcuggaccagggccugaccagacagaugagacugagaguggagagccugaagcagagaggcgagaagagacaggacggcgagaagcugcugcagcccgccgagagcguguacagacugaacuucacccagcagcagagacugcaguucgagagauggaacguggugcuggacaagcccggcaaggugaccaucaccggcaccagccagaacuggacccccgaccugaccaaccugaugaccagacagcugcuggaccccaccgccaucuucuggagaaaggaggacagcgacgccaucgacuggaacgaggccgacgcccuggaguucggcgagagacugagcgaccuggccaagaucagaaaggugauguacuuccuggugaccuucggcgagggcguggagcccgccaaccugaaggccagcgugguguucaaccagcuguaa

SEQ ID NO: 20915 - RNA, 1398 nt, Artificial Sequence
  ONECUT1__Homo_sapiens__NP_004489
augaacgcccagcugaccauggaggccaucggcgagcugcacggcgugagccacgagcccgugcccgcccccgccgaccugcugggcggcagcccccacgccagaagcagcguggcccacagaggcagccaccugccccccgcccaccccagaagcaugggcauggccagccugcuggacggcggcagcggcggcggcgacuaccaccaccaccacagagcccccgagcacagccuggccggcccccugcaccccaccaugaccauggccugcgagaccccccccggcaugagcaugcccaccaccuacaccacccugaccccccugcagccccugccccccaucagcaccgugagcgacaaguucccccaccaccaccaccaccaccaccaccaccaccacccccaccaccaccagagacuggccggcaacgugagcggcagcuucacccugaugagagacgagagaggccuggccagcaugaacaaccuguacacccccuaccacaaggacguggccggcaugggccagagccugagcccccugagcagcagcggccugggcagcauccacaacagccagcagggccugccccacuacgcccaccccggcgccgccaugcccaccgacaagaugcugacccccaacggcuucgaggcccaccaccccgccaugcugggcagacacggcgagcagcaccugacccccaccagcgccggcauggugcccaucaacggccugcccccccaccacccccacgcccaccugaacgcccagggccacggccagcugcugggcaccgccagagagcccaaccccagcgugaccggcgcccaggugagcaacggcagcaacagcggccagauggaggagaucaacaccaaggagguggcccagagaaucaccaccgagcugaagagauacagcaucccccaggccaucuucgcccagagagugcugugcagaagccagggcacccugagcgaccugcugagaaaccccaagcccuggagcaagcugaagagcggcagagagaccuucagaagaauguggaaguggcugcaggagcccgaguuccagagaaugagcgcccugagacuggccgccugcaagagaaaggagcaggagcacggcaaggacagaggcaacacccccaagaagcccagacugguguucaccgacgugcagagaagaacccugcacgccaucuucaaggagaacaagagacccagcaaggagcugcagaucaccaucagccagcagcugggccuggagcugagcaccgugagcaacuucuucaugaacgccagaagaagaagccuggacaaguggcaggacgagggcagcagcaacagcggcaacagcagcagcagcagcagcaccugcaccaaggccuaa

SEQ ID NO: 20916 - RNA, 1515 nt, Artificial Sequence
  ONECUT2__Homo_sapiens__NP_004843
augaaggccgccuacaccgccuacagaugccugaccaaggaccuggagggcugcgccaugaaccccgagcugaccauggagagccugggcacccugcacggccccgccggcggcggcagcggcggcggcggcggcggcggcggcggcggcggcggcggcggccccggccacgagcaggagcugcuggccagccccagcccccaccacgccggcagaggcgccgccggcagccugagaggccccccccccccccccaccgcccaccaggagcugggcaccgccgccgccgccgccgccgccgccagcagaagcgccauggugaccagcauggccagcauccuggacggcggcgacuacagacccgagcugagcaucccccugcaccacgccaugagcaugagcugcgacagcagcccccccggcaugggcaugagcaacaccuacaccacccugaccccccugcagccccugccccccaucagcaccgugagcgacaaguuccaccacccccacccccaccaccacccccaccaccaccaccaccaccaccaccagagacugagcggcaacgugagcggcagcuucacccugaugagagacgagagaggccugcccgccaugaacaaccuguacagccccuacaaggagaugcccggcaugagccagagccugagcccccuggccgccaccccccugggcaacggccugggcggccugcacaacgcccagcagagccugcccaacuacggcccccccggccacgacaagaugcugagccccaacuucgacgcccaccacaccgccaugcugaccagaggcgagcagcaccugagcagaggccugggcaccccccccgccgccaugaugagccaccugaacggccugcaccaccccggccacacccagagccacggccccgugcuggcccccagcagagagagaccccccagcagcagcagcggcagccagguggccaccagcggccagcuggaggagaucaacaccaaggagguggcccagagaaucaccgccgagcugaagagauacagcaucccccaggccaucuucgcccagagagugcugugcagaagccagggcacccugagcgaccugcugagaaaccccaagcccuggagcaagcugaagagcggcagagagaccuucagaagaauguggaaguggcugcaggagcccgaguuccagagaaugagcgcccugagacuggccgccugcaagagaaaggagcaggagcccaacaaggacagaaacaacagccagaagaagagcagacugguguucaccgaccugcagagaagaacccuguucgccaucuucaaggagaacaagagacccagcaaggagaugcagaucaccaucagccagcagcugggccuggagcugaccaccgugagcaacuucuucaugaacgccagaagaagaagccuggagaaguggcaggacgaccugagcaccggcggcagcagcagcaccagcagcaccugcaccaaggccuaa

SEQ ID NO: 20917 - RNA, 2883 nt, Artificial Sequence
  OPA1__Homo_sapiens__NP_056375
auguggagacugagaagagccgccguggccugcgaggugugccagagccuggugaagcacagcagcggcaucaagggcagccugccccugcagaagcugcaccuggugagcagaagcaucuaccacagccaccaccccacccugaagcugcagagaccccagcugagaaccagcuuccagcaguucagcagccugaccaaccugccccugagaaagcugaaguucagccccaucaaguacggcuaccagcccagaagaaacuucuggcccgccagacuggccaccagacugcugaagcugagauaccugauccugggcagcgccgugggcggcggcuacaccgccaagaagaccuucgaccaguggaaggacaugauccccgaccugagcgaguacaaguggaucgugcccgacaucgugugggagaucgacgaguacaucgacuucgagaagaucagaaaggcccugcccagcagcgaggaccuggugaagcuggcccccgacuucgacaagaucguggagagccugagccugcugaaggacuucuucaccagcggcagccccgaggagaccgccuucagagccaccgacagaggcagcgagagcgacaagcacuucagaaaggugagcgacaaggagaagaucgaccagcugcaggaggagcugcugcacacccagcugaaguaccagagaauccuggagagacuggagaaggagaacaaggagcugagaaagcuggugcugcagaaggacgacaagggcauccaccacagaaagcugaagaagagccugaucgacauguacagcgaggugcuggacgugcugagcgacuacgacgccagcuacaacacccaggaccaccugcccagaguggugguggugggcgaccagagcgccggcaagaccagcgugcuggagaugaucgcccaggccagaaucuuccccagaggcagcggcgagaugaugaccagaagccccgugaaggugacccugagcgagggcccccaccacguggcccuguucaaggacagcagcagagaguucgaccugaccaaggaggaggaccuggccgcccugagacacgagaucgagcugagaaugagaaagaacgugaaggagggcugcaccgugagccccgagaccaucagccugaacgugaagggccccggccugcagagaauggugcugguggaccugcccggcgugaucaacaccgugaccagcggcauggcccccgacaccaaggagaccaucuucagcaucagcaaggccuacaugcagaaccccaacgccaucauccugugcauccaggacggcagcguggacgccgagagaagcaucgugaccgaccuggugagccagauggacccccacggcagaagaaccaucuucgugcugaccaagguggaccuggccgagaagaacguggccagccccagcagaauccagcagaucaucgagggcaagcuguuccccaugaaggcccugggcuacuucgccguggugaccggcaagggcaacagcagcgagagcaucgaggccaucagagaguacgaggaggaguucuuccagaacagcaagcugcugaagaccagcaugcugaaggcccaccaggugaccaccagaaaccugagccuggccgugagcgacugcuucuggaagauggugagagagagcguggagcagcaggccgacagcuucaaggccaccagauucaaccuggagaccgaguggaagaacaacuaccccagacugagagagcuggacagaaacgagcuguucgagaaggccaagaacgagauccuggacgaggugaucagccugagccaggugacccccaagcacugggaggagauccugcagcagagccugugggagagagugagcacccacgugaucgagaacaucuaccugcccgccgcccagaccaugaacagcggcaccuucaacaccaccguggacaucaagcugaagcaguggaccgacaagcagcugcccaacaaggccguggagguggccugggagacccugcaggaggaguucagcagauucaugaccgagcccaagggcaaggagcacgacgacaucuucgacaagcugaaggaggccgugaaggaggagagcaucaagagacacaaguggaacgacuucgccgaggacagccugagagugauccagcacaacgcccuggaggacagaagcaucagcgacaagcagcagugggacgccgccaucuacuucauggaggaggcccugcaggccagacugaaggacaccgagaacgccaucgagaacauggugggccccgacuggaagaagagauggcuguacuggaagaacagaacccaggagcagugcgugcacaacgagaccaagaacgagcuggagaagaugcugaagugcaacgaggagcaccccgccuaccuggccagcgacgagaucaccaccgugagaaagaaccuggagagcagaggcguggagguggaccccagccugaucaaggacaccuggcaccagguguacagaagacacuuccugaagaccgcccugaaccacugcaaccugugcagaagaggcuucuacuacuaccagagacacuucguggacagcgagcuggagugcaacgacguggugcuguucuggagaauccagagaaugcuggccaucaccgccaacacccugagacagcagcugaccaacaccgaggugagaagacuggagaagaacgugaaggaggugcuggaggacuucgccgaggacggcgagaagaagaucaagcugcugaccggcaagagagugcagcuggccgaggaccugaagaaggugagagagauccaggagaagcuggacgccuucaucgaggcccugcaccaggagaaguaa

SEQ ID NO: 20918 - RNA, 543 nt, Artificial Sequence
  OPA3__Homo_sapiens__NP_001017989
augguggugggcgccuuccccauggccaagcugcuguaccugggcaucagacaggugagcaagccccuggccaacagaaucaaggaggccgccagaagaagcgaguucuucaagaccuacaucugccugccccccgcccagcuguaccacuggcuggagaugagaaccaagaugagaaucaugggcuucaacgccgccgccaucaagccccugaacgagggcgccgccgccgagcugggcgccgagcugcugggcgagggcaucaucuucaucaccgccugcagcugccugaugcuggaguacuggagacaccagcugcagcagagaagaaaggagaaggagagaagaguggccagagaggcccugagaggcgaggugggccaccugggccuggcccuggaggagcugcaggcccaggugcaggccaccagcacccagcuggcccuggaggagcugagagcccagcugcaggaggugagagcccaccugugccugagagaccccccccccgccccccccguggcccccgccagcgagaaguaa

SEQ ID NO: 20919 - RNA, 1017 nt, Artificial Sequence
  OPCML__Homo_sapiens__NP_001012393
auguaccaccccgccuacugggugguguucagcgccaccaccgcccugcuguucauccccggcgugcccgugagaagcggcgacgccaccuuccccaaggccauggacaacgugaccgugagacagggcgagagcgccacccugagaugcaccaucgacgacagagugaccagaguggccuggcugaacagaagcaccauccuguacgccggcaacgacaaguggagcaucgaccccagagugaucauccuggugaacacccccacccaguacagcaucaugauccagaacguggacguguacgacgagggccccuacaccugcagcgugcagaccgacaaccaccccaagaccagcagagugcaccugaucgugcaggugcccccccagaucaugaacaucagcagcgacaucaccgugaacgagggcagcagcgugacccugcugugccuggccaucggcagacccgagcccaccgugaccuggagacaccugagcgugaaggagggccagggcuucgugagcgaggacgaguaccuggagaucagcgacaucaagagagaccagagcggcgaguacgagugcagcgcccugaacgacguggccgcccccgacgugagaaaggugaagaucaccgugaacuacccccccuacaucagcaaggccaagaacaccggcgugagcgugggccagaagggcauccugagcugcgaggccagcgccgugcccauggccgaguuccagugguucaaggaggagaccagacuggccaccggccuggacggcaugagaaucgagaacaagggcagaaugagcacccugaccuucuucaacgugagcgagaaggacuacggcaacuacaccugcguggccaccaacaagcugggcaacaccaacgccagcaucacccuguacggccccggcgccgugaucgacggcgugaacagcgccagcagagcccuggccugccuguggcugagcggcacccugcuggcccacuucuucaucaaguucuaa

SEQ ID NO: 20920 - RNA, 2085 nt, Artificial Sequence
  OPHN1__Homo_sapiens__XP_005262327
augggccaccccccccuggaguucagcgacugcuaccuggacagccccgacuucagagagagacugaagugcuacgagcaggagcuggagagaaccaacaaguucaucaaggacgugaucaaggacggcaacgcccugaucagcgccaugagaaacuacagcagcgccgugcagaaguucagccagacccugcagagcuuccaguucgacuucaucggcgacacccugaccgacgacgagaucaacaucgccgagagcuucaaggaguucgccgagcugcugaacgagguggagaacgagagaaugaugauggugcacaacgccagcgaccugcugaucaagccccuggagaacuucagaaaggagcagaucggcuucaccaaggagagaaagaagaaguucgagaaggacggcgagagauucuacagccugcuggacagacaccugcaccugagcagcaagaagaaggagagccagcugcaggaggccgaccugcagguggacaaggagagacacaacuucuucgagagcagccuggacuacguguaccagauccaggaggugcaggagagcaagaaguucaacaucguggagcccgugcuggccuuccugcacagccuguucaucagcaacagccugaccguggagcugacccaggacuuccugcccuacaagcagcagcugcagcugagccugcagaacaccagaaaccacuucagcagcaccagagaggagauggaggagcugaagaagagaaugaaggaggccccccagaccugcaagcugcccggccagcccaccaucgagggcuaccuguacacccaggagaagugggcccugggcaucagcugggugaaguacuacugccaguacgagaaggagaccaagacccugaccaugacccccauggagcagaagcccggcgccaagcagggcccccuggaccugacccugaaguacugcgugagaagaaagaccgagagcaucgacaagagauucugcuucgacaucgagaccaacgagagacccggcaccaucacccugcaggcccugagcgaggccaacagaagacuguggauggaggccauggacggcaaggagcccaucuaccacagccccaucaccaagcagcaggagauggagcugaacgaggugggcuucaaguucgugagaaagugcaucaacaucaucgagaccaagggcaucaagaccgagggccuguacagaaccgugggcagcaacauccaggugcagaagcugcugaacgccuucuucgaccccaagugccccggcgacguggacuuccacaacagcgacugggacaucaagaccaucaccagcagccugaaguucuaccugagaaaccugagcgagcccgugaugaccuacagacugcacaaggagcuggugagcgccgccaagagcgacaaccuggacuacagacugggcgccauccacagccugguguacaagcugcccgagaagaacagagagaugcuggagcugcugaucagacaccuggugaacgugugcgagcacagcaaggagaaccugaugacccccagcaacaugggcgugaucuucggccccacccugaugagagcccaggaggacaccguggccgccaugaugaacaucaaguuccagaacaucgugguggagauccugaucgagcacuucggcaagaucuaccugggcccccccgaggagagcgccgccccccccgugcccccccccagagugaccgccagaagacacaagcccaucaccaucagcaagagacugcugagagagagaaccguguucuacaccagcagccuggacgagagcgagggcgacgccgacagcuucagcaaggugagaccccccggcgagaagcccaccaucaucagaccccccgugagaccccccgacccccccugcagagccgccaccccccagaagcccgagcccaagcccgacaucguggccggcaacgccggcgagaucaccagcagcgugguggccagcagaaccagauucuucgagaccgccagcagaaagaccggcagcagccagggcagacugcccggcgacgagagcuaa

SEQ ID NO: 20921 - RNA, 1095 nt, Artificial Sequence
  OPN1LW__Homo_sapiens__NP_064445
auggcccagcaguggagccugcagagacuggccggcagacacccccaggacagcuacgaggacagcacccagagcagcaucuucaccuacaccaacagcaacagcaccagaggccccuucgagggccccaacuaccacaucgcccccagauggguguaccaccugaccagcguguggaugaucuucguggugaccgccagcguguucaccaacggccuggugcuggccgccaccaugaaguucaagaagcugagacacccccugaacuggauccuggugaaccuggccguggccgaccuggccgagaccgugaucgccagcaccaucagcaucgugaaccaggugagcggcuacuucgugcugggccaccccaugugcgugcuggagggcuacaccgugagccugugcggcaucaccggccuguggagccuggccaucaucagcugggagagauggaugguggugugcaagcccuucggcaacgugagauucgacgccaagcuggccaucgugggcaucgccuucagcuggaucugggccgccguguggaccgccccccccaucuucggcuggagcagauacuggccccacggccugaagaccagcugcggccccgacguguucagcggcagcagcuaccccggcgugcagagcuacaugaucgugcugauggugaccugcugcaucaucccccuggccaucaucaugcugugcuaccugcagguguggcuggccaucagagccguggccaagcagcagaaggagagcgagagcacccagaaggccgagaaggaggugaccagaauggugguggugaugaucuucgccuacugcgugugcuggggccccuacaccuucuucgccugcuucgccgccgccaaccccggcuacgccuuccacccccugauggccgcccugcccgccuacuucgccaagagcgccaccaucuacaaccccgugaucuacguguucaugaacagacaguucagaaacugcauccugcagcuguucggcaagaagguggacgacggcagcgagcugagcagcgccagcaagaccgaggugagcagcgugagcagcgugagccccgccuaa

SEQ ID NO: 20922 - RNA, 1095 nt, Artificial Sequence
  OPN1MW2__Homo_sapiens__NP_001041646
auggcccagcaguggagccugcagagacuggccggcagacacccccaggacagcuacgaggacagcacccagagcagcaucuucaccuacaccaacagcaacagcaccagaggccccuucgagggccccaacuaccacaucgcccccagauggguguaccaccugaccagcguguggaugaucuucguggugaucgccagcguguucaccaacggccuggugcuggccgccaccaugaaguucaagaagcugagacacccccugaacuggauccuggugaaccuggccguggccgaccuggccgagaccgugaucgccagcaccaucagcguggugaaccagguguacggcuacuucgugcugggccaccccaugugcgugcuggagggcuacaccgugagccugugcggcaucaccggccuguggagccuggccaucaucagcugggagagauggaugguggugugcaagcccuucggcaacgugagauucgacgccaagcuggccaucgugggcaucgccuucagcuggaucugggccgccguguggaccgccccccccaucuucggcuggagcagauacuggccccacggccugaagaccagcugcggccccgacguguucagcggcagcagcuaccccggcgugcagagcuacaugaucgugcugauggugaccugcugcaucaccccccugagcaucaucgugcugugcuaccugcagguguggcuggccaucagagccguggccaagcagcagaaggagagcgagagcacccagaaggccgagaaggaggugaccagaauggugguggugauggugcuggccuucugcuucugcuggggccccuacgccuucuucgccugcuucgccgccgccaaccccggcuaccccuuccacccccugauggccgcccugcccgccuucuucgccaagagcgccaccaucuacaaccccgugaucuacguguucaugaacagacaguucagaaacugcauccugcagcuguucggcaagaagguggacgacggcagcgagcugagcagcgccagcaagaccgaggugagcagcgugagcagcgugagccccgccuaa

SEQ ID NO: 20923 - RNA, 1047 nt, Artificial Sequence
  OPN1SW__Homo_sapiens__NP_001699
augagaaagaugagcgaggaggaguucuaccuguucaagaacaucagcagcgugggccccugggacggcccccaguaccacaucgcccccgugugggccuucuaccugcaggccgccuucaugggcaccguguuccugaucggcuucccccugaacgccauggugcugguggccacccugagauacaagaagcugagacagccccugaacuacauccuggugaacgugagcuucggcggcuuccugcugugcaucuucagcguguuccccguguucguggccagcugcaacggcuacuucguguucggcagacacgugugcgcccuggagggcuuccugggcaccguggccggccuggugaccggcuggagccuggccuuccuggccuucgagagauacaucgugaucugcaagcccuucggcaacuucagauucagcagcaagcacgcccugaccguggugcuggccaccuggaccaucggcaucggcgugagcaucccccccuucuucggcuggagcagauucauccccgagggccugcagugcagcugcggccccgacugguacaccgugggcaccaaguacagaagcgagagcuacaccugguuccuguucaucuucugcuucaucgugccccugagccugaucugcuucagcuacacccagcugcugagagcccugaaggccguggccgcccagcagcaggagagcgccaccacccagaaggccgagagagaggugagcagaauggugguggugauggugggcagcuucugcgugugcuacgugcccuacgccgccuucgccauguacauggugaacaacagaaaccacggccuggaccugagacuggugaccauccccagcuucuucagcaagagcgccugcaucuacaaccccaucaucuacugcuucaugaacaagcaguuccaggccugcaucaugaagauggugugcggcaaggccaugaccgacgagagcgacaccugcagcagccagaagaccgaggugagcaccgugagcagcacccaggugggccccaacuaa

SEQ ID NO: 20924 - RNA, 1209 nt, Artificial Sequence
  OPN3__Homo_sapiens__NP_055137
auguacagcggcaacagaagcggcggccacggcuacugggacggcggcggcgccgccggcgccgagggccccgcccccgccggcacccugagccccgccccccuguucagccccggcaccuacgagagacuggcccugcugcugggcagcaucggccugcugggcgugggcaacaaccugcuggugcuggugcuguacuacaaguuccagagacugagaacccccacccaccugcugcuggugaacaucagccugagcgaccugcuggugagccuguucggcgugaccuucaccuucgugagcugccugagaaacggcugggugugggacaccgugggcugcgugugggacggcuucagcggcagccuguucggcaucgugagcaucgccacccugaccgugcuggccuacgagagauacaucagaguggugcacgccagagugaucaacuucagcugggccuggagagccaucaccuacaucuggcuguacagccuggccugggccggcgccccccugcugggcuggaacagauacauccuggacgugcacggccugggcugcaccguggacuggaagagcaaggacgccaacgacagcagcuucgugcuguuccuguuccugggcugccugguggugccccugggcgugaucgcccacugcuacggccacauccuguacagcaucagaaugcugagaugcguggaggaccugcagaccauccaggugaucaagauccugaaguacgagaagaagcuggccaagaugugcuuccugaugaucuucaccuuccuggugugcuggaugcccuacaucgugaucugcuuccugguggugaacggccacggccaccuggugacccccaccaucagcaucgugagcuaccuguucgccaagagcaacaccguguacaaccccgugaucuacguguucaugaucagaaaguucagaagaagccugcugcagcugcugugccugagacugcugagaugccagagacccgccaaggaccugcccgccgccggcagcgagaugcagaucagacccaucgugaugagccagaaggacggcgacagacccaagaagaaggugaccuucaacagcagcagcaucaucuucaucaucaccagcgacgagagccugagcguggacgacagcgacaagaccaacggcagcaagguggacgugauccaggugagaccccuguaa

SEQ ID NO: 20925 - RNA, 1470 nt, Artificial Sequence
  OPN4__Homo_sapiens__NP_001025186
augaacccccccagcggccccagagugccccccagccccacccaggagcccagcugcauggccacccccgccccccccagcuggugggacagcagccagagcagcaucagcagccugggcagacugcccagcaucagccccaccgcccccggcaccugggccgccgccugggugccccugcccaccguggacgugcccgaccacgcccacuacacccugggcaccgugauccugcuggugggccugaccggcaugcugggcaaccugaccgugaucuacaccuucugcagagccgugcugagaggcgugaccgugaugaugcagagcagaagccugagaacccccgccaacauguucaucaucaaccuggccgugagcgacuuccugaugagcuucacccaggcccccguguucuucaccagcagccuguacaagcaguggcuguucggcgagaccggcugcgaguucuacgccuucugcggcgcccuguucggcaucagcagcaugaucacccugaccgccaucgcccuggacagauaccuggugaucaccagaccccuggccaccuucggcguggccagcaagagaagagccgccuucgugcugcugggcguguggcuguacgcccuggccuggagccugccccccuucuucggcuggagcgccuacgugcccgagggccugcugaccagcugcagcugggacuacaugagcuucacccccgccgugagagccuacaccaugcugcugugcugcuucguguucuuccugccccugcugaucaucaucuacugcuacaucuucaucuucagagccaucagagagaccggcagagcccugcagaccuucggcgccugcaagggcaacggcgagagccuguggcagagacagagacugcagagcgagugcaagauggccaagaucaugcugcuggugauccugcuguucgugcugagcugggcccccuacagcgccguggcccugguggccuucgccggcuacgcccacgugcugacccccuacaugagcagcgugcccgccgugaucgccaaggccagcgccauccacaaccccaucaucuacgccaucacccaccccaaguacagaguggccaucgcccagcaccugcccugccugggcgugcugcugggcgugagcagaagacacagcagacccuaccccagcuacagaagcacccacagaagcacccugaccagccacaccagcaaccugagcuggaucagcaucagaagaagacaggagagccugggcagcgagagcgaggugggcuggacccacauggaggccgccgccguguggggcgccgcccagcaggccaacggcagaagccuguacggccagggccuggaggaccuggaggccaaggccccccccagaccccagggccacgaggccgagacccccggcaagaccaagggccugauccccagccaggaccccagaauguaa

SEQ ID NO: 20926 - RNA, 1065 nt, Artificial Sequence
  OPN5__Homo_sapiens__NP_859528
auggcccugaaccacaccgcccugccccaggacgagagacugccccacuaccugagagacggcgaccccuucgccagcaagcugagcugggaggccgaccugguggccggcuucuaccugaccaucaucggcauccugagcaccuucggcaacggcuacgugcuguacaugagcagcagaagaaagaagaagcugagacccgccgagaucaugaccaucaaccuggccgugugcgaccugggcaucagcguggugggcaagcccuucaccaucaucagcugcuucugccacagauggguguucggcuggaucggcugcagaugguacggcugggccggcuucuucuucggcugcggcagccugaucaccaugaccgccgugagccuggacagauaccugaagaucugcuaccugagcuacggcguguggcugaagagaaagcacgccuacaucugccuggccgccaucugggccuacgccagcuucuggaccaccaugccccuggugggccugggcgacuacgugcccgagcccuucggcaccagcugcacccuggacugguggcuggcccaggccagcgugggcggccagguguucauccugaacauccuguucuucugccugcugcugcccaccgccgugaucguguucagcuacgugaagaucaucgccaaggugaagagcagcagcaaggagguggcccacuucgacagcagaauccacagcagccacgugcuggagaugaagcugaccaagguggccaugcugaucugcgccggcuuccugaucgccuggauccccuacgccguggugagcguguggagcgccuucggcagacccgacagcauccccauccagcugagcguggugcccacccugcuggccaagagcgccgccauguacaaccccaucaucuaccaggugaucgacuacaaguucgccugcugccagaccggcggccugaaggccaccaagaagaagagccuggagggcuucagacugcacaccgugaccaccgugagaaagagcagcgccgugcuggagauccacgaggagugggaguaa

SEQ ID NO: 20927 - RNA, 1143 nt, Artificial Sequence
  OPRK1__Homo_sapiens__NP_000903
auggacagccccauccagaucuucagaggcgagcccggccccaccugcgcccccagcgccugccugccccccaacagcagcgccugguuccccggcugggccgagcccgacagcaacggcagcgccggcagcgaggacgcccagcuggagcccgcccacaucagccccgccauccccgugaucaucaccgccguguacagcgugguguucguggugggccuggugggcaacagccuggugauguucgugaucaucagauacaccaagaugaagaccgccaccaacaucuacaucuucaaccuggcccuggccgacgcccuggugaccaccaccaugcccuuccagagcaccguguaccugaugaacagcuggcccuucggcgacgugcugugcaagaucgugaucagcaucgacuacuacaacauguucaccagcaucuucacccugaccaugaugagcguggacagauacaucgccgugugccaccccgugaaggcccuggacuucagaaccccccugaaggccaagaucaucaacaucugcaucuggcugcugagcagcagcgugggcaucagcgccaucgugcugggcggcaccaaggugagagaggacguggacgugaucgagugcagccugcaguuccccgacgacgacuacagcuggugggaccuguucaugaagaucugcguguucaucuucgccuucgugauccccgugcugaucaucaucgugugcuacacccugaugauccugagacugaagagcgugagacugcugagcggcagcagagagaaggacagaaaccugagaagaaucaccagacuggugcugguggugguggccguguucguggugugcuggacccccauccacaucuucauccugguggaggcccugggcagcaccagccacagcaccgccgcccugagcagcuacuacuucugcaucgcccugggcuacaccaacagcagccugaaccccauccuguacgccuuccuggacgagaacuucaagagaugcuucagagacuucugcuucccccugaagaugagaauggagagacagagcaccagcagagugagaaacaccgugcaggaccccgccuaccugagagacaucgacggcaugaacaagcccguguaa

SEQ ID NO: 20928 - RNA, 1113 nt, Artificial Sequence
  OPRL1__Homo_sapiens__NP_001186948
auggagccccuguuccccgcccccuucugggaggugaucuacggcagccaccugcagggcaaccugagccugcugagccccaaccacagccugcugcccccccaccugcugcugaacgccagccacggcgccuuccugccccugggccugaaggugaccaucgugggccuguaccuggccgugugcgugggcggccugcugggcaacugccuggugauguacgugauccugagacacaccaagaugaagaccgccaccaacaucuacaucuucaaccuggcccuggccgacacccuggugcugcugacccugcccuuccagggcaccgacauccugcugggcuucuggcccuucggcaacgcccugugcaagaccgugaucgccaucgacuacuacaacauguucaccagcaccuucacccugaccgccaugagcguggacagauacguggccaucugccaccccaucagagcccuggacgugagaaccagcagcaaggcccaggccgugaacguggccaucugggcccuggccagcguggugggcgugcccguggccaucaugggcagcgcccagguggaggacgaggagaucgagugccugguggagauccccaccccccaggacuacuggggccccguguucgccaucugcaucuuccuguucagcuucaucgugcccgugcuggugaucagcgugugcuacagccugaugaucagaagacugagaggcgugagacugcugagcggcagcagagagaaggacagaaaccugagaagaaucaccagacuggugcugguggugguggccguguucgugggcugcuggacccccgugcagguguucgugcuggcccagggccugggcgugcagcccagcagcgagaccgccguggccauccugagauucugcaccgcccugggcuacgugaacagcugccugaaccccauccuguacgccuuccuggacgagaacuucaaggccugcuucagaaaguucugcugcgccagcgcccugagaagagacgugcaggugagcgacagagugagaagcaucgccaaggacguggcccuggccugcaagaccagcgagaccgugcccagacccgccuaa

SEQ ID NO: 20929 - RNA, 1203 nt, Artificial Sequence
  OPRM1__Homo_sapiens__NP_000905
auggacagcagcgccgcccccaccaacgccagcaacugcaccgacgcccuggccuacagcagcugcagccccgcccccagccccggcagcugggugaaccugagccaccuggacggcaaccugagcgaccccugcggccccaacagaaccgaccugggcggcagagacagccugugcccccccaccggcagccccagcaugaucaccgccaucaccaucauggcccuguacagcaucgugugcguggugggccuguucggcaacuuccuggugauguacgugaucgugagauacaccaagaugaagaccgccaccaacaucuacaucuucaaccuggcccuggccgacgcccuggccaccagcacccugcccuuccagagcgugaacuaccugaugggcaccuggcccuucggcaccauccugugcaagaucgugaucagcaucgacuacuacaacauguucaccagcaucuucacccugugcaccaugagcguggacagauacaucgccgugugccaccccgugaaggcccuggacuucagaacccccagaaacgccaagaucaucaacgugugcaacuggauccugagcagcgccaucggccugcccgugauguucauggccaccaccaaguacagacagggcagcaucgacugcacccugaccuucagccaccccaccugguacugggagaaccugcugaagaucugcguguucaucuucgccuucaucaugcccgugcugaucaucaccgugugcuacggccugaugauccugagacugaagagcgugagaaugcugagcggcagcaaggagaaggacagaaaccugagaagaaucaccagaauggugcugguggugguggccguguucaucgugugcuggacccccauccacaucuacgugaucaucaaggcccuggugaccauccccgagaccaccuuccagaccgugagcuggcacuucugcaucgcccugggcuacaccaacagcugccugaaccccgugcuguacgccuuccuggacgagaacuucaagagaugcuucagagaguucugcauccccaccagcagcaacaucgagcagcagaacagcaccagaaucagacagaacaccagagaccaccccagcaccgccaacaccguggacagaaccaaccaccagcuggagaaccuggaggccgagaccgccccccugcccuaa

SEQ ID NO: 20930 - RNA, 999 nt, Artificial Sequence
  OPTC__Homo_sapiens__XP_011507708
augagacugcuggccuuccugagccugcuggcccuggugcugcaggagaccggcaccgccagccugcccagaaaggagagaaagagaagagaggagcagaugcccagagagggcgacagcuucgaggugcugccccugagaaacgacgugcugaaccccgacaacuacggcgaggugaucgaccugagcaacuacgaggagcugaccgacuacggcgaccagcugcccgaggugaaggugaccagccuggcccccgccaccagcaucagccccgccaagagcaccaccgcccccggcacccccagcagcaaccccaccaugaccagacccaccaccgccggccugcugcugagcagccagcccaaccacggccugcccaccugccuggugugcgugugccugggcagcagcguguacugcgacgacaucgaccuggaggacauccccccccugcccagaagaaccgccuaccuguacgccagauucaacagaaucagcagaaucagagccgaggacuucaagggccugaccaagcugaagagaaucgaccugagcaacaaccugaucagcagcaucgacaacgacgccuucagacugcugcacgcccugcaggaccugauccugcccgagaaccagcuggaggcccugcccgugcugcccagcggcaucgaguuccuggacgugagacugaacagacugcagagcagcggcauccagcccgccgccuucagagccauggagaagcugcaguuccuguaccugagcgacaaccugcuggacagcauccccggcccccugccccugagccugagaagcgugcaccugcagaacaaccugaucgagaccaugcagagagacguguucugcgaccccgaggagcacaagcacaccagaagacagcuggaggacaucagacuggacggcaaccccaucaaccugagccuguuccccagcgccuacuucugccugcccagacugcccaucggcagauucaccuaa

SEQ ID NO: 20931 - RNA, 1734 nt, Artificial Sequence
  OPTN__Homo_sapiens__NP_001008214
augagccaccagccccugagcugccugaccgagaaggaggacagccccagcgagagcaccggcaacggccccccccaccuggcccaccccaaccuggacaccuucacccccgaggagcugcugcagcagaugaaggagcugcugaccgagaaccaccagcugaaggaggccaugaagcugaacaaccaggccaugaagggcagauucgaggagcugagcgccuggaccgagaagcagaaggaggagagacaguucuucgagauccagagcaaggaggccaaggagagacugauggcccugagccacgagaacgagaagcugaaggaggagcugggcaagcugaagggcaagagcgagagaagcagcgaggaccccaccgacgacagcagacugcccagagccgaggccgagcaggagaaggaccagcugagaacccagguggugagacugcaggccgagaaggccgaccugcugggcaucgugagcgagcugcagcugaagcugaacagcagcggcagcagcgaggacagcuucguggagaucagaauggccgagggcgaggccgagggcagcgugaaggagaucaagcacagccccggccccaccagaaccgugagcaccggcaccgcccugagcaaguacagaagcagaagcgccgacggcgccaagaacuacuucgagcacgaggagcugaccgugagccagcugcugcugugccugagagagggcaaccagaagguggagagacuggagguggcccugaaggaggccaaggagagagugagcgacuucgagaagaagaccagcaacagaagcgagaucgagacccagaccgagggcagcaccgagaaggagaacgacgaggagaagggccccgagaccgugggcagcgagguggaggcccugaaccugcaggugaccagccuguucaaggagcugcaggaggcccacaccaagcugagcgaggccgagcugaugaagaagagacugcaggagaagugccaggcccuggagagaaagaacagcgccauccccagcgagcugaacgagaagcaggagcugguguacaccaacaagaagcuggagcugcagguggagagcaugcugagcgagaucaagauggagcaggccaagaccgaggacgagaagagcaagcugaccgugcugcagaugacccacaacaagcugcugcaggagcacaacaacgcccugaagaccaucgaggagcugaccagaaaggagagcgagaagguggacagagccgugcugaaggagcugagcgagaagcuggagcuggccgagaaggcccuggccagcaagcagcugcagauggacgagaugaagcagaccaucgccaagcaggaggaggaccuggagaccaugaccauccugagagcccagauggagguguacugcagcgacuuccacgccgagagagccgccagagagaagauccacgaggagaaggagcagcuggcccugcagcuggccgugcugcugaaggagaacgacgccuucgaggacggcggcagacagagccugauggagaugcagagcagacacggcgccagaaccagcgacagcgaccagcaggccuaccuggugcagagaggcgccgaggacagagacuggagacagcagagaaacauccccauccacagcugccccaagugcggcgaggugcugcccgacaucgacacccugcagauccacgugauggacugcaucaucuaa

SEQ ID NO: 20932 - RNA, 912 nt, Artificial Sequence
  OR10A2__Homo_sapiens__NP_001004460
augagcuucagcagccugcccaccgagauccagagccugcuguuccugaccuuccugaccaucuaccuggugacccugaugggcaacugccugaucauccuggugacccuggccgaccccaugcugcacagccccauguacuucuuccugagaaaccugagcuuccuggagaucggcuucaaccuggugaucgugcccaagaugcugggcacccugcuggcccaggacaccaccaucagcuuccugggcugcgccacccagauguacuucuucuucuucuucggcguggccgagugcuuccugcuggccaccauggccuacgacagauacguggccaucugcagcccccugcacuaccccgugaucaugaaccagagaaccagagccaagcuggccgccgccagcugguuccccggcuuccccguggccaccgugcagaccaccuggcuguucagcuuccccuucugcggcaccaacaaggugaaccacuucuucugcgacagcccccccgugcugagacuggugugcgccgacaccgcccuguucgagaucuacgccaucgugggcaccauccugguggugaugauccccugccugcugauccugugcagcuacacccacaucgccgccgccauccugaagauccccagcgccaagggcaagaacaaggccuucagcaccugcagcagccaccugcugguggugagccuguucuacaucagccugagccugaccuacuucagacccaagagcaacaacagccccgagggcaagaagcugcugagccugagcuacaccgugaugacccccaugcugaaccccaucaucuacagccugagaaacaacgaggugaagaacgcccugagcagaaccgugagcaaggcccuggcccugagaaacugcauccccuaa

SEQ ID NO: 20933 - RNA, 948 nt, Artificial Sequence
  OR10A4__Homo_sapiens__NP_997069
augaugugggagaacuggaccaucgugagcgaguucgugcuggugagcuucagcgcccugagcaccgagcugcaggcccugcuguuccugcuguuccugaccaucuaccuggugacccugaugggcaacgugcugaucauccuggugaccaucgccgacagcgcccugcagagccccauguacuucuuccugagaaaccugagcuuccuggagaucggcuucaaccuggugaucgugcccaagaugcugggcacccugaucauccaggacaccaccaucagcuuccugggcugcgccacccagauguacuucuucuucuucuucggcgccgccgagugcugccugcuggccaccauggccuacgacagauacguggccaucugcgacccccugcacuaccccgugaucaugggccacaucagcugcgcccagcuggccgccgccagcugguucagcggcuucagcguggccaccgugcagaccaccuggaucuucagcuuccccuucugcggccccaacagagugaaccacuucuucugcgacagcccccccgugaucgcccuggugugcgccgacaccagcguguucgagcuggaggcccugaccgccaccgugcuguucauccuguuccccuuccugcugauccugggcagcuacgugagaauccugagcaccaucuucagaaugcccagcgccgagggcaagcaccaggccuucagcaccugcagcgcccaccugcugguggugagccuguucuacagcaccgccauccugaccuacuucagaccccagagcagcgccagcagcgagagcaagaagcugcugagccugagcagcaccguggugacccccaugcugaaccccaucaucuacagcagcagaaacaaggaggugaaggccgcccugaagagacugauccacagaacccugggcagccagaagcuguaa

SEQ ID NO: 20934 - RNA, 939 nt, Artificial Sequence
  OR10C1__Homo_sapiens__NP_039229
augagcgccaacaccagcauggugaccgaguuccugcugcugggcuucagccaccuggccgaccugcagggccugcuguucagcguguuccugaccaucuaccugcugaccguggccggcaacuuccugaucguggugcuggugagcaccgacgccgcccugcagagccccauguacuucuuccugagaacccugagcgcccuggagaucggcuacaccagcgugaccgugccccugcugcugcaccaccugcugaccggcagaagacacaucagcagaagcggcugcgcccugcagauguucuucuuccuguucuucggcgccaccgagugcugccugcuggccgccauggccuacgacagauacgccgccaucugcgagccccugagauacccccugcugcugagccacagagugugccugcagcuggccggcagcgccugggccugcggcgugcuggugggccugggccacacccccuucaucuucagccugcccuucugcggccccaacaccaucccccaguucuucugcgagauccagcccgugcugcagcuggugugcggcgacaccagccugaacgagcugcagaucauccuggccaccgcccugcugauccugugccccuucggccugauccugggcagcuacggcagaauccuggugaccaucuucagaauccccagcguggccggcagaagaaaggccuucagcaccugcagcagccaccugaucauggugagccuguucuacggcaccgcccuguucaucuacaucagacccaaggccagcuacgaccccgccaccgacccccuggugagccuguucuacgccguggugacccccauccugaaccccaucaucuacagccugagaaacaccgaggugaaggccgcccugaagagaaccauccagaagaccgugcccauggagaucuaa

SEQ ID NO: 20935 - RNA, 963 nt, Artificial Sequence
  OR10J1__Homo_sapiens__NP_036483
augcugcugugcuucagauucggcaaccagagcaugaagagagagaacuucacccugaucaccgacuucguguuccagggcuucagcagcuuccacgagcagcagaucacccuguucggcguguuccuggcccuguacauccugacccuggccggcaacaucaucaucgugaccaucaucagaauggaccugcaccugcacacccccauguacuucuuccugagcaugcugagcaccagcgagaccguguacacccuggugauccugcccagaaugcugagcagccuggugggcaugagccagcccaucagccuggccggcugcgccacccagauguucuucuucgugaccuucggcaucaccaacugcuuccugcugaccgccaugggcuacgacagauacguggccaucugcaacccccugagauacauggugaucaugaacaagagacugagaauccagcuggugcugggcgccugcagcaucggccugaucguggccaucacccaggugaccagcguguucagacugcccuucugcgccagaaaggugccccacuucuucugcgacaucagacccgugaugaagcugagcugcaucgacaccaccgugaacgagauccugacccugaucaucagcgugcuggugcugguggugcccaugggccugguguucaucagcuacgugcugaucaucagcaccauccugaagaucgccagcguggagggcagaaagaaggccuucgccaccugcgccagccaccugaccguggugaucgugcacuacagcugcgccagcaucgccuaccugaagcccaagagcgagaacaccagagagcacgaccagcugaucagcgugaccuacaccgugaucaccccccugcugaaccccgugguguacacccugagaaacaaggaggugaaggacgcccugugcagagccgugggcggcaaguucagcuaa

SEQ ID NO: 20936 - RNA, 990 nt, Artificial Sequence
  OR10J3__Homo_sapiens__NP_001004467
augcccaagcugaacagcaccuucgugaccgaguuccuguucgagggcuucagcagcuucagaagacagcacaagcugguguucuucgugguguuccugacccuguaccugcugacccugagcggcaacgugaucaucaugaccaucaucagacuggaccaccaccugcacacccccauguacuucuuccugugcaugcugagcaucagcgagaccugcuacaccguggccaucaucccccacaugcugagcggccugcugaacccccaccagcccaucgccacccagagcugcgccacccagcuguucuucuaccugaccuucggcaucaacaacugcuuccugcugaccgugaugggcuacgacagauacguggccaucugcaacccccugagauacagcgugaucaugggcaagagagccugcauccagcuggccagcggcagccugggcaucggccugggcauggccaucgugcaggugaccagcguguucggccugcccuucugcgacgccuucgugaucagccacuucuucugcgacgugagacaccugcugaagcuggccugcaccgacaccaccgugaacgagaucaucaacuucguggugagcgugugcgugcuggugcugcccaugggccugguguucaucagcuacgugcugaucaucagcaccauccugaagaucgccagcgccgagggccagaagaaggccuucgccaccugcgccagccaccugaccguggugaucauccacuacggcugcgccagcaucaucuaccugaagcccaagagccagagcagccugggccaggacagacugaucagcgugaccuacacccaccacagccccaccgagcccugcugcgugcagcccgaggagcagggcggccagagaugcagcgcccagagcagaggcgccaagaacagcgugagccugaugaagagaggcugcgagggcuucagcuucgccuucaucaacauguacuaa

SEQ ID NO: 20937 - RNA, 930 nt, Artificial Sequence
  OR10J5__Homo_sapiens__NP_001004469
augaagagaaagaacuucaccgaggugagcgaguucaucuuccugggcuucagcagcuucggcaagcaccagaucacccuguucgugguguuccugaccguguacauccugacccugguggccaacaucaucaucgugaccaucaucugcaucgaccaccaccugcacacccccauguacuucuuccugagcaugcuggccagcagcgagaccguguacacccuggugaucgugcccagaaugcugcugagccugaucuuccacaaccagcccaucagccuggccggcugcgccacccagauguucuucuucgugauccuggccaccaacaacugcuuccugcugaccgccaugggcuacgacagauacguggccaucugcagaccccugagauacaccgugaucaugagcaagggccugugcgcccagcuggugugcggcagcuucggcaucggccugaccauggccgugcugcacgugaccgccauguucaaccugcccuucugcggcaccgugguggaccacuucuucugcgacaucuaccccgugaugaagcugagcugcaucgacaccaccaucaacgagaucaucaacuacggcgugagcagcuucgugaucuucgugcccaucggccugaucuucaucagcuacgugcuggugaucagcagcauccugcagaucgccagcgccgagggcagaaagaagaccuucgccaccugcgugagccaccugaccguggugaucgugcacugcggcugcgccagcaucgccuaccugaagcccaagagcgagagcagcaucgagaaggaccuggugcugagcgugaccuacaccaucaucaccccccugcugaaccccgugguguacagccugagaaacaaggaggugaaggacgcccugugcagaguggugggcagaaacaucagcuaa

SEQ ID NO: 20938 - RNA, 942 nt, Artificial Sequence
  OR10K1__Homo_sapiens__NP_001004473
auggagcaggugaacaagaccguggugagagaguucguggugcugggcuucagcagccuggccagacugcagcagcugcuguucgugaucuuccugcugcuguaccuguucacccugggcaccaacgccaucaucaucagcaccaucgugcuggacagagcccugcacacccccauguacuucuuccuggccauccugagcugcagcgagaucugcuacaccuucgugaucgugcccaagaugcugguggaccugcugagccagaagaagaccaucagcuuccugggcugcgccauccagauguucagcuuccuguucuucggcagcagccacagcuuccugcuggccgccaugggcuacgacagauacauggccaucugcaacccccugagauacagcgugcugaugggccacggcgugugcaugggccugauggccgccgccugcgccugcggcuucaccgugagccuggugaccaccagccugguguuccaccugcccuuccacagcagcaaccagcugcaccacuucuucugcgacaucagccccgugcugaagcuggccagccagcacagcggcuucagccagcuggugaucuucaugcugggcguguucgcccuggugaucccccugcugcugauccuggugagcuacaucagaaucaucagcgccauccugaagauccccagcagcgugggcagauacaagaccuucagcaccugcgccagccaccugaucguggugaccgugcacuacagcugcgccagcuucaucuaccugagacccaagaccaacuacaccagcagccaggacacccugaucagcgugagcuacaccauccugaccccccuguucaaccccaugaucuacagccugagaaacaaggaguucaagagcgcccugagaagaaccaucggccagaccuucuacccccugagcuaa

SEQ ID NO: 20939 - RNA, 939 nt, Artificial Sequence
  OR10K2__Homo_sapiens__NP_001004476
auggagagagugaacgagaccguggugagagaggugaucuuccugggcuucagcagccuggccagacugcagcagcugcuguucgugaucuuccugcugcuguaccuguucacccugggcaccaacgccaucaucaucagcaccaucgugcuggacagagcccugcacauccccauguacuucuuccuggccauccugagcugcagcgagaucugcuacaccuucaucaucgugcccaagaugcugguggaccugcugagccagaagaagaccaucagcuuccugggcugcgccauccagauguucagcuuccuguuccugggcugcagccacagcuuccugcuggccgugaugggcuacgacagauacaucgccaucugcaacccccugagauacagcgugcugaugggccacggcgugugcaugggccugguggccgccgccugcgccugcggcuucaccguggcccagaucaucaccagccugguguuccaccugcccuucuacagcagcaaccagcugcaccacuucuucugcgacaucgcccccgugcugaagcuggccagccaccacaaccacuucagccagaucgugaucuucaugcugugcacccuggugcuggccaucccccugcugcugauccuggugagcuacgugcacauccugagcgccauccugcaguuccccagcacccugggcagaugcaaggccuucagcaccugcgugagccaccugaucaucgugaccgugcacuacggcugcgccagcuucaucuaccugagaccccagagcaacuacagcagcagccaggacgcccugaucagcgugagcuacaccaucaucaccccccuguucaaccccaugaucuacagccugagaaacaaggaguucaagagcgcccugugcaagaucgugagaagaaccaucagccugcuguaa

SEQ ID NO: 20940 - RNA, 1008 nt, Artificial Sequence
  OR10R2__Homo_sapiens__NP_001004472
augccccagauccugaucuucaccuaccugaacauguucuacuucuuccccccccugcagauccuggccgagaaccugaccauggugaccgaguuccugcugcugggcuucagcagccugggcgagauccagcuggcccuguucgugguguuccuguuccuguaccuggugauccugagcggcaacgugaccaucaucagcgugauccaccuggacaagagccugcacacccccauguacuucuuccugggcauccugagcaccagcgagaccuucuacaccuucgugauccugcccaagaugcugaucaaccugcugagcguggccagaaccaucagcuucaacugcugcgcccugcagauguucuucuuccugggcuucgccaucaccaacugccugcugcugggcgugaugggcuacgacagauacgccgccaucugccacccccugcacuaccccacccugaugagcuggcaggugugcggcaagcuggccgccgccugcgccaucggcggcuuccuggccagccugaccguggugaaccugguguucagccugcccuucugcagcgccaacaaggugaaccacuacuucugcgacaucagcgccgugauccugcuggccugcaccaacaccgacgugaacgaguucgugaucuucaucugcggcgugcuggugcugguggugcccuuccuguucaucugcgugagcuaccugugcauccugagaaccauccugaagauccccagcgccgagggcagaagaaaggccuucagcaccugcgccagccaccugagcguggugaucgugcacuacggcugcgccagcuucaucuaccugagacccaccgccaacuacgugagcaacaaggacagacuggugaccgugaccuacaccaucgugaccccccugcugaaccccaugguguacagccugagaaacaaggacgugcagcuggccaucagaaaggugcugggcaagaagggcagccugaagcuguacaacuaa

SEQ ID NO: 20941 - RNA, 945 nt, Artificial Sequence
  OR10T2__Homo_sapiens__NP_001004475
augagaggcuucaacaagaccaccguggugacccaguucauccuggugggcuucagcagccugggcgagcugcagcugcugcuguucgugaucuuccugcugcuguaccugaccauccugguggccaacgugaccaucauggccgugaucagauucagcuggacccugcacacccccauguacggcuuccuguucauccugagcuucagcgagagcugcuacaccuucgugaucaucccccagcugcuggugcaccugcugagcgacaccaagaccaucagcuucauggccugcgccacccagcuguucuucuuccugggcuucgccugcaccaacugccugcugaucgccgugaugggcuacgacagauacguggccaucugccacccccugagauacacccugaucaucaacaagagacugggccuggagcugaucagccugagcggcgccaccggcuucuucaucgcccugguggccaccaaccugaucugcgacaugagauucugcggccccaacagagugaaccacuacuucugcgacauggcccccgugaucaagcuggccugcaccgacacccacgugaaggagcuggcccuguucagccugagcauccuggugaucauggugcccuuccugcugauccugaucagcuacggcuucaucgugaacaccauccugaagauccccagcgccgagggcaagaaggccuucgugaccugcgccagccaccugaccgugguguucgugcacuacggcugcgccagcaucaucuaccugagacccaagagcaagagcgccagcgacaaggaccagcugguggccgugaccuacaccguggugaccccccugcugaacccccugguguacagccugagaaacaaggaggugaagaccgcccugaagagagugcugggcaugcccguggccaccaagaugagcuaa

SEQ ID NO: 20942 - RNA, 981 nt, Artificial Sequence
  OR10X1__Homo_sapiens__NP_001004477
auggugcugaacguguacugcugcuucuuccagaucagcgacauccagaccaugaagaucaaccagaccauccugaaggaguucauccuggugggcuucagcguguacccccacgugcagaccuuccuguucgugguguucuucugccuguaccugcugacccuggccggcaaccugaucaucaugggccugaccuggguggacagaagccugcacacccccauguaccuguuccugagcgcccugagcuucagcgagaccugcuacacccugaccaucgugcccaagaugcuggaggaccugcuggccaaggacagaagcaucagcgugaccggcugcagccugcagaugugcuucuuccugggccugggcggcaccaacugcaucauccugacccugaugggcuacgacagauuccuggccaucugcaacccccugagauacccccugcugaugaccaacaucgugugcggccagcugguggccagcgccugcaccgccggcuucuucaucagccugaccgagaccgcccugaucuucagagacagcuucugcagacccaaccuggugaagcacuucuucugccacaugcuggccgugaucagacugagcugcaucgacagcaaccacaccgaguucaucaucacccugaucagcgugagcggccugcugggcacccugcugcugaucauccugaccgacguguucaucaucagcaccgugcugagaauccccagcgccgagggcaagcagaaggccuucaccaccugcgccagccaccugaccguggugaucauccacuucggcuucgccagcaucguguaccugaagcccgaggccagcggcgacgacacccugaucgccgugcccuacaccgugaucacccccuuccugagccccaucaucuucagccugagaaacaaggacaugaagaacgccuucagaagaaugaugggcaacaccguggcccugaagaaguaa

SEQ ID NO: 20943 - RNA, 942 nt, Artificial Sequence
  OR10Z1__Homo_sapiens__NP_001004478
augggccagaccaacgugaccagcuggagagacuucguguuccugggcuucagcagcagcggcgagcugcagcugcugcuguucgcccuguuccugagccuguaccuggugacccugaccagcaacguguucaucaucaucgccaucagacuggacagccaccugcacacccccauguaccuguuccugagcuuccugagcuucagcgagaccugcuacacccugggcaucauccccagaaugcugagcggccuggccggcggcgaccaggccaucagcuacgugggcugcgccgcccagauguucuucagcgccagcugggccugcaccaacugcuuccugcuggccgccaugggcuucgacagauacguggccaucugcgccccccugcacuacgccagccacaugaaccccacccugugcgcccagcuggugaucaccagcuuccugaccggcuaccuguucggccugggcaugacccuggugaucuuccaccugagcuucugcagcagccacgagauccagcacuucuucugcgacaccccccccgugcugagccuggccugcggcgacaccggccccagcgagcugagaaucuucauccugagccugcuggugcugcuggugagcuucuucuucaucaccaucagcuacgccuacauccuggccgccauccugagaauccccagcgccgagggccagaagaaggccuucagcaccugcgccagccaccugaccguggugaucauccacuacggcugcgccagcuucguguaccugagacccaaggccagcuacagccuggagagagaccagcugaucgccaugaccuacaccguggugaccccccugcugaaccccaucguguacagccugagaaacagagccauccagaccgcccugagaaacgccuucagaggcagacugcugggcaagggcuaa

SEQ ID NO: 20944 - RNA, 948 nt, Artificial Sequence
  OR11A1__Homo_sapiens__NP_039225
auggagaucgugagcaccggcaacgagaccaucaccgaguucgugcugcugggcuucuacgacauccccgagcugcacuuccuguucuucaucguguucaccgccguguacguguucaucaucaucggcaacaugcugaucaucguggccguggugagcagccagagacugcacaagcccauguacaucuuccuggccaaccugagcuuccuggacauccuguacaccagcgccgugaugcccaagaugcuggagggcuuccugcaggaggccaccaucagcguggccggcugccugcugcaguucuucaucuucggcagccuggccaccgccgagugccugcugcuggccgugauggccuacgacagauaccuggccaucugcuacccccugcacuacccccugcugaugggccccagaagauacaugggccugguggugaccaccuggcugagcggcuucgugguggacggccuggugguggcccugguggcccagcugagauucugcggccccaaccacaucgaccaguucuacugcgacuucaugcuguucgugggccuggccugcagcgaccccagaguggcccaggugaccacccugauccugagcguguucugccugaccauccccuucggccugauccugaccagcuacgccagaaucgugguggccgugcugagagugcccgccggcgccagcagaagaagagccuucagcaccugcagcagccaccuggccguggugaccaccuucuacggcacccugaugaucuucuacguggcccccagcgccgugcacagccagcugcugagcaagguguucagccugcuguacaccguggugaccccccuguucaaccccgugaucuacaccaugagaaacaaggaggugcaccaggcccugagaaagauccugugcaucaagcagaccgagacccuggacuaa

SEQ ID NO: 20945 - RNA, 924 nt, Artificial Sequence
  OR12D2__Homo_sapiens__NP_039224
augcugaacaccaccagcgugaccgaguuccugcugcugggcgugaccgacauccaggagcugcagcccuuccuguucgugguguuccugaccaucuacuucaucagcgugaccggcaacggcgccgugcugaugaucgugaucagcgaccccagacugcacagccugauguacuucuuccugggcaaccugagcuaccuggacaucugcuacagcaccgugacccugcccaagaugcugcagaacuuccugagcacccacaaggccaucagcuuccugggcugcaucagccagcugcacuucuuccacagccugggcagcaccgagagcaugcuguucgccgugauggccuucgaccugagcguggccaucugcaagccccugagauacaccgugaucaugaacccccagcugugcacccagauggccaucaccaucugggugaucggcuucuuccacgcccugcugcacagcgugaugaccagcagacugaacuucugcggcagcaacagaauccaccacuuccugugcgacaucaagccccugcugaagcuggccugcggcaacaccgagcugaaccaguggcugcugagcaccgugaccggcaccaucgccaugggccccuucuuccugacccugcugagcuacuucuacaucaucaccuaccuguucuucaagaccagaagcugcagcaugcugugcaaggcccugagcaccugcgccagccacuucaugguggugauccuguucuacgcccccgugcuguucaccuacauccaccccgcccuggagagcuucauggaccaggacagaaucguggccaucauguacaccguggugacccccgugcugaacccccugaucuacacccugagaaacaaggaggugaagggcgcccugggcagagugaucagaagacuguaa

SEQ ID NO: 20946 - RNA, 951 nt, Artificial Sequence
  OR12D3__Homo_sapiens__NP_112221
auggagaacgugaccaccaugaacgaguuccugcugcugggccugaccggcgugcaggagcugcagcccuucuucuucggcaucuuccugaucaucuaccugaucaaccugaucggcaacggcagcauccuggugaugguggugcuggagccccagcugcacagccccauguacuucuuccugggcaaccugagcugccuggacaucagcuacagcagcgugacccugcccaagcugcuggugaaccuggugugcagcagaagagccaucagcuuccugggcugcaucacccagcugcacuucuuccacuuccugggcagcaccgaggccauccugcuggccaucauggccuucgacagauucguggccaucugcaacccccugagauacaccgugaucaugaacccccaggugugcauccugcuggccgccgccgccuggcugaucagcuucuucuacgcccugaugcacagcgugaugaccgcccaccugagcuucugcggcagccagaagcugaaccacuucuucuacgacgugaagccccugcuggagcuggccugcagcgacacccugcugaaccaguggcugcugagcaucgugaccggcagcaucagcaugggcgccuucuuccugacccugcugagcugcuucuacgugaucggcuuccugcuguucaagaacagaagcugcagaauccugcacaaggcccugagcaccugcgccagccacuucaugguggugugccuguucuacggccccgugggcuucaccuacaucagacccgccagcgccaccagcaugauccaggacagaaucauggccaucauguacagcgccgugacccccgugcugaacccccugaucuacacccugagaaacaaggaggugaugauggcccugaagaagaucuucggcagaaagcuguucaaggacuggcagcagcaccacuaa

SEQ ID NO: 20947 - RNA, 1044 nt, Artificial Sequence
  OR13C3__Homo_sapiens__NP_001001961
augaucgugcagcugaucugcaccgugugcuuccuggccgugaacaccuuccacgugagaagcagcuucgacuuccugaaggccgacgacaugggcgagaucaaccagacccuggugagcgaguuccugcugcugggccugagcggcuaccccaagaucgagaucguguacuucgcccugauccuggugauguaccuggugauccugaucggcaacggcgugcugaucaucgccagcaucuucgacagccacuuccacacccccauguacuucuuccugggcaaccugagcuuccuggacaucugcuacaccagcagcagcgugcccagcacccuggugagccugaucagcaagaagagaaacaucagcuucagcggcugcgccgugcagauguucuucggcuucgccaugggcagcaccgagugccugcugcugggcaugauggccuucgacagauacguggccaucugcaacccccugagauaccccaucauccugagcaagguggccuacgugcugauggccagcgugagcuggcugagcggcggcaucaacagcgccgugcagacccugcuggccaugagacugcccuucugcggcaacaacaucaucaaccacuucgccugcgagauccuggccgugcugaagcuggccugcgccgacaucagccugaacaucaucaccauggugaucagcaacauggccuuccuggugcugccccugauggugaucuucuucagcuacauguucauccuguacaccauccugcagaugaacagcgccaccggcagaagaaaggccuucagcaccugcagcgcccaccugaccguggugaucaucuucuacggcaccaucuucuucauguacgccaagcccaagagccaggaccugaucggcgaggagaagcugcaggcccuggacaagcugaucagccuguucuacggcguggugacccccaugcugaaccccauccuguacagccugagaaacaaggacgugaaggccgccgugaaguaccugcugaacaagaagcccauccacuaa

SEQ ID NO: 20948 - RNA, 957 nt, Artificial Sequence
  OR13C4__Homo_sapiens__NP_001001919
auggacaagaucaaccagaccuucgugagagaguucauccugcugggccugagcggcuaccccaagcuggagaucaucuucuucgcccugauccuggugauguacguggugauccugaucggcaacggcgugcugaucaucgccagcauccuggacagcagacugcacaugcccauguacuucuuccugggcaaccugagcuuccuggacaucugcuacaccaccagcagcauccccagcacccuggugagccugaucagcaagaagagaaacaucagcuucagcggcugcgccgugcagauguucuucggcuucgccaugggcagcaccgagugcuuccugcugggcaugauggccuucgacagauacguggccaucugcaacccccugagauaccccaucaucaugaacaaggugguguacgugcugcugaccagcgugagcuggcugagcggcggcaucaacagcaccgugcagaccagccuggccaugagauggcccuucugcggcaacaacaucaucaaccacuuccugugcgagauccuggccgugcugaagcuggccugcagcgacaucagcgugaacaucgugacccuggccgugagcaacaucgccuuccuggugcugccccugcuggugaucuucuucagcuacauguucauccuguacaccauccugagaaccaacagcgccaccggcagacacaaggccuucagcaccugcagcgcccaccugaccguggugaucaucuucuacggcaccaucuucuucauguacgccaagcccaagagccaggaccugcugggcaaggacaaccugcaggccaccgagggccuggugagcauguucuacggcguggugacccccaugcugaaccccaucaucuacagccugagaaacaaggacgugaaggccgccaucaaguaccugcugagcagaaaggccaucaaccaguaa

SEQ ID NO: 20949 - RNA, 960 nt, Artificial Sequence
  OR13F1__Homo_sapiens__NP_001004485
auguuccccgccaacuggaccagcgugaagguguucuucuuccugggcuucuuccacuaccccaaggugcaggugaucaucuucgccgugugccugcugauguaccugaucacccugcugggcaacaucuuccugaucagcaucaccauccuggacagccaccugcacacccccauguaccuguuccugagcaaccugagcuuccuggacaucugguacagcagcagcgcccugagccccaugcuggccaacuucgugagcggcagaaacaccaucagcuucagcggcugcgccacccagauguaccugagccuggccaugggcagcaccgagugcgugcugcugcccaugauggccuacgacagauacguggccaucugcaacccccugagauaccccgugaucaugaacagaagaaccugcgugcagaucgccgccggcagcuggaugaccggcugccugaccgccaugguggagaugaugagcgugcugccccugagccugugcggcaacagcaucaucaaccacuucaccugcgagauccuggccauccugaagcuggugugcguggacaccagccuggugcagcugaucaugcuggugaucagcgugcugcugcugcccaugcccaugcugcugaucugcaucagcuacgccuucauccuggccagcauccugagaaucagcagcguggagggcagaagcaaggccuucagcaccugcaccgcccaccugauggugguggugcuguucuacggcaccgcccugagcaugcaccugaagcccagcgccguggacagccaggagaucgacaaguucauggcccugguguacgccggccagacccccaugcugaaccccaucaucuacagccugagaaacaaggaggugaagguggcccugaagaagcugcugaucagaaaccacuucaacaccgccuucaucagcauccugaaguaa

SEQ ID NO: 20950 - RNA, 924 nt, Artificial Sequence
  OR13G1__Homo_sapiens__NP_001005487
augaaccacagcguggugaccgaguucaucauccugggccugaccaagaagcccgagcugcagggcaucaucuuccuguucuuccugaucguguaccugguggccuuccugggcaacaugcugaucaucaucgccaagaucuacaacaacacccugcacacccccauguacguguuccugcugacccuggccgugguggacaucaucugcaccaccagcaucauccccaagaugcugggcaccaugcugaccagcgagaacaccaucagcuacgccggcugcaugagccagcuguuccuguucaccuggagccugggcgccgagauggugcuguucaccaccauggccuacgacagauacguggccaucugcuucccccugcacuacagcaccaucaugaaccaccacaugugcguggcccugcugagcauggugauggccaucgccgugaccaacagcugggugcacaccgcccugaucaugagacugaccuucugcggccccaacaccaucgaccacuucuucugcgagauccccccccugcuggcccugagcugcagccccgugagaaucaacgaggugaugguguacguggccgacaucacccuggccaucggcgacuucauccugaccugcaucagcuacggcuucaucaucguggccauccugagaaucagaaccguggagggcaagagaaaggccuucagcaccugcagcagccaccugaccguggugacccuguacuacagccccgugaucuacaccuacaucagacccgccagcagcuacaccuucgagagagacaaggugguggccgcccuguacacccuggugacccccacccugaaccccaugguguacagcuuccagaacagagagaugcaggccggcaucagaaagguguucgccuuccugaagcacuaa

SEQ ID NO: 20951 - RNA, 939 nt, Artificial Sequence
  OR13J1__Homo_sapiens__NP_001004487
auggagccccugaacagaaccgaggugagcgaguucuuccugaagggcuucagcggcuaccccgcccuggagcaccugcuguucccccugugcagcgccauguaccuggugacccugcugggcaacaccgccaucauggccgugagcgugcuggacauccaccugcacacccccguguacuucuuccugggcaaccugagcacccuggacaucugcuacacccccaccuucgugccccugaugcuggugcaccugcugagcagcagaaagaccaucagcuucgccgugugcgccauccagaugugccugagccugagcaccggcagcaccgagugccugcugcuggccaucaccgccuacgacagauaccuggccaucugccagccccugagauaccacgugcugaugagccacagacugugcgugcugcugaugggcgccgccugggugcugugccugcugaagagcgugaccgagauggugaucagcaugagacugcccuucugcggccaccacguggugagccacuucaccugcaagauccuggccgugcugaagcuggccugcggcaacaccagcgugagcgaggacuuccugcuggccggcagcauccugcugcugcccgugccccuggccuucaucugccugagcuaccugcugauccuggccaccauccugagagugcccagcgccgccagaugcugcaaggccuucagcaccugccuggcccaccuggccguggugcugcuguucuacggcaccaucaucuucauguaccugaagcccaagagcaaggaggcccacaucagcgacgagguguucaccgugcuguacgccauggugaccaccaugcugaaccccaccaucuacagccugagaaacaaggaggugaaggaggccgccagaaagguguggggcagaagcagagccagcagauaa

SEQ ID NO: 20952 - RNA, 966 nt, Artificial Sequence
  OR14J1__Homo_sapiens__NP_112208
auggugaaccugaccagcaugagcggcuuccugcugaugggcuucagcgacgagagaaagcugcagauccugcacgcccugguguuccuggugaccuaccugcuggcccugaccggcaaccugcugaucaucaccaucaucaccguggacagaagacugcacagccccauguacuacuuccugaagcaccugagccugcuggaccugugcuucaucagcgugaccgugccccagagcaucgccaacagccugaugggcaacggcuacaucagccuggugcagugcauccugcagguguucuucuucaucgcccuggccagcagcgagguggccauccugaccgugaugagcuacgacagauacgccgccaucugccagccccugcacuacgagaccaucauggaccccagagccugcagacacgccgugaucgccguguggaucgccggcggccugagcggccugaugcacgccgccaucaacuucagcaucccccugugcggcaagagagugauccaccaguucuucugcgacgugccccagaugcugaagcuggccugcagcuacgaguucaucaacgagaucgcccuggccgccuucaccaccagcgccgccuucaucugccugaucagcaucgugcugagcuacaucagaaucuucagcaccgugcugagaauccccagcgccgagggcagaaccaagguguucagcaccugccugccccaccuguucguggccaccuucuuccugagcgccgccggcuucgaguuccugagacugcccagcgacagcagcagcaccguggaccugguguucagcguguucuacaccgugaucccccccacccugaaccccgugaucuacagccugagaaacgacagcaugaaggccgcccugagaaagaugcugagcaaggaggagcugccccagagaaagaugugccugaaggccauguucaagcuguaa

SEQ ID NO: 20953 - RNA, 930 nt, Artificial Sequence
  OR1A1__Homo_sapiens__NP_055380
augagagagaacaaccagagcagcacccuggaguucauccugcugggcgugaccggccagcaggagcaggaggacuucuucuacauccuguuccuguucaucuaccccaucacccugaucggcaaccugcugaucgugcuggccaucugcagcgacgugagacugcacaaccccauguacuuccugcuggccaaccugagccugguggacaucuucuucagcagcgugaccauccccaagaugcuggccaaccaccugcugggcagcaagagcaucagcuucggcggcugccugacccagauguacuucaugaucgcccugggcaacaccgacagcuacauccuggccgccauggccuacgacagagccguggccaucagcagaccccugcacuacaccaccaucaugagccccagaagcugcaucuggcugaucgccggcagcugggugaucggcaacgccaacgcccugccccacacccugcugaccgccagccugagcuucugcggcaaccaggagguggccaacuucuacugcgacaucaccccccugcugaagcugagcugcagcgacauccacuuccacgugaagaugauguaccugggcgugggcaucuucagcgugccccugcugugcaucaucgugagcuacaucagaguguucagcaccguguuccaggugcccagcaccaagggcgugcugaaggccuucagcaccugcggcagccaccugaccguggugagccuguacuacggcaccgugaugggcaccuacuucagaccccugaccaacuacagccugaaggacgccgugaucaccgugauguacaccgccgugacccccaugcugaaccccuucaucuacagccugagaaacagagacaugaaggccgcccugagaaagcuguucaacaagagaaucagcagcuaa

SEQ ID NO: 20954 - RNA, 945 nt, Artificial Sequence
  OR1C1__Homo_sapiens__NP_036485
auggagaagagaaaccugaccguggugagagaguucgugcugcugggccugcccagcagcgccgagcagcagcaccugcugagcgugcuguuccugugcauguaccuggccaccacccugggcaacaugcugaucaucgccaccaucggcuucgacagccaccugcacagccccauguacuucuuccugagcaaccuggccuucguggacaucugcuucaccagcaccaccgugccccagaugguggugaacauccugaccggcaccaagaccaucagcuucgccggcugccugacccagcuguucuucuucgugagcuucgugaacauggacagccugcugcugugcgugauggccuacgacagauacguggccaucugccacccccugcacuacaccgccagaaugaaccugugccugugcgugcagcugguggccggccuguggcuggugaccuaccugcacgcccugcugcacaccgugcugaucgcccagcugagcuucugcgccagcaacaucauccaccacuucuucugcgaccugaacccccugcugcagcugagcugcagcgacgugagcuucaacgugaugaucaucuucgccgugggcggccugcuggcccugaccccccuggugugcauccuggugagcuacggccugaucuucagcaccgugcugaagaucaccagcacccagggcaagcagagagccgugagcaccugcagcugccaccugagcgugguggugcuguucuacggcaccgccaucgccguguacuucagccccagcagcccccacaugcccgagagcgacacccugagcaccaucauguacagcaugguggcccccaugcugaaccccuucaucuacacccugagaaacagagacaugaagagaggccugcagaagaugcugcugaagugcaccguguuccagcagcaguaa

SEQ ID NO: 20955 - RNA, 939 nt, Artificial Sequence
  OR1D2__Homo_sapiens__NP_002539
auggacggcggcaaccagagcgagggcagcgaguuccugcugcugggcaugagcgagagccccgagcagcagagaauccuguucuggauguuccugagcauguaccuggugaccguggugggcaacgugcugaucauccuggccaucagcagcgacagcagacugcacacccccguguacuucuuccuggccaaccugagcuucaccgaccuguucuucgugaccaacaccauccccaagaugcuggugaaccugcagagccacaacaaggccaucagcuacgccggcugccugacccagcuguacuuccuggugagccugguggcccuggacaaccugauccuggccgugauggccuacgacagauacguggccaucugcugcccccugcacuacaccaccgccaugagccccaagcugugcauccugcugcugagccugugcugggugcugagcgugcuguacggccugauccacacccugcugaugaccagagugaccuucugcggcagcagaaagauccacuacaucuucugcgagauguacgugcugcugagaauggccugcagcaacauccagaucaaccacaccgugcugaucgccaccggcugcuucaucuuccugauccccuucggcuucgugaucaucagcuacgugcugaucaucagagccauccugagaauccccagcgugagcaagaaguacaaggccuucagcaccugcgccagccaccugggcgccgugagccuguucuacggcacccugugcaugguguaccugaagccccugcacaccuacagcgugaaggacagcguggccaccgugauguacgccguggugacccccaugaugaaccccuucaucuacagccugagaaacaaggacaugcacggcgcccugggcagacugcuggacaagcacuucaagagacugaccuaa

SEQ ID NO: 20956 - RNA, 945 nt, Artificial Sequence
  OR1E1__Homo_sapiens__NP_003544
augaugggccagaaccagaccagcaucagcgacuuccugcugcugggccugcccauccagcccgagcagcagaaccugugcuacgcccuguuccuggccauguaccugaccacccugcugggcaaccugcugaucaucgugcugaucagacuggacagccaccugcacacccccauguaccuguuccugagcaaccugagcuucagcgaccugugcuucagcagcgugaccauccccaagcugcugcagaacaugcagaaccaggaccccagcauccccuacgccgacugccugacccagauguacuucuuccugcuguucggcgaccuggagagcuuccugcugguggccauggccuacgacagauacguggccaucugcuucccccugcacuacaccgccaucaugagccccaugcugugccuggcccugguggcccugagcugggugcugaccaccuuccacgccaugcugcacacccugcugauggccagacugugcuucugcgccgacaacgugaucccccacuucuucugcgacaugagcgcccugcugaagcuggccuucagcgacaccagagugaacgagugggugaucuucaucaugggcggccugauccuggugauccccuuccugcugauccugggcagcuacgccagaaucgugagcagcauccugaaggugcccagcagcaagggcaucugcaaggccuucagcaccugcggcagccaccugagcguggugagccuguucuacggcaccgugaucggccuguaccugugcagcagcgccaacagcagcacccugaaggacaccgugauggccaugauguacaccguggugacccccaugcugaaccccuucaucuacagccugagaaacagagacaugaagggcgcccugagcagagugauccaccagaagaagaccuucuucagccuguaa

SEQ ID NO: 20957 - RNA, 972 nt, Artificial Sequence
  OR1E2__Homo_sapiens__NP_003545
augaugggccagaaccagaccagcaucagcgacuuccugcugcugggccugcccauccagcccgagcagcagaaccugugcuacgcccuguuccuggccauguaccugaccacccugcugggcaaccugcugaucaucgugcugaucagacuggacagccaccugcacacccccguguaccuguuccugagcaaccugagcuucagcgaccugugcuucagcagcgugaccaugcccaagcugcugcagaacaugcagaaccaggaccccagcauccccuacgccgacugccugacccagauguacuucuuccuguacuucagcgaccuggagagcuuccugcugguggccauggccuacgacagauacguggccaucugcuuccccaugcacuacaccgccaucugcuuccugcugcacuacaccgccaucaugagccccaugcugugccugagcgugguggcccugagcugggugcugaccaccuuccacgccaugcugcacacccugcugauggccagacugugcuucugcgccgacaacgugaucccccacuucuucugcgacaugagcgcccugcugaagcuggccugcagcgacaccagagugaacgagugggugaucuucaucaugggcggccugauccuggugauccccuuccugcugauccugggcagcuacgccagaaucgugagcagcauccugaaggugcccagcagcaagggcaucugcaaggccuucagcaccugcggcagccaccugagcguggugagccuguucuacggcaccgugaucggccuguaccugugccccagcgccaacagcagcacccugaaggacaccgugauggccaugauguacaccguggugacccccaugcugacccccuucaucuacagccugagaaacagagacaugaagggcgcccuggagagagugaucugcaagagaaagaaccccuuccugcuguaa

SEQ ID NO: 20958 - RNA, 942 nt, Artificial Sequence
  OR1J2__Homo_sapiens__NP_473448
augagccccgagaaccagagcagcgugagcgaguuccugcugcugggccugcccaucagacccgagcagcaggccguguucuucacccuguuccugggcauguaccugaccaccgugcugggcaaccugcugaucaugcugcugauccagcuggacagccaccugcacacccccauguacuucuuccugagccaccuggcccugaccgacaucagcuucagcagcgugaccgugcccaagaugcugauggacaugagaaccaaguacaagagcauccuguacgaggagugcaucagccagauguacuucuucaucuucuucaccgaccuggacagcuuccugaucaccagcauggccuacgacagauacguggccaucugccacccccugcacuacaccgugaucaugagagaggagcugugcguguuccugguggccgugagcuggauccugagcugcgccagcagccugagccacacccugcugcugaccagacugagcuucugcgccgccaacaccaucccccacguguucugcgaccuggccgcccugcugaagcugagcugcagcgacaucuuccugaacgagcuggugauguucaccgugggcgugguggugaucacccugcccuucaugugcauccuggugagcuacggcuacaucggcgccaccauccugagagugcccagcaccaagggcauccacaaggcccugagcaccugcggcagccaccugagcguggugagccuguacuacggcagcaucuucggccaguaccuguuccccaccgugagcagcagcaucgacaaggacgugaucguggcccugauguacaccguggugacccccaugcugaaccccuucaucuacagccugagaaacagagacaugaaggaggcccugggcaagcuguucagcagagccaccuucuucagcugguaa

SEQ ID NO: 20959 - RNA, 951 nt, Artificial Sequence
  OR1K1__Homo_sapiens__NP_543135
auggaggccgccaacgagagcagcgagggcaucagcuucgugcugcugggccugaccaccagccccggccagcagagaccccuguucgugcuguuccugcugcuguacguggccagccugcugggcaacggccugaucguggccgccauccaggccagccccgcccugcacgcccccauguacuuccugcuggcccaccugagcuucgccgaccugugcuucgccagcgugaccgugcccaagaugcuggccaaccugcuggcccacgaccacagcaucagccuggccggcugccugacccagauguacuucuucuucgcccugggcgugaccgacagcugccugcuggccgccauggccuacgacugcuacguggccaucagacacccccugcccuacgccaccagaaugagcagagccaugugcgccgcccuggugggcauggccuggcuggugagccacgugcacagccugcuguacauccugcugauggccagacugagcuucugcgccagccaccaggugccccacuucuucugcgaccaccagccccugcugagacugagcugcagcgacacccaccacauccagcugcugaucuucaccgagggcgccgccgugguggugacccccuuccugcugauccuggccagcuacggcgccaucgccgccgccgugcugcagcugcccagcgccagcggcagacugagagccgugagcaccugcggcagccaccuggccguggugagccuguucuacggcaccgugaucgccguguacuuccaggccaccagcagaagagaggccgaguggggcagaguggccaccgugauguacaccguggugacccccaugcugaaccccaucaucuacagccuguggaacagagacgugcagggcgcccugagagcccugcugaucggcagaagaaucagcgccagcgacagcuaa

SEQ ID NO: 20960 - RNA, 930 nt, Artificial Sequence
  OR1L8__Homo_sapiens__NP_001004454
auggagagaaucaaccacaccagcagcgugagcgaguucauccugcugggccugagcagcagacccgaggaccagaagacccuguucgugcuguuccugaucguguaccuggugaccaucaccggcaaccugcugaucauccuggccaucagauucaacccccaccugcagacccccauguacuucuuccugagcuuccugagccugaccgacaucugcuucaccaccagcguggugcccaagaugcugaugaacuuccugagcgagaagaagaccaucagcuacgccggcugccugacccagauguacuuccuguacgcccugggcaacagcgacagcugccugcuggccgugauggccuucgacagauacguggccgugugcgaccccuuccacuacgugaccaccaugagccaccaccacugcgugcugcugguggccuucagcugcagcuucccccaccugcacagccugcugcacacccugcugcugaacagacugaccuucugcgacagcaacgugauccaccacuuccugugcgaccugagccccgugcugaagcugagcugcagcagcaucuucgugaacgagaucgugcagaugaccgaggcccccaucgugcuggugaccagauuccugugcaucgccuucagcuacaucagaauccugaccaccgugcugaagauccccagcaccagcggcaagagaaaggccuucagcaccugcggcuucuaccugaccguggugacccuguucuacggcagcaucuucugcguguaccugcagccccccagcaccuacgccgugaaggaccacguggccaccaucguguacaccgugcugagcagcaugcugaaccccuucaucuacagccugagaaacaaggaccugaagcagggccugagaaagcugaugagcaagagaagcuaa

SEQ ID NO: 20961 - RNA, 942 nt, Artificial Sequence
  OR1M1__Homo_sapiens__NP_001004456
auggagcccagaaaccagaccagcgccagccaguucauccugcugggccugagcgagaagcccgagcaggagacccugcuguucagccuguucuucugcauguaccuggugaugguggugggcaaccugcugaucauccuggccaucagcaucgacagccaccugcacacccccauguacuucuuccuggccaaccugagccugguggacuucugccuggccaccaacaccauccccaagaugcuggugagccugcagaccggcagcaaggccaucagcuaccccugcugccugauccagauguacuucuuccacuucuucggcaucguggacagcgugaucaucgccaugauggccuacgacagauucguggccaucugccacccccugcacuacgccaagaucaugagccugagacugugcagacugcuggugggcgcccugugggccuucagcugcuucaucagccugacccacauccugcugauggccagacugguguucugcggcagccacgaggugccccacuacuucugcgaccugacccccauccugagacugagcugcaccgacaccagcgugaacagaaucuucauccugaucguggccggcauggugaucgccacccccuucgugugcauccuggccagcuacgccagaauccugguggccaucaugaaggugcccagcgccggcggcagaaagaaggccuucagcaccugcagcagccaccugagcgugguggcccuguucuacggcaccaccaucggcguguaccugugccccagcagcgugcugaccaccgugaaggagaaggccagcgccgugauguacaccgccgugacccccaugcugaaccccuucaucuacagccugagaaacagagaccugaagggcgcccugagaaagcuggugaacagaaagaucaccagcagcagcuaa

SEQ ID NO: 20962 - RNA, 936 nt, Artificial Sequence
  OR1N1__Homo_sapiens__NP_036495
auggagaaccagagcagcaucagcgaguucuuccugagaggcaucagcgccccccccgagcagcagcagagccuguucggcaucuuccugugcauguaccuggugacccugaccggcaaccugcugaucauccuggccaucggcagcgaccugcaccugcacacccccauguacuucuuccuggccaaccugagcuucguggacaugggccugaccagcagcaccgugaccaagaugcuggugaacauccagaccagacaccacaccaucagcuacaccggcugccugacccagauguacuucuuccugauguucggcgaccuggacagcuucuuccuggccgccauggccuacgacagauacguggccaucugccacccccugugcuacagcaccgugaugagaccccaggugugcgcccugaugcuggcccugugcugggugcugaccaacaucguggcccugacccacaccuuccugauggccagacugagcuucugcgugaccggcgagaucgcccacuucuucugcgacaucacccccgugcugaagcugagcugcagcgacacccacaucaacgagaugaugguguucgugcugggcggcaccgugcugaucgugcccuuccugugcaucgugaccagcuacauccacaucgugcccgccauccugagagugagaaccagaggcggcgugggcaaggccuucagcaccugcagcagccaccugugcguggugugcguguucuacggcacccuguucagcgccuaccugugcccccccagcaucgccagcgaggagaaggacaucgccgccgccgccauguacaccaucgugacccccaugcugaaccccuucaucuacagccugagaaacaaggacaugaagggcgcccugaagagacuguucagccacagaagcaucgugagcagcuaa

SEQ ID NO: 20963 - RNA, 993 nt, Artificial Sequence
  OR1N2__Homo_sapiens__NP_001004457
auggagggcuucuaccugagaagaagccacgagcugcagggcaugggcaagcccggcagagugaaccagaccaccgugagcgacuuccugcugcugggccugagcgaguggcccgaggagcagccccugcuguucggcaucuuccugggcauguaccuggugaccauggugggcaaccugcugaucauccuggccaucagcagcgacccccaccugcacacccccauguacuucuuccuggccaaccugagccugaccgacgccugcuucaccagcgccagcauccccaagaugcuggccaacauccacacccagagccagaucaucagcuacagcggcugccuggcccagcuguacuuccugcugauguucggcggccuggacaacugccugcuggccgugauggccuacgacagauacguggccaucugccagccccugcacuacagcaccagcaugagcccccagcugugcgcccugaugcugggcgugugcugggugcugaccaacugccccgcccugaugcacacccugcugcugaccagaguggccuucugcgcccagaaggccaucccccacuucuacugcgaccccagcgcccugcugaagcuggccugcagcgacacccacgugaacgagcugaugaucaucaccaugggccugcuguuccugaccgugccccugcugcugaucguguucagcuacgugagaaucuucugggccguguucgugaucagcagccccggcggcagauggaaggccuucagcaccugcggcagccaccugaccguggugcugcuguucuacggcagccugaugggcguguaccugcugccccccagcaccuacagcaccgagagagagagcagagccgccgugcuguacauggugaucauccccacccugaaccccuucaucuacagccugagaaacagagacaugaaggaggcccugggcaagcuguucgugagcggcaagaccuucuuccuguaa

SEQ ID NO: 20964 - RNA, 933 nt, Artificial Sequence
  OR2A25__Homo_sapiens__NP_001004488
augggcggcaaccagaccagcaucaccgaguuccugcugcugggcuuccccaucggccccagaauccagaugcugcuguucggccuguucagccuguucuacaucuucauccugcugggcaacggcaccauccugggccugaucagccuggacagcagacugcacacccccauguacuucuuccugagccaccuggccgugguggacaucgccugcgccugcagcaccgugccccagaugcuggugaaccugcugcaccccgccaagcccaucagcuucgccggcugcaugacccagauguuccuguuccugagcuucgcccacaccgagugccugcugcugguggugaugagcuacgacagauacguggccaucugccacccccugagauacagcaccaucaugaccuggaaggugugcaucacccuggcccugaccagcuggauccugggcgugcugcuggcccuggugcaccuggugcugcugcugccccugagcuucugcggcccccagaagcugaaccacuucuucugcgagaucauggccgugcugaagcuggccugcgccgacacccacaucaacgaggugauggugcuggccggcgccgugagcgugcuggugggcgccuucuucagcaccgugaucagcuacgugcacauccugugcgccauccugaagauccagagcggcgagggcugccagaaggccuucagcaucugcagcagccaccugugcguggugggccuguucuacggcaccgccaucaucauguacguggagccccaguacgagagccccaaggagcagaagaaguaccugcugcuguuccacagccuguucaaccccaugcugaacccccugaucuacagccugagaaacaaggaggugcagggcacccugaagagaaugcuggagaagaagagaaccagcuaa

SEQ ID NO: 20965 - RNA, 951 nt, Artificial Sequence
  OR2AG1__Homo_sapiens__NP_001004489
auggagcuguggaacuucacccugggcagcggcuucauccuggugggcauccugaacgacagcggcagccccgagcugcugugcgccaccaucaccauccuguaccugcuggcccugaucagcaacggccugcugcugcuggccaucaccauggaggccagacugcacaugcccauguaccugcugcugggccagcugagccugauggaccugcuguucaccagcguggugacccccaaggcccuggccgacuuccugagaagagagaacaccaucagcuucggcggcugcgcccugcagauguuccuggcccugaccaugggcggcgccgaggaccugcugcuggccuucauggccuacgacagauacguggccaucugccacccccugaccuacaugacccugaugagcagcagagccugcuggcugaugguggccaccagcuggauccuggccagccugagcgcccugaucuacaccguguacaccaugcacuaccccuucugcagagcccaggagaucagacaccugcugugcgagaucccccaccugcugaagguggccugcgccgacaccagcagauacgagcugaugguguacgugaugggcgugaccuuccugauccccagccuggccgccauccuggccagcuacacccagauccugcugaccgugcugcacaugcccagcaacgagggcagaaagaaggcccuggugaccugcagcagccaccugaccguggugggcauguucuacggcgccgccaccuucauguacgugcugcccagcagcuuccacagcaccagacaggacaacaucaucagcguguucuacaccaucgugacccccgcccugaacccccugaucuacagccugagaaacaaggaggugaugagagcccugagaagagugcugggcaaguacaugcugcccgcccacagcacccuguaa

SEQ ID NO: 20966 - RNA, 1008 nt, Artificial Sequence
  OR2AK2__Homo_sapiens__NP_001004491
augaacaucagcgacgugaucagcuucgacauccuggugagcgccaugaagaccggcaaccagagcuucggcaccgacuuccugcuggugggccuguuccaguacggcuggaucaacagccugcuguucguggugaucgccacccuguucaccguggcccugaccggcaacaucaugcugauccaccugaucagacugaacaccagacugcacacccccauguacuuccugcugagccagcugagcaucguggaccugauguacaucagcaccaccgugcccaagauggccgugagcuuccugagccagagcaagaccaucagauuccugggcugcgagauccagaccuacguguuccuggcccugggcggcaccgaggcccugcugcugggcuucaugagcuacgacagauacguggccaucugccacccccugcacuaccccaugcugaugagcaagaagaucugcugccugaugguggccugcgccugggccagcggcagcaucaacgccuucauccacacccuguacguguuccagcugcccuucugcagaagcagacugaucaaccacuucuucugcgaggugcccgcccugcugagccuggugugccaggacaccagccaguacgaguacaccgugcugcugagcggccugaucauccugcugcugcccuuccuggccauccuggccagcuacgccagagugcugaucgugguguuccagaugagcagcggcaagggccaggccaaggccgugagcaccugcagcagccaccugaucguggccagccuguucuacgccaccacccuguucaccuacaccagaccccacagccugagaagccccagcagagacaaggccguggccguguucuacaccaucgugaccccccugcugaaccccuucaucuacagccugagaaacaaggaggugaccggcgccgugagaagacugcugggcuacuggaucugcugcagaaaguacgacuucagaagccuguacuaa

SEQ ID NO: 20967 - RNA, 963 nt, Artificial Sequence
  OR2AT4__Homo_sapiens__NP_001005285
auggacgccaccgccugcaacgagagcguggacggcagccccguguucuaccugcugggcauccccagccugcccgagaccuucuuccugcccguguucuucaucuuccugcuguucuaccugcugauccugaugggcaacgcccugauccugguggccgugguggccgagcccagccugcacaagcccauguacuucuuccugaucaaccugagcacccuggacauccuguucaccaccaccaccgugcccaagaugcugagccuguuccugcugggcgacagauuccugagcuucagcagcugccugcugcagauguaccuguuccagagcuucaccugcagcgaggccuucauccugguggugauggccuacgacagauacguggccaucugccacccccugcacuaccccgugcugaugaacccccagaccaacgccacccuggccgccagcgccuggcugaccgcccugcugcugcccauccccgccguggugagaaccagccagauggccuacaacagcaucgccuacaucuaccacugcuucugcgaccaccuggccguggugcaggccagcugcagcgacaccaccccccagacccugaugggcuucugcaucgccaugguggugagcuuccugccccugcugcuggugcugcugagcuacgugcacauccuggccagcgugcugagaaucagcagccuggagggcagagccaaggccuucagcaccugcagcagccaccugcugguggugggcaccuacuacagcagcaucgccaucgccuacguggccuacagagccgaccugccccuggacuuccacaucaugggcaacgugguguacgccauccugacccccauccugaacccccugaucuacacccugagaaacagagacgugaaggccgccaucaccaagaucaugagccaggaccccggcugcgacagaagcaucuaa

SEQ ID NO: 20968 - RNA, 1074 nt, Artificial Sequence
  OR2B2__Homo_sapiens__NP_149046
augaacugggugaacaagagcgugccccaggaguucauccugcugguguucagcgaccagcccuggcuggagaucccccccuucgugauguuccuguucagcuacauccugaccaucuucggcaaccugaccaucauccuggugagccacguggacuucaagcugcacacccccauguacuucuuccugagcaaccugagccugcuggaccugugcuacaccaccagcaccgugccccagaugcuggugaacaucugcaacaccagaaaggugaucagcuacggcggcugcguggcccagcuguucaucuuccuggcccugggcagcaccgagugccugcugcuggccgugaugugcuucgacagauucguggccaucugcagaccccugcacuacagcaucaucaugcaccagagacugugcuuccagcuggccgccgccagcuggaucagcggcuucagcaacagcgugcugcagagcaccuggacccugaagaugccccugugcggccacaaggagguggaccacuucuucugcgaggugcccgcccugcugaagcugagcugcguggacaccaccgccaacgaggccgagcuguucuucaucagcgugcuguuccugcugauccccgugacccugauccugaucagcuacgccuucaucgugcaggccgugcugagaauccagagcgccgagggccagagaaaggccuucggcaccugcggcagccaccugaucguggugagccuguucuacggcaccgccaucagcauguaccugcagccccccagccccagcagcaaggacagaggcaagauggugagccuguucugcggcaucaucgcccccaugcugaacccccugaucuacacccugagaaacaaggaggugaaggaggccuucaagagacugguggccaagagccugcugaaccaggagaucagaaacaugcagaugaucagcuucgccaaggacaccgugcugaccuaccugaccaacuucagcgccagcugccccaucuucgugaucaccaucgagaacuacugcaaccugccccagagaaaguuccccuaa

SEQ ID NO: 20969 - RNA, 942 nt, Artificial Sequence
  OR2B3__Homo_sapiens__NP_001005226
augaacugggagaacgagagcagccccaaggaguucauccugcugggcuucagcgacagagccuggcugcagaugccccuguucguggugcugcugaucagcuacaccaucaccaucuucggcaacgugagcaucaugauggugugcauccuggaccccaagcugcacacccccauguacuucuuccugaccaaccugagcauccuggaccugugcuacaccaccaccaccgugccccacaugcuggugaacaucggcugcaacaagaagaccaucagcuacgccggcugcguggcccaccugaucaucuuccuggcccugggcgccaccgagugccugcugcuggccgugaugagcuucgacagauacguggccgugugcagaccccugcacuacguggugaucaugaacuacugguucugccugagaauggccgccuucagcuggcugaucggcuucggcaacagcgugcugcagagcagccugacccugaacaugcccagaugcggccaccaggagguggaccacuucuucugcgaggugcccgcccugcugaagcugagcugcgccgacaccaagcccaucgaggccgagcuguucuucuucagcgugcugauccugcugauccccgugacccugauccugaucagcuacggcuucaucgcccaggccgugcugaagaucagaagcgccgagggcagacagaaggccuucggcaccugcggcagccacaugaucguggugagccuguucuacggcaccgccaucuacauguaccugcagccccccagcagcaccagcaaggacuggggcaagauggugagccuguucuacggcaucaucaccagcaugcugaacagccugaucuacagccugagaaacaaggacaugaaggaggccuucaagagacugaugcccagaaucuucuucugcaagaaguaa

SEQ ID NO: 20970 - RNA, 942 nt, Artificial Sequence
  OR2B6__Homo_sapiens__NP_036499
augaacugggugaacgacagcaucauccaggaguucauccugcugggcuucagcgacagacccuggcuggaguucccccugcuggugguguuccugaucagcuacaccgugaccaucuucggcaaccugaccaucauccuggugagcagacuggacaccaagcugcacacccccauguacuucuuccugaccaaccugagccugcuggaccugugcuacaccaccugcaccgugccccagaugcuggugaaccugugcagcaucagaaaggugaucagcuacagaggcugcguggcccagcuguucaucuuccuggcccugggcgccaccgaguaccugcugcuggccgugaugagcuucgacagauucguggccaucugcagaccccugcacuacagcgugaucaugcaccagagacugugccugcagcuggccgccgccagcugggugaccggcuucagcaacagcguguggcugagcacccugacccugcagcugccccugugcgaccccuacgugaucgaccacuuccugugcgaggugcccgcccugcugaagcugagcugcguggagaccaccgccaacgaggccgagcuguuccuggugagcgagcuguuccaccugaucccccugacccugauccugaucagcuacgccuucaucgugagagccgugcugagaauccagagcgccgagggcagacagaaggccuucggcaccugcggcagccaccugaucguggugagccuguucuacagcaccgccgugagcguguaccugcagccccccagccccagcagcaaggaccagggcaagauggugagccuguucuacggcaucaucgcccccaugcugaacccccugaucuacacccugagaaacaaggaggugaaggagggcuucaagagacugguggccagaguguuccugaucaagaaguaa

SEQ ID NO: 20971 - RNA, 939 nt, Artificial Sequence
  OR2C1__Homo_sapiens__NP_036500
auggacggcgugaacgacagcagccugcagggcuucgugcugaugggcaucagcgaccacccccagcuggagaugaucuucuucaucgccauccuguucagcuaccugcugacccugcugggcaacagcaccaucauccugcugagcagacuggaggccagacugcacacccccauguacuucuuccugagcaaccugagcagccuggaccuggccuucgccaccagcagcgugccccagaugcugaucaaccuguggggccccggcaagaccaucagcuacggcggcugcaucacccagcuguacguguuccuguggcugggcgccaccgagugcauccugcugguggugauggccuucgacagauacguggccgugugcagaccccugagauacaccgccaucaugaacccccagcugugcuggcugcuggccgugaucgccugccugggcggccugggcaacagcgugauccagagcaccuucacccugcagcugccccugugcggccacagaagaguggagggcuuccugugcgaggugcccgccaugaucaagcuggccugcggcgacaccagccugaaccaggccgugcugaacggcgugugcaccuucuucaccgccgugccccugagcaucaucgugaucagcuacugccugaucgcccaggccgugcugaagaucagaagcgccgagggcagaagaaaggccuucaacaccugccugagccaccugcuggugguguuccuguucuacggcagcgccagcuacggcuaccugcugcccgccaagaacagcaagcaggaccagggcaaguucaucagccuguucuacagccuggugacccccauggugaacccccugaucuacacccugagaaacauggaggugaagggcgcccugagaagacugcugggcaagggcagagaggugggcuaa

SEQ ID NO: 20972 - RNA, 954 nt, Artificial Sequence
  OR2F2__Homo_sapiens__NP_001004685
auggagaucgacaaccagaccugggugagagaguucauccugcugggccugagcagcgacuggugcacccagaucagccuguucagccuguuccuggugaccuaccugaugaccgugcugggcaacugccugaucgugcugcugaucagacuggacagcagacugcacacccccauguacuucuuccugaccaaccugagccugguggacgugagcuacgccaccagcguggugccccagcugcuggcccacuuccuggccgagcacaaggccauccccuuccagagcugcgccgcccagcuguucuucagccuggcccugggcggcaucgaguucgugcugcuggccgugauggccuacgacagacacguggccgugagcgacagacugagauacagcgccaucaugcacggcggccugugcgccagacuggccaucaccagcugggugagcggcagcaucaacagccuggugcagaccgccaucaccuuccagcugcccaugugcaccaacaaguucaucgaccacaucagcugcgagcugcuggccguggugagacuggccugcguggacaccagcagcaacgaggccgccaucauggugagcagcaucgugcugcugaugacccccuucugccuggugcugcugagcuacaucagaaucaucagcaccauccugaagauccagagcagagagggcagaaagaaggccuuccacaccugcgccagccaccugaccgugguggcccugugcuacggcaccaccaucuucaccuacauccagccccacagcggccccagcgugcugcaggagaagcugaucagcguguucuacgccaucgugaugccccugcugaaccccgugaucuacagccugagaaacaaggaggugaagggcgccuggcacaagcugcuggagaaguucagcggccugaccagcaagcugggcaccuaa

SEQ ID NO: 20973 - RNA, 954 nt, Artificial Sequence
  OR2G2__Homo_sapiens__NP_001001915
augggcauggugagacacaccaacgagagcaaccuggccggcuucauccugcugggcuucagcgacuacccccagcugcagaaggugcuguucgugcugauccugauccuguaccugcugaccauccugggcaacaccaccaucauccuggugagcagacuggagcccaagcugcacaugcccauguacuucuuccugagccaccugagcuuccuguacagaugcuucaccagcagcgugaucccccagcugcuggugaaccugugggagcccaugaagaccaucgccuacggcggcugccuggugcaccuguacaacagccacgcccugggcagcaccgagugcgugcugcccgccgugaugagcugcgacagauacguggccgugugcagaccccugcacuacaccgugcugaugcacauccaccugugcauggcccuggccagcauggccuggcugagcggcaucgccaccacccuggugcagagcacccugacccugcagcugcccuucugcggccacagacagguggaccacuucaucugcgaggugcccgugcugaucaagcuggccugcgugggcaccaccuucaacgaggccgagcuguucguggccagcauccuguuccugaucgugcccgugagcuucauccuggugagcagcggcuacaucgcccacgccgugcugagaaucaagagcgccaccagaagacagaaggccuucggcaccugcuucagccaccugaccguggugaccaucuucuacggcaccaucaucuucauguaccugcagcccgccaagagcagaagcagagaccagggcaaguucgugagccuguucuacaccguggugaccagaaugcugaacccccugaucuacacccugagaaucaaggaggugaagggcgcccugaagaaggugcuggccaaggcccugggcgugaacauccuguaa

SEQ ID NO: 20974 - RNA, 930 nt, Artificial Sequence
  OR2G3__Homo_sapiens__NP_001001914
augggccugggcaacgagagcagccugauggacuucauccugcugggcuucagcgaccaccccagacuggaggccgugcuguucguguucgugcuguucuucuaccugcugacccuggugggcaacuucaccaucaucaucaucagcuaccuggaccccccccugcacacccccauguacuucuuccugagcaaccugagccugcuggacaucugcuucaccaccagccuggccccccagacccuggugaaccugcagagacccaagaagaccaucaccuacggcggcugcguggcccagcuguacaucagccuggcccugggcagcaccgagugcauccugcuggccgacauggcccuggacagauacaucgccgugugcaagccccugcacuacguggugaucaugaaccccagacugugccagcagcuggccagcaucagcuggcugagcggccuggccagcagccugauccacgccaccuucacccugcagcugccccugugcggcaaccacagacuggaccacuucaucugcgaggugcccgcccugcugaagcuggccugcguggacaccaccgugaacgagcuggugcuguucguggugagcgugcuguucguggugaucccccccgcccugaucagcaucagcuacggcuucaucacccaggccgugcugagaaucaagagcguggaggccagacacaaggccuucagcaccugcagcagccaccugaccguggugaucaucuucuacggcaccaucaucuacguguaccugcagcccagcgacagcuacgcccaggaccagggcaaguucaucagccuguucuacaccauggugacccccacccugaaccccaucaucuacacccugagaaacaaggacaugaaggaggcccugagaaagcugcugagcggcaagcuguaa

SEQ ID NO: 20975 - RNA, 939 nt, Artificial Sequence
  OR2H2__Homo_sapiens__NP_009091
auggugaaccagagcagcacccccggcuuccugcugcugggcuucagcgagcaccccggccuggagagaacccuguucgugguggugcugaccagcuaccugcugacccuggugggcaacacccugaucauccugcugagcgcccuggaccccaagcugcacagccccauguacuucuuccugagcaaccugagcuuccuggaccugugcuucaccaccagcugcgugccccagaugcuggugaaccuguggggccccaagaagaccaucagcuuccuggacugcagcgugcagaucuucaucuuccugagccugggcaccaccgagugcauccugcugaccgugauggccuucgacagauacguggccgugugccagccccugcacuacgccaccaucauccaccccagacugugcuggcagcuggccagcguggccugggugaucggccugguggagagcguggugcagacccccagcacccugcaccugcccuucugccccgacagacagguggacgacuucgugugcgaggugcccgcccugaucagacugagcugcgaggacaccagcuacaacgagauccagguggccguggccagcguguucauccugguggugccccugagccugauccuggugagcuacggcgccaucaccugggccgugcugagaaucaacagcgccaagggcagaagaaaggccuucggcaccugcagcagccaccugaccguggugacccuguucuacagcagcgugaucgccguguaccugcagcccaagaaccccuacgcccaggagagaggcaaguucuucggccuguucuacgccgugggcacccccagccugaacccccugaucuacacccugagaaacaaggaggugaccagagccuucagaagacugcugggcaaggagaugggccugacccagagcuaa

SEQ ID NO: 20976 - RNA, 939 nt, Artificial Sequence
  OR2J2__Homo_sapiens__NP_112167
augaugaucaagaagaacgccagcagcgaggacuucuucauccugcugggcuucagcaacuggccccagcuggagguggugcuguucguggugauccugaucuucuaccugaugacccugaccggcaaccuguucaucaucauccugagcuacguggacagccaccugcacacccccauguacuucuuccugagcaaccugagcuuccuggaccugugcuacaccaccagcagcaucccccagcugcuggugaaccugagaggccccgagaagaccaucagcuacgccggcugcauggugcagcuguacuucgugcuggcccugggcaucaccgagugcgugcugcugguggugaugagcuacgacagauacguggccgugugcagaccccugcacuacaccgugcugaugcaccccagauucugccaccugcugguggccgccagcugggugaucggcuucaccaucagcgcccugcacagcagcuucaccuucugggugccccugugcggccacagacugguggaccacuucuucugcgaggugcccgcccugcugagacugagcugcguggacacccacgccaacgagcugacccugauggugaugagcagcaucuucgugcugaucccccugauccugauccugaccaccuacggcgccaucgccagagccgugcugagcaugcagagcaccaccggccugcagaagguguucagaaccugcggcgcccaccugaugguggugagccuguucuucauccccgugaugugcauguaccugcagccccccagcgagaacagccccgaccagggcaaguucaucgcccuguucuacaccguggugacccccagccugaacccccugaucuacacccugagaaacaagcacgugaagggcgccgccaagagacugcugggcugggaguggggcaaguaa

SEQ ID NO: 20977 - RNA, 936 nt, Artificial Sequence
  OR2J3__Homo_sapiens__NP_001005216
augaacgacgacggcaaggugaacgccagcagcgagggcuacuucauccuggugggcuucagcaacuggccccaccuggagguggugaucuucgugguggugcugaucuucuaccugaugacccugaucggcaaccuguucaucaucauccugagcuaccuggacagccaccugcacacccccauguacuucuuccugagcaaccugagcuuccuggaccugugcuacaccaccagcagcaucccccagcugcuggugaaccuguggggccccgagaagaccaucagcuacgccggcugcaugauccagcuguacuucgugcuggcccugggcaccaccgagugcgugcugcugguggugaugagcuacgacagauacgccgccgugugcagaccccugcacuacaccgugcugaugcaccccagauucugccaccugcuggccguggccagcugggugagcggcuucaccaacagcgcccugcacagcagcuucaccuucugggugccccugugcggccacagacagguggaccacuucuucugcgaggugcccgcccugcugagacugagcugcguggacacccacgugaacgagcugacccugaugaucaccagcagcaucuucgugcugaucccccugauccugauccugaccagcuacggcgccaucgugagagccauccugagaaugcagagcaccaccggccugcagaagguguucggcaccugcggcgcccaccugauggccgugagccuguucuucauccccgccaugugcauguaccugcagccccccagcggcaacagccaggaccagggcaaguucaucgcccuguucuacaccguggugacccccagccugaacccccugaucuacacccugagaaacaagguggugagaggcgccgugaagagacugaugggcugggaguaa

SEQ ID NO: 20978 - RNA, 939 nt, Artificial Sequence
  OR2L2__Homo_sapiens__NP_001004686
auggagaacuacaaccagaccagcaccgacuucauccugcugggccuguucccccagagcagaaucggccuguucguguucacccugaucuuccugaucuuccugauggcccugaucggcaaccugagcaugauccugcugaucuuccuggacauccaccugcacacccccauguacuuccugcugagccagcugagccugaucgaccugaacuacaucagcaccaucgugcccaagaugguguacgacuuccuguacggcaacaagagcaucagcuucaccggcugcggcauccagagcuucuucuuccugacccuggccguggccgagggccugcugcugaccagcauggccuacgacagauacguggccaucugcuucccccugcacuaccccaucagaaucagcaagagagugugcgugaugaugaucaccggcagcuggaugaucagcagcaucaacagcugcgcccacaccguguacgcccugugcauccccuacugcaagagcagagccaucaaccacuucuucugcgacgugcccgccaugcugacccuggccugcaccgacaccuggguguacgagagcaccguguuccugagcagcaccaucuuccuggugcugcccuucaccggcaucgccugcagcuacggcagagugcugcuggccguguacagaaugcacagcgccgagggcagaaagaaggccuacagcaccugcagcacccaccugaccguggugagcuucuacuacgcccccuucgccuacaccuacgugagacccagaagccugagaagccccaccgaggacaagauccuggccguguucuacaccauccugacccccaugcugaaccccaucaucuacagccugagaaacaaggaggugaugggcgcccugacccaggugauccagaagaucuucagcgugaagauguaa

SEQ ID NO: 20979 - RNA, 939 nt, Artificial Sequence
  OR2M3__Homo_sapiens__NP_001004689
auggccagagagaacagcaccuucaacagcgacuucauccugcugggcaucuucaaccacagccccacccacaccuuccuguucuuccuggugcuggccaucuucagcguggccuucaugggcaacagcgugauggugcugcugaucuaccuggacacccagcugcacacccccauguaccugcugcugagccagcugagccugauggaccugaugcugaucugcaccaccgugcccaagauggccuucaacuaccugagcggcagcaagagcaucagcauggccggcugcgccacccagaucuucuucuacaccagccugcugggcagcgagugcuuccugcuggccgugauggccuacgacagauacaccgccaucugccacccccugagauacaccaaccugaugagccccaagaucugcggccugaugaccgccuucagcuggauccugggcagcaccgacggcaucaucgacgugguggccaccuucagcuucagcuacugcggcagcagagagaucgcccacuucuucugcgacuuccccagccugcugauccugagcugcagcgacaccagcaucuucgagaagauccuguucaucugcugcaucgugaugaucguguuccccguggccaucaucaucgccagcuacgccagagugauccuggccgugauccacaugggcagcggcgagggcagaagaaaggccuucaccaccugcagcagccaccugcugguggugggcauguacuacggcgccgcccuguucauguacaucagacccaccagcgacagaagccccacccaggacaagauggugagcguguucuacaccauccugacccccaugcugaacccccugaucuacagccugagaaacaaggaggugaccagagccuucaugaagauccugggcaagggcaagagcggcgaguaa

SEQ ID NO: 20980 - RNA, 936 nt, Artificial Sequence
  OR2M4__Homo_sapiens__NP_059974
auggugugggagaaccagaccuucaacagcaucuucauccugcugggcaucuucaaccacagccccacccacaccuuccuguucagccuggugcugggcaucuucagccuggcccugauggagaacaucagcauggugcugcugaucuacaucgagaagcagcugcacacccccauguacuuccugcugagccagcugagccugauggaccugaugcugaucugcaccacccugcccaagaugaucuucagcuaccugagcggcaagaagagcaucagccuggccggcugcggcacccagaucuucuucuacgugagccugcugggcgccgagugcuuccugcuggccgugauggccuacgacagauacguggccaucugccacccccugcaguacaccauccugaugaaccccaagcugugcguguucaugaccguggccagcuggacccugggcagccuggacggcaucaucgugcuggccgccgugcugagcuucagcuacugcagcagccuggagauccaccacuucuucugcgacguggccgcccugcugccccugagcugcaccgagaccagcgccuucgagagacugcuggugaucugcugcguggugaugcugaucuuccccgugagcgugaucauccugagcuacagccacgugcugagagccgugauccacaugggcagcggcgagagcagaagaaaggccuucaccaccugcagcagccaccugagcguggugggccuguacuacggcgccgccauguucauguacaugagacccgccagcaagcacacccccgaccaggacaagauggugagcgccuucuacaccauccugacccccaugcugaacccccugaucuacagccugagaaacaaggagguguucagagcccugcagaaggugcugaagaagagaaagcugaucuaa

SEQ ID NO: 20981 - RNA, 939 nt, Artificial Sequence
  OR2M7__Homo_sapiens__NP_001004691
auggccugggagaaccagaccuucaacagcgacuuccugcugcugggcaucuucaaccacagccccacccacaccuuccuguucuuccuggugcuggccaucuucagcguggccuucaugggcaacagcaucauggugcugcugaucuaccuggacacccagcugcacacccccauguacuuccugcugagccagcugagccugauggaccugaugcugaucugcaccaccgugcccaagauggccuucaacuaccugagcggcagcaagagcaucagcauggccggcugcgccacccagaucuucuucuacaucagccugcugggcagcgagugcuuccugcuggccgugaugagcuacgacagauacaccgccaucugccacccccugagauacaccaaccugaugagacccaagaucugcggccugaugaccgccuucagcuggauccugggcagcaccgacggcaucaucgacgccguggccaccuucagcuucagcuacugcggcagcagagagaucgcccacuucugcugcgacuuccccagccugcugauccugagcugcaacgacaccagcaucuucgaggaggugaucuucaucugcugcaucgugaugcugguguuccccguggccaucaucaucaccagcuacgccagagugauccuggccgugauccacaugggcagcggcgagggcagaagaaaggccuucaccaccugcagcagccaccugaugguggugggcauguacuacggcgccggccuguucaugugcauccagcccaccagccaccacagccccaugcaggacaagauggugagcguguucuacaccaucgugacccccaugcugaacccccugaucuacagccugagaaacaaggaggugaccagagcccugaugaagauccugggcaagggcaagagcggcgacuaa

SEQ ID NO: 20982 - RNA, 960 nt, Artificial Sequence
  OR2S2__Homo_sapiens__NP_063950
auggagaaggccaacgagaccagccccgugaugggcuucgugcugcugagacugagcgcccaccccgagcuggagaagaccuucuucgugcugauccugcugauguaccuggugauccugcugggcaacggcgugcugauccuggugaccauccuggacagcagacugcacacccccauguacuucuuccugggcaaccugagcuuccuggacaucugcuucaccaccagcagcgugccccuggugcuggacagcuuccugaccccccaggagaccaucagcuucagcgccugcgccgugcagauggcccugagcuucgccauggccggcaccgagugccugcugcugagcaugauggccuucgacagauacguggccaucugcaacccccugagauacagcgugaucaugagcaaggccgccuacaugcccauggccgccagcagcugggccaucggcggcgccgccagcguggugcacaccagccuggccauccagcugcccuucugcggcgacaacgugaucaaccacuucaccugcgagauccuggccgugcugaagcuggccugcgccgacaucagcaucaacgugaucagcauggaggugaccaacgugaucuuccugggcgugcccgugcuguucaucagcuucagcuacguguucaucaucaccaccauccugagaauccccagcgccgagggcagaaagaagguguucagcaccugcagcgcccaccugaccguggugaucguguucuacggcacccuguucuucauguacggcaagcccaagagcaaggacagcaugggcgccgacaaggaggaccugagcgacaagcugaucccccuguucuacggcguggugacccccaugcugaaccccaucaucuacagccugagaaacaaggacgugaaggccgccgugagaagacugcugagacccaagggcuucacccaguaa

SEQ ID NO: 20983 - RNA, 939 nt, Artificial Sequence
  OR2T10__Homo_sapiens__NP_001004693
augagacuggccaaccagacccugggcggcgacuucuuccugcugggcaucuucagccagaucagccaccccggcagacugugccugcugaucuucagcaucuuccugauggccgugagcuggaacaucacccugauccugcugauccacaucgacagcagccugcacacccccauguacuucuucaucaaccagcugagccugaucgaccugaccuacaucagcgugaccgugcccaagaugcuggugaaccagcuggccaaggacaagaccaucagcgugcugggcugcggcacccagauguacuucuaccugcagcugggcggcgccgagugcugccugcuggccgccauggccuacgacagauacguggccaucugccacccccugagauacagcgugcugaugagccacagagugugccugcugcuggccagcggcugcugguucgugggcagcguggacggcuucaugcugacccccaucgccaugagcuuccccuucugcagaagccacgagauccagcacuucuucugcgaggugcccgccgugcugaagcugagcugcagcgacaccagccuguacaagaucuucauguaccugugcugcgugaucaugcugcugauccccgugaccgugaucagcgugagcuacuacuacaucauccugaccauccacaagaugaacagcguggagggcagaaagaaggccuucaccaccugcagcagccacaucaccguggugagccuguucuacggcgccgccaucuacaacuacaugcugcccagcagcuaccagacccccgagaaggacaugaugagcagcuucuucuacaccauccugacccccgugcugaaccccaucaucuacagcuucagaaacaaggacgugaccagagcccugaagaagaugcugagcgugcagaagccccccuacuaa

SEQ ID NO: 20984 - RNA, 963 nt, Artificial Sequence
  OR2T12__Homo_sapiens__NP_001004692
auggagaugagaaacaccacccccgacuucauccugcugggccuguucaaccacaccagagcccaccaggugcuguucaugaugcugcuggccaccgugcugaccagccuguucagcaacgcccugaugauccugcugauccacugggaccacagacugcacagacccauguacuuccugcugagccagcugagccugauggacaugaugcuggugagcaccaccgugcccaagauggccgccgacuaccugaccggcaacaaggccaucagcagagccggcugcggcgugcagaucuucuuccugcccacccugggcggcggcgagugcuuccugcuggccgccauggccuacgacagauacgccgccgugugccacccccugagauaccccacccugaugagcuggcagcugugccugagaaugaccaugagcagcuggcugcugggcgccgccgacggccugcugcaggccguggccacccugagcuuccccuacugcggcgcccacgagaucgaccacuucuucugcgaggcccccgugcuggugagacuggccugcgccgacaccagcguguucgagaacgccauguacaucugcugcgugcugaugcugcuggugcccuucagccugauccugagcagcuacggccugauccuggccgccgugcugcugaugagaagcaccgaggccagaaagaaggccuucgccaccugcagcagccacguggccguggugggccuguucuacggcgccggcaucuucaccuacaugagacccaagagccacagaagcaccaaccacgacaagguggugagcgccuucuacaccauguucaccccccugcugaacccccugaucuacagcgugagaaacagcgaggugaaggaggcccugaagagauggcugggcaccugcgugaaccugaagcaccagcagaacgaggcccacagaagcagauaa

SEQ ID NO: 20985 - RNA, 1110 nt, Artificial Sequence
  OR2T1__Homo_sapiens__NP_112166
auguggcaggaguacuacuuccugaacguguucuucccccugcugaaggugugcugccugaccaucaacagccacguggugauccugcugcccugggagugcuaccaccugaucuggaagauccugcccuacaucggcaccaccgugggcagcauggaggaguacaacaccagcagcaccgacuucaccuucaugggccuguucaacagaaaggagaccagcggccugaucuucgccaucaucagcaucaucuucuucaccgcccugauggccaacggcgugaugaucuuccugauccagaccgaccugagacugcacacccccauguacuuccugcugagccaccugagccugaucgacaugauguacaucagcaccaucgugcccaagaugcuggugaacuaccugcuggaccagagaaccaucagcuucgugggcugcaccgcccagcacuuccuguaccugacccuggugggcgccgaguucuuccugcugggccugauggccuacgacagauacguggccaucugcaacccccugagauaccccgugcugaugagcagaagagugugcuggaugaucaucgccggcagcugguucggcggcagccuggacggcuuccugcugacccccaucaccaugagcuuccccuucugcaacagcagagagaucaaccacuucuucugcgaggcccccgccgugcugaagcuggccugcgccgacaccgcccuguacgagaccgugauguacgugugcugcgugcugaugcugcugauccccuucagcguggugcuggccagcuacgccagaauccugaccaccgugcagugcaugagcagcguggagggcagaaagaaggccuucgccaccugcagcagccacaugaccguggugagccuguucuacggcgccgccauguacaccuacaugcugccccacagcuaccacaagcccgcccaggacaaggugcugagcguguucuacaccauccugacccccaugcugaacccccugaucuacagccugagaaacaaggacgugaccggcgcccugaagagagcccugggcagauucaagggcccccagagagugagcggcggcguguucuaa

SEQ ID NO: 20986 - RNA, 975 nt, Artificial Sequence
  OR2T2__Homo_sapiens__NP_001004136
augggcauggagggccugcugcagaacagcaccaacuucgugcugaccggccugaucacccaccccgccuuccccggccugcuguucgccaucguguucagcaucuucgugguggccaucaccgccaaccuggugaugauccugcugauccacauggacagcagacugcacacccccauguacuuccugcugagccagcugagcaucauggacaccaucuacaucugcaucaccgugcccaagaugcugcaggaccugcugagcaaggacaagaccaucagcuuccugggcugcgccgugcagaucuuccuguaccugacccugaucggcggcgaguucuuccugcugggccugauggccuacgacagauacguggccgugugcaacccccugagauacccccugcugaugaacagaagagugugccuguucaugguggugggcagcugggugggcggcagccuggacggcuucaugcugacccccgugaccaugagcuuccccuucugcagaagcagagagaucaaccacuucuucugcgagauccccgccgugcugaagcugagcugcaccgacaccagccuguacgagacccugauguacgccugcugcgugcugaugcugcugaucccccugagcgugaucagcgugagcuacacccacauccugcugaccgugcacagaaugaacagcgccgagggcagaagaaaggccuucgccaccugcagcagccacaucaugguggugagcguguucuacggcgccgccuucuacaccaacgugcugccccacagcuaccacacccccgagaaggacaagguggugagcgccuucuacaccauccugacccccaugcugaacccccugaucuacagccugagaaacaaggacguggccgccgcccugagaaaggugcugggcagaugcggcagcagccagagcaucagaguggccaccgugaucagaaagggcuaa

SEQ ID NO: 20987 - RNA, 963 nt, Artificial Sequence
  OR2T33__Homo_sapiens__NP_001004695
auggagaugagaaacaccacccccgacuucauccugcugggccuguucaaccacaccagagcccaccaggugcuguucaugauggugcugagcaucgugcugaccagccuguucggcaacagccugaugauccugcugauccacugggaccacagacugcacacccccauguacuuccugcugagccagcugagccugauggacaugaugcuggugagcaccaccgugcccaagauggccgccgacuaccugaccggcagcaaggccaucagcagagccggcugcggcgugcagaucuucuuccugcccacccugggcggcggcgagugcuuccugcuggccgccauggccuacgacagauacgccgccgugugccacccccugagauaccccacccugaugagcuggcagcugugccugagaaugaccaugagcugcuggcugcugggcgccgccgacggccugcugcaggccguggugacccugagcuuccccuacugcggcgcccacgagaucgaccacuucuucugcgagacccccgugcuggugagacuggccugcgccgacaccagcguguucgagaacgccauguacaucugcugcgugcugaugcugcuggugcccuucagccugauccugagcagcuacggccugauccuggccgccgugcugcacaugagaagcaccgaggccagaaagaaggccuucgccaccugcagcagccacguggccguggugggccuguucuacggcgccgccaucuucaccuacaugagacccaagagccacagaagcaccaaccacgacaagguggugagcgccuucuacaccauguucaccccccugcugaacccccugaucuacagcgugaagaacagcgaggugaagggcgcccugaagagauggcugggcaccugcgugaacaucaagcaccagcagaacgaggcccacagaagcagauaa

SEQ ID NO: 20988 - RNA, 1047 nt, Artificial Sequence
  OR2T4__Homo_sapiens__NP_001004696
auggacaacaucaccuggauggccagccacaccggcuggagcgacuucauccugaugggccuguucagacagagcaagcaccccauggccaacaucaccuggauggccaaccacaccggcuggagcgacuucauccugcugggccuguucagacagagcaagcaccccgcccugcugugcguggugaucuucgugguguuccugauggcccugagcggcaacgccgugcugauccugcugauccacugcgacgcccaccugcacacccccauguacuucuucaucagccagcugagccugauggacauggccuacaucagcgugaccgugcccaagaugcugcuggaccaggugaugggcgugaacaagaucagcgcccccgagugcggcaugcagauguucuucuacgugacccuggccggcagcgaguucuuccugcuggccaccauggccuacgacagauacguggccaucugccacccccugagauaccccgugcugaugaaccacagagugugccuguuccugagcagcggcugcugguuccugggcagcguggacggcuucaccuucacccccaucaccaugaccuuccccuucagaggcagcagagagauccaccacuucuucugcgaggugcccgccgugcugaaccugagcugcagcgacaccagccuguacgagaucuucauguaccugugcugcgugcugaugcugcugauccccguggugaucaucagcagcagcuaccugcugauccugcugaccauccacggcaugaacagcgccgagggcagaaagaaggccuucgccaccugcagcagccaccugaccguggugauccuguucuacggcgccgccaucuacaccuacaugcugcccagcagcuaccacacccccgagaaggacaugauggugagcguguucuacaccauccugacccccguggugaacccccugaucuacagccugagaaacaaggacgugaugggcgcccugaagaagaugcugaccguggagcccgccuuccagaaggccauggaguaa

SEQ ID NO: 20989 - RNA, 948 nt, Artificial Sequence
  OR2T5__Homo_sapiens__NP_001004697
auggccaacaucaccagaauggccaaccacaccggcaagcuggacuucauccugaugggccuguucagaagaagcaagcaccccgcccugcugagcguggugaucuucgugguguuccugaaggcccugagcggcaacgccgugcugauccugcugauccacugcgacgcccaccugcacagccccauguacuucuucaucagccagcugagccugauggacauggccuacaucagcgugaccgugcccaagaugcugcuggaccaggugaugggcgugaacaaggugagcgcccccgagugcggcaugcagauguuccuguaccugacccuggccggcagcgaguucuuccugcuggccaccauggccuacgacagauacguggccaucugccacccccugagauaccccgugcugaugaaccacagagugugccuguuccuggccagcggcugcugguuccugggcagcguggacggcuucaugcugacccccaucaccaugagcuuccccuucugcagaagcugggagauccaccacuucuucugcgaggugcccgccgugaccauccugagcugcagcgacaccagccuguacgagacccugauguaccugugcugcgugcugaugcugcugauccccgugaccaucaucagcagcagcuaccugcugauccugcugaccgugcacagaaugaacagcgccgagggcagaaagaaggccuucgccaccugcagcagccaccugaccguggugauccuguucuacggcgccgccguguacaccuacaugcugcccagcagcuaccacacccccgagaaggacaugauggugagcguguucuacaccauccugacccccgugcugaacccccugaucuacagccugagaaacaaggacgugaugggcgcccugaagaagaugcugaccgugagauucgugcuguaa

SEQ ID NO: 20990 - RNA, 963 nt, Artificial Sequence
  OR2W1__Homo_sapiens__NP_112165
auggaccagagcaacuacagcagccugcacggcuucauccugcugggcuucagcaaccaccccaagauggagaugauccugagcggcgugguggccaucuucuaccugaucacccuggugggcaacaccgccaucauccuggccagccugcuggacagccagcugcacacccccauguacuucuuccugagaaaccugagcuuccuggaccugugcuucaccaccagcaucaucccccagaugcuggugaaccuguggggccccgacaagaccaucagcuacgugggcugcaucauccagcuguacguguacauguggcugggcagcguggagugccugcugcuggccgugaugagcuacgacagauucaccgccaucugcaagccccugcacuacuucguggugaugaacccccaccugugccugaagaugaucaucaugaucuggagcaucagccuggccaacagcguggugcugugcacccugacccugaaccugcccaccugcggcaacaacauccuggaccacuuccugugcgagcugcccgcccuggugaagaucgccugcguggacaccaccaccguggagaugagcguguucgcccugggcaucaucaucgugcugaccccccugauccugauccugaucagcuacggcuacaucgccaaggccgugcugagaaccaagagcaaggccagccagagaaaggccaugaacaccugcggcagccaccugaccguggugagcauguucuacggcaccaucaucuacauguaccugcagcccggcaacagagccagcaaggaccagggcaaguuccugacccuguucuacaccgugaucacccccagccugaacccccugaucuacacccugagaaacaaggacaugaaggacgcccugaagaagcugaugagauuccaccacaagagcaccaagaucaagagaaacugcaagagcuaa

SEQ ID NO: 20991 - RNA, 936 nt, Artificial Sequence
  OR2Y1__Homo_sapiens__NP_001001657
augggcagcuucaacaccagcuucgaggacggcuucauccuggugggcuucagcgacuggccccagcuggagcccauccuguucguguucaucuucaucuucuacagccugacccuguucggcaacaccaucaucaucgcccugagcuggcuggaccugagacugcacacccccauguacuucuuccugagccaccugagccugcuggaccugugcuucaccaccagcaccgugccccagcugcugaucaaccugugcggcguggacagaaccaucaccagaggcggcugcguggcccagcuguucaucuaccuggcccugggcagcaccgagugcgugcugcugguggugauggccuucgacagauacgccgccgugugcagaccccugcacuacauggccaucaugcacccccaccugugccagacccuggccaucgccagcuggggcgccggcuucgugaacagccugauccagaccggccuggccauggccaugccccugugcggccacagacugaaccacuucuucugcgagaugcccguguuccugaagcuggccugcgccgacaccgagggcaccgaggccaagauguucguggccagagugaucgugguggccgugcccgccgcccugauccugggcagcuacgugcacaucgcccacgccgugcugagagugaagagcaccgccggcagaagaaaggccuucggcaccugcggcagccaccugcuggugguguuccuguucuacggcagcgccaucuacaccuaccugcagagcauccacaacuacagcgagagagagggcaaguucguggcccuguucuacaccaucaucacccccauccugaacccccugaucuacacccugagaaacaaggacgugaagggcgcccuguggaaggugcuguggagaggcagagacagcggcuaa

SEQ ID NO: 20992 - RNA, 945 nt, Artificial Sequence
  OR2Z1__Homo_sapiens__NP_001004699
augggcgacgugaaccagagcguggccagcgacuucauccuggugggccuguucagccacagcggcagcagacagcugcuguucagccugguggccgugauguucgugaucggccugcugggcaacaccgugcugcuguuccugaucagaguggacagcagacugcacacccccauguacuuccugcugagccagcugagccuguucgacaucggcugccccauggugaccauccccaagauggccagcgacuuccugagaggcgagggcgccaccagcuacggcggcggcgccgcccagaucuucuuccugacccugaugggcguggccgagggcgugcugcuggugcugaugagcuacgacagauacguggccgugugccagccccugcaguaccccgugcugaugagaagacaggugugccugcugaugaugggcagcagcuggguggugggcgugcugaacgccagcauccagaccagcaucacccugcacuuccccuacugcgccagcagaaucguggaccacuucuucugcgaggugcccgcccugcugaagcugagcugcgccgacaccugcgccuacgagauggcccugagcaccagcggcgugcugauccugaugcugccccugagccugaucgccaccagcuacggccacgugcugcaggccgugcugagcaugagaagcgaggaggccagacacaaggccgugaccaccugcagcagccacaucaccguggugggccuguucuacggcgccgccguguucauguacauggugcccugcgccuaccacagcccccagcaggacaacguggugagccuguucuacagccuggugacccccacccugaacccccugaucuacagccugagaaaccccgagguguggauggcccuggugaaggugcugagcagagccggccugagacagaugugcuaa

SEQ ID NO: 20993 - RNA, 948 nt, Artificial Sequence
  OR3A1__Homo_sapiens__NP_002541
augcagcccgagagcggcgccaacggcaccgugaucgccgaguucauccugcugggccugcuggaggcccccggccugcagcccgugguguucgugcuguuccuguucgccuaccuggugaccgugagaggcaaccugagcauccuggccgccgugcugguggagcccaagcugcacacccccauguacuucuuccugggcaaccugagcgugcuggacgugggcugcaucagcgugaccgugcccagcaugcugagcagacugcugagcagaaagagagccgugcccugcggcgccugccugacccagcuguucuucuuccaccuguucgugggcguggacugcuuccugcugaccgccauggccuacgacagauuccuggccaucugcagaccccugaccuacagcaccagaaugagccagaccgugcagagaaugcugguggccgccagcugggccugcgccuucaccaacgcccugacccacaccguggccaugagcacccugaacuucugcggccccaacgugaucaaccacuucuacugcgaccugccccagcuguuccagcugagcugcagcagcacccagcugaacgagcugcugcuguucgccgugggcuucaucauggccggcacccccauggcccugaucgugaucagcuacauccacguggccgccgccgugcugagaaucagaagcguggagggcagaaagaaggccuucagcaccugcggcagccaccugaccgugguggccaucuucuacggcagcggcaucuucaacuacaugagacugggcagcaccaagcugagcgacaaggacaaggccgugggcaucuucaacaccgugaucaaccccaugcugaaccccaucaucuacagcuucagaaaccccgacgugcagagcgccaucuggagaaugcugaccggcagaagaagccuggccuaa

SEQ ID NO: 20994 - RNA, 1035 nt, Artificial Sequence
  OR4A15__Homo_sapiens__NP_001005275
auggagcugcugaccaacaaccugaaguucaucaccgaccccuucgugugcagacugagacaccugagccccacccccagcgaggagcacaugaagaacaagaacaacgugaccgaguucauccugcugggccugacccagaaccccgagggccagaaggugcuguucgugaccuuccugcugaucuacauggugaccaucaugggcaaccugcugaucaucgugaccaucauggccagccagagccugggcagccccauguacuucuuccuggccagccugagcuucaucgacaccguguacagcaccgccuucgcccccaagaugaucguggaccugcugagcgagaagaagaccaucagcuuccagggcugcauggcccagcuguucauggaccaccuguucgccggcgccgaggugauccugcugguggugauggccuacgacagauacauggccaucugcaagccccugcacgagcugaucaccaugaacagaagagugugcgugcugaugcugcuggccgccuggaucggcggcuuccugcacagccuggugcaguuccuguucaucuaccagcugcccuucugcggccccaacgugaucgacaacuuccugugcgaccuguacccccugcugaagcuggccugcaccaacaccuacgugaccggccugagcaugaucgccaacggcggcgccaucugcgccgugaccuucuucaccauccugcugagcuacggcgugauccugcacagccugaagacccagagccuggagggcaagagaaaggccuucuacaccugcgccagccacgugaccguggugauccuguucuucgugcccugcaucuuccuguacgccagacccaacagcaccuuccccaucgacaagagcaugaccguggugcugaccuucaucacccccaugcugaacccccugaucuacacccugaagaacgccgagaugaagagcgccaugagaaagcuguggagcaagaaggugagccuggccggcaaguggcuguaccacagcuaa

SEQ ID NO: 20995 - RNA, 930 nt, Artificial Sequence
  OR4C12__Homo_sapiens__NP_001005270
auggagaagaagaagaacgugaccgaguucauccugaucggccugacccagaaccccaucauggagaaggugaccuucgugguguuccuggugcuguacaugaucacccugagcggcaaccugcugaucguggugaccaucaccaccagccaggcccugagcagccccauguacuucuuccugacccaccugagccugaucgacaccguguacagcagcagcagcgcccccaagcugaucguggacagcuuccaggagaagaagaucaucagcuucaacggcugcauggcccaggccuacgccgagcacaucuucggcgccaccgagaucauccugcugaccgugauggccugcgacugcuacguggccaucugcaagccccugaacuacaccaccaucaugagccacagccugugcauccugcugguggccguggccugggugggcggcuuccugcacgccaccauccagauccuguucaccguguggcugcccuucugcggccccaacgugaucggccacuucaugugcgaccuguacccccugcugaagcuggugugcaucgacacccacacccugggccuguucguggccgugaacagcggcuucaucugccugcugaacuuccugauccugguggugagcuacgugaucauccugagaagccugaagaacaacagccuggagggcagaugcaaggcccugagcaccugcaucagccacaucaucgugguggugcuguucuucgugcccugcaucuucguguaccugagaagcgugaccacccugcccaucgacaaggccguggccguguucuacaccaugguggugcccaugcugaaccccgugguguacacccugagaaacgccgaggugaagagcgccaucagaaagcuguggagaaagaaggugaccagcgacaacgacuaa

SEQ ID NO: 20996 - RNA, 930 nt, Artificial Sequence
  OR4C13__Homo_sapiens__NP_001001955
auggccaacagaaacaacgugaccgaguucauccugcugggccugaccgagaaccccaagaugcagaagaucaucuucgugguguucagcgugaucuacaucaacgccaugaucggcaacgugcugaucguggugaccaucaccgccagccccagccugagaagccccauguacuucuuccuggccuaccugagcuucaucgacgccugcuacagcagcgugaacacccccaagcugaucaccgacagccuguacgagaacaagaccauccuguucaacggcugcaugacccagguguucggcgagcacuucuucagaggcguggaggugauccugcugaccgugauggccuacgaccacuacguggccaucugcaagccccugcacuacaccaccgugaugaagcagcacgugugcagccugcuggugggcgugagcugggugggcggcuuccugcacgccaccauccagauccuguucaucugccagcugcccuucugcggccccaacgugaucgaccacuucaugugcgaccuguacacccugaucaaccuggccugcaccaacacccacacccugggccuguucaucgccgccaacagcggcuucaucugccugcugaacugccugcugcugcuggugagcugcguggugauccuguacagccugaagacccacagccuggaggccagacacgaggcccugagcaccugcgugagccacaucaccguggugauccugagcuucauccccugcaucuucguguacaugagaccccccgccacccugcccaucgacaaggccguggccguguucuacaccaugaucaccagcaugcugaacccccugaucuacacccugagaaacgcccagaugaagaacgccaucagaaagcugugcagcagaaaggccaucagcagcgugaaguaa

SEQ ID NO: 20997 - RNA, 930 nt, Artificial Sequence
  OR4C6__Homo_sapiens__NP_001004704
auggagaaccagaacaacgugaccgaguucauccugcugggccugaccgagaaccuggagcuguggaagaucuucagcgccguguuccuggugauguacguggccaccgugcuggagaaccugcugaucguggugaccaucaucaccagccagagccugagaagccccauguacuucuuccugaccuuccugagccugcuggacgugauguucagcagcgugguggcccccaaggugaucguggacacccugagcaagagcaccaccaucagccugaagggcugccugacccagcuguucguggagcacuucuucggcggcgugggcaucauccugcugaccgugauggccuacgacagauacguggccaucugcaagccccugcacuacaccaucaucaugagccccagagugugcugccugauggugggcggcgccugggugggcggcuucaugcacgccaugauccagcugcuguucauguaccagauccccuucugcggccccaacaucaucgaccacuucaucugcgaccuguuccagcugcugacccuggccugcaccgacacccacauccugggccugcuggugacccugaacagcggcaugaugugcguggccaucuuccugauccugaucgccagcuacaccgugauccugugcagccugaagagcuacagcagcaagggcagacacaaggcccugagcaccugcagcagccaccugaccgugguggugcuguucuucgugcccugcaucuuccuguacaugagacccguggugacccaccccaucgacaaggccauggccgugagcgacagcaucaucacccccaugcugaacccccugaucuacacccugagaaacgccgaggugaagagcgccaugaagaagcuguggaugaagugggaggcccuggccggcaaguaa

SEQ ID NO: 20998 - RNA, 936 nt, Artificial Sequence
  OR4D10__Homo_sapiens__NP_001004705
auggagauggagaacugcaccagagugaaggaguucaucuuccugggccugacccagaacagagaggugagccuggugcuguuccuguuccugcugcugguguacgugaccacccugcugggcaaccugcugaucauggugaccgugaccugcgagagcagacugcacacccccauguacuuccugcugcacaaccugagcaucgccgacaucugcuucagcagcaucaccgugcccaaggugcugguggaccugcugagcgagagaaagaccaucagcuucaaccacugcuucacccagauguuccuguuccaccugaucggcggcguggacguguucagccugagcgugauggcccuggacagauacguggccaucagcaagccccugcacuacgccaccaucaugagcagagaccacugcaucggccugaccguggccgccuggcugggcggcuucgugcacagcaucgugcagaucagccugcugcugccccugcccuucugcggccccaacgugcuggacaccuucuacugcgacgugcacagagugcugaagcuggcccacaccgacaucuucauccuggagcugcugaugaucagcaacaacggccugcugaccacccugugguucuuccugcugcuggugagcuacaucgugauccugagccugcccaagagccaggccggcgagggcagaagaaaggccaucagcaccugcaccagccacaucaccguggugacccugcacuucgugcccugcaucuacguguacgccagacccuucaccgcccugcccauggacaaggccaucagcgugaccuucaccgugaucagcccccugcugaacccccugaucuacacccugagaaaccacgagaugaagagcgccaugagaagacugaagagaagacuggugcccagcgacagaaaguaa

SEQ ID NO: 20999 - RNA, 915 nt, Artificial Sequence
  OR4K13__Homo_sapiens__NP_001004714
auggagagagccaaccacagcguggugagcgaguucauccugcugggccugagcaagagccagaaccugcagauccuguucuuccugggcuucagcgugguguucgugggcaucgugcugggcaaccugcugauccuggugaccgugaccuucgacagccugcugcacacccccauguacuuccugcugagcaaccugagcugcaucgacaugauccuggccagcuucgccacccccaagaugaucguggacuuccugagagagagaaagaccaucagcugguggggcugcuacagccagauguucuucaugcaccugcugggcggcagcgagaugaugcugcugguggccauggccaucgacagauacguggccaucugcaagccccugcacuacaugaccaucaugagccccagagugcugaccggccugcugcugagcagcuacgccgugggcuucgugcacagcagcagccagauggccuucaugcugacccugcccuucugcggccccaacgugaucgacagcuucuucugcgaccugccccuggugaucaagcuggccugcaaggacaccuacauccugcagcugcuggugaucgccgacagcggccugcugagccuggugugcuuccugcugcugcuggugagcuacggcgugaucaucuucagcgugagauacagagccgccagcagaagcagcaaggccuucagcacccugagcgcccacaucaccguggugacccuguucuucgcccccugcguguucaucuacguguggcccuucagcagauacagcguggacaagauccugagcguguucuacaccaucuucaccccccugcugaaccccaucaucuacacccugagaaaccaggaggugaaggccgccaucaagaagagacugugcaucuaa

SEQ ID NO: 21000 - RNA, 939 nt, Artificial Sequence
  OR4P4__Homo_sapiens__NP_001004124
auggagaagagcaacaacagcacccuguucauccugcugggcuucagccagaacaagaacaucgaggugcugugcuucgugcuguuccuguucugcuacaucgccaucuggaugggcaaccugcugaucaugaucagcaucaccugcacccagcugauccaccagcccauguacuucuuccugaacuaccugagccugagcgaccugugcuacaccagcaccgugacccccaagcugaugguggaccugcuggccgagagaaagaccaucagcuacaacaacugcaugauccagcuguucaccacccacuucuucggcggcaucgagaucuucauccugaccggcauggccuacgacagauacguggccaucugcaagccccugcacuacaccaucaucaugagcagacagaagugcaacaccaucaucaucgugugcugcaccggcggcuucauccacagcgccagccaguuccugcugaccaucuucgugcccuucugcggccccaacgagaucgaccacuacuucugcgacguguacccccugcugaagcuggccugcagcaacauccacaugaucggccugcuggugaucgccaacagcggccugaucgcccuggugaccuucguggugcugcugcugagcuacguguucauccuguacaccaucagagccuacagcgccgagagaagaagcaaggcccuggccaccugcagcagccacgugaucgugguggugcuguucuucgcccccgcccuguucaucuacaucagacccgugaccaccuucagcgaggacaagguguucgcccuguucuacaccaucaucgcccccauguucaacccccugaucuacacccugagaaacaccgagaugaagaacgccaugagaaagguguggugcugccagauccugcugaagagaaaccagcuguucuaa

SEQ ID NO: 21001 - RNA, 936 nt, Artificial Sequence
  OR4S2__Homo_sapiens__NP_001004059
auggagaagaucaacaacgugaccgaguucaucuucuggggccugagccagagccccgagaucgagaaggugugcuucgugguguucagcuucuucuacaucaucauccugcugggcaaccugcugaucaugcugaccgugugccugagcaaccuguucaagagccccauguacuucuuccugagcuuccugagcuucguggacaucugcuacagcagcgugaccgcccccaagaugaucguggaccugcuggccaaggacaagaccaucagcuacgugggcugcaugcugcagcuguucggcgugcacuucuucggcugcaccgagaucuucauccugaccgugauggccuacgacagauacguggccaucugcaagccccugcacuacaugaccaucaugaacagagagaccugcaacaagaugcugcugggcaccugggugggcggcuuccugcacagcaucauccagguggcccugguggugcagcugcccuucugcggccccaacgagaucgaccacuacuucugcgacgugcaccccgugcugaagcuggccugcaccgagaccuacaucgugggcgugguggugaccgccaacagcggcaccaucgcccugggcagcuucgugauccugcugaucagcuacagcaucauccuggugagccugagaaagcagagcgccgagggcagaagaaaggcccugagcaccugcggcagccacaucgccaugguggugaucuucuucggccccugcaccuucauguacaugagacccgacaccaccuucagcgaggacaagaugguggccguguucuacaccaucaucacccccaugcugaacccccugaucuacacccugagaaacgccgaggugaagaacgccaugaagaagcuguggggcagaaacguguuccuggaggccaagggcaaguaa

SEQ ID NO: 21002 - RNA, 942 nt, Artificial Sequence
  OR51A2__Homo_sapiens__NP_001004748
augagcaucaucaacaccagcuacguggagaucaccaccuucuuccuggugggcaugcccggccuggaguacgcccacaucuggaucagcauccccaucugcagcauguaccugaucgccauccugggcaacggcaccauccuguucaucaucaagaccgagcccagccugcacggccccauguacuacuuccugagcaugcuggccaugagcgaccugggccugagccugagcagccugcccaccgugcugagcaucuuccuguucaacgcccccgagaccagcagcagcgccugcuucgcccaggaguucuucauccacggcuucagcgugcuggagagcagcgugcugcugaucaugagcuucgacagauuccuggccauccacaacccccugagauacaccagcauccugaccaccgugagaguggcccagaucggcaucguguucagcuucaagagcaugcugcuggugcugcccuuccccuucacccugagaagccugagauacugcaagaagaaccagcugagccacagcuacugccugcaccaggacgugaugaagcuggccugcagcgacaacagaaucgacgugaucuacggcuucuucggcgcccugugccugaugguggacuucauccugaucgccgugagcuacacccugauccugaagaccgugcccggcaucgccagcaagaaggaggagcugaaggcccugaacaccugcgugagccacaucugcgccgugaucaucuucuaccugcccaucaucaaccuggccguggugcacagauucgccggccacgugagcccccugaucaacgugcugauggccaacgugcugcugcuggugcccccccugaugaagcccaucguguacugcgugaagaccaagcagaucagagugagagugguggccaagcugugccaguggaagaucuaa

SEQ ID NO: 21003 - RNA, 939 nt, Artificial Sequence
  OR51A7__Homo_sapiens__NP_001004749
augagcgugcugaacaacagcgaggugaagcuguuccugcugaucggcauccccggccuggagcacgcccacaucugguucagcauccccaucugccugauguaccugcuggccaucaugggcaacugcaccauccuguucaucaucaagaccgagcccagccugcacgagcccauguacuacuuccuggccaugcuggccgugagcgacaugggccugagccugagcagccugcccaccaugcugagaguguuccuguucaacgccaugggcaucagccccaacgccugcuucgcccaggaguucuucauccacggcuucaccgugauggagagcagcgugcugcugaucaugagccuggacagauuccuggccauccacaacccccugagauacagcagcauccugaccagcaacagaguggccaagaugggccugauccuggccaucagaagcauccugcuggugauccccuuccccuucacccugagaagacugaaguacugccagaagaaccugcugagccacagcuacugccugcaccaggacaccaugaagcuggccugcagcgacaacaagaccaacgugaucuacggcuucuucaucgcccugugcaccaugcuggaccuggcccugaucgugcugagcuacgugcugauccugaagaccauccugagcaucgccagccuggccgagagacugaaggcccugaacaccugcgugagccacaucugcgccgugcugaccuucuacgugcccaucaucacccuggccgccaugcaccacuucgccaagcacaagagcccccugguggugauccugaucgccgacauguuccugcuggugcccccccugaugaaccccaucguguacugcgugaagaccagacagaucugggagaagauccugggcaagcugcugaacgugugcggcagauaa

SEQ ID NO: 21004 - RNA, 957 nt, Artificial Sequence
  OR51E1__Homo_sapiens__NP_689643
augaugguggaccccaacggcaacgagagcagcgccaccuacuucauccugaucggccugcccggccuggaggaggcccaguucuggcuggccuucccccugugcagccuguaccugaucgccgugcugggcaaccugaccaucaucuacaucgugagaaccgagcacagccugcacgagcccauguacaucuuccugugcaugcugagcggcaucgacauccugaucagcaccagcagcaugcccaagaugcuggccaucuucugguucaacagcaccaccauccaguucgacgccugccugcugcagauguucgccauccacagccugagcggcauggagagcaccgugcugcuggccauggccuucgacagauacguggccaucugccacccccugagacacgccaccgugcugacccugcccagagugaccaagaucggcguggccgccguggugagaggcgccgcccugauggccccccugcccguguucaucaagcagcugcccuucugcagaagcaacauccugagccacagcuacugccugcaccaggacgugaugaagcuggccugcgacgacaucagagugaacgugguguacggccugaucgugaucaucagcgccaucggccuggacagccugcugaucagcuucagcuaccugcugauccugaagaccgugcugggccugaccagagaggcccaggccaaggccuucggcaccugcgugagccacgugugcgccguguucaucuucuacgugcccuucaucggccugagcauggugcacagauucagcaagagaagagacagcccccugcccgugauccuggccaacaucuaccugcuggugccccccgugcugaaccccaucguguacggcgugaagaccaaggagaucagacagagaauccugagacuguuccacguggccacccacgccagcgagcccuaa

SEQ ID NO: 21005 - RNA, 963 nt, Artificial Sequence
  OR51E2__Homo_sapiens__NP_110401
augagcagcugcaacuucacccacgccaccuucgugcugaucggcauccccggccuggagaaggcccacuucugggugggcuucccccugcugagcauguacgugguggccauguucggcaacugcaucgugguguucaucgugagaaccgagagaagccugcacgcccccauguaccuguuccugugcaugcuggccgccaucgaccuggcccugagcaccagcaccaugcccaagauccuggcccuguucugguucgacagcagagagaucagcuucgaggccugccugacccagauguucuucauccacgcccugagcgccaucgagagcaccauccugcuggccauggccuucgacagauacguggccaucugccacccccugagacacgccgccgugcugaacaacaccgugaccgcccagaucggcaucguggccguggugagaggcagccuguucuucuucccccugccccugcugaucaagagacuggccuucugccacagcaacgugcugagccacagcuacugcgugcaccaggacgugaugaagcuggccuacgccgacacccugcccaacgugguguacggccugaccgccauccugcuggugaugggcguggacgugauguucaucagccugagcuacuuccugaucaucagaaccgugcugcagcugcccagcaagagcgagagagccaaggccuucggcaccugcgugagccacaucggcguggugcuggccuucuacgugccccugaucggccugagcguggugcacagauucggcaacagccugcaccccaucgugagaguggugaugggcgacaucuaccugcugcugccccccgugaucaaccccaucaucuacggcgccaagaccaagcagaucagaaccagagugcuggccauguucaagaucagcugcgacaaggaccugcaggccgugggcggcaaguaa

SEQ ID NO: 21006 - RNA, 1029 nt, Artificial Sequence
  OR51F2__Homo_sapiens__NP_001004753
augaccgagaccagccugagcagccagugcuuccccaugagcgugcugaacaacaccaucgccgagccccugaucuuccugcugaugggcauccccggccugaaggccacccaguacuggaucagcauccccuucugccugcuguacgugguggccgugagcggcaacagcaugauccuguucguggugcugugcgagagaagccugcacaagcccauguacuacuuccugagcaugcugagcgccaccgaccugagccugagccugugcacccugagcaccacccugggcguguucugguucgaggccagagagaucaaccugaacgccugcaucgcccagauguucuuccugcacggcuucaccuucauggagagcggcgugcugcuggccauggccuucgacagauucguggccaucugcuacccccugagauacaccaccauccugaccaacgccagaaucgccaagaucggcaugagcaugcugaucagaaacguggccgugaugcugcccgugaugcuguucgugaagagacugagcuucugcagcagcauggugcugagccacagcuacugcuaccacguggaccugauccagcugagcugcaccgacaacagaaucaacagcauccugggccuguucgcccugcugagcaccaccggcuucgacugccccugcauccugcugagcuacauccugaucaucagaagcgugcugagcaucgccagcagcgaggagagaagaaaggccuucaacaccugcaccagccacaucagcgccgugagcaucuucuaccugccccugaucagccugagccuggugcacagauacggccacagcgccccccccuucgugcacaucaucauggccaacguguuccugcugaucccccccgugcugaaccccaucaucuacagcgugaagaucaagcagauccagaaggccaucaucaaggugcugauccagaagcacagcaagagcaaccaccagcuguuccugaucagagacaaggccaucuacgaguaa

SEQ ID NO: 21007 - RNA, 966 nt, Artificial Sequence
  OR51V1__Homo_sapiens__NP_001004760
auguuccugagcagcagaaugaucaccagcgugagccccagcaccagcaccaacagcagcuuccugcugaccggcuucagcggcauggagcagcaguaccccuggcugagcauccccuucagcagcaucuacgccauggugcugcugggcaacugcauggugcugcacgugaucuggaccgagcccagccugcaccagcccauguucuacuuccugagcaugcuggcccugaccgaccugugcaugggccugagcaccguguacaccgugcugggcauccuguggggcaucaucagagagaucagccuggacagcugcaucgcccagagcuacuucauccacggccugagcuucauggagagcagcgugcugcugaccauggccuucgacagauacaucgccaucugcaacccccugagauacagcagcauccugaccaacagcagaaucaucaagaucggccugaccaucaucggcagaagcuucuucuucaucaccccccccaucaucugccugaaguucuucaacuacugccacuuccacauccugagccacagcuucugccugcaccaggaccugcugagacuggccugcagcgacaucagauucaacagcuacuacgcccugaugcuggugaucugcauccugcugcuggacgccauccugauccuguucagcuacauccugauccugaagagcgugcuggccguggccagccaggaggagagacacaagcuguuccagaccugcaucagccacaucugcgccgugcugguguucuacauccccaucaucagccugaccauggugcacagauucggcaagcaccugagccccguggcccacgugcugaucggcaacaucuacauccuguuccccccccugaugaaccccaucaucuacagcgugaagacccagcagauccacaccagaaugcugagacuguucagccugaagagauacuaa

SEQ ID NO: 21008 - RNA, 972 nt, Artificial Sequence
  OR52B2__Homo_sapiens__NP_001004052
augagccacaccaacgugaccaucuuccaccccgccguguucgugcugcccggcauccccggccuggaggccuaccacaucuggcugagcaucccccugugccugaucuacaucaccgccgugcugggcaacagcauccugaucguggugaucgugauggagagaaaccugcacgugcccauguacuucuuccugagcaugcuggccgugauggacauccugcugagcaccaccaccgugcccaaggcccuggccaucuucuggcugcaggcccacaacaucgccuucgacgccugcgugacccagggcuucuucgugcacaugauguucgugggcgagagcgccauccugcuggccauggccuucgacagauucguggccaucugcgccccccugagauacaccaccgugcugaccuggcccguggugggcagaaucgcccuggccgugaucaccagaagcuucugcaucaucuuccccgugaucuuccugcugaagagacugcccuucugccugaccaacaucgugccccacagcuacugcgagcacaucggcguggccagacuggccugcgccgacaucaccgugaacaucugguacggcuucagcgugcccaucgugauggugauccuggacgugauccugaucgccgugagcuacagccugauccugagagccguguucagacugcccagccaggacgccagacacaaggcccugagcaccugcggcagccaccugugcgugauccugauguucuacgugcccagcuucuucacccugcugacccaccacuucggcagaaacaucccccagcacgugcacauccugcuggccaaccuguacguggccgugccccccaugcugaaccccaucguguacggcgugaagaccaagcagaucagagagggcguggcccacagauucuucgacaucaagaccuggugcugcaccagcccccugggcagcuaa

SEQ ID NO: 21009 - RNA, 945 nt, Artificial Sequence
  OR52B4__Homo_sapiens__NP_001005161
augcccaccgugaaccacagcggcaccagccacaccguguuccaccugcugggcauccccggccugcaggaccagcacauguggaucagcauccccuucuucaucagcuacgugaccgcccugcugggcaacagccugcugaucuucaucauccugaccaagagaagccugcacgagcccauguaccuguuccugugcaugcuggccggcgccgacaucgugcugagcaccugcaccaucccccaggcccuggccaucuucugguucagagccggcgacaucagccuggacagaugcaucacccagcuguucuucauccacagcaccuucaucagcgagagcggcauccugcuggugauggccuucgaccacuacaucgccaucugcuacccccugagauacaccaccauccugaccaacgcccugaucaagaagaucugcgugaccgugagccugagaagcuacggcaccaucuuccccaucaucuuccugcugaagagacugaccuucugccagaacaacaucaucccccacaccuucugcgagcacaucggccuggccaaguacgccugcaacgacaucagaaucaacaucugguacggcuucagcauccugaugagcaccguggugcuggacguggugcugaucuucaucagcuacaugcugauccugcacgccguguuccacaugcccagccccgacgccugccacaaggcccugaacaccuucggcagccacgugugcaucaucauccuguucuacggcagcggcaucuucaccauccugacccagagauucggcagacacaucccccccugcauccacaucccccuggccaacgugugcauccuggccccccccaugcugaaccccaucaucuacggcaucaagaccaagcagauccaggagcagguggugcaguuccuguucaucaagcagaaguaa

SEQ ID NO: 21010 - RNA, 957 nt, Artificial Sequence
  OR52D1__Homo_sapiens__NP_001005163
augagcgacagcaaccugagcgacaaccaccugcccgacaccuucuuccugaccggcauccccggccuggaggccgcccacuucuggaucgccauccccuucugcgccauguaccugguggcccuggugggcaacgccgcccugauccuggugaucgccauggacaacgcccugcacgcccccauguaccuguuccugugccugcugagccugaccgaccuggcccugagcagcaccaccgugcccaagaugcuggccauccuguggcugcacgccggcgagaucagcuucggcggcugccuggcccagauguucugcgugcacagcaucuacgcccuggagagcagcauccugcuggccauggccuucgacagauacguggccaucugcaacccccugagauacaccaccauccugaaccacgccgugaucggcagaaucggcuucgugggccuguucagaagcguggccaucgugagccccuucaucuuccugcugagaagacugcccuacugcggccacagagugaugacccacaccuacugcgagcacaugggcaucgccagacuggccugcgccaacaucaccgugaacaucguguacggccugaccguggcccugcuggccaugggccuggacagcauccugaucgccaucagcuacggcuucauccugcacgccguguuccaccugcccagccacgacgcccagcacaaggcccugagcaccugcggcagccacaucggcaucauccugguguucuacauccccgccuucuucagcuuccugacccacagauucggccaccacgaggugcccaagcacgugcacaucuuccuggccaaccuguacgugcuggugccccccgugcugaaccccauccuguacggcgccagaaccaaggagaucagaagcagacugcugaagcugcugcaccugggcaagaccagcaucuaa

SEQ ID NO: 21011 - RNA, 942 nt, Artificial Sequence
  OR52E6__Homo_sapiens__NP_001005167
augcccaucgccaacgacacccaguuccacaccagcagcuuccugcugcugggcauccccggccuggaggacgugcacaucuggaucggcuuccccuucuucagcguguaccugaucgcccugcugggcaacgccgccaucuucuucgugauccagaccgagcagagccugcacgagcccauguacuacugccuggccaugcuggacagcaucgaccugagccugagcaccgccaccauccccaagaugcugggcaucuucugguucaacaucaaggagaucagcuucggcggcuaccugagccagauguucuucauccacuucuucaccgugauggagagcaucgugcugguggccauggccuucgacagauacaucgccaucugcaagccccugugguacaccaugauccugaccagcaagaucaucagccugaucgccggcaucgccgugcugagaagccuguacauggugaucccccugguguuccugcugcugagacugcccuucugcggccacagaaucaucccccacaccuacugcgagcacaugggcaucgccagacuggccugcgccagcaucaaggugaacaucauguucggccugggcagcaucagccugcugcugcuggacgugcugcugaucauccugagccacaucagaauccuguacgccguguucugccugcccagcugggaggccagacugaaggcccugaacaccugcggcagccacaucggcgugauccuggccuucagcacccccgccuucuucagcuucuucacccacugcuucggccacgacaucccccaguacauccacaucuuccuggccaaccuguacgugguggugccccccacccugaaccccgugaucuacggcgugagaaccaagcacaucagagagaccgugcugagaaucuucuucaagaccgaccacuaa

SEQ ID NO: 21012 - RNA, 975 nt, Artificial Sequence
  OR52I1__Homo_sapiens__NP_001005169
augcugggccccgccuacaaccacaccauggagacccccgccagcuuccugcuggugggcauccccggccugcagagcagccaccuguggcuggccaucagccugagcgccauguacaucaccgcccugcugggcaacacccugaucgugaccgccaucuggauggacagcaccagacacgagcccauguacugcuuccugugcgugcuggccgccguggacaucgugauggccagcagcguggugcccaagauggugagcaucuucugcagcggcgacagcagcaucagcuucagcgccugcuucacccagauguucuucgugcaccuggccaccgccguggagaccggccugcugcugaccauggccuucgacagauacguggccaucugcaagccccugcacuacaagagaauccugaccccccaggugaugcugggcaugagcauggccgugaccaucagagccgugaccuucaugaccccccugagcuggaugaugaaccaccugcccuucugcggcagcaacgugguggugcacagcuacugcaagcacaucgcccuggccagacuggccugcgccgaccccgugcccagcagccuguacagccugaucggcagcagccugauggugggcagcgacguggccuucaucgccgccagcuacauccugauccugagagccguguucgaccugagcagcaagaccgcccagcugaaggcccugagcaccugcggcagccacgugggcgugauggcccuguacuaccugcccggcauggccagcaucuacgccgccuggcugggccaggacaucgugccccugcacacccaggugcugcuggccgaccuguacgugaucauccccgccacccugaaccccaucaucuacggcaugagaaccaagcagcugcuggagggcaucuggagcuaccugaugcacuuccuguucgaccacagcaaccugggcagcuaa

SEQ ID NO: 21013 - RNA, 1053 nt, Artificial Sequence
  OR52I2__Homo_sapiens__NP_001005170
augugccagcagauccugagagacugcauccugcugauccaccaccugugcaucaacagaaagaaggugagccuggugaugcugggccccgccuacaaccacaccauggagacccccgccagcuuccugcuggugggcauccccggccugcagagcagccaccuguggcuggccaucagccugagcgccauguacaucaucgcccugcugggcaacaccaucaucgugaccgccaucuggauggacagcaccagacacgagcccauguacugcuuccugugcgugcuggccgccguggacaucgugauggccagcagcguggugcccaagauggugagcaucuucugcagcggcgacagcagcaucagcuucagcgccugcuucacccagauguucuucgugcaccuggccaccgccguggagaccggccugcugcugaccauggccuucgacagauacguggccaucugcaagccccugcacuacaagagaauccugaccccccaggugaugcugggcaugagcauggccaucaccaucagagccaucaucgccaucaccccccugagcuggauggugagccaccugcccuucugcggcagcaacgugguggugcacagcuacugcgagcacaucgcccuggccagacuggccugcgccgaccccgugcccagcagccuguacagccugaucggcagcagccugauggugggcagcgacguggccuucaucgccgccagcuacauccugauccugaaggccguguucggccugagcagcaagaccgcccagcugaaggcccugagcaccugcggcagccacgugggcgugauggcccuguacuaccugcccggcauggccagcaucuacgccgccuggcugggccaggacguggugccccugcacacccaggugcugcuggccgaccuguacgugaucauccccgccacccugaaccccaucaucuacggcaugagaaccaagcagcugagagagagaaucuggagcuaccugaugcacgugcuguucgaccacagcaaccugggcagcuaa

SEQ ID NO: 21014 - RNA, 945 nt, Artificial Sequence
  OR52K1__Homo_sapiens__NP_001005171
augcugcccagcaacaucaccagcacccaccccgccguguuccugcuggugggcauccccggccuggagcaccugcacgccuggaucagcauccccuucugcuucgccuacacccuggcccugcugggcaacugcacccugcuguucaucauccaggccgacgccgcccugcacgagcccauguaccuguuccuggccaugcuggccaccaucgaccuggugcugagcagcaccacccugcccaagaugcuggccaucuucugguucagagaccaggagaucaacuucuucgccugccuggugcagauguucuuccugcacagcuucagcaucauggagagcgccgugcugcuggccauggccuucgacagauacguggccaucugcaagccccugcacuacaccaccgugcugaccggcagccugaucaccaagaucggcauggccgccguggccagagccgugacccugaugaccccccugcccuuccugcugagaagauuccacuacugcagaggccccgugaucgcccacugcuacugcgagcacauggccguggugagacuggccugcggcgacaccagcuucaacaacaucuacggcaucgccguggccauguucaucguggugcuggaccugcuguucgugauccugagcuacguguucauccugcaggccgugcugcagcuggccagccaggaggccagauacaaggccuucggcaccugcgugagccacaucggcgccauccugagcaccuacacccccguggugaucagcagcgugaugcacagaguggccagacacgccgcccccagagugcacauccugcuggccaucuucuaccugcuguucccccccauggugaaccccaucaucuacggcgugaagaccaagcagaucagagaguacgugcugagccuguuccagagaaagaacauguaa

SEQ ID NO: 21015 - RNA, 945 nt, Artificial Sequence
  OR52K2__Homo_sapiens__NP_001005172
augagcgccagcaacaucacccugacccaccccaccgccuuccugcuggugggcauccccggccuggagcaccugcacaucuggaucagcauccccuucugccuggccuacacccuggcccugcugggcaacugcacccugcugcugaucauccaggccgacgccgcccugcacgagcccauguaccuguuccuggccaugcuggccgccaucgaccuggugcugagcagcagcgcccugcccaagaugcuggccaucuucugguucagagacagagagaucaacuucuucgccugccuggcccagauguucuuccugcacagcuucagcaucauggagagcgccgugcugcuggccauggccuucgacagauacguggccaucugcaagccccugcacuacaccaaggugcugaccggcagccugaucaccaagaucggcauggccgccguggccagagccgugacccugaugaccccccugcccuuccugcugagaugcuuccacuacugcagaggccccgugaucgcccacugcuacugcgagcacauggccguggugagacuggccugcggcgacaccagcuucaacaacaucuacggcaucgccguggccauguucaucguggugcuggaccugcugcuggugauccugagcuacaucuucauccugcaggccgugcugcugcuggccagccaggaggccagauacaaggccuucggcaccugcgugagccacaucggcgccauccuggccuucuacaccaccguggugaucagcagcgugaugcacagaguggccagacacgccgccccccacgugcacauccugcuggccaacuucuaccugcuguucccccccauggugaaccccaucaucuacggcgugaagaccaagcagaucagagagagcauccugggcguguuccccagaaaggacauguaa

SEQ ID NO: 21016 - RNA, 954 nt, Artificial Sequence
  OR52M1__Homo_sapiens__NP_001004137
augcugaccuuccacaacgugugcagcgugcccagcagcuucuggcugaccggcauccccggccuggagagccugcacguguggcugagcauccccuucggcagcauguaccugguggccguggugggcaacgugaccauccuggccguggugaagaucgagagaagccugcaccagcccauguacuucuuccugugcaugcuggccgccaucgaccuggugcugagcaccagcaccauccccaagcugcugggcaucuucugguucggcgccugcgacaucggccuggacgccugccugggccagauguuccugauccacugcuucgccaccguggagagcggcaucuuccuggccauggccuucgacagauacguggccaucugcaacccccugagacacagcauggugcugaccuacaccguggugggcagacugggccuggugagccugcugagaggcgugcuguacaucggcccccugccccugaugaucagacugagacugccccuguacaagacccacgugaucagccacagcuacugcgagcacauggccgugguggcccugaccugcggcgacagcagagugaacaacguguacggccugagcaucggcuuccuggugcugauccuggacagcguggccaucgccgccagcuacgugaugaucuucagagccgugaugggccuggccacccccgaggccagacugaagacccugggcaccugcgccagccaccugugcgccauccugaucuucuacgugcccaucgccgugagcagccugauccacagauucggccagugcgugcccccccccgugcacacccugcuggccaacuucuaccugcugaucccccccauccugaaccccaucguguacgccgugagaaccaagcagaucagagagagccugcugcagauccccagaaucgagaugaagaucagauaa

SEQ ID NO: 21017 - RNA, 942 nt, Artificial Sequence
  OR5D18__Homo_sapiens__NP_001001952
augcugcugaccgacagaaacaccagcggcaccaccuucacccugcugggcuucagcgacuaccccgagcugcaggugccccuguuccugguguuccuggccaucuacaacgugaccgugcugggcaacaucggccugaucgugaucaucaagaucaaccccaagcugcacacccccauguacuucuuccugagccagcugagcuucguggacuucugcuacagcagcaucaucgcccccaagaugcuggugaaccugguggugaaggacagaaccaucagcuuccugggcugcguggugcaguucuucuucuucugcaccuucguggugaccgagagcuuccugcuggccgugauggccuacgacagauucguggccaucugcaacccccugcuguacaccgugaacaugagccagaagcugugcgugcugcugguggugggcagcuacgccuggggcgugagcugcagccuggagcugaccugcagcgcccugaagcugugcuuccacggcuucaacaccaucaaccacuucuucugcgaguucagcagccugcugagccugagcugcagcgacaccuacaucaaccaguggcugcuguucuuccuggccaccuucaacgagaucagcacccugcugaucgugcugaccagcuacgccuucaucguggugaccauccugaagaugagaagcgugagcggcagaagaaaggccuucagcaccugcgccagccaccugaccgccaucaccaucuuccacggcaccauccuguuccuguacugcgugcccaacagcaagaacagcagacacaccgugaagguggccagcguguucuacaccguggugauccccaugcugaacccccugaucuacagccugagaaacaaggacgugaaggacaccgugaccgagauccuggacaccaagguguucagcuacuaa

SEQ ID NO: 21018 - RNA, 945 nt, Artificial Sequence
  OR5H2__Homo_sapiens__NP_001005482
augagcaacgaggacauggagcaggacaacaccacccugcugaccgaguucgugcugaccggccugaccuaccagcccgaguggaagaugccccuguuccugguguuccuggugaucuaccugaucaccaucguguggaaccugggccugaucgcccugaucuggaacgacccccagcugcacauccccauguacuucuuccugggcagccuggccuucguggacgccuggaucagcagcaccgugacccccaagaugcuggugaacuuccuggccaagaacagaaugaucagccugagcgagugcaugauccaguucuucagcuucgccuucggcggcaccaccgagugcuuccugcuggccaccauggccuacgacagauacguggccaucugcaagccccugcuguaccccgugaucaugaacaacagccugugcaucagacugcuggccuucagcuuccugggcggcuuccugcacgcccugauccacgaggugcugaucuucagacugaccuucugcaacagcaacaucauccaccacuucuacugcgacaucaucccccuguucaugaucagcugcaccgaccccagcaucaacuuccugaugguguucauccugagcggcagcauccagguguucaccaucgugaccgugcugaacagcuacaccuucgcccuguucaccauccugaagaagaagagcgugagaggcgugagaaaggccuucagcaccugcggcgcccaccugcugagcgugagccuguacuacggcccccugaucuucauguaccugagacccgccagcccccaggccgacgaccaggacaugaucgacagcguguucuacaccaucaucaucccccugcugaaccccaucaucuacagccugagaaacaagcaggugaucgacagcuucaccaagauggugaagagaaacguguaa

SEQ ID NO: 21019 - RNA, 978 nt, Artificial Sequence
  OR5H6__Homo_sapiens__NP_001005479
auguuccuguaccugugcuucaucuuccagagaaccugcagcgaggagauggaggaggagaacgccacccugcugaccgaguucgugcugaccggcuuccugcaccagcccgacugcaagaucccccuguuccuggccuuccuggugaucuaccugaucaccaucaugggcaaccugggccugaucgugcugaucuggaaggacccccaccugcacauccccauguaccuguuccugggcagccuggccuucguggacgccagccugagcagcaccgugacccccaagaugcugaucaacuuccuggccaagagcaagaugaucagccugagcgagugcauggugcaguucuucagccuggugaccaccgugaccaccgagugcuuccugcuggccaccauggccuacgacagauacguggccaucugcaaggcccugcuguaccccgugaucaugaccaacgagcugugcauccagcugcuggugcugagcuucaucggcggccugcugcacgcccugauccacgaggccuucagcuucagacugaccuucugcaacagcaacaucauccagcacuucuacugcgacaucaucccccugcugaagaucagcugcaccgacagcagcaucaacuuccugaugguguucaucuucgccggcagcgugcagguguucaccaucggcaccauccugaucagcuacaccaucauccuguucaccauccuggagaagaagagcaucaagggcaucagaaaggccgugagcaccugcggcgcccaccugcugagcgugagccuguacuacggcccccugaccuucaaguaccugggcagcgccagcccccaggccgacgaccaggacaugauggagagccuguucuacaccgugaucgugccccugcugaaccccaugaucuacagccugagaaacaagcaggugaucgccagcuucaccaagauguucaagagcaacguguaa

SEQ ID NO: 21020 - RNA, 927 nt, Artificial Sequence
  OR5K1__Homo_sapiens__NP_001004736
auggccgaggagaaccacaccaugaagaacgaguucauccugaccggcuucaccgaccaccccgagcugaagacccugcuguucgugguguucuucgccaucuaccugaucaccguggugggcaacaucagccugguggcccugaucuucacccacagaagacugcacacccccauguacaucuuccugggcaaccuggcccugguggacagcugcugcgccugcgccaucacccccaagaugcuggagaacuucuucagcgagaacaagagaaucagccuguacgagugcgccgugcaguucuacuuccugugcaccguggagaccgccgacugcuuccugcuggccgccauggccuacgacagauacguggccaucugcaacccccugcaguaccacaucaugaugagcaagaagcugugcauccagaugaccaccggcgccuucaucgccggcaaccugcacagcaugauccacgugggccugguguucagacugguguucugcggcagcaaccacaucaaccacuucuacugcgacauccugccccuguacagacugagcugcguggaccccuacaucaacgagcuggugcuguucaucuucagcggcagcgugcagguguucaccaucggcagcgugcugaucagcuaccuguacauccugcugaccaucuucaagaugaagagcaaggagggcagagccaaggccuucagcaccugcgccagccacuuccugagcgugagccuguucuacggcagccuguucuucauguacgugagacccaaccugcuggaggagggcgacaaggacauccccgccgccauccuguucaccaucguggugccccugcugaaccccuucaucuacagccugagaaacagagaggugaucagcgugcugagaaagauccugaugaagaaguaa

SEQ ID NO: 21021 - RNA, 951 nt, Artificial Sequence
  OR5K2__Homo_sapiens__NP_001004737
augguggaggagaaccacaccaugaagaacgaguucauccugaccggcuucaccgaccaccccgagcugaagacccugcuguucgugguguucuucgccaucuaccugaucaccguggugggcaacaucagccugguggcccugaucuucacccacugcagacugcacacccccauguacaucuuccugggcaaccuggcccugguggacagcugcugcgccugcgccaucacccccaagaugcuggagaacuucuucagcgagggcaagagaaucagccuguacgagugcgccgugcaguucuacuuccugugcaccguggagaccgccgacugcuuccugcuggccgccguggccuacgacagauacguggccaucugcaacccccugcaguaccacaucaugaugagcaagaagcugugcauccagaugaccaccggcgccuucaucgccggcaaccugcacagcaugauccacgugggccugguguucagacugguguucugcggccugaaccacaucaaccacuucuacugcgacacccugccccuguacagacugagcugcguggaccccuucaucaacgagcuggugcuguucaucuucagcggcagcgugcagguguucaccaucggcagcgugcugaucagcuaccuguacauccugcugaccaucuucagaaugaagagcaaggagggcagagccaaggccuucagcaccugcgccagccacuucagcagcgugagccuguucuacggcagcaucuucuuccuguacaucagacccaaccugcuggaggagggcggcaacgacauccccgccgccauccuguucaccaucguggugccccugcugaaccccuucaucuacagccugagaaacaaggaggugaucagcgugcugagaaagauccugcugaagaucaagagccagggcagcgugaacaaguaa

SEQ ID NO: 21022 - RNA, 966 nt, Artificial Sequence
  OR5V1__Homo_sapiens__NP_110503
auggagagaaagaaccagaccgccaucaccgaguucaucauccugggcuucagcaaccugaacgagcugcaguuccugcuguucaccaucuucuuccugaccuacuucugcacccugggcggcaacauccugaucauccugaccaccgugaccgacccccaccugcacacccccauguacuacuuccugggcaaccuggccuucaucgacaucugcuacaccaccagcaacgugccccagaugauggugcaccugcugagcaagaagaagagcaucagcuacgugggcugcguggugcagcuguucgccuucguguucuucgugggcagcgagugccugcugcuggccgccauggccuacgacagauacaucgccaucugcaacccccugagauacagcgugauccugagcaaggugcugugcaaccagcuggccgccagcugcugggccgccggcuuccugaacagcguggugcacaccgugcugaccuucugccugcccuucugcggcaacaaccagaucaacuacuucuucugcgacauccccccccugcugauccugagcugcggcaacaccagcgugaacgagcuggcccugcugagcaccggcguguucaucggcuggacccccuuccugugcaucgugcugagcuacaucugcaucaucagcaccauccugagaauccagagcagcgagggcagaagaaaggccuucagcaccugcgccagccaccuggccaucguguuccuguucuacggcagcgccaucuucaccuacgugagacccaucagcaccuacagccugaagaaggacagacuggugagcgugcuguacagcguggugacccccaugcugaaccccaucaucuacacccugagaaacaaggacaucaaggaggccgugaagaccaucggcagcaaguggcagccccccaucagcagccuggacagcaagcugaccuacuaa

SEQ ID NO: 21023 - RNA, 936 nt, Artificial Sequence
  OR6B1__Homo_sapiens__NP_001005281
auggagcuggagaaccagaccagagugaccaaguucauccuggugggcuuccccggcagccugagcaugagagccgccauguuccugaucuuccugguggccuacauccugaccguggccgagaacgugaucaucauccugcuggugcugcagaacagaccccugcacaagcccauguacuucuuccuggccaaccugagcuuccuggagaccugguacaucagcgugaccgugcccaagcugcuguucagcuucuggagcgugaacaacagcaucagcuucacccugugcaugauccagcuguacuucuucaucgcccugaugugcaccgagugcgugcugcuggccgccauggccuacgacagauacguggccaucugcagaccccugcacuaccccaccaucaugagccacggccugugcuucagacuggcccugggcagcugggccaucggcuucggcaucagccuggccaagaucuacuucaucagcugccugagcuucugcggccccaacgugaucaaccacuucuucugcgacaucagccccgugcugaaccugagcugcaccgacaugagcaucaccgagcugguggacuucauccuggcccuggugaucuuccuguucccccuguucaucaccgugcugagcuacggcugcauccuggccaccauccugugcaugcccaccggcaagcagaaggccuucagcaccugcgccagccaccuggugguggugaccaucuucuacagcgccaucaucuucauguacgccagacccagagugauccacgccuucaacaugaacaagaucaucagcaucuucuacgccaucgugacccccagccugaaccccuucaucuacugccugagaaacagagaggugaaggaggcccugaagaagcuggccuacugccaggccagcagaagcgacuaa

SEQ ID NO: 21024 - RNA, 939 nt, Artificial Sequence
  OR6B2__Homo_sapiens__NP_001005853
augagcggcgagaacgugaccaaggugagcaccuucauccuggugggccugcccaccgcccccggccugcaguaccugcuguuccugcuguuccugcugaccuaccuguucgugcugguggagaaccuggccaucauccugaucguguggagcagcaccagccugcacagacccauguacuacuuccugagcagcaugagcuuccuggagaucugguacgugagcgacaucacccccaagaugcuggagggcuuccugcugcagcagaagagaaucagcuucgugggcugcaugacccagcuguacuucuucagcagccuggugugcaccgagugcgugcugcuggccagcauggccuacgacagauacguggccaucugccacccccugagauaccacgugcuggugacccccggccugugccugcagcuggugggcuucagcuucgugagcggcuucaccaucagcaugaucaaggugugcuucaucagcagcgugaccuucugcggcagcaacgugcugaaccacuucuucugcgacaucagccccauccugaagcuggccugcaccgacuucagcaccgccgagcugguggacuucauccuggccuucaucauccugguguucccccugcuggccaccauccugagcuacuggcacaucacccuggccgugcugagaauccccagcgccaccggcugcuggagagccuucagcaccugcgccagccaccugaccguggugaccguguucuacaccgcccugcuguucauguacgugagaccccaggccaucgacagccagagcagcaacaagcugaucagcgccguguacaccguggugacccccaucaucaacccccugaucuacugccugagaaacaaggaguucaaggacgcccugaagaaggcccugggccugggccagaccagccacuaa

SEQ ID NO: 21025 - RNA, 939 nt, Artificial Sequence
  OR6C1__Homo_sapiens__NP_001005182
augagaaaccacaccgagaucaccgaguucauccugcugggccugaccgacgaccccaacuuccagguggugaucuucguguuccugcugaucaccuacaugcugagcaucaccggcaaccugacccugaucaccaucacccugcuggacagccaccugcagacccccauguacuucuuccugagaaacuucagcauccuggagaucagcuucaccaccgugagcauccccaaguuccugggcaacaucaucagcggcgacaagaccaucagcuucaacaacugcaucgugcagcuguucuucuucauccugcugggcgugaccgaguucuaccugcuggccgccaugagcuacgacagauacguggccaucugcaagccccugcacugccugagcaucaugaacagaagagugugcacccugcugguguucaccagcuggcuggugagcuuccugaucaucuuccccgcccugaugcugcugcugaagcugcacuacugcagaagcaacaucaucgaccacuucaccugcgacuacuucccccugcugcagcuggccugcagcgacaccaaguuccuggaggugaugggcuucagcugcgccgccuucacccugauguucacccuggcccugaucuuccugagcuacaucuacaucaucagaaccauccugagaauccccagcaccagccagagaaccaaggccuucagcaccugcagcagccacauggugguggugagcaucagcuacggcagcugcaucuucauguacaucaagcccagcgccaaggacagagugagccugagcaagggcguggccauccugaacaccagcguggcccccaugaugaaccccuucaucuacagccugagaaaccagcaggugaagcaggccuucaucaacauggccagaaagaccguguucuucaccagcaccuaa

SEQ ID NO: 21026 - RNA, 927 nt, Artificial Sequence
  OR6F1__Homo_sapiens__NP_001005286
auggacaccggcaacaagacccugccccaggacuuccugcugcugggcuuccccggcagccagacccugcagcugagccuguucaugcuguuccuggugauguacauccugaccgugagcggcaacguggccauccugaugcuggugagcaccagccaccagcugcacacccccauguacuucuuccugagcaaccugagcuuccuggagaucugguacaccaccgccgccgugcccaaggcccuggccauccugcugggcagaagccagaccaucagcuucaccagcugccugcugcagauguacuucguguucagccugggcugcaccgaguacuuccugcuggccgccauggccuacgacagaugccuggccaucugcuacccccugcacuacggcgccaucaugagcagccugcugagcgcccagcuggcccugggcagcugggugugcggcuucguggccaucgccgugcccaccgcccugaucagcggccugagcuucugcggccccagagccaucaaccacuucuucugcgacaucgcccccuggaucgcccuggccugcaccaacacccaggccguggagcugguggccuucgugaucgccgugguggugauccugagcagcugccugaucaccuucgugagcuacguguacaucaucagcaccauccugagaauccccagcgccagcggcagaagcaaggccuucagcaccugcagcagccaccugaccguggugcugaucugguacggcagcaccguguuccugcacgugagaaccagcaucaaggacgcccuggaccugaucaaggccgugcacgugcugaacaccguggugacccccgugcugaaccccuucaucuacacccugagaaacaaggaggugagagagacccugcugaagaaguggaagggcaaguaa

SEQ ID NO: 21027 - RNA, 975 nt, Artificial Sequence
  OR6K2__Homo_sapiens__NP_001005279
auggagagccccaacagaaccaccauccaggaguucaucuucagcgccuuccccuacagcugggugaagagcguggugugcuucgugccccugcuguucaucuacgccuucaucguggugggcaaccuggugaucaucaccguggugcagcugaacacccaccugcacacccccauguacaccuucaucagcgcccugagcuuccuggagaucugguacaccaccgccaccauccccaagaugcugagcagccugcugagcgagagaagcaucagcuucaacggcugccugcugcagauguacuucuuccacagcaccggcaucugcgaggugugccugcugaccgugauggccuucgaccacuaccuggccaucugcagcccccugcacuaccccagcaucaugacccccaagcugugcacccagcugacccugagcugcugcgugugcggcuucaucaccccccugcccgagaucgccuggaucagcacccugcccuucugcggcagcaaccaccuggagcacaucuucugcgacuuccugcccgugcugagacuggccugcaccgacaccagagccaucgugaugauccaggugguggacgugauccacgccguggagaucaucaccgccgugaugcugaucuucaugagcuacgacggcaucguggccgugauccugagaauccacagcgccggcggcagaagaaccgccuucagcaccugcgugagccacuucaucguguucagccuguucuucggcagcgugacccugauguaccugagauucagcgccaccuacagccuguucugggacaucgccaucgcccuggccuucgccgugcugagccccuucuucaaccccaucaucuacagccugagaaacaaggagaucaaggaggccaucaagaagcacaucggccaggccaagaucuucuucagcgugagacccggcaccagcagcaagaucuucuaa

SEQ ID NO: 21028 - RNA, 948 nt, Artificial Sequence
  OR6K3__Homo_sapiens__NP_001005327
auggagagcggcaaccagagcaccgugaccgaguucaucuucaccggcuucccccagcugcaggacggcagccugcuguacuucuucccccugcuguucaucuacaccuucaucaucaucgacaaccugcugaucuucagcgccgugagacuggacacccaccugcacaaccccauguacaacuucaucagcaucuucagcuuccuggagaucugguacaccaccgccaccauccccaagaugcugagcaaccugaucagcgagaagaaggccaucagcaugaccggcugcauccugcagauguacuucuuccacagccuggagaacagcgagggcauccugcugaccaccauggccaucgacagauacguggccaucugcaacccccugagauaccagaugaucaugacccccagacugugcgcccagcugagcgccggcagcugccuguucggcuuccugauccugcugcccgagaucgugaugaucagcacccugcccuucugcggccccaaccagauccaccagaucuucugcgaccuggugcccgugcugagccuggccugcaccgacaccagcaugauccugaucgaggacgugauccacgccgugaccaucaucaucaccuuccugaucaucgcccugagcuacgugagaaucgugaccgugauccugagaauccccagcagcgagggcagacagaaggccuucagcaccugcgccggccaccugaugguguuccccaucuucuucggcagcgugagccugauguaccugagauucagcgacaccuacccccccgugcuggacaccgccaucgcccugauguucaccgugcuggcccccuucuucaaccccaucaucuacagccugagaaacaaggacaugaacaacgccaucaagaagcuguucugccugcagaaggugcugaacaagcccggcggcuaa

SEQ ID NO: 21029 - RNA, 1032 nt, Artificial Sequence
  OR6K6__Homo_sapiens__NP_001005184
augaagcaguacagcgugggcaaccagcacagcaacuacagaagccugcuguuccccuuccugugcagccagaugacccagcugaccgccagcggcaaccagaccauggugaccgaguuccuguucagcauguucccccacgcccacagaggcggccugcuguucuucaucccccugcugcugaucuacggcuucauccugaccggcaaccugaucauguucaucgugauccaggugggcauggcccugcacaccccccuguacuucuucaucagcgugcugagcuuccuggagaucugcuacaccaccaccaccauccccaagaugcugagcugccugaucagcgagcagaagagcaucagcguggccggcugccugcugcagauguacuucuuccacagccugggcaucaccgagagcugcgugcugaccgccauggccaucgacagauacaucgccaucugcaacccccugagauaccccaccaucaugauccccaagcugugcauccagcugaccgugggcagcugcuucugcggcuuccugcuggugcugcccgagaucgccuggaucagcacccugcccuucugcggcagcaaccagauccaccagaucuucugcgacuucacccccgugcugagccuggccugcaccgacaccuuccugguggugaucguggacgccauccacgccgccgagaucguggccagcuuccuggugaucgcccugagcuacaucagaaucaucaucgugauccugggcaugcacagcgccgagggccaccacaaggccuucagcaccugcgccgcccaccuggccguguuccugcuguucuucggcagcguggccgugauguaccugagauucagcgccaccuacagcguguucugggacaccgccaucgccgugaccuucgugauccuggcccccuucuucaaccccaucaucuacagccugaagaacaaggacaugaaggaggccaucggcagacuguuccacuaccagaagagagccggcugggccggcaaguaa

SEQ ID NO: 21030 - RNA, 939 nt, Artificial Sequence
  OR6N1__Homo_sapiens__NP_001005185
auggacaccggcaacuggagccagguggccgaguucaucauccugggcuucccccaccugcagggcgugcagaucuaccuguuccugcugcugcugcugaucuaccugaugaccgugcugggcaaccugcugaucuuccugguggugugccuggacagcagacugcacacccccauguaccacuucgugagcauccugagcuucagcgagcugggcuacaccgccgccaccauccccaagaugcuggccaaccugcugagcgagaagaagaccaucagcuucagcggcugccugcugcagaucuacuucuuccacagccugggcgccaccgagugcuaccugcugaccgccauggccuacgacagauaccuggccaucugcagaccccugcacuaccccacccugaugacccccacccugugcgccgagaucgccaucggcugcuggcugggcggccuggccggccccgugguggagaucagccugaucagcagacugcccuucugcggccccaacagaauccagcacguguucugcgacuucccccccgugcugagccuggccugcaccgacaccagcaucaacgugcugguggacuucgugaucaacagcugcaagauccuggccaccuuccugcugauccugugcagcuacgugcagaucaucugcaccgugcugagaauccccagcgccgccggcaagagaaaggccaucagcaccugcgccagccacuucaccguggugcugaucuucuacggcagcauccugagcauguacgugcagcugaagaagagcuacagccuggacuacgaccaggcccuggccgugguguacagcgugcugacccccuuccugaaccccuucaucuacagccugagaaacaaggagaucaaggaggccgugagaagacagcugaagagaaucggcauccuggccuaa

SEQ ID NO: 21031 - RNA, 954 nt, Artificial Sequence
  OR6N2__Homo_sapiens__NP_001005278
auggaccaguacaaccacagcagccuggccgaguucguguuccugggcuucgccagcgugggcuacgugagaggcuggcuguucgugcugcugcugcuggccuaccuguucaccaucugcggcaacaugcugaucuucagcgugaucagacuggacgccgcccugcacacccccauguaccacuucgugagcgugcugagcuuccuggagcugugguacaccgccaccaccauccccaagaugcugagcaacauccugagcgagaagaagaccaucagcuucgccggcugccugcugcagaccuacuucuuccacagccugggcgccagcgagugcuaccugcugaccgccauggccuacgacagauaccuggccaucugcagaccccugcacuaccccaucaucaugaccaccacccugugcgccaagauggccgccgccugcuggaccugcggcuuccugugccccaucagcgaggugauccuggccagccagcugcccuucugcgccuacaacgagauccagcacaucuucugcgacuuccccccccugcugagccuggccugcaaggacaccagcgccaacauccugguggacuucgccaucaacgccuucaucauccugaucaccuucuucuucaucaugaucagcuacgccagaaucaucggcgccgugcugaagaucaagaccgccagcggcagaaagaaggccuucagcaccugcgccagccaccuggccguggugcugaucuucuucggcagcaucaucuucauguacgugagacugaagaagagcuacagccugacccuggacagaacccuggccaucguguacagcgugcugacccccauggugaaccccaucaucuacagccugagaaacaaggagaucaucaaggccaucaagagaaccaucuuccagaagggcgacaaggccagccuggcccaccuguaa

SEQ ID NO: 21032 - RNA, 939 nt, Artificial Sequence
  OR6X1__Homo_sapiens__NP_001005188
augagaaacggcaccgugaucaccgaguucauccugcugggcuuccccgugauccagggccugcagaccccccuguucaucgccaucuuccugaccuacauccugacccuggccggcaacggccugaucaucgccaccgugugggccgagcccagacugcagauccccauguacuucuuccugugcaaccugagcuuccuggagaucugguacaccaccaccgugauccccaagcugcugggcaccuucgugguggccagaaccgugaucugcaugagcugcugccugcugcaggccuucuuccacuucuucgugggcaccaccgaguuccugauccugaccaucaugagcuucgacagauaccugaccaucugcaacccccugcaccaccccaccaucaugaccagcaagcugugccugcagcuggcccugagcagcuggguggugggcuucaccaucguguucugccagaccaugcugcugauccagcugcccuucugcggcaacaacgugaucagccacuucuacugcgacgugggccccagccugaaggccgccugcaucgacaccagcauccuggagcugcugggcgugaucgccaccauccuggugauccccggcagccugcuguucaacaugaucagcuacaucuacauccugagcgccauccugagaauccccagcgccaccggccaccagaagaccuucagcaccugcgccagccaccugaccguggugagccugcuguacggcgccgugcuguucauguaccugagacccaccgcccacagcagcuucaagaucaacaagguggugagcgugcugaacaccauccugaccccccugcugaaccccuucaucuacaccaucagaaacaaggaggugaagggcgcccugagaaaggccaugaccugccccaagaccggccacgccaaguaa

SEQ ID NO: 21033 - RNA, 978 nt, Artificial Sequence
  OR6Y1__Homo_sapiens__NP_001005189
augaccaccaucauccuggagguggacaaccacaccgugaccaccagauucauccugcugggcuuccccaccagacccgccuuccagcugcuguucuucagcaucuuccuggccaccuaccugcugacccugcuggagaaccugcugaucauccuggccauccacagcgacggccagcugcacaagcccauguacuucuuccugagccaccugagcuuccuggagaugugguacgugaccgugaucagccccaagaugcugguggacuuccugagccacgacaagagcaucagcuucaacggcugcaugacccagcuguacuucuucgugaccuucgugugcaccgaguacauccugcuggccaucauggccuucgacagauacguggccaucugcaacccccugagauaccccgugaucaugaccaaccagcugugcggcacccuggccggcggcugcugguucugcggccugaugaccgccaugaucaagaugguguucaucgcccagcugcacuacugcggcaugccccagaucaaccacuacuucugcgacaucagcccccugcugaacgugagcugcgaggacgccagccaggccgagaugguggacuucuuccuggcccugauggugaucgccaucccccugugcguggugguggccagcuacgccgccauccuggccaccauccugagaauccccagcgcccagggcagacagaaggccuucagcaccugcgccagccaccugaccguggugauccuguucuacagcaugacccuguucaccuacgccagacccaagcugauguacgccuacaacagcaacaagguggugagcgugcuguacaccgugaucgugccccugcugaaccccaucaucuacugccugagaaaccacgaggugaaggccgcccugagaaagaccauccacugcagaggcagcggcccccagggcaacggcgccuucagcagcuaa

SEQ ID NO: 21034 - RNA, 963 nt, Artificial Sequence
  OR7C1__Homo_sapiens__NP_945182
auggagaccggcaaccagacccacgcccaggaguuccugcugcugggcuucagcgccaccagcgagauccaguucauccuguucggccuguuccugagcauguaccuggugaccuucaccggcaaccugcugaucauccuggccaucugcagcgacagccaccugcacacccccauguacuucuuccugagcaaccugagcuucgccgaccugugcuucaccagcaccaccgugcccaagaugcugcugaacauccugacccagaacaaguucaucaccuacgccggcugccugagccagaucuucuucuucaccagcuucggcugccuggacaaccugcugcugaccgugauggccuacgacagauucguggccgugugccacccccugcacuacaccgugaucaugaacccccagcugugcggccugcuggugcugggcagcuggugcaucagcgugaugggcagccugcuggagacccugaccgugcugagacugagcuucugcaccgagauggagaucccccacuucuucugcgaccugcuggaggugcugaagcuggccugcagcgacaccuucaucaacaacguggugaucuacuucgccaccggcgugcugggcgugaucagcuucaccggcaucuucuucagcuacuacaagaucguguucagcauccugagaaucagcagcgccggcagaaagcacaaggccuucagcaccugcggcagccaccugagcguggugacccuguucuacggcaccggcuucggcguguaccugagcagcgccgccacccccagcagcagaaccagccugguggccagcgugauguacaccauggugacccccaugcugaaccccuucaucuacagccugagaaacaccgacaugaagagagcccugggcagacugcugagcagagccaccuucuucaacggcgacaucaccgccggccugagcuaa

SEQ ID NO: 21035 - RNA, 939 nt, Artificial Sequence
  OR7D2__Homo_sapiens__NP_787079
auggaggccggcaaccagaccggcuuccuggaguucauccugcugggccugagcgaggaccccgagcugcagcccuucaucuucggccuguuccugagcauguaccuggugaccgugcugggcaaccugcugaucauccuggccaucagcagcgacagccaccugcacacccccauguacuucuuccugagcaaccugagcuggguggacaucugcuucagcaccugcaucgugcccaagaugcuggugaacauccagaccgagaacaaggccaucagcuacauggacugccugacccagguguacuucagcauguucuuccccauccuggacacccugcugcugaccgugauggccuacgacagauucguggccgugugccacccccugcacuacaugaucaucaugaacccccaccugugcggccugcugguguucgugaccuggcugaucggcgugaugaccagccugcugcacaucagccugaugaugcaccugaucuucugcaaggacuucgagaucccccacuucuucugcgagcugaccuacauccugcagcuggccugcagcgacaccuuccugaacagcacccugaucuacuucaugaccggcgugcugggcguguucccccugcugggcaucaucuucagcuacagcagaaucgccagcagcaucagaaagaugagcagcagcggcggcaagcagaaggcccugagcaccugcggcagccaccugagcguggugagccuguucuacggcaccggcaucggcgugcacuucaccagcgccgugacccacagcagccagaagaucagcguggccagcgugauguacaccguggugacccccaugcugaaccccuucaucuacagccugagaaacaaggacgugaagggcgcccugggcagccugcugagcagagccgccagcugccuguaa

SEQ ID NO: 21036 - RNA, 1020 nt, Artificial Sequence
  OR7E24__Homo_sapiens__NP_001073404
augagcuacuuccccauccuguucuucuucuuccugaagagaugccccagcuacaccgagccccagaaccugaccggcgugagcgaguuccugcugcugggccugagcgaggaccccgagcugcagcccgugcuggccggccuguuccugagcauguaccuggugaccgugcugggcaaccugcugaucauccuggccgugagcagcgacagccaccugcacacccccauguacuucuuccugagcaaccugagccuggccgacaucggcuucaccagcaccaccgugcccaagaugaucguggacaugcagacccacagcagagugaucagcuacgagggcugccugacccagaugagcuucuucgugcuguucgccugcauggacgacaugcugcugagcgugauggccuacgacagauucguggccaucugccacccccugcacuacagaaucaucaugaaccccagacugugcggcuuccugauccugcugagcuucuucaucagccugcuggacagccagcugcacaaccugaucaugcugcagcugaccugcuucaaggacguggacaucagcaacuucuucugcgaccccagccagcugcugcaccugagaugcagcgacaccuucaucaacgagauggugaucuacuucaugggcgccaucuucggcugccugcccaucagcggcauccuguucagcuacuacaagaucgugagccccauccugagagugcccaccagcgacggcaaguacaaggccuucagcaccugcggcagccaccuggccguggugugccuguucuacggcaccggccuggugggcuaccugagcagcgccgugcugcccagccccagaaagagcaugguggccagcgugauguacaccguggugacccccaugcugaaccccuucaucuacagccugagaaacaaggacauccagagcgcccugugcagacugcacggcagaaucaucaagagccaccaccugcaccccuucugcuacaugggcuaa

SEQ ID NO: 21037 - RNA, 1080 nt, Artificial Sequence
  OR8S1__Homo_sapiens__NP_001005203
auggcccugggcaaccacagcaccaucaccgaguuccugcugcugggccugagcgccgaccccaacaucagagcccugcuguucgugcuguuccugggcaucuaccugcugaccaucauggagaaccugaugcugcugcugaugaucagagccgacagcugccugcacaagcccauguacuucuuccugagccaccugagcuucguggaccugugcuucagcagcgugaucgugcccaagaugcuggagaaccugcugagccagagaaagaccaucagcguggagggcugccuggcccagguguucuucguguucgugaccgccggcaccgaggccugccugcugagcggcauggccuacgacagacacgccgccaucugcagaccccugcuguacggccagaucaugggcaagcagcuguacaugcaccugguguggggcagcuggggccugggcuuccuggacgcccugaucaacgugcugcuggccgugaacaugguguucugcgaggccaagaucauccaccacuacagcuacgagaugcccagccugcugccccugagcugcagcgacaucagcagaagccugaucgcccugcugugcagcacccugcugcacggccugggcaacuuccugcugguguuccugagcuacaccagaaucaucagcaccauccugagcaucagcagcaccagcggcagaagcaaggccuucagcaccugcagcgcccaccugaccgccgugacccuguacuacggcagcggccugcugagacaccugaugcccaacagcggcagccccaucgagcugaucuucagcgugcaguacaccguggugacccccaugcugaacagccugaucuacagccugaagaacaaggaggugaagggcgagagaagccugagagacagcagccaccugccccagcugcacaagggccaggccagauggaagagacccgccuucaccgagggcagaagagagcccggccaccccgagcugagcauccccgugaccccccagccccagggcgccugcgccugcagcgcccugagagccgcccccaccgcccugcccuaa

SEQ ID NO: 21038 - RNA, 1008 nt, Artificial Sequence
  OR9K2__Homo_sapiens__NP_001005243
augcugggcagcaagcccagagugcaccuguacauccugcccugcgccagccagcaggugagcaccaugggcgacagaggcaccagcaaccacagcgagaugaccgacuucauccuggccggcuucagagugagacccgagcugcacauccugcuguuccugcuguuccuguucguguacgccaugauccugcugggcaacgugggcaugaugaccaucaucaugaccgaccccagacugaacacccccauguacuucuuccugggcaaccugagcuucaucgaccuguucuacagcagcgugaucgagcccaaggccaugaucaacuucuggagcgagaacaagagcaucagcuucgccggcugcguggcccagcuguuccuguucgcccugcugaucgugaccgagggcuuccugcuggccgccauggccuacgacagauucaucgccaucugcaacccccugcuguacagcgugcagaugagcaccagacugugcacccagcugguggccggcagcuacuucugcggcugcaucagcagcgugauccagaccagcaugaccuucacccugagcuucugcgccagcagagccguggaccacuucuacugcgacagcagaccccugcagagacugagcugcagcgaccuguucauccacagaaugaucagcuucagccugagcugcaucaucauccugcccaccaucaucgugaucaucgugagcuacauguacaucgugagcaccgugcugaagauccacagcaccgagggccacaagaaggccuucagcaccugcagcagccaccugggcguggugagcgugcuguacggcgccguguucuucauguaccugacccccgacagauuccccgagcugagcaagguggccagccugugcuacagccuggugacccccaugcugaacccccugaucuacagccugagaaacaaggacgugcaggaggcccugaagaaguuccuggagaagaagaacaucauccuguaa

SEQ ID NO: 21039 - RNA, 945 nt, Artificial Sequence
  OR9Q2__Homo_sapiens__NP_001005283
auggccgagagaaacuacaccguggugaccgaguucuuccugaccgccuucaccgagcaccugcaguggagagugccccuguuccugaucuuccugagcuucuaccuggccaccaugcugggcaacaccggcaugauccugcugaucagaggcgacagaagacugcacacccccauguacuucuuccugagccaccugagccugguggacaucugcuacagcagcgccaucaucccccagaugcuggccgugcugugggagcacggcaccaccaucagccaggccagaugcgccgcccaguucuuccuguucaccuucuucgccagcaucgacugcuaccugcuggccaucauggccuacgacagauacaccgccgugugccagccccugcuguacgugaccaucaucaccgagaaggccagauggggccuggugaccggcgccuacguggccggcuucuucagcgccuucgugagaaccgugaccgccuucacccugagcuucugcggcaacaacgagaucaacuucaucuucugcgaccugcccccccugcugaagcugagcugcggcgacagcuacacccaggagguggugaucaucguguucgcccuguucgugaugcccgccugcauccuggugauccuggugagcuaccuguucaucaucguggccauccugcagauccacagcgccggcggcagagccaagaccuucagcaccugcgccagccaccugaccgccguggcccuguucuucggcacccugaucuucauguaccugagagacaacaccggccagagcagcgagggcgacagaguggugagcgugcuguacaccguggugacccccaugcugaacccccugaucuacagccugagaaacaaggaggugaaggaggccaccagaaaggcccugagcaagagcaagcccgccagaagacccuaa

SEQ ID NO: 21040 - RNA, 906 nt, Artificial Sequence
  ORAI1__Homo_sapiens__NP_116179
augcaccccgagcccgcccccccccccagcagaagcagccccgagcugccccccagcggcggcagcaccaccagcggcagcagaagaagcagaagaagaagcggcgacggcgagccccccggcgcccccccccccccccccagcgccgugaccuaccccgacuggaucggccagagcuacagcgaggugaugagccugaacgagcacagcaugcaggcccugagcuggagaaagcuguaccugagcagagccaagcugaaggccagcagcagaaccagcgcccugcugagcggcuucgccaugguggccaugguggaggugcagcuggacgccgaccacgacuacccccccggccugcugaucgccuucagcgccugcaccaccgugcugguggccgugcaccuguucgcccugaugaucagcaccugcauccugcccaacaucgaggccgugagcaacgugcacaaccugaacagcgugaaggagagcccccacgagagaaugcacagacacaucgagcuggccugggccuucagcaccgugaucggcacccugcuguuccuggccgagguggugcugcugugcugggugaaguuccugccccugaagaagcagcccggccagcccagacccaccagcaagccccccgccagcggcgccgccgccaacgugagcaccagcggcaucacccccggccaggccgccgccaucgccagcaccaccaucauggugcccuucggccugaucuucaucguguucgccgugcacuucuacagaagccuggugagccacaagaccgacagacaguuccaggagcugaacgagcuggccgaguucgccagacugcaggaccagcuggaccacagaggcgaccacccccugacccccggcagccacuacgccuaa

SEQ ID NO: 21041 - RNA, 888 nt, Artificial Sequence
  ORAI3__Homo_sapiens__NP_689501
augaagggcggcgagggcgacgccggcgagcaggccccccugaaccccgagggcgagagccccgccggcagcgccaccuacagagaguucgugcacagaggcuaccuggaccugaugggcgccagccagcacagccugagagcccugagcuggagaagacuguaccugagcagagccaagcugaaggccagcagcagaaccagcgcccugcugagcggcuucgccaugguggccaugguggaggugcagcuggagagcgaccacgaguacccccccggccugcugguggccuucagcgccugcaccaccgugcugguggccgugcaccuguucgcccugauggugagcaccugccugcugccccacaucgaggccgugagcaacauccacaaccugaacagcgugcaccagagcccccaccagagacugcacagauacguggagcuggccuggggcuucagcaccgcccugggcaccuuccuguuccuggccgagguggugcuggugggcugggugaaguucgugcccaucggcgccccccuggacacccccacccccauggugcccaccagcagagugcccggcacccuggcccccguggccaccagccugagccccgccagcaaccugcccagaagcagcgccagcgccgcccccagccaggccgagcccgccugcccccccagacaggccugcggcggcggcggcgcccacggccccggcuggcaggccgccauggccagcaccgccaucauggugcccgugggccugguguucguggccuucgcccugcacuucuacagaagccugguggcccacaagaccgacagauacaagcaggagcuggaggagcugaacagacugcagggcgagcugcaggccguguaa

SEQ ID NO: 21042 - RNA, 414 nt, Artificial Sequence
  ORAOV1__Homo_sapiens__NP_703152
auggccggcagccaggacaucuucgacgccaucgugauggccgacgagagauuccacggcgagggcuacagagagggcuacgaggagggcagcagccugggcgugauggagggcagacagcacggcacccugcacggcgccaagaucggcagcgagaucggcugcuaccagggcuucgccuucgccuggaagugccugcugcacagcugcaccaccgagaaggacagcagaaagaugaaggugcuggagagccugaucggcaugauccagaaguuccccuacgacgaccccaccuacgacaagcugcacgaggaccuggacaagaucagaggcaaguucaagcaguucugcagccugcugaacgugcagcccgacuucaagaucagcgccgagggcagcggccugagcuucuaa

SEQ ID NO: 21043 - RNA, 1734 nt, Artificial Sequence
  ORC2__Homo_sapiens__NP_006181
augagcaagcccgagcugaaggaggacaagaugcuggaggugcacuucgugggcgacgacgacgugcugaaccacauccuggacagagagggcggcgccaagcugaagaaggagagagcccagcugcuggugaaccccaagaagaucaucaagaagcccgaguacgaccuggaggaggacgaccaggaggugcugaaggaccagaacuacguggagaucaugggcagagacgugcaggagagccugaagaacggcagcgccaccggcggcggcaacaagguguacagcuuccagaacagaaagcacagcgagaagauggccaagcuggccagcgagcuggccaagaccccccagaagagcgugagcuucagccugaagaacgaccccgagaucaccaucaacgugccccagagcagcaagggccacagcgccagcgacaaggugcagcccaagaacaacgacaagagcgaguuccugagcaccgcccccagaagccugagaaagagacugaucgugcccagaagccacagcgacagcgagagcgaguacagcgccagcaacagcgaggacgacgagggcguggcccaggagcacgaggaggacaccaacgccgugaucuucagccagaagauccaggcccagaacagaguggugagcgcccccgugggcaaggagacccccagcaagagaaugaagagagacaagaccagcgaccugguggaggaguacuucgaggcccacagcagcagcaaggugcugaccagcgacagaacccugcagaagcugaagagagccaagcuggaccagcagacccugagaaaccugcugagcaaggugagccccagcuucagcgccgagcugaagcagcugaaccagcaguacgagaagcuguuccacaaguggaugcugcagcugcaccugggcuucaacaucgugcuguacggccugggcagcaagagagaccugcuggagagauucagaaccaccaugcugcaggacagcauccacguggugaucaacggcuucuuccccggcaucagcgugaagagcgugcugaacagcaucaccgaggaggugcuggaccacaugggcaccuucagaagcauccuggaccagcuggacuggaucgugaacaaguucaaggaggacagcagccuggagcuguuccugcugauccacaaccuggacagccagaugcugagaggcgagaagagccagcagaucaucggccagcugagcagccugcacaacaucuaccugaucgccagcaucgaccaccugaacgccccccugaugugggaccacgccaagcagagccuguucaacuggcugugguacgagaccaccaccuacagccccuacaccgaggagaccagcuacgagaacagccugcuggugaagcagagcggcagccugccccugagcagccugacccacgugcugagaagccugacccccaacgccagaggcaucuucagacugcugaucaaguaccagcuggacaaccaggacaaccccagcuacaucggccugagcuuccaggacuucuaccagcagugcagagaggccuuccuggugaacagcgaccugacccugagagcccagcugaccgaguucagagaccacaagcugaucagaaccaagaagggcaccgacggcguggaguaccugcugauccccguggacaacggcacccugaccgacuuccuggagaaggaggaggaggaggccuaa

SEQ ID NO: 21044 - RNA, 1707 nt, Artificial Sequence
  ORC3__Homo_sapiens__NP_001184188
augaagcacuuccugcagaagcugaucagccagcugauggacugcugcguggacaucaagagcaaggaggaggagagcgugcacgugacccagagaaagacccacuacagcauggacagccugagcagcugguacaugaccgugacccagaagaccgaccccaagaugcugagcaagaagagaaccaccagcagccaguggcagagcccccccgugguggugauccugaaggacauggagagcuucgccaccaaggugcugcaggacuucaucaucaucagcagccagcaccugcacgaguucccccugauccugaucuucggcaucgccaccagccccaucaucauccacagacugcugccccacgccgugagcagccugcugugcaucgagcuguuccagagccugagcugcaaggagcaccugaccaccgugcuggacaagcugcugcugaccacccaguuccccuucaagaucaacgagaaggugcugcaggugcugaccaacaucuuccuguaccacgacuucagcgugcagaacuucaucaagggccugcagcugagccugcuggagcacuucuacagccagccccugagcgugcugugcugcaaccugcccgaggccaagagaagaaucaacuuccugagcaacaaccagugcgagaacaucagaagacugcccagcuucagaagauacguggagaagcaggccagcgagaagcagguggcccugcugaccaacgagagauaccugaaggaggagacccagcugcugcuggagaaccugcacguguaccacaugaacuacuuccuggugcugagaugccugcacaaguucaccagcagccugcccaaguacccccugggcagacagaucagagagcuguacugcaccugccuggagaagaacaucugggacagcgaggaguacgccagcgugcugcagcugcugagaaugcuggccaaggacgagcugaugaccauccuggagaagugcuucaagguguucaagagcuacugcgagaaccaccugggcagcaccgccaagagaaucgaggaguuccuggcccaguuccagagccuggacgagaccaaggaggaggaggacgccagcggcagccagcccaagggccugcagaagaccgaccuguaccaccugcagaagagccugcuggagaugaaggagcugagaagaagcaagaagcagaccaaguucgaggugcugagagagaacguggugaacuucaucgacugccuggugagagaguaccugcugccccccgagacccagccccugcacgaggugguguacuucagcgccgcccacgcccugagagagcaccugaacgccgcccccagaaucgcccugcacaccgcccugaacaaccccuacuacuaccugaagaacgaggcccugaagagcgaggagggcugcauccccaacaucgcccccgacaucugcaucgccuacaagcugcaccuggagugcagcagacugaucaaccugguggacuggagcgaggccuucgccaccguggugaccgccgccgagaagauggacgccaacagcgccaccagcgaggagaugaacgagaucauccacgccagauucaucagagccgugagcgagcuggagcugcugggcuucaucaagcccaccaagcagaagaccgaccacguggccagacugaccuggggcggcugcuaa

SEQ ID NO: 21045 - RNA, 1059 nt, Artificial Sequence
  ORC4__Homo_sapiens__NP_001177810
auggagaucgaggaggugagcgagaacgugcugcaggugcaccugaacggccugcugcagaucaacgacaagaucgcccugaaggagaucaccagacagcugaaccuggagaacguggugggcgacaagguguucggcagcuucgccgagaaccugagcuuccugcuggaggcccugaagaagggcgacagaaccagcagcugccccgugaucuucauccuggacgaguucgaccuguucgcccaccacaagaaccagacccugcuguacaaccuguucgacaucagccagagcgcccagacccccaucgccgugaucggccugaccugcagacuggacauccuggagcugcuggagaagagagugaagagcagauucagccacagacagauccaccugaugaacagcuucggcuucccccaguacgugaagaucuucaaggagcagcugagccugcccgccgaguuccccgacaagguguucgccgagaaguggaacgagaacgugcaguaccugagcgaggacagaagcgugcaggaggugcugcagaagcacuucaacaucagcaagaaccugagaagccugcacaugcugcugaugcuggcccugaacagagugaccgccagccaccccuucaugaccgccguggaccugauggaggccagccagcugugcagcauggacagcaaggccaacaucgugcacggccugagcgugcuggagaucugccugaucaucgccaugaagcaccugaacgacaucuacgaggaggagcccuucaacuuccagaugguguacaacgaguuccagaaguucgugcagagaaaggcccacagcguguacaacuucgagaagcccguggugaugaaggccuucgagcaccugcagcagcuggagcugaucaagcccauggagagaaccagcggcaacagccagagagaguaccagcugaugaagcugcugcuggacaacacccagaucaugaacgcccugcagaaguaccccaacugccccaccgacgugagacagugggccaccagcagccugagcuggcuguaa

SEQ ID NO: 21046 - RNA, 1308 nt, Artificial Sequence
  ORC5__Homo_sapiens__NP_002544
augccccaccuggagaacguggugcugugcagagagagccaggugagcauccugcagagccuguucggcgagagacaccacuucagcuuccccagcaucuucaucuacggccacaccgccagcggcaagaccuacgugacccagacccugcugaagacccuggagcugccccacguguucgugaacugcguggagugcuucacccugagacugcugcuggagcagauccugaacaagcugaaccaccugagcagcagcgaggacggcugcagcaccgagaucaccugcgagaccuucaacgacuucgugagacuguucaagcaggugaccaccgccgagaaccugaaggaccagaccguguacaucgugcuggacaaggccgaguaccugagagacauggaggccaaccugcugcccggcuuccugagacugcaggagcuggccgacagaaacgugaccgugcuguuccugagcgagaucgugugggagaaguucagacccaacaccggcugcuucgagcccuucgugcuguacuuccccgacuacagcaucggcaaccugcagaagauccugagccacgaccacccccccgaguacagcgccgacuucuacgccgccuacaucaacauccugcugggcguguucuacaccgugugcagagaccugaaggagcugagacaccuggccgugcugaacuuccccaaguacugcgagcccguggugaagggcgaggccagcgagagagacaccagaaagcuguggagaaacaucgagccccaccugaagaaggccaugcagaccguguaccugagagagaucagcagcagccagugggagaagcugcagaaggacgacaccgaccccggccagcugaagggccugagcgcccacacccacguggagcugcccuacuacagcaaguucauccugaucgccgccuaccuggccagcuacaaccccgccagaaccgacaagagauucuuccugaagcaccacggcaagaucaagaagaccaacuuccugaagaagcacgagaagaccagcaaccaccugcugggccccaagcccuucccccuggacagacugcuggccauccuguacagcaucguggacagcagaguggcccccaccgccaacaucuucagccagaucaccagccuggugacccugcagcugcugacccuggugggccacgacgaccagcuggacggccccaaguacaagugcaccgugagccuggacuucaucagagccaucgccagaaccgugaacuucgacaucaucaaguaccuguacgacuuccuguaa

SEQ ID NO: 21047 - RNA, 759 nt, Artificial Sequence
  ORC6__Homo_sapiens__NP_055136
augggcagcgagcugaucggcagacuggcccccagacugggccuggccgagcccgacaugcugagaaaggccgaggaguaccugagacugagcagagugaagugcgugggccugagcgccagaaccaccgagaccagcagcgccgugaugugccuggaccuggccgccagcuggaugaagugcccccuggacagagccuaccugaucaagcugagcggccugaacaaggagaccuaccagagcugccugaagagcuucgagugccugcugggccugaacagcaacaucggcaucagagaccuggccgugcaguucagcugcaucgaggccgugaacauggccagcaagauccugaagagcuacgagagcagccugccccagacccagcagguggaccuggaccugagcagaccccuguucaccagcgccgcccugcugagcgccugcaagauccugaagcugaagguggacaagaacaagaugguggccaccagcggcgugaagaaggccaucuucgacagacugugcaagcagcuggagaagaucggccagcagguggacagagagcccggcgacguggccaccccccccagaaagagaaagaagaucgugguggaggcccccgccaaggagauggagaagguggaggagaugccccacaagccccagaaggacgaggaccugacccaggacuacgaggaguggaagagaaagauccuggagaacgccgccagcgcccagaaggccaccgccgaguaa

SEQ ID NO: 21048 - RNA, 606 nt, Artificial Sequence
  ORM1__Homo_sapiens__NP_000598
auggcccugagcugggugcugaccgugcugagccugcugccccugcuggaggcccagaucccccugugcgccaaccuggugcccgugcccaucaccaacgccacccuggacagaaucaccggcaagugguucuacaucgccagcgccuucagaaacgaggaguacaacaagagcgugcaggagauccaggccaccuucuucuacuucacccccaacaagaccgaggacaccaucuuccugagagaguaccagaccagacaggaccagugcaucuacaacaccaccuaccugaacgugcagagagagaacggcaccaucagcagauacgugggcggccaggagcacuucgcccaccugcugauccugagagacaccaagaccuacaugcuggccuucgacgugaacgacgagaagaacuggggccugagcguguacgccgacaagcccgagaccaccaaggagcagcugggcgaguucuacgaggcccuggacugccugagaauccccaagagcgacgugguguacaccgacuggaagaaggacaagugcgagccccuggagaagcagcacgagaaggagagaaagcaggaggagggcgagagcuaa

SEQ ID NO: 21049 - RNA, 606 nt, Artificial Sequence
  ORM2__Homo_sapiens__NP_000599
auggcccugagcugggugcugaccgugcugagccugcugccccugcuggaggcccagaucccccugugcgccaaccuggugcccgugcccaucaccaacgccacccuggacagaaucaccggcaagugguucuacaucgccagcgccuucagaaacgaggaguacaacaagagcgugcaggagauccaggccaccuucuucuacuucacccccaacaagaccgaggacaccaucuuccugagagaguaccagaccagacagaaccagugcuucuacaacagcagcuaccugaacgugcagagagagaacggcaccgugagcagauacgagggcggcagagagcacguggcccaccugcuguuccugagagacaccaagacccugauguucggcagcuaccuggacgacgagaagaacuggggccugagcuucuacgccgacaagcccgagaccaccaaggagcagcugggcgaguucuacgaggcccuggacugccugugcauccccagaagcgacgugauguacaccgacuggaagaaggacaagugcgagccccuggagaagcagcacgagaaggagagaaagcaggaggagggcgagagcuaa

SEQ ID NO: 21050 - RNA, 462 nt, Artificial Sequence
  ORMDL3__Homo_sapiens__NP_001307731
augaacgugggcaccgcccacagcgaggugaaccccaacaccagagugaugaacagcagaggcaucuggcugagcuacgugcuggccaucggccugcugcacaucgugcugcugagcauccccuucgugagcgugcccgugguguggacccugaccaaccugauccacaacaugggcauguacaucuuccugcacaccgugaagggcacccccuucgagacccccgaccagggcaaggccagacugcugacccacugggagcagauggacuacggcgugcaguucaccgccagcagaaaguuccugaccaucacccccaucgugcuguacuuccugaccagcuucuacaccaaguacgaccagauccacuucgugcugaacaccgugagccugaugagcgugcugauccccaagcugccccagcugcacggcgugagaaucuucggcaucaacaaguacuaa

SEQ ID NO: 21051 - RNA, 1839 nt, Artificial Sequence
  OS9__Homo_sapiens__NP_001017956
auggccgccgagacccugcugagcagccugcugggccugcugcugcugggccugcugcugcccgccagccugaccggcggcgugggcagccugaaccuggaggagcugagcgagaugagauacggcaucgagauccugccccugcccgugaugggcggccagagccagagcagcgacguggugaucgugagcagcaaguacaagcagagauacgagugcagacugcccgccggcgccauccacuuccagagagagagagaggaggagacccccgccuaccagggccccggcauccccgagcugcugagccccaugagagacgcccccugccugcugaagaccaaggacugguggaccuacgaguucugcuacggcagacacauccagcaguaccacauggaggacagcgagaucaagggcgaggugcuguaccugggcuacuaccagagcgccuucgacugggacgacgagaccgccaaggccagcaagcagcacagacugaagagauaccacagccagaccuacggcaacggcagcaagugcgaccugaacggcagacccagagaggccgaggugagauuccugugcgacgagggcgccggcaucagcggcgacuacaucgacagaguggacgagccccugagcugcagcuacgugcugaccaucagaacccccagacugugcccccacccccugcugagacccccccccagcgccgccccccaggccauccugugccaccccagccugcagcccgaggaguacauggccuacgugcagagacaggccgacagcaagcaguacggcgacaagaucaucgaggagcugcaggaccugggcccccagguguggagcgagaccaagagcggcguggccccccagaagauggccggcgccagccccaccaaggacgacagcaaggacagcgacuucuggaagaugcugaacgagcccgaggaccaggcccccggcggcgaggaggugcccgccgaggagcaggaccccagccccgaggccgccgacagcgccagcggcgcccccaacgacuuccagaacaacgugcaggugaaggugaucagaagccccgccgaccugaucagauucaucgaggagcugaagggcggcaccaagaagggcaagcccaacaucggccaggagcagcccguggacgacgccgccgaggugccccagagagagcccgagaaggagagaggcgaccccgagagacagagagagauggaggaggaggaggacgaggacgaggacgaggacgaggacgaggacgagagacagcugcugggcgaguucgagaaggagcuggagggcauccugcugcccagcgacagagacagacugagaagcgaggugaaggccggcauggagagagagcuggagaacaucauccaggagaccgagaaggagcuggaccccgacggccugaagaaggagagcgagagagacagagccaugcuggcccugaccagcacccugaacaagcugaucaagagacuggaggagaagcagagccccgagcuggugaagaagcacaagaagaagagaguggugcccaagaagcccccccccagcccccagcccaccggcaagaucgagaucaagaucgugagacccugggccgagggcaccgaggagggcgccagauggcugaccgacgaggacaccagaaaccugaaggagaucuucuucaacauccuggugcccggcgccgaggaggcccagaaggagagacagagacagaaggagcuggagagcaacuacagaagaguguggggcagccccggcggcgagggcaccggcgaccuggacgaguucgacuucuaa

SEQ ID NO: 21052 - RNA, 2253 nt, Artificial Sequence
  OSBP2__Homo_sapiens__NP_001269667
augcacagacagagaaccagaaccaugagcagccuggccgccaagagacugggcaugaacagaagacccgccggcagcggcggcggcggcggcgaggccgccaccuggggccacagauucuggagaccccaggagagacccaccgacagaaaccagggcgagauggcccacaccugcagaggcaccaucaaccugagcaccgcccacaucgacaccgaggacagcugcggcauccugcugaccagcggcgccagaagcuaccaccugaaggccagcagcgagguggacagacagcaguggaucaccgcccuggagcuggccaaggccaaggccgugagagugaugaacacccacagcgacgacagcggcgacgacgacgaggccaccacccccgccgacaagagcgagcugcaccacacccugaagaaccugagccugaagcuggacgaccugagcaccugcaacgaccugaucgccaagcacggcgccgcccugcagagaagccugaccgagcuggacggccugaagauccccagcgagagcggcgagaagcugaagguggugaacgagagagccacccuguucagaaucaccagcaacgccaugaucaacgccugcagagacuuccuggagcuggccgagauccacagcagaaaguggcagagagcccugcaguacgagcaggagcagagagugcaccuggaggagaccaucgagcagcuggccaagcagcacaacagccuggagagagccuuccacagcgcccccggcagacccgccaaccccagcaagagcuucaucgagggcagccugcugacccccaagggcgaggacagcgaggaggacgaggacaccgaguacuucgacgccauggaggacagcaccagcuucaucaccgugaucaccgaggccaaggaggacagaaaggccgagggcagcaccggcaccagcagcguggacuggagcagcgccgacaacgugcuggacggcgccagccuggugcccaagggcagcagcaaggugaagagaagagugagaauccccaacaagcccaacuacagccugaaccuguggagcaucaugaagaacugcaucggcagagagcugagcagaauccccaugcccgugaacuucaacgagccccugagcaugcugcagagacugaccgaggaccuggaguaccaccaccugcuggacaaggccgugcacugcaccagcagcguggagcagaugugccugguggccgccuucagcgugagcagcuacagcaccaccgugcacagaaucgccaagcccuucaaccccaugcugggcgagaccuucgagcuggacagacuggacgacaugggccugagaagccugugcgagcaggugagccaccacccccccagcgccgcccacuacguguucagcaagcacggcuggagccuguggcaggagaucaccaucagcagcaaguucagaggcaaguacaucagcaucaugccccugggcgccauccaccuggaguuccaggccagcggcaaccacuacguguggagaaagagcaccagcaccgugcacaacaucaucgugggcaagcuguggaucgaccagagcggcgacaucgagaucgugaaccacaagaccaacgacagaugccagcugaaguuccugcccuacagcuacuucagcaaggaggccgccagaaaggugaccggcguggugagcgacagccagggcaaggcccacuacgugcugagcggcagcugggacgagcagauggagugcagcaaggugaugcacagcagccccagcagccccagcagcgacggcaagcagaagaccguguaccagacccugagcgccaagcugcuguggaagaaguacccccugcccgagaacgccgagaacauguacuacuucagcgagcuggcccugacccugaacgagcacgaggagggcguggcccccaccgacagcagacugagacccgaccagagacugauggagaagggcagaugggacgaggccaacaccgagaagcagagacuggaggagaagcagagacugagcagaagaagaagacuggaggccugcggccccggcagcagcugcagcagcgaggaggagaaggaggccgacgccuacaccccccugugguucgagaagagacuggacccccugaccggcgagauggccugcguguacaagggcggcuacugggaggccaaggagaagcaggacuggcacaugugccccaacaucuucuaa

SEQ ID NO: 21053 - RNA, 2424 nt, Artificial Sequence
  OSBP__Homo_sapiens__NP_002547
auggccgccaccgagcugagaggcguggugggccccggccccgccgccaucgccgcccugggcggcggcggcgccggcccccccguggugggcggcggcggcggcagaggcgacgccggccccggcagcggcgccgccagcggcaccgugguggccgccgccgccggcggccccggccccggcgccggcggcguggccgccgccggccccgcccccgccccccccaccggcggcagcggcggcagcggcgccggcggcagcggcagcgccagagagggcuggcuguucaaguggaccaacuacaucaagggcuaccagagaagaugguucgugcugagcaacggccugcugagcuacuacagaagcaaggccgagaugagacacaccugcagaggcaccaucaaccuggccaccgccaacaucaccguggaggacagcugcaacuucaucaucagcaacggcggcgcccagaccuaccaccugaaggccagcagcgagguggagagacagagaugggugaccgcccuggagcuggccaaggccaaggccgugaagaugcuggccgagagcgacgagagcggcgacgaggagagcgugagccagaccgacaagaccgagcugcagaacacccugagaacccugagcagcaagguggaggaccugagcaccugcaacgaccugaucgccaagcacggcaccgcccugcagagaagccugagcgagcuggagagccugaagcugcccgccgagagcaacgagaagaucaagcaggugaacgagagagccacccuguucagaaucaccagcaacgccaugaucaacgccugcagagacuuccugaugcuggcccagacccacagcaagaaguggcagaagagccugcaguacgagagagaccagagaaucagacuggaggagacccuggagcagcuggccaagcagcacaaccaccuggagagagccuucagaggcgccaccgugcugcccgccaacacccccggcaacgugggcagcggcaaggaccagugcugcagcggcaagggcgacaugagcgacgaggacgacgagaacgaguucuucgacgcccccgagaucaucaccaugcccgagaaccugggccacaagagaaccggcagcaacaucagcggcgccagcagcgacaucagccuggacgagcaguacaagcaccagcuggaggagaccaagaaggagaagagaaccagaauccccuacaagcccaacuacagccugaaccuguggagcaucaugaagaacugcaucggcaaggagcugagcaagauccccaugcccgugaacuucaacgagccccugagcaugcugcagagacugaccgaggaccuggaguaccacgagcugcuggacagagccgccaagugcgagaacagccuggagcagcugugcuacguggccgccuucaccgugagcagcuacagcaccaccguguucagaaccagcaagcccuucaacccccugcugggcgagaccuucgagcuggacagacuggaggagaacggcuacagaagccugugcgagcaggugagccaccacccccccgccgccgcccaccacgccgagagcaagaacggcuggacccugagacaggagaucaagaucaccagcaaguucagaggcaaguaccugagcaucaugccccugggcaccauccacugcaucuuccacgccaccggccaccacuacaccuggaagaaggugaccaccaccgugcacaacaucaucgugggcaagcuguggaucgaccagagcggcgagaucgacaucgugaaccacaagaccggcgacaagugcaaccugaaguucgugcccuacagcuacuucagcagagacguggccagaaaggugaccggcgaggugaccgaccccagcggcaaggugcacuucgcccugcugggcaccugggacgagaagauggagugcuucaaggugcagcccgugaucggcgagaacggcggcgacgccagacagagaggccacgaggccgaggagagcagagugaugcuguggaagagaaacccccugcccaagaacgccgagaacauguacuacuucagcgagcuggcccugacccugaacgccugggagagcggcaccgcccccaccgacagcagacugagacccgaccagagacugauggagaacggcagaugggacgaggccaacgccgagaagcagagacuggaggagaagcagagacugagcagaaagaagagagaggccgaggccaugaaggccaccgaggacggcacccccuacgaccccuacaaggcccugugguucgagagaaagaaggaccccgugaccaaggagcugacccacaucuacagaggcgaguacugggagugcaaggagaagcaggacuggagcagcugccccgacaucuucuaa

SEQ ID NO: 21054 - RNA, 2103 nt, Artificial Sequence
  OSBPL10__Homo_sapiens__NP_001167531
auggagagagccgugcagggcaccgacggcggcggcggcagcaacagcagcagcagaagcagcagcagagccaccagcgccggcagcagccccagcugcagccuggccggcagaggcgugagcagcagaagcgccgccgccggccugggcggcggcggcagcagaagcagccccggcagcguggccgccagccccagcggcggcggcggcagaagaagagagcccgcccuggagggcgugcugagcaaguacaccaaccugcugcagggcuggcagaacagauacuucgugcuggacuucgaggccggcauccugcaguacuucgugaacgagcagagcaagcaccagaagcccagaggcgugcugagccugagcggcgccaucgugagccugagcgacgaggccccccacaugcuggugguguacagcgccaacggcgagauguucaagcugagagccgccgacgccaaggagaagcaguucugggugacccagcugagagccugcgccaaguaccacauggagaugaacagcaagaugaugaaccagguggagggccagcagaagaaccuggugcacgccaucgagagccugcccggcagcggcccccugaccgcccuggaccaggaccugcugcugcugaaggccaccagcgccgccacccugagcugccugggcgagugccugaaccugcugcagcagagcgugcaccaggccggccagcccagccagaagcccggcgccagcgagaacauccugggcuggcacggcagcaagagccacagcaccgagcagcugaagaacggcacccugggcagccugcccagcgccagcgccaacaucaccugggccauccugcccaacagcgccgaggacgagcagaccagccagcccgagcccgagcccaacagcggcagcgagcuggugcugagcgaggacgagaagagcgacaacgaggacaaggaggagaccgagcugggcgugauggaggaccagagaagcaucauccugcaccugaucagccagcugaagcugggcauggaccugaccaagguggugcugcccaccuucauccuggagaagagaagccugcuggagauguacgccgacuucauggcccaccccgaccugcugcuggccaucaccgccggcgccacccccgaggagagagugaucugcuucguggaguacuaccugaccgccuuccacgagggcagaaagggcgcccuggccaagaagcccuacaaccccaucaucggcgagaccuuccacugcagcugggaggugcccaaggacagagugaagcccaagagaaccgccagcagaagccccgccagcugccacgagcaccccauggccgacgaccccagcaagagcuacaagcugagauucguggccgagcaggugagccaccacccccccaucagcugcuucuacugcgagugcgaggagaagagacugugcgugaacacccacguguggaccaagagcaaguucaugggcaugagcgugggcgugagcaugaucggcgagggcgugcugagacugcuggagcacggcgaggaguacguguucacccugcccagcgccuacgccagaagcauccugaccauccccuggguggagcugggcggcaaggugagcaucaacugcgccaagaccggcuacagcgccaccgugaucuuccacaccaagcccuucuacggcggcaaggugcacagagugaccgccgaggugaagcacaaccccaccaacaccaucgugugcaaggcccacggcgaguggaacggcacccuggaguucaccuacaacaacggcgagaccaaggugaucgacaccaccacccugcccguguaccccaagaagaucagaccccuggagaagcagggccccauggagagcagaaaccuguggagagaggugaccagauaccugagacugggcgacaucgacgccgccaccgagcagaagagacaccuggaggagaagcagagaguggaggagagaaagagagagaaccugagaacccccuggaagcccaaguacuucauccaggagggcgacggcuggguguacuucaacccccuguggaaggcccacuaa

SEQ ID NO: 21055 - RNA, 2244 nt, Artificial Sequence
  OSBPL11__Homo_sapiens__NP_073613
augcagggcggcgagcccgugagcaccaugaaggugagcgagagcgagggcaagcuggagggccaggccaccgccgugacccccaacaagaacagcagcugcggcggcggcaucagcagcagcagcagcagcagaggcggcagcgccaagggcuggcaguacagcgaccacauggagaacguguacggcuaccugaugaaguacaccaaccuggugaccggcuggcaguacagauucuucgugcugaacaacgaggccggccugcuggaguacuucgugaacgagcagagcagaaaccagaagcccagaggcacccugcagcuggccggcgccgugaucagccccagcgacgaggacagccacaccuucaccgugaacgccgccagcggcgagcaguacaagcugagagccaccgacgccaaggagagacagcacugggugagcagacugcagaucugcacccagcaccacaccgaggccaucggcaagaacaaccccccccugaagagcagaagcuucagccuggccagcagcagcaacagccccaucagccagagaagacccagccagaacgccaucagcuucuucaacgugggccacagcaagcugcagagccugagcaagagaaccaaccugccccccgaccaccugguggaggugagagagaugaugagccacgccgagggccagcagagagaccugaucagaagaaucgagugccugcccaccagcggccaccugagcagccuggaccaggaccugcugaugcugaaggccaccagcauggccaccaugaacugccugaacgacugcuuccacauccugcagcugcagcacgccagccaccagaagggcagccugcccagcggcaccaccaucgaguggcuggagcccaagaucagccugagcaaccacuacaagaacggcgccgaccagcccuucgccaccgaccagagcaagcccguggccgugcccgaggagcagcccguggccgagagcggccugcuggccagagagcccgaggagaucaacgccgacgacgagaucgaggacaccugcgaccacaaggaggacgaccugggcgccguggaggagcagagaagcgugauccugcaccugcugagccagcugaagcugggcauggaccugaccagaguggugcugcccaccuucauccuggagaagagaagccugcuggagauguacgccgacuucaugagccaccccgaccuguucaucgccaucaccaacggcgccaccgccgaggacagaaugaucagauucguggaguacuaccugaccagcuuccacgagggcagaaagggcgccaucgccaagaagcccuacaaccccaucaucggcgagaccuuccacugcagcuggaagaugcccaagagcgagguggccagcagcguguucagcagcagcagcacccagggcgugaccaaccacgccccccugagcggcgagagccugacccaggugggcagcgacugcuacaccgugagauucguggccgagcaggugagccaccacccccccgugagcggcuucuacgccgagugcaccgagagaaagaugugcgugaacgcccacguguggaccaagagcaaguuccugggcaugagcaucggcgugaccauggugggcgagggcauccugagccugcuggagcacggcgaggaguacaccuucagccugcccugcgccuacgccagaagcauccugaccgugcccuggguggagcugggcggcaaggugagcgugaacugcgccaagaccggcuacagcgccagcaucaccuuccacaccaagcccuucuacggcggcaagcugcacagagugaccgccgaggugaagcacaacaucaccaacaccguggugugcagagugcagggcgaguggaacagcgugcuggaguucaccuacagcaacggcgagaccaaguacguggaccugaccaagcuggccgugaccaagaagagagugagaccccuggagaagcaggaccccuucgagagcagaagacuguggaagaacgugaccgacagccugagagagagcgagaucgacaaggccaccgagcacaagcacacccuggaggagagacagagaaccgaggagagacacagaaccgagaccggcacccccuggaagaccaaguacuucaucaaggagggcgacggcuggguguaccacaagccccuguggaagaucauccccaccacccagcccgccgaguaa

SEQ ID NO: 21056 - RNA, 1314 nt, Artificial Sequence
  OSBPL1A__Homo_sapiens__NP_060500
augagcgaggagaaggacugcggcggcggcgacgcccugagcaacggcaucaagaagcacagaaccagccugcccagccccauguucagcagaaacgacuucagcaucuggagcauccugagaaagugcaucggcauggagcugagcaagaucaccaugcccgugaucuucaacgagccccugagcuuccugcagagacugaccgaguacauggagcacaccuaccugauccacaaggccagcagccugagcgaccccguggagagaaugcagugcguggccgccuucgccgugagcgccguggccagccagugggagagaaccggcaagcccuucaacccccugcugggcgagaccuacgagcuggugagagacgaccugggcuucagacugaucagcgagcaggugagccaccacccccccaucagcgccuuccacgccgagggccugaacaacgacuucaucuuccacggcagcaucuaccccaagcugaaguucuggggcaagagcguggaggccgagcccaagggcaccaucacccuggagcugcuggagcacaacgaggccuacaccuggaccaaccccaccugcugcgugcacaacaucaucgugggcaagcuguggaucgagcaguacggcaacguggagaucaucaaccacaagaccggcgacaagugcgugcugaacuucaagcccugcggccuguucggcaaggagcugcacaagguggagggcuacauccaggacaagagcaagaagaagcugugcgcccuguacggcaaguggaccgagugccuguacagcguggaccccgccaccuucgacgccuacaagaagaacgacaagaagaacaccgaggagaagaagaacagcaagcagaugagcaccagcgaggagcuggacgagaugcccgugcccgacagcgagagcguguucaucauccccggcagcgugcugcuguggagaaucgcccccagaccccccaacagcgcccagauguacaacuucaccagcuucgccauggugcugaacgagguggacaaggacauggagagcgugauccccaagaccgacugcagacugagacccgacaucagagccauggagaacggcgagaucgaccaggccagcgaggagaagaagagacuggaggagaagcagagagccgccagaaagaacagaagcaagagcgaggaggacuggaagaccagaugguuccaccagggccccaaccccuacaacggcgcccaggacuggaucuacagcggcagcuacugggacagaaacuacuucaaccugcccgacaucuacuaa

SEQ ID NO: 21057 - RNA, 1113 nt, Artificial Sequence
  OSBPL2__Homo_sapiens__NP_001265578
augcccaucgccuucaacgagccccugagcuuccugcagagaaucaccgaguacauggagcacguguaccugauccacagagccagcugccagccccagccccuggagagaaugcagagcguggccgccuucgccgugagcgccguggccagccagugggagagaaccggcaagcccuucaacccccugcugggcgagaccuacgagcugaucagagaggaccugggcuucagauucaucagcgagcaggugagccaccacccccccaucagcgccuuccacagcgagggccugaaccacgacuuccuguuccacggcagcaucuaccccaagcugaaguucuggggcaagagcguggaggccgagcccagaggcaccaucacccuggagcugcugaagcacaacgaggccuacaccuggaccaaccccaccugcugcgugcacaacgugaucaucggcaagcuguggaucgagcaguacggcaccguggagauccugaaccacagaaccggccacaagugcgugcugcacuucaagcccugcggccuguucggcaaggagcugcacaagguggagggccacauccaggacaagaacaagaagaagcuguucaugaucuacggcaaguggaccgagugccuguggggcaucgaccccgugagcuacgagagcuucaagaagcaggagagaagaggcgaccaccugagaaaggccaagcuggacgaggacagcggcaaggccgacagcgacguggccgacgacgugcccguggcccaggagaccgugcaggugauccccggcagcaagcugcuguggagaaucaacaccagaccccccaacagcgcccagaucuggcccgccagaagaagaagcggcuggagaagaagcagagagaagcacggcggcagcggccccagaagaagacagagcggcagaagaggcggcagcacccaggccaucacccccacccugggcccccccaccggcugcaugcagggcaucacccugagcggcaucagccccaccgcccagaucagcaccgagggccuggagggccccggcgccagagacagaagacugaccagacuggacuuccuggaguggccccuguaa

SEQ ID NO: 21058 - RNA, 2664 nt, Artificial Sequence
  OSBPL3__Homo_sapiens__NP_056365
augaugagcgacgagaagaaccugggcgugagccagaagcuggugagccccagcagaagcaccagcagcugcagcagcaagcagggcagcagacaggacagcugggaggugguggagggccugagaggcgagaugaacuacacccaggagccccccgugcagaagggcuuccugcugaagaagagaaaguggccccugaagggcuggcacaagagauucuucuaccuggacaagggcauccugaaguacgccaagagccagaccgacaucgagagagagaagcugcacggcugcaucgacgugggccugagcgugaugagcgugaagaagagcagcaagugcaucgaccuggacaccgaggagcacaucuaccaccugaaggugaagagcgaggagguguucgacgagugggugagcaagcugagacaccacagaauguacagacagaacgagaucgccauguucccccacgaggugaaccacuucuucagcggcagcaccaucaccgacagcagcagcggcguguucgacagcaucagcagcagaaagagaagcagcaucagcaagcagaaccuguuccagaccggcagcaacgugagcuucagcugcggcggcgagaccagagugccccuguggcugcagagcagcgaggacauggagaagugcagcaaggaccuggcccacugccacgccuaccugguggagaugagccagcugcugcagagcauggacgugcugcacagaaccuacagcgcccccgccaucaacgccauccagggcggcagcuucgagagccccaagaaggagaagagaagccacagaagauggagaagcagagccaucggcaaggacgccaagggcacccugcaggugcccaagcccuucagcggccccgugagacugcacagcagcaaccccaaccugagcacccuggacuucggcgaggagaagaacuacagcgacggcagcgagaccagcagcgaguucagcaagaugcaggaggaccugugccacaucgcccacaagguguacuucacccugagaagcgccuucaacaucaugagcgccgagagagagaagcugaagcagcugauggagcaggacgccagcagcagccccagcgcccaggugaucggccugaagaacgcccugagcagcgcccuggcccagaacaccgaccugaaggagagacugagaagaauccacgccgagagccugcugcuggacagccccgccguggccaagagcggcgacaaccuggccgaggagaacagcagagacgagaacagagcccuggugcaccagcugagcaacgagagcagacugagcaucaccgacagccugagcgaguucuucgacgcccaggaggugcugcugagccccagcagcagcgagaacgagaucagcgacgacgacagcuacgugagcgacaucagcgacaaccugagccuggacaaccugagcaacgaccuggacaacgagagacagacccugggccccgugcuggacagcggcagagaggccaagagcagaagaagaaccugccugcccgcccccugccccagcagcagcaacaucagccuguggaacauccugagaaacaacaucggcaaggaccugagcaagguggccaugcccguggagcugaacgagccccugaacacccugcagagacugugcgaggagcuggaguacagcgagcugcuggacaaggccgcccagauccccagcccccuggagagaaugguguacguggccgccuucgccaucagcgccuacgccagcagcuacuacagagccggcagcaagcccuucaaccccgugcugggcgagaccuacgagugcaucagagaggacaagggcuuccaguucuucagcgagcaggugagccaccacccccccaucagcgccugccacgccgagagcagaaacuucguguucuggcaggacgugagauggaagaacaaguucuggggcaagagcauggagaucgugcccaucggcaccacccacgugacccugcccguguucggcgaccacuucgaguggaacaaggugaccagcugcauccacaacauccugagcggccagagauggaucgagcacuacggcgagaucgugaucaagaaccugcacgacgacagcugcuacugcaaggugaacuucaucaaggccaaguacuggagcaccaacgcccacgagaucgagggcaccguguucgacagaagcggcaaggccgugcacagacuguucggcaaguggcacgagagcaucuacugcggcggcggcagcagcagcgccugcguguggagagccaaccccaugcccaagggcuacgagcaguacuacagcuucacccaguucgcccuggagcugaacgagauggaccccagcagcaagagccugcugccccccaccgacaccagauucagacccgaccagagauuccuggaggagggcaaccuggaggaggccgagauccagaagcagagaaucgagcagcugcagagagagagaagaagagugcuggaggagaaccacguggagcaccagcccagauucuucagaaagagcgacgacgacagcugggugagcaacggcaccuaccuggagcugagaaaggaccugggcuucagcaagcuggaccaccccgugcugugguaa

SEQ ID NO: 21059 - RNA, 2640 nt, Artificial Sequence
  OSBPL5__Homo_sapiens__NP_065947
augaaggaggaggccuuccugagaagaagauucagccugugcccccccagcagcaccccccagaagguggaccccagaaagcugaccagaaaccugcugcugagcggcgacaacgagcuguacccccugagccccggcaaggacauggagcccaacggccccagccugcccagagacgagggcccccccacccccagcagcgccaccaaggugccccccgccgaguacagacugugcaacggcagcgacaaggagugcgugagccccaccgccagagugaccaagaaggagacccugaaggcccagaaggagaacuacagacaggagaagaagagagccaccagacagcugcugagcgcccugaccgaccccagcguggugaucauggccgacagccugaagaucagaggcacccugaagagcuggaccaagcuguggugcgugcugaagcccggcgugcugcugaucuacaagacccccaaggugggccagugggugggcaccgugcugcugcacugcugcgagcugaucgagagacccagcaagaaggacggcuucugcuucaagcuguuccacccccuggaccagagcgugugggccgugaagggccccaagggcgagagcgugggcagcaucacccagccccugcccagcagcuaccugaucuucagagccgccagcgagagcgacggcagaugcuggcuggacgcccuggagcuggcccugagaugcagcagccugcugagacugggcaccugcaagcccggcagagacggcgagcccggcaccagccccgacgccagccccagcagccugugcggccugcccgccagcgccaccgugcaccccgaccaggaccuguucccccugaacggcagcagccuggagaacgacgccuucagcgacaagagcgagagagagaaccccgaggagagcgacaccgagacccaggaccacagcagaaagaccgagagcggcagcgaccagagcgagacccccggcgcccccgugagaagaggcaccaccuacguggagcaggugcaggaggagcugggcgagcugggcgaggccagccagguggagaccgugagcgaggagaacaagagccugauguggacccugcugaagcagcugagacccggcauggaccugagcagaguggugcugcccaccuucgugcuggagcccagaagcuuccugaacaagcugagcgacuacuacuaccacgccgaccugcugagcagagccgccguggaggaggacgccuacagcagaaugaagcuggugcugagaugguaccugagcggcuucuacaagaagcccaagggcaucaagaagcccuacaaccccauccugggcgagaccuucagaugcugcugguuccacccccagaccgacagcagaaccuucuacaucgccgagcaggugagccaccacccccccgugagcgccuuccacgugagcaacagaaaggacggcuucugcaucagcggcagcaucaccgccaagagcagauucuacggcaacagccugagcgcccugcuggacggcaaggccacccugaccuuccugaacagagccgaggacuacacccugaccaugcccuacgcccacugcaagggcauccuguacggcaccaugacccuggagcugggcggcaaggugaccaucgagugcgccaagaacaacuuccaggcccagcuggaguucaagcugaagcccuucuucggcggcagcaccagcaucaaccagaucagcggcaagaucaccagcggcgaggaggugcuggccagccugagcggccacugggacagagacguguucaucaaggaggagggcagcggcagcagcgcccuguucuggacccccagcggcgaggugagaagacagagacugagacagcacaccgugccccuggaggagcagaccgagcuggagagcgagagacuguggcagcacgugaccagagccaucagcaagggcgaccagcacagagccacccaggagaaguucgcccuggaggaggcccagagacagagagccagagagagacaggagagccugaugcccuggaagccccagcuguuccaccuggaccccaucacccaggaguggcacuacagauacgaggaccacagccccugggacccccugaaggacaucgcccaguucgagcaggacggcauccugagaacccugcagcaggaggccguggccagacagaccaccuuccugggcagccccggccccagacacgagagaagcggccccgaccagagacugagaaaggccagcgaccagcccagcggccacagccaggccaccgagagcagcggcagcacccccgagagcugccccgagcugagcgacgaggagcaggacggcgacuucgugcccggcggcgagagccccugccccagaugcagaaaggaggccagaagacugcaggcccugcacgaggccauccugagcaucagagaggcccagcaggagcugcacagacaccugagcgccaugcugagcagcaccgccagagccgcccaggcccccacccccggccugcugcagagccccagaagcugguuccugcugugcguguuccuggccugccagcuguucaucaaccacauccugaaguaa

SEQ ID NO: 21060 - RNA, 2880 nt, Artificial Sequence
  OSBPL6__Homo_sapiens__NP_001188409
augagcagcgacgagaagggcaucagccccgcccacaagaccagcacccccacccacagaagcgccagcagcagcaccagcagccagagagacagcagacagagcauccacauccuggagagaaccgccagcagcagcaccgagcccagcgugagcagacagcugcuggagcccgagcccgugccccugagcaaggaggccgacagcugggagaucaucgagggccugaagaucggccagaccaacgugcagaagcccgacaagcacgagggcuucaugcugaagaagagaaaguggccccugaagggcuggcacaagagauucuucgugcuggacaacggcaugcugaaguacagcaaggccccccuggacauccagaagggcaaggugcacggcagcaucgacgugggccugagcgugaugagcaucaagaagaaggccagaagaaucgaccuggacaccgaggagcacaucuaccaccugaaggugaagagccaggacugguucgacgccugggugagcaagcugagacaccacagacuguacagacagaacgagaucgugagaagccccagagacgccagcuuccacaucuuccccagcaccagcaccgccgagagcagccccgccgccaacgugagcgugauggacggcaagaugcagcccaacagcuuccccuggcagagcccccugcccugcagcaacagccugcccgccaccugcaccaccggccagagcaagguggccgccuggcugcaggacagcgaggagauggacagaugcgccgaggaccuggcccacugccagagcaaccugguggagcugagcaagcugcugcagaaccuggagauccugcagagaacccagagcgcccccaacuucaccgacaugcaggccaacugcguggacaucagcaagaaggacaagagagugaccagaagauggagaaccaagagcgugagcaaggacaccaagauccagcugcaggagggcccccccgccaagggccaguucagcaccaccagaagaagacagagacuggccgccgccguggccaccaccgugcccuucagcgccaccaugagccccgugagacugcacagcagcaaccccaaccugugcgccgacaucgaguuccagaccccccccagccaccugaccgacccccuggagagcagcaccgacuacaccaagcugcaggaggaguucugccugaucgcccagaaggugcacagccugcugaagagcgccuucaacagcaucgccaucgagaaggagaagcugaagcagauggugagcgagcaggaccacagcaagggccacagcacccagauggccagacugagacagagccugagccaggcccugaaccagaacgccgagcugagaagcagacugaacagaauccacagcgagagcaucaucugcgaccagguggugagcgugaacaucauccccagccccgacgaggccggcgagcagauccacgugagccugccccugagccagcagguggccaacgagagcagacugagcaugagcgagagcgugagcgaguucuucgacgcccaggaggugcugcugagcgccagcagcagcgagaacgaggccagcgacgacgagagcuacaucagcgacgugagcgacaacaucagcgaggacaacaccagcguggccgacaacaucagcagacagauccugaacggcgagcugaccggcggcgccuucagaaacggcagaagagccugccugcccgcccccugccccgacaccagcaacaucaaccuguggaacauccugagaaacaacaucggcaaggaccugagcaaggugagcaugcccguggagcugaacgagccccugaacacccugcagcaccugugcgaggagauggaguacagcgagcugcuggacaaggccagcgagaccgacgaccccuacgagagaauggugcugguggccgccuucgccgugagcggcuacugcagcaccuacuucagagccggcagcaagcccuucaaccccgugcugggcgagaccuacgagugcaucagagaggacaagggcuucagauucuucagcgagcaggugagccaccacccccccaucagcgccugccacugcgagagcaagaacuucguguucuggcaggacaucagauggaagaacaaguucuggggcaagagcauggagauccugcccgugggcacccugaacgugaugcugcccaaguacggcgacuacuacguguggaacaaggugaccaccugcauccacaacauccugagcggcagaagauggaucgagcacuacggcgaggugaccaucagaaacaccaagagcagcgugugcaucugcaagcugaccuucgugaaggugaacuacuggaacagcaacaugaacgaggugcagggcguggugaucgaccaggagggcaaggccguguacagacuguucggcaaguggcacgagggccuguacugcggcguggcccccagcgccaagugcaucuggagacccggcagcaugcccaccaacuacgagcuguacuacggcuucaccagauucgccaucgagcugaacgagcuggaccccgugcugaaggaccugcugccccccaccgacgccagauucagacccgaccagagauuccuggaggagggcaaccuggaggccgccgccagcgagaagcagagaguggaggagcugcagagaagcagaagaagauacauggaggagaacaaccuggagcacauccccaaguucuucaagaaggugaucgacgccaaccagagagaggccugggugagcaacgacaccuacugggagcugagaaaggaccccggcuucagcaagguggacagccccgugcugugguaa

SEQ ID NO: 21061 - RNA, 2544 nt, Artificial Sequence
  OSBPL8__Homo_sapiens__NP_001003712
augagccagagacagggcaaggaggccuaccccacccccaccaaggaccugcaccagcccagccugagccccgccagcccccacagccagggcuucgagagaggcaaggaggacaucagccagaacaaggacgagagcagccugagcaugagcaagagcaagagcgagagcaagcuguacaacggcagcgagaaggacagcagcaccagcagcaagcugaccaagaaggagagccugaaggugcagaagaagaacuacagagaggagaagaagagagccaccaaggagcugcugagcaccaucaccgaccccagcgugaucgugauggccgacuggcugaagaucagaggcacccugaagagcuggaccaagcuguggugcgugcugaagcccggcgugcugcugaucuacaagacccagaagaacggccagugggugggcaccgugcugcugaacgccugcgagaucaucgagagacccagcaagaaggacggcuucugcuucaagcuguuccacccccuggagcagagcaucugggccgugaagggccccaagggcgaggccgugggcagcaucacccagccccugcccagcagcuaccugaucaucagagccaccagcgagagcgacggcagaugcuggauggacgcccuggagcuggcccugaagugcagcagccugcugaagagaaccaugaucagagagggcaaggagcacgaccugagcgugagcagcgacagcacccacgugaccuucuacggccugcugagagccaacaaccugcacagcggcgacaacuuccagcugaacgacagcgagaucgagagacagcacuucaaggaccaggacauguacagcgacaagagcgacaaggagaacgaccaggagcacgacgagagcgacaacgaggugaugggcaagagcgaggagagcgacaccgacaccagcgagagacaggacgacagcuacaucgagcccgagcccguggagccccugaaggagaccaccuacaccgagcagagccacgaggagcugggcgaggccggcgaggccagccagaccgagaccgugagcgaggagaacaagagccugaucuggacccugcugaagcaggugagacccggcauggaccugagcaagguggugcugcccaccuucauccuggagcccagaagcuuccuggacaagcugagcgacuacuacuaccacgccgacuuccugagcgaggccgcccuggaggagaaccccuacuucagacugaagaagguggugaagugguaccugagcggcuucuacaagaagcccaagggccugaagaagcccuacaaccccauccugggcgagaccuucagaugccuguggauccaccccagaaccaacagcaagaccuucuacaucgccgagcaggugagccaccacccccccaucagcgccuucuacgugagcaacagaaaggacggcuucugccugagcggcagcauccuggccaagagcaaguucuacggcaacagccugagcgccauccuggagggcgaggccagacugaccuuccugaacagaggcgaggacuacgugaugaccaugcccuacgcccacugcaagggcauccuguacggcaccaugacccuggagcugggcggcaccgugaacaucaccugccagaagaccggcuacagcgccauccuggaguucaagcugaagcccuuccugggcagcagcgacugcgugaaccagaucagcggcaagcugaagcugggcaaggaggugcuggccacccuggagggccacugggacagcgagguguucaucaccgacaagaagaccgacaacagcgagguguucuggaaccccacccccgacaucaagcaguggagacugaucagacacaccgugaaguucgaggagcagggcgacuucgagagcgagaagcuguggcagagagugaccagagccaucaacgccaaggaccagaccgaggccacccaggagaaguacgugcuggaggaggcccagagacaggccgccagagacagaaagaccaagaacgaggaguggagcugcaagcuguucgagcuggacccccugaccggcgaguggcacuacaaguucgccgacaccagacccugggacccccugaacgacaugauccaguucgagaaggacggcgugauccagaccaaggugaagcacagaacccccauggugagcgugcccaagaugaagcacaagcccaccagacagcagaagaagguggccaagggcuacagcagccccgagcccgacauccaggacagcagcggcagcgaggcccagagcgugaagcccagcaccagaagaaagaagggcaucgagcugggcgacauccagagcagcaucgagagcaucaagcagacccaggaggagaucaagagaaacaucauggcccugagaaaccaccuggugagcagcacccccgccaccgacuacuuccugcagcagaaggacuacuucaucaucuuccugcugauccugcugcaggugaucaucaacuucauguucaaguaa

SEQ ID NO: 21062 - RNA, 2280 nt, Artificial Sequence
  OSBPL9__Homo_sapiens__XP_011538901
auggccagcaucauggagggcccccugagcaaguggaccaacgugaugaagggcuggcaguacagaugguucgugcuggacuacaacgccggccugcugagcuacuacaccagcaaggacaagaugaugagaggcagcagaagaggcugcgugagacugagaggcgccgugaucggcaucgacgacgaggacgacagcaccuucaccaucaccguggaccagaagaccuuccacuuccaggccagagacgccgacgagagagagaaguggauccacgcccuggaggagaccauccugagacacacccugcagcugcagaucagcaccacccuggccuucuuccagagcagcggcaucagccccgugcuggaguucagcaagaucaucggccuggacagcggcuucgugcccagcgugcaggacuucgacaagaagcugaccgaggccgacgccuaccugcagauccugaucgagcagcugaagcuguucgacgacaagcugcagaacugcaaggaggacgagcagagaaagaagaucgagacccugaaggagaccaccaacagcaugguggagagcaucaagcacugcaucgugcugcugcagaucgccaaggaccagagcaacgccgagaagcacgccgacggcaugaucagcaccaucaaccccguggacgccaucuaccagcccagcccccuggagcccgugaucagcaccaugcccagccagaccgugcugccccccgagcccgugcagcugugcaagagcgagcagagacccagcagccugcccgugggccccgugcuggccacccugggccaccaccagacccccacccccaacagcaccggcagcggccacagcccccccagcagcagccugaccagccccagccacgugaaccugagccccaacaccgugcccgaguucagcuacagcagcagcgaggacgaguucuacgacgccgacgaguuccaccagagcggcagcagccccaagagacugaucgacagcagcggcagcgccagcgugcugacccacagcagcagcggcaacagccugaagagacccgacaccaccgagagccugaacagcagccugagcaacggcaccagcgacgccgaccuguucgacagccacgacgacagagacgacgacgccgaggccggcagcguggaggagcacaagagcgugaucaugcaccugcugagccaggugagacugggcauggaccugaccaagguggugcugcccaccuucauccuggagagaagaagccugcuggagauguacgccgacuucuucgcccaccccgaccuguucgugagcaucagcgaccagaaggaccccaaggacagaauggugcagguggugaagugguaccugagcgccuuccacgccggcagaaagggcagcguggccaagaagcccuacaaccccauccugggcgagaucuuccagugccacuggacccugcccaacgacaccgaggagaacaccgagcuggugagcgagggccccgugcccugggugagcaagaacagcgugaccuucguggccgagcaggugagccaccacccccccaucagcgccuucuacgccgagugcuucaacaagaagauccaguucaacgcccacaucuggaccaagagcaaguuccugggcaugagcaucggcgugcacaacaucggccagggcugcgugagcugccuggacuacgacgagcacuacauccugaccuuccccaacggcuacggcagaagcauccugaccgugcccuggguggagcugggcggcgagugcaacaucaacugcagcaagaccggcuacagcgccaacaucaucuuccacaccaagcccuucuacggcggcaagaagcacagaaucaccgccgagaucuucagccccaacgacaagaagagcuucugcagcaucgagggcgaguggaacggcgugauguacgccaaguacgccaccggcgagaacaccguguucguggacaccaagaagcugcccaucaucaagaagaaggugagaaagcuggaggaccagaacgaguacgagagcagaagccuguggaaggacgugaccuucaaccugaagaucagagacaucgacgccgccaccgaggccaagcacagacuggaggagagacagagagccgaggccagagagagaaaggagaaggagauccagugggagaccagacuguuccacgaggacggcgagugcuggguguacgacgagccccugcugaagagacugggcgccgccaagcacuaa

SEQ ID NO: 21063 - RNA, 849 nt, Artificial Sequence
  OSCAR__Homo_sapiens__NP_001269278
auggcccuggugcugauccugcagcugcugacccuguggccccugugccacaccgacaucacccccagcgugccccccgccagcuaccaccccaagcccuggcugggcgcccagcccgccaccguggugacccccggcgugaacgugacccugagaugcagagccccccagcccgccuggagauucggccuguucaagcccggcgagaucgccccccugcuguucagagacgugagcagcgagcuggccgaguucuuccuggaggaggugacccccgcccagggcggcagcuacagaugcugcuacagaagacccgacuggggccccggcguguggagccagcccagcgacgugcuggagcugcuggugaccgaggagcugcccagacccagccugguggcccugcccggccccguggugggccccggcgccaacgugagccugagaugcgccggcagacugagaaacaugagcuucgugcuguacagagagggcguggccgccccccugcaguacagacacagcgcccagcccugggccgacuucacccugcugggcgccagagcccccggcaccuacagcugcuacuaccacacccccagcgcccccuacgugcugagccagagaagcgaggugcuggugaucagcugggagggcgagggccccgaggccagacccgccagcagcgcccccggcaugcaggcccccggccccccccccagcgaccccggcgcccaggcccccagccugagcagcuucagacccagaggccuggugcugcagccccugcugccccagacccaggacagcugggaccccgcccccccccccagcgaccccggcguguaa

SEQ ID NO: 21064 - RNA, 879 nt, Artificial Sequence
  OSER1__Homo_sapiens__XP_011527155
augaagagcgaggccaaggacggcgaggaggagagccugcagaccgccuucaagaagcugagaguggacgccagcggcagcguggccagccugagcgugggcgagggcaccggcgugagagcccccgugagaaccgccaccgacgacaccaagcccaagaccaccugcgccagcaaggacagcuggcacggcagcaccagaaagagcagcagaggcgccgugagaacccagagaagaagaagaagcaagagccccgugcugcacccccccaaguucauccacugcagcaccaucgccagcagcagcagcagccagcugaagcacaagagccagaccgacagccccgacggcagcagcggccugggcaucagcagccccaaggaguucagcgccggcgagagcagcaccagccuggacgccaaccacaccggcgccgugguggagccccugagaaccagcgugcccagacugcccagcgagagcaagaaggaggacagcagcgacgccacccaggugccccaggccagccugaaggccagcgaccugagcgacuuccagagcgugagcaagcugaaccagggcaagcccugcaccugcaucggcaaggagugccagugcaagagauggcacgacauggagguguacagcuucagcggccugcagagcgugcccccccuggcccccgagagaagaagcacccuggaggacuacagccagagccugcacgccagaacccugagcggcagccccagaagcugcagcgagcaggccagaguguucguggacgacgugaccaucgaggaccugagcggcuacauggaguacuaccuguacauccccaagaagaugagccacauggccgagaugauguacaccuaa

SEQ ID NO: 21065 - RNA, 1008 nt, Artificial Sequence
  OSGEP__Homo_sapiens__NP_060277
augcccgccgugcugggcuucgagggcagcgccaacaagaucggcgugggcguggugagagacggcaaggugcuggccaaccccagaagaaccuacgugaccccccccggcaccggcuuccugcccggcgacaccgccagacaccacagagccgugauccuggaccugcugcaggaggcccugaccgagagcggccugaccagccaggacaucgacugcaucgccuacaccaagggccccggcaugggcgccccccuggugagcguggccgugguggccagaaccguggcccagcuguggaacaagccccuggugggcgugaaccacugcaucggccacaucgagaugggcagacugaucaccggcgccaccagccccaccgugcuguacgugagcggcggcaacacccaggugaucgccuacagcgagcacagauacagaaucuucggcgagaccaucgacaucgccgugggcaacugccuggacagauucgccagagugcugaagaucagcaacgaccccagccccggcuacaacaucgagcagauggccaagagaggcaagaagcugguggagcugcccuacaccgugaagggcauggacgugagcuucagcggcauccugagcuucaucgaggacguggcccacagaaugcuggccaccggcgagugcacccccgaggaccugugcuucagccugcaggagaccguguucgccaugcugguggagaucaccgagagagccauggcccacugcggcagccaggaggcccugaucgugggcggcgugggcugcaacgugagacugcaggagaugauggccaccaugugccaggagagaggcgccagacuguucgccaccgacgagagauucugcaucgacaacggcgccaugaucgcccaggccggcugggagauguucagagccggccacagaaccccccugagcgacagcggcgugacccagagauacagaaccgacgagguggaggugaccuggagagacuaa

SEQ ID NO: 21066 - RNA, 1434 nt, Artificial Sequence
  OSGIN1__Homo_sapiens__NP_892026
augagcagcagcagaaaggaccaccugggcgccagcagcagcgagccccugcccgugaucaucgugggcaacggccccagcggcaucugccugagcuaccugcugagcggcuacacccccuacaccaagcccgacgccauccacccccacccccugcugcagagaaagcugaccgaggcccccggcgugagcauccuggaccaggaccuggacuaccugagcgagggccuggagggcagaagccagagccccguggcccugcuguucgacgcccugcugagacccgacaccgacuucggcggcaacaugaagagcgugcugaccuggaagcacagaaaggagcacgccaucccccacguggugcugggcagaaaccugcccggcggcgccuggcacagcaucgagggcagcauggugauccugagccagggccaguggaugggccugcccgaccuggaggugaaggacuggaugcagaagaagagaagaggccugagaaacagcagagccaccgccggcgacaucgcccacuacuacagagacuacguggugaagaagggccugggccacaacuucgugagcggcgccguggugaccgccguggaguggggcacccccgaccccagcagcugcggcgcccaggacagcagcccccuguuccaggugagcggcuuccugaccagaaaccaggcccagcagcccuucagccugugggccagaaacguggugcuggccaccggcaccuucgacagccccgccagacugggcauccccggcgaggcccugcccuucauccaccacgagcugagcgcccuggaggccgccaccagagugggcgccgugacccccgccagcgaccccgugcugaucaucggcgccggccugagcgccgccgacgccgugcuguacgccagacacuacaacauccccgugauccacgccuucagaagagccguggacgaccccggccugguguucaaccagcugcccaagaugcuguaccccgaguaccacaaggugcaccagaugaugagagagcagagcauccugagccccagccccuacgagggcuacagaagccugcccagacaccagcugcugugcuucaaggaggacugccaggccguguuccaggaccuggagggcguggagaagguguucggcgugagccuggugcuggugcugaucggcagccaccccgaccugagcuuccugcccggcgccggcgccgacuucgccguggaccccgaccagccccugagcgccaagagaaaccccaucgacguggaccccuucaccuaccagagcaccagacaggagggccuguacgccaugggcccccuggccggcgacaacuucgugagauucgugcagggcggcgcccuggccguggccagcagccugcugagaaaggagaccagaaagccccccuaa

SEQ ID NO: 21067 - RNA, 759 nt, Artificial Sequence
  OSM__Homo_sapiens__NP_065391
augggcgugcugcugacccagagaacccugcugagccuggugcuggcccugcuguuccccagcauggccagcauggccgccaucggcagcugcagcaaggaguacagagugcugcugggccagcugcagaagcagaccgaccugaugcaggacaccagcagacugcuggaccccuacaucagaauccagggccuggacgugcccaagcugagagagcacugcagagagagacccggcgccuuccccagcgaggagacccugagaggccugggcagaagaggcuuccugcagacccugaacgccacccugggcugcgugcugcacagacuggccgaccuggagcagagacugcccaaggcccaggaccuggagagaagcggccugaacaucgaggaccuggagaagcugcagauggccagacccaacauccugggccugagaaacaacaucuacugcauggcccagcugcuggacaacagcgacaccgccgagcccaccaaggccggcagaggcgccagccagccccccacccccacccccgccagcgacgccuuccagagaaagcuggagggcugcagauuccugcacggcuaccacagauucaugcacagcgugggcagaguguucagcaaguggggcgagagccccaacagaagcagaagacacagcccccaccaggcccugagaaagggcgugagaagaaccagacccagcagaaagggcaagagacugaugaccagaggccagcugcccagauaa

SEQ ID NO: 21068 - RNA, 1029 nt, Artificial Sequence
  OSMR__Homo_sapiens__NP_001161827
auggcccuguucgccguguuccagaccaccuucuuccugacccugcugagccugagaaccuaccagagcgaggugcuggccgagagacugccccugacccccgugagccugaaggugagcaccaacagcaccagacagagccugcaccugcaguggaccgugcacaaccugcccuaccaccaggagcugaagaugguguuccagauccagaucagcagaaucgagaccagcaacgugaucugggugggcaacuacagcaccaccgugaaguggaaccaggugcugcacuggagcugggagagcgagcugccccuggagugcgccacccacuucgugagaaucaagagccugguggacgacgccaaguuccccgagcccaacuucuggagcaacuggagcagcugggaggaggugagcgugcaggacagcaccggccaggacauccuguucguguuccccaaggacaagcugguggaggagggcaccaacgugaccaucugcuacgugagcagaaacauccagaacaacgugagcugcuaccuggagggcaagcagauccacggcgagcagcuggacccccacgugaccgccuucaaccugaacagcgugcccuucaucagaaacaagggcaccaacaucuacugcgaggccagccagggcaacgugagcgagggcaugaagggcaucgugcuguucgugagcaaggugcuggaggagcccaaggacuucagcugcgagaccgaggacuucaagacccugcacugcaccugggaccccggcaccgacaccgcccugggcuggagcaagcagcccagccagagcuacacccuguucgagagcuucagcggcgagaagaagcugugcacccacaagaacuggugcaacuggcagaucacccaggacagccaggagaccuacaacuucacccugaucgccgagaacuaccugagaaagagaagcgugaacauccuguucaaccugacccacagaggcgagaccagaguggugaccgcccacagaggccacuaa

SEQ ID NO: 21069 - RNA, 801 nt, Artificial Sequence
  OSR1__Homo_sapiens__XP_006712005
augggcagcaagacccugcccgcccccgugcccauccaccccagccugcagcugaccaacuacagcuuccugcaggccgugaacggccugcccaccgugcccagcgaccaccugcccaaccuguacggcuucagcgcccugcacgccgugcaccugcaccaguggacccugggcuaccccgccaugcaccugcccagaagcagcuucagcaaggugcccggcaccgugagcagccugguggacgccagauuccagcugcccgccuuccccugguucccccacgugauccagcccaagcccgagaucaccgccggcggcagcgugcccgcccugaagaccaagcccagauucgacuucgccaaccuggcccuggccgccacccaggaggaccccgccaagcugggcagaggcgagggccccggcagccccgccggcggccugggcgcccugcuggacgugaccaagcugagccccgagaagaagcccaccagaggcagacugcccagcaagaccaagaaggaguucgugugcaaguucugcggcagacacuucaccaagagcuacaaccugcugauccacgagagaacccacaccgacgagagacccuacaccugcgacaucugccacaaggccuucagaagacaggaccaccugagagaccacagauacauccacagcaaggagaagcccuucaagugccaggagugcggcaagggcuucugccagagcagaacccuggccgugcacaagacccugcacagccaggugaaggagcugaagaccagcaagaucaagugcuaa

SEQ ID NO: 21070 - RNA, 939 nt, Artificial Sequence
  OSR2__Homo_sapiens__NP_001135934
augggcagcaaggcccugcccgcccccaucccccugcaccccagccugcagcugaccaacuacagcuuccugcaggccgugaacaccuuccccgccaccguggaccaccugcagggccuguacggccugagcgccgugcagaccaugcacaugaaccacuggacccugggcuaccccaacgugcacgagaucaccagaagcaccaucaccgagauggccgccgcccagggccugguggacgccagauuccccuuccccgcccugcccuucaccacccaccuguuccaccccaagcagggcgccaucgcccacgugcugcccgcccugcacaaggacagacccagauucgacuucgccaaccuggccguggccgccacccaggaggacccccccaagaugggcgaccugagcaagcugagccccggccugggcagccccaucagcggccugagcaagcugacccccgacagaaagcccagcagaggcagacugcccagcaagaccaagaaggaguucaucugcaaguucugcggcagacacuucaccaagagcuacaaccugcugauccacgagagaacccacaccgacgagagacccuacaccugcgacaucugccacaaggccuucagaagacaggaccaccugagagaccacagauacauccacagcaaggagaagcccuucaagugccaggagugcggcaagggcuucugccagagcagaacccuggccgugcacaagacccugcacaugcaggagagcccccacaagugccccaccugcggcagaaccuucaaccagagaagcaaccugaagacccaccugcugacccacaccgacaucaagcccuacagcugcgagcagugcggcaagguguucagaagaaacugcgaccugagaagacacagccugacccacacccccagacaggacuucuaa

SEQ ID NO: 21071 - RNA, 645 nt, Artificial Sequence
  OSTF1__Homo_sapiens__NP_036515
augagcaagcccccccccaagcccgugaagcccggccaggugaagguguucagagcccuguacaccuucgagcccagaacccccgacgagcuguacuucgaggagggcgacaucaucuacaucaccgacaugagcgacaccaacugguggaagggcaccagcaagggcagaaccggccugauccccagcaacuacguggccgagcaggccgagagcaucgacaacccccugcacgaggccgccaagagaggcaaccugagcuggcugagagagugccuggacaacagagugggcgugaacggccuggacaaggccggcagcaccgcccuguacugggccugccacggcggccacaaggacaucguggagaugcuguucacccagcccaacaucgagcugaaccagcagaacaagcugggcgacaccgcccugcacgccgccgccuggaagggcuacgccgacaucgugcagcugcugcuggccaagggcgccagaaccgaccugagaaacaucgagaagaagcuggccuucgacauggccaccaacgccgccugcgccagccugcugaagaagaagcagggcaccgacgccgugagaacccugagcaacgccgaggacuaccuggacgacgaggacagcgacuaa

SEQ ID NO: 21072 - RNA, 1005 nt, Artificial Sequence
  OSTM1__Homo_sapiens__NP_054747
auggagcccggccccaccgccgcccagagaagaugcagccugccccccuggcugccccugggccugcugcuguggagcggccuggcccugggcgcccugcccuucggcagcagcccccacagaguguuccacgaccugcugagcgagcagcagcugcuggagguggaggaccugagccugagccugcugcagggcggcggccugggcccccugagccugccccccgaccugcccgaccuggaccccgagugcagagagcugcugcuggacuucgccaacagcagcgccgagcugaccggcugccuggugagaagcgccagacccgugagacugugccagaccugcuacccccuguuccagcagguggugagcaagauggacaacaucagcagagccgccggcaacaccagcgagagccagagcugcgccagaagccugcugauggccgacagaaugcagaucguggugauccugagcgaguucuucaacaccaccuggcaggaggccaacugcgccaacugccugaccaacaacagcgaggagcugagcaacagcaccguguacuuccugaaccuguucaaccacacccugaccugcuucgagcacaaccugcagggcaacgcccacagccugcugcagaccaagaacuacagcgaggugugcaagaacugcagagaggccuacaagacccugagcagccuguacagcgagaugcagaagaugaacgagcuggagaacaaggccgagcccggcacccaccugugcaucgacguggaggacgccaugaacaucaccagaaagcuguggagcagaaccuucaacugcagcgugcccugcagcgacaccgugcccgugaucgccgugagcguguucauccuguuccugcccgugguguucuaccugagcagcuuccugcacagcgagcagaagaagagaaagcugauccugcccaagagacugaagagcagcaccagcuucgccaacauccaggagaacagcaacuaa

SEQ ID NO: 21073 - RNA, 1065 nt, Artificial Sequence
  OTC__Homo_sapiens__NP_000522
augcuguucaaccugagaauccugcugaacaacgccgccuucagaaacggccacaacuucauggugagaaacuucagaugcggccagccccugcagaacaaggugcagcugaagggcagagaccugcugacccugaagaacuucaccggcgaggagaucaaguacaugcuguggcugagcgccgaccugaaguucagaaucaagcagaagggcgaguaccugccccugcugcagggcaagagccugggcaugaucuucgagaagagaagcaccagaaccagacugagcaccgagaccggcuucgcccugcugggcggccaccccugcuuccugaccacccaggacauccaccugggcgugaacgagagccugaccgacaccgccagagugcugagcagcauggccgacgccgugcuggccagaguguacaagcagagcgaccuggacacccuggccaaggaggccagcauccccaucaucaacggccugagcgaccuguaccaccccauccagauccuggccgacuaccugacccugcaggagcacuacagcagccugaagggccugacccugagcuggaucggcgacggcaacaacauccugcacagcaucaugaugagcgccgccaaguucggcaugcaccugcaggccgccacccccaagggcuacgagcccgacgccagcgugaccaagcuggccgagcaguacgccaaggagaacggcaccaagcugcugcugaccaacgacccccuggaggccgcccacggcggcaacgugcugaucaccgacaccuggaucagcaugggccaggaggaggagaagaagaagagacugcaggccuuccagggcuaccaggugaccaugaagaccgccaagguggccgccagcgacuggaccuuccugcacugccugcccagaaagcccgaggagguggacgacgagguguucuacagccccagaagccugguguuccccgaggccgagaacagaaaguggaccaucauggccgugauggugagccugcugaccgacuacagcccccagcugcagaagcccaaguucuaa

SEQ ID NO: 21074 - RNA, 3183 nt, Artificial Sequence
  OTOA__Homo_sapiens__NP_001155155
augggcaacagcaucaccuacagagaccaggccgccguggagaaccaccuggagcagagacugcaccagccccagaagcugcuggaggaccugagaaagaccgacgcccagcaguucagaaccgccaugaagugccugcuggaggacaagaaggacggccuggaccugaaggacaucaucaucgaccugggcgagaucagagagagagcccugcagagccccggcgugaacagaagccuguuccugaucacccuggagagaugcuuccagaugcugaacagccuggagugcguggagauccugggcaaggugcugagaggcagcagcggcagcuuccugcagcccgacaucaccgagagacugcccagagaccugagagaggacgccuucaagaaccugagcgccguguucaaggaccuguacgacaagaccagcgcccacagccagagagcccuguacagcuggaugaccggcauccugcagaccagcagcaacgccaccgacgacagcgccagcugggugagcgccgagcaccugugggugcugggcagauacauggugcaccugagcuucgaggagaucaccaagaucagccccaucgagaucggccuguucaucagcuacgacaacgccaccaagcagcuggacaugguguacgacaucacccccgagcuggcccaggccuuccuggagagaaucagcagcagcaacuucaacaugagaaacaccagcaccauccacagacugggccugcuggugugcuucuacaacgaccuggagcugcuggacgccaccguggcccaggugcugcuguaccagaugaucaagugcagccaccugagaggcuuccaggccggcgugcagaagcugaaggccgagcugcuggacaucgccauggagaaccagacccugaacgagacccugggcagccugagcgacgccguggugggccugaccuacagccagcuggagagccugagccccgaggccgugcacggcgccaucagcacccugaaccaggugagcggcugggccaagagccaggugaucauccugagcgccaaguaccuggcccacgagaaggugcugagcuucuacaacgugagccagaugggcgcccugcuggccggcgugagcacccaggccuucugcagcaugaagagaaaggacaucagccaggugcugagaagcgccgugagccaguacgugagcgaccugagccccgcccagcagcagggcauccugagcaagauggugcaggccgaggacaccgcccccggcaucguggagauccagggcgccuucuucaaggaggugagccuguucgaccugagaagacagcccggcuucaacagcaccgugcugaaggacaaggagcugggcagaagccaggcccuguuccuguacgagcugcugcugaagaccaccagaagacccgaggagcugcugagcgccggccagcuggugaagggcgugaccugcagccacaucgacgccaugagcaccgacuucuuccuggcccacuuccaggacuuccagaacaacuucgcccugcugagccccuaccaggugaacugccuggccuggaaguacugggaggugagcagacugagcaugccccccuuccugcuggccgcccugcccgccagauaccuggccagcgugcccgccagccagugcgugcccuuccugaucagccugggcaagagcuggcuggacagccuggugcuggacagccacaagaagaccagcgugcugagaaaggugcagcagugccuggacgacagcaucgccgacgaguacaccguggacaucaugggcaaccugcugugccaccugcccgccgccaucaucgacagaggcaucagccccagagccugggccaccgcccugcacggccugagagacugccccgaccugaaccccgagcagaaggccgccgugagacugaagcugcugggccaguacggccugccccagcacuggaccgccgagaccaccaaggaccugggccccuuccuggugcuguucagcggcgacgagcugagcagcaucgccaccaaguuccccgagauccugcugcaggccgccagcaagauggccagaacccugcccaccaaggaguuccugugggccguguuccagagcgugagaaacagcagcgacaagauccccagcuacgaccccaugcccggcugccacggcgugguggcccccagcagcgacgacaucuucaagcuggccgaggccaacgccugcugggcccuggaggaccugagaugcauggaggaggacaccuucaucagaaccguggagcugcugggcgccgugcagggcuucagcagaccccagcugaugacccugaaggagaaggccauccaggugugggacaugcccagcuacuggagagagcaccacaucgugagccugggcagaaucgcccuggcccugaacgagagcgagcuggagcagcuggaccugagcagcaucgacaccguggccagccugagcuggcagaccgaguggacccccggccaggccgagagcauccugcagggcuaccuggacgacagcggcuacagcauccaggaccugaagagcuuccaccuggugggccugggcgccacccugugcgccaucaacaucaccgagaucccccugaucaagaucagcgaguucagaguggugguggccagaaucggcacccugcugugcagcacccacgugcuggccgaguucaagagaaaggccgaggugguguucggcgaccccaccgaguggaccagcagcgugcugcaggagcugggcaccaucgccgccggccugaccaaggccgagcugagaaugcuggacaaggaccugaugcccuacuuccagcccagcgccaucaagugccugcccgacgagaucuucaaggagcugagcgccgagcagaucgccagccugggccccgagaacgccgccgccgugacccacgcccagagaagaagacugagcccccugcagcugcagagccugcagcaggcccuggacggcgccaagacccacagcuggcaggacgcccccgccagcgccggccccaccagaaccagcagcagcagaagccccgccggcgcccugcagagcuggggccuguggcugggcugcccccugcuggugcugauggccaagcugcugugguaa

SEQ ID NO: 21075 - RNA, 3693 nt, Artificial Sequence
  OTOF__Homo_sapiens__NP_004793
augaucaagaccgagaagagcuaccccgagagaagacugagaggcgugcuggaggagcugagcugcggcugcugcagauuccugagccuggccgacaaggaccagggccacagcagcagaaccagacuggacagagagagacugaagagcugcaugagagagcuggagaacaugggccagcaggccagaaugcugagagcccaggugaagagacacaccgugagagacaagcugagacugugccagaacuuccugcagaagcugagauuccuggccgacgagccccagcacagcauccccgacaucuucaucuggaugaugagcaacaacaagagaguggccuacgccagagugcccagcaaggaccugcuguucagcaucguggaggaggagaccggcaaggacugcgccaaggugaagacccuguuccugaagcugcccggcaagagaggcuucggcagcgccggcuggaccgugcaggccaagguggagcuguaccuguggcugggccugagcaagcagagaaaggaguuccugugcggccugcccugcggcuuccaggaggugaaggccgcccagggccugggccugcacgccuucccccccgugagccugguguacaccaagaagcaggccuuccagcugagagcccacauguaccaggccagaagccuguucgccgccgacagcagcggccugagcgaccccuucgccagaguguucuucaucaaccagagccagugcaccgaggugcugaacgagacccugugccccaccugggaccagaugcugguguucgacaaccuggagcuguacggcgaggcccacgagcugagagacgacccccccaucaucgugaucgagaucuacgaccaggacagcaugggcaaggccgacuucaugggcagaaccuucgccaagccccuggugaagauggccgacgaggccuacugcccccccagauuccccccccagcuggaguacuaccagaucuacagaggcaacgccaccgccggcgaccugcuggccgccuucgagcugcugcagaucggccccgccggcaaggccgaccugccccccaucaacggccccguggacguggacagaggccccaucaugcccgugcccaugggcaucagacccgugcugagcaaguacagaguggaggugcuguucuggggccugagagaccugaagagagugaaccuggcccagguggacagacccagaguggacaucgagugcgccggcaagggcgugcagagcagccugauccacaacuacaagaagaaccccaacuucaacacccuggugaagugguucgagguggaccugcccgagaacgagcugcugcaccccccccugaacaucagagugguggacugcagagccuucggcagauacacccuggugggcagccacgccgugagcagccugagaagauucaucuacagaccccccgacagaagcgcccccagcuggaacaccaccggcgaggugguggugaccauggagcccgaggugcccaucaagaagcuggagaccauggugaagcuggacgccaccagcgaggccguggugaagguggacguggccgaggaggagaaggagaagaagaagaagaagaagggcaccgccgaggagcccgaggaggaggagcccgacgagagcaugcuggacugguggagcaaguacuucgccagcaucgacaccaugaaggagcagcugagacagcaggagcccagcggcaucgaccuggaggagaaggaggagguggacaacaccgagggccugaagggcagcaugaagggcaaggagaaggccagagccgccaaggaggagaagaagaagaagacccagagcagcggcagcggccagggcagcgaggcccccgagaagaagaagcccaagaucgacgagcugaagguguaccccaaggagcuggagagcgaguucgacaacuucgaggacuggcugcacaccuucaaccugcugagaggcaagaccggcgacgacgaggacggcagcaccgaggaggagagaaucgugggcagauucaagggcagccugugcguguacaaggugccccugcccgaggacgugagcagagaggccggcuacgacagcaccuacggcauguuccagggcauccccagcaacgaccccaucaacgugcuggugagaguguacguggugagagccaccgaccugcaccccgccgacaucaacggcaaggccgaccccuacaucgccaucagacugggcaagaccgacaucagagacaaggagaacuacaucagcaagcagcugaaccccguguucggcaagagcuucgacaucgaggccagcuuccccauggagagcaugcugaccguggccguguacgacugggaccuggugggcaccgacgaccugaucggcgagaccaagaucgaccuggagaacagauucuacagcaagcacagagccaccugcggcaucgcccagaccuacagcacccacggcuacaacaucuggagagaccccaugaagcccagccagauccugaccagacugugcaaggacggcaagguggacggcccccacuucggcccccccggcagagugaagguggccaacagaguguucaccggccccagcgagaucgaggacgagaacggccagagaaagcccaccgacgagcacguggcccugcuggcccugagacacugggaggacauccccagagccggcugcagacuggugcccgagcacguggagaccagaccccugcugaaccccgacaagcccggcaucgagcagggcagacuggagcuguggguggacauguuccccauggacaugcccgcccccggcaccccccuggacaucagccccagaaagcccaagaaguacgagcugagagugaucaucuggaacaccgacgagguggugcuggaggacgacgacuucuucaccggcgagaagagcagcgacaucuucgugagaggcuggcugaagggccagcaggaggacaagcaggacaccgacgugcacuaccacagccugaccggcgagggcaacuucaacuggagauaccuguuccccuucgacuaccuggccgccgaggagaagaucgugaucagcaagaaggagagcauguucagcugggacgagaccgaguacaagauccccgccagacugacccugcagaucugggacgccgaccacuucagcgccgacgacuuccugggcgccaucgagcuggaccugaacagauuccccagaggcgccaagaccgccaagcagugcaccauggagauggccaccggcgagguggacgugccccuggugagcaucuucaagcagaagagagugaagggcugguggccccugcuggccagaaacgagaacgacgaguucgagcugaccggcaagguggaggccgagcugcaccugcugaccgccgaggaggccgagaagaaccccgugggccuggccagaaacgagcccgacccccuggagaagcccaacagacccgacaccagcuucaucugguuccugaacccccugaagagcgccagauacuuccuguggcacaccuacagauggcugcugcugaagcugcugcugcugcugcugcugcugcugcugcuggcccuguuccuguacagcgugcccggcuaccuggugaagaagauccugggcgccuaa

SEQ ID NO: 21076 - RNA, 8778 nt, Artificial Sequence
  OTOG__Homo_sapiens__NP_001264198
augggcgugcuggccagcgcccugugcuggcugcugugcguguggcugcccuggggcgagcaggccgccgagagccugagagugcagagacugggcgagagagugguggacagcggcagaagcggcgccagaggcaugagaaacgugaagggcaugagaaacggccccgcccagaccagagugagcagcagcagcagccaccaggaggccacccuggccaugggcgacaaggccaccguggugggcggccagcaggccgaggcccccgacagcguggccaugagcagcugggagagaagacugcacagagccaagugcgcccccagcuaccuguucagcugcuucaacggcggcgagugcgugcaccccgccuucugcgacugcagaagauucaacgccaccggccccagaugccagaugguguacaacgccggccccgagagagacagcaucugcagagccuggggccagcaccacguggagaccuucgacggccuguacuacuaccugagcggcaagggcagcuacacccuggugggcagacacgagcccgagggccagagcuucagcauccaggugcacaacgacccccagugcggcagcagccccuacaccugcagcagagccgugagccuguucuucgugggcgagcaggagauccaccuggccaaggaggugacccacggcggcaugagagugcagcugccccacgugaugggcagcgccagacugcagcagcuggccggcuacgugaucgugagacaccagagcgccuucacccuggccugggacggcgccagcgccguguacaucaagaugagccccgagcugcugggcuggacccacggccugugcggcaacaacaacgccgaccccaaggacgaccuggugaccagcagcggcaagcugaccgacgacgugguggaguucgugcacagcuggcaggagcaggcccccaaccagccccccggccccaccaccagcagccugcccagaccccccugccugcagcagaaccccggcaccaugcagggcguguacgagcagugcgaggcccugcugagaccccccuucgacgccugccacgccuacgugagcccccugcccuucaccgccagcugcaccagcgaccugugccagagcaugggcgacguggccaccuggugcagagcccuggccgaguacgccagagccugcgcccaggccggcagaccccugcagggcuggagaacccagcugagacagugcaccgugcacugcaaggagaaggccuucaccuacaacgagugcaucgccugcugccccgccagcugccaccccagagccagcugcguggacagcgagaucgccugcguggacggcugcuacugccccaacggccugaucuucgaggacggcggcugcguggcccccgccgagugccccugcgaguuccacggcacccuguacccccccggcagcguggugaaggaggacugcaacaccugcaccugcaccagcggcaagugggagugcagcaccgccgugugccccgccgagugcagcgugaccggcgacauccacuucaccaccuucgacggcagaagauacaccuuccccgccaccugccaguacauccuggccaagagcagaagcagcggcaccuucaccgugacccugcagaacgcccccugcggccugaaccaggacggcgccugcgugcagagcgugagcgugauccugcaccaggaccccagaagacaggugacccugacccaggccggcgacgugcugcuguucgaccaguacaagaucaucccccccuacaccgacgacgccuucgagaucagaagacugagcagcguguuccugagagugagaaccaacgugggcgugagagugcuguacgacagagagggccugagacuguaccugcagguggaccagagauggguggaggacaccgugggccugugcggcaccuucaacggcaacacccaggacgacuuccugagccccgugggcgugcccgagagcaccccccagcuguucggcaacagcuggaagacccugagcgccugcagcccccuggugagcggcagcccccuggaccccugcgacgugcaccugcaggccgccagcuacagcgugcaggccugcagcgugcugaccggcgagauguucgcccccugcagcgccuuccugagccccgugcccuacuucgagcagugcagaagagacgccugcagaugcggccagcccugccugugcgccacccuggcccacuacgcccaccugugcagaagacacggccugcccguggacuucagagccagacugcccgccugcgcccugagcugcgaggccagcaaggaguacagccccugcguggcccccugcggcagaaccugccaggaccuggccagccccgaggccugcggcguggacggcggcgacgaccugagcagagacgagugcguggagggcugcgccugcccccccgacaccuaccuggacacccaggccgaccugugcgugcccagaaaccagugcagcugccacuuccagggcguggacuacccccccggcgacagcgacauccccagccugggccacugccacugcaaggacggcgugaugagcugcgacagcagagcccccgccgccgccugccccgccggccagguguucgugaacugcagcgaccugcacaccgaccuggagcugagcagagagagaaccugcgagcagcagcugcugaaccugagcgugagcgccagaggccccugccugagcggcugcgccugcccccagggccugcugagacacggcgacgccugcuuccugcccgaggagugccccugcaccuggaagggcaaggaguacuuccccggcgaccaggugaugagccccugccacaccugcgugugccagagaggcagcuuccagugcacccugcaccccugcgccagcaccugcaccgccuacggcgacagacacuacagaaccuucgacggccugcccuucgacuucgugggcgccugcaaggugcaccuggugaagagcaccagcgacgugagcuucagcgugaucguggagaacgugaacugcuacagcagcggcaugaucugcagaaaguucaucagcaucaacgugggcaacagccugaucguguucgacgacgacagcggcaaccccagccccgagagcuuccuggacgacaagcaggaggugcacaccuggagagugggcuucuucacccuggugcacuucccccaggagcacaucacccugcugugggaccagagaaccaccgugcacgugcaggccggcccccaguggcagggccagcuggccggccugugcggcaacuucgaccugaagaccaucaacgagaugagaacccccgagaaccuggagcugaccaacccccaggaguucggcagcagcugggccgccguggagugccccgacacccuggaccccagagacaugugcgugcugaacccccugagagagcccuucgccaagaaggagugcagcauccugcugagcgagguguucgagaucugccaccccgugguggacgugaccugguucuacagcaacugccugaccgacaccugcggcugcagccagggcggcgacugcgagugcuucugcgccagcgugagcgccuacgcccaccagugcugccagcacggcguggccguggacuggagaacccccagacugugccccuacgacugcgacuucuucaacaaggugcugggcaagggccccuaccagcugagcagccuggccgccggcggcgcccuggugggcaugaaggccgugggcgacgacaucgugcuggugagaaccgaggacguggcccccgccgacaucgugagcuuccugcugaccgccgcccuguacaaggccaaggcccacgaccccgacguggugagccuggaggccgccgacagacccaacuucuuccugcacgugaccgccaacggcagccuggagcuggccaaguggcagggcagagacaccuuccagcagcacgccagcuuccugcugcacagaggcaccagacaggccggccugguggcccuggagagccuggccaagcccagcagcuuccuguacgugagcggcgccgugcuggcccugagacuguacgagcacaccgagguguucagaagaggcacccuguucagacugcuggacgccaagcccagcggcgccgccuaccccaucugcgaguggagauacgacgccugcgccagccccugcuuccagaccugcagagaccccagagccgccagcugcagagacgugcccagaguggagggcugcgugcccgugugccccaccccccaggugcuggacgaggugacccagagaugcguguaccuggaggacugcguggagcccgccgugugggugcccaccgaggcccugggcaacgagacccugccccccagccagggccugcccacccccagcgacgaggagccccagcugagccaggagagccccagaacccccacccacagacccgcccugacccccgccgccccccugaccaccgcccugaacccccccgugaccgccaccgaggagcccguggugagccccggccccacccagaccacccugcagcagccccuggagcugaccgccagccagcugcccgccggccccaccgagagccccgccagcaagggcgugaccgccagccugcuggccaucccccacacccccgagagcagcagccugcccguggcccugcagacccccacccccggcauggugagcggcgccauggagaccaccagagugaccgugaucuucgccggcagccccaacaucaccgugagcagcagaagcccccccgcccccagauucccccugaugaccaaggccgugaccgugagaggccacggcagccugcccgugagaaccacccccccccagcccagccugaccgccagccccagcagcagacccguggccagccccggcgccaucagcagaagccccaccagcagcggcagccacaaggccgugcugacccccgccgugaccaaggugaucagcagaaccggcgugccccagcccacccaggcccagagcgccagcagccccagcaccccccugaccguggccggcaccgccgccgagcaggugcccgugagcccccuggccaccagaagccuggagaucgugcugagcaccgagaagggcgaggccggccacagccagcccaugggcagccccgccagcccccagccccacccccugcccagcgccccccccagacccgcccagcacaccaccauggccaccagaagccccgcccugccccccgagacccccgccgccgccagccugagcaccgccaccgacggccuggccgccacccccuucaugagccuggagagcaccagacccagccagcugcugagcggccugccccccgacaccagccugccccuggccaaggugggcaccagcgcccccguggccacccccggccccaaggccagcgugaucaccaccccccugcagccccaggccaccacccugcccgcccagacccugagccccgugcugcccuucacccccgccgccaugacccaggcccacccccccacccacaucgccccccccgccgccggcaccgcccccggccugcugcugggcgccacccugcccaccagcggcgugcugcccguggccgagggcaccgccagcauggugagcguggugcccagaaagagcaccaccggcaagguggccauccugagcaagcaggugagccugcccaccagcauguacggcagcgccgagggcggccccaccgagcugacccccgccaccagccacccccugaccccccugguggccgagcccgagggcgcccaggccggcaccgcccugcccgugcccaccagcuacgcccugagcagagugagcgccagaaccgccccccaggacagcaugcuggugcugcugccccagcuggccgaggcccacggcaccagcgccggcccccaccuggccgccgagcccguggacgaggccaccaccgagcccagcggcagaagcgcccccgcccugagcaucguggagggccuggccgaggcccuggccaccaccaccgaggccaacaccagcaccaccugcgugcccaucgccgagcaggacugcgugagacacaucugccuggagggccagcugaucagagugaaccagagccagcacugcccccagggcgccgccccccccagaugcggcauccugggccuggccgugagagugggcggcgacagaugcugcccccugugggagugcgccugcagaugcagcaucuuccccgaccugagcuucgugaccuucgacggcagccacguggcccuguucaaggaggccaucuacauccugagccagagccccgacgagaugcugaccgugcacgugcuggacugcaagagcgccaaccugggccaccugaacuggccccccuucugccuggugaugcugaacaugacccaccuggcccaccaggugaccaucgacagauucaacagaaaggugaccguggaccugcagcccguguggccccccgugagcagauacggcuucagaaucgaggacaccggccacauguacaugauccugacccccagcgacauccagauccaguggcugcacagcagcggccugaugaucguggaggccagcaagaccagcaaggcccagggccacggccugugcggcaucugcgacggcgacgccgccaacgaccugacccugaaggacggcagcguggugggcggcgccgaggaccccgcccccuuccuggacagcuggcaggugcccagcagccugaccagcgugggccagaccagauucagacccgacagcugcgccaccaccgacugcagccccugccugagaauggugagcaacagaaccuucagcgccugccacagauucgugccccccgagagcuucugcgagcuguggaucagagacaccaaguacgugcagcagcccugcguggcccugaccguguacguggccaugugccacaaguuccacgugugcaucgaguggagaagaagcgacuacugccccuuccugugcagcagcgacagcaccuaccaggccugcgugaccgccugcgagccccccaagaccugccaggacggcauccugggcccccuggaccccgagcacugccaggugcugggcgagggcugcgugugcagcgagggcaccauccugcacagaagacacagcgcccugugcauccccgaggccaagugcgccugcaccgacagcaugggcgugcccagagcccugggcgagaccuggaacagcagccugagcggcugcugccagcaccagugccaggcccccgacaccaucgugcccguggaccugggcugccccagccccagacccgagagcugccugagauucggcgagguggcccugcugcugcccaccaaggaccccugcugccugggcaccgugugcgugugcaaccagacccugugcgagggccuggcccccaccugcagacccggccacagacugcugacccacuuccaggaggacagcugcugccccagcuacagcugcgagugcgaccccgaccugugcgaggccgagcuggugcccagcugcagacaggaccagauccugaucaccggcagacugggcgacagcugcugcaccagcuacuucugcgccugcggcgacugccccgacagcauccccgagugccaggagggcgaggcccugaccgugcacagaaacaccaccgagcugugcugcccccuguaccagugcgugugcgagaacuucagaugcccccaggugcagugcggccugggcaccgcccugguggagguguggagccccgacagaugcugccccuacaagagcugcgagugcgacugcgacaccauccccgugcccagaugccaccugugggagaagagccagcuggacgaggaguucaugcacagcguggagaacgugugcggcugcgccaaguacgagugcgugaaggcccccgugugccugagcagagagcugggcgugaugcagcccggccagaccgugguggagcugagcgccgacggcgugugccacaccagcagaugcaccaccgugcuggacccccugaccaacuucuaccagaucaacaccaccagcgugcugugcgacauccacugcgaggccaaccaggaguacgagcaccccagagaccuggccgccugcugcggcagcugcagaaacgugagcugccuguucaccuuccccaacggcaccaccagccuguuccugcccggcgccagcuggaucgccgacugcgccagacaccacugcagcagcaccccccugggcgccgugcuggugagaagccccaucagcugccccccccugaacgagaccgagugcgccaaggugggcggcagcguggugcccagccuggagggcugcugcagaaccugcaaggaggacggcagaagcugcaagaaggugaccaucagaaugaccaucagaaagaacgagugcagaagcagcacccccgugaaccuggugagcugcgacggcagaugccccagcgccagcaucuacaacuacaacaucaacaccuacgccagauucugcaagugcugcagagaggugggccugcagagaagaagcgugcagcuguucugcgccaccaacgccaccugggugcccuacaccgugcaggagcccaccgacugcgccugccaguggagcuaa

SEQ ID NO: 21077 - RNA, 7035 nt, Artificial Sequence
  OTOGL__Homo_sapiens__NP_775862
augauccccuggagcaucuuccugcugcacgugcugcuguucagccugcaggaguacaucugcgccagcagcauccugaugggcaccagcaagaacggcuucaacgagaacagacagaagagagcccugcuggccgcccaguucgaggccaccagccccagauacuucuuccacgacgccaucaacuggggcgagagcaagaucaagggcagcugccccuacgagugccugaacggcgccuucugcagcaagaccggcaccugcgacugccagaucuuccaggcccugggcaccagaugccagaucauccccaacaugggcaacggcagagacggcaucugcaagaccuggggccaguaccacuucgagaccuucgacggcaucuacuacuacuuccccggcaacugcagcuacaucuucgccaaggacugcggcgaccuggagcccagauacaccgugugggugcacaacagccccaagugccugggcagcguguacagcugcuacagaagcaucagccuguucuucagcaaccaggaggagaucagaaucuacggccacgagaucaagaagaacggcaucagccugacccugccccagaccaucggccagaucuucaucgagaagcuggccgacuacauccuggugaagaccaccuucggcuucagccuggccugggacggcaucagcggcaucuaccugaagcugagcgaggaccacaagggcaagagcugcggccugugcggcaacuacaacgacauccagagcgacgacuucaucauccugcaggaggacuacaccgaggacaucgccauguucgccaacagcuggagcgugcagacccccgacgacaccaagugcgugcugacccccagcgacuuccccaaccccugcagcagcggcaugcccgccuucgaggccaucuucuucaagugccagauccugcugcaguuccccuuccugagcugccacgaguacaucgaccccuaccuguacaucgccagcugcgugaacgaccugugcaagaccgacgacgacgagaccuacugcagagccgccaccgaguacgccagagccugcagccacgccggcuaccccauccaggacuggagagacgacuuccccgccugcaccgacaagugcgacgacagcuucgugcacagagacugcaucagcugcugcccccccaccugcaccuucgagaagcagugccugggcagcaaccugcacugccuggacggcugcuacugccccgacggccuggugauggacaacggcaccugcaucagccuggagaacugccccugcggcuuccacggccuggccuacagcgugggcagcaagaucgagcaggagugcaccgagugcgugugcgugggcggcguguggaacugcaccgagcaggacugccccgugcagugcagcguggugggcgacagccacuucaccaccuucgacggcagacacuacagcuucaucggcaugugccaguacauccuggugaagggcaccggcaaggacaaguucaccaucacccugcagaaggcccccugcgagcagaaccugggccuggugugccugcagagcaucacccugauccuggaggacgacuucaacaagcaggugacccugggcagaggcggccagauccugaccagccccaaccagggcuucaaccugaacggcaucguggagauccagacccugagcagccuguucauccugcugaagaccaccuucggccugaagauccuguucgccaucgacggcgagagaaucuacauccagcugaccagcgccuggaagagaagaacccugggccugugcggcaccuucaacggcaacaucagagacgacuuccugagccccagcggcaugaucgagggcaccccccagcugcacgccaacgccuggagagugagcagcaccugcuucgcccccgugcacgugcccgugguggaccccugcaacaucaaccagcagaacaucggcuacgccgcccacugcgacgugauccaccaggagcuguucgcccccugccacaucuacaucagccccggccuguacuaccagcugugcagacacgacgccugcaagugcggcagcagcugccugugcaacgcccuggcccacuacgccuaccugugcggccagcacggcgugcccaucgacuucagaacccagaucagcuucugcgccguggugugccagaagggcaugcuguaccaccacugcagcagcuucugccugcacagcugcaucagccugagcagccccgagcagugcagcgacgacugcgccgagggcugcaacugccccgagggcaaguucuacgaggacacccugaacuucugcgugcccaucuuccacugcagaugccacuacagaggcagcguguaccagcccggcgagcugauccccacccccagcggccugugccagugcagcaacggcaccgugaagugcgacgagcuggccacccccagcgccgugcacaucugccccgagggcaaggaguacuucgacugcagauuccccgaccccgagcugcccgccggcggcgugaacugcgagaccaccugcgccaaccuggccaugaacuucaccugcacccccagcagccccugcaucagcggcugcgugugcgcccccggcauggccgagcacagaggcaagugcuacgugcccgagagcugccccugcaucuggaaggacugggaguaccugagcggcgaggugaucgccacccccugcuacaccugcgugugcagaagaggcauguucaacugcaccuacuaccccugccccgccgugugcaccaucuacggcgacagacacuacuacagcuucgacggccuggaguacgacuacaucagcgacugccagguguuccugaucaagagcgccgacgacagcgacaucagcgugaucgcccagaacaagaagugcuucgacaacgacaucgugugcagcaagagcgugcugaucagcgugggcgacaccgagaucuaccugaacgacacccccuacaagcagaagcagagcggcuucuuccuggagaacaagagcaccuaccagcuguggaaggccggcuacuacaucgugguguacuuccccgagaaggacaucaccauccugugggacagaaagaccaccauccacaucaaggugggcccccaguggaagaacaagcugagcggccugugcggcaacuucgacaagugcaccagcaacgacaugaccaccagcaacaaccuggaggugagaaacgccagaguguucggcgacagcugggcccugggccagugcgagagccccgacgagaccaucaagcccugcgaggcccaccagaacaaguuccccuacgccaagaaggagugcagcauccuguacagcgacaucuucgccagcugcagaaacgugaucgacgugaccagcuucgccaagaacugccacgaggacaccugcaacugcaaccugggcggcgacugcgagugccugugcaccagcaucgccgccuacgccuacaagugcugccaggagggcaucagcauccacuggagaagcagcaccgugugcagccuggacugcgaguacuacaacgagggccugggcgagggccccuacaugcuggccagcuacggccagagcggccuggugcugggcgccaacaugaccagcagaagcguguucugccugcccagaagcagcgugcacaccagccuguucuucuacuucaugaucacccccggccuguucaaggagaaggugagcagccuggcccuggugagccuggagagcgccgagagacccaacuacuuccuguacgugcacgacaacgacacccugagccuggagcugugggaggccaacagcgccuuccacagaagagccaccuucuuccaccaccagggccuguggauccccggcuacagcgccuucgagcuguacagcaagaagggcuucuucaucaucuucaccgacagcagcgugaaggccagcaaguacgacgacagcgaggaguucaagcacagcagcagcuucagcaucgaggagauccaggccgccgugcccuacagaaagaugugcgaguggagauacgagcccugcgccacccccugcuucaagaccugcagcgaccccgaggcccuggccugcaaguuccugccccccguggagggcugccugcccuacugccccaagaacaugauccuggacgaggugacccugaagugcguguaccccagagacugcauccccgugauccccaccgagcccacccugaugccccccgccaagcccaccgugcccauguucaccgugugggagaugaucacccccagcgacaucaccguguucgacaugcugacccccaccaccggccuggagugcgagccccagaaguucgaccccguguacgacugcagccaguacaucugccugaacauggaguggcagcuguacaacuggagccugaacugccccaaggacguggagaugcccgacugcggcuucagaggcagacccgugcaggugaacagcgacaucugcugccccgagugggagugccccugcagaugcagcaugcugagcgagcugagcaucaucaccuucgacggcaacaacgccgcccuguacagcauggccagcuacauccuggugagaauccccggcgagaucaucguggcccacaucgagaagugcagcaugaaccagaacggcaacagccugaagaagcuggcccccagcggcagaaucagcggccugugcuucaagaagcugaacgugaccacccccauccacaagaucaucgugaacagacuggccagaaagguggagguggacagcaucguggugccccugcccuucagcagccaggagcugagcaucgaggacagcggcagcauguacgugaucaccacccccgccggccugaucaucaaguggagccaccugaccggcaucaucgacauccacuucggcuucagauucaaccugagcagcuacaccgagggccugugcggcaucugcaacgaggaccccgacgacgaccugagaaugcagaacggcaccaucaucaccaacauggaggacaucggccuguucaucgagagcugggagaucgagaagagcuucgaggugaccaugagaagacccgugagaaacugcaccgagcacgacugcagccagugcaucgaccugcugaacagaagaaucuucauccccugccacgacaaggugagccccgaggacuucugcgagaagauguggaucaacuacaccuacuucuggaacuacgagugcgacgcccugagcgccuacguggcccugugcaacaaguucgacaucugcauccaguggagaacccccgacuacugcagccugagcugccccgagggcaaggaguaccagcccugcgugagacccugcgaggccagaaccugccugaaccagugguucuacggccacaccagcugccugaaccugagagaggacugcgugugcaaggugggcaccauccugcacagaccccacagcgcccagugcauccccgagaaggagugcgccugcaccgacagcgaggaccagcccagaaccgccggcgagaucuggaacggcggcaucgacgagugcacccuguacaagugccuggagaacggcagcaucauccccaucgagcccgacugcgacgaggagcccacccccgugugcgagagagaggccgagguggugaugggcaucaucgacaaguggaccugcugcagcaaggaggugugcggcugcgacaccacccugugcgagaccagcauccccaccugcaccaacagccagaagcugaucgugggccacagcccccugagcugcugcccccaguacaagugcgagugcgacccccugaagugccccagcaucagcacccccgagugcagagaggaccaguucaugauccaggugagacaggaggagcccugcugcuucagccccuucugcgugugcgagagcugcaccaagcccgugccccugugccacgacggcgaguuccugaccguggaccugaacagcacccacuucugcugcccccaguacuacugcgugugcgagcccaaccugugccccaugccccugcugaacugcgccgaggacaugaaccuggugaaggagaacgugagcggccagugcugccccaccuggcacugcgagugcaacugcgagaaccugaucaugcccaccugcgaggugggcgaguucaccgccaucgaccacaacuuccagagcgacugcggcugcauccaguaccugugcgagaaggacgacgugugcguguuccaggaggugagcgugcugaaccccggccagagcaugaucaaguaccuggaggaggacuucugcuacgccaucgagugccuggaggagaaggacaaccacaccggcuuccacacccugaacuucacccuggugaacugcagcaagaagugcgacgugcaccagguguacacccccagccccagcgacuacggcugcugcggcaccugcaagaacgugagcugcaaguuccacauggagaacggcaccagcgugguguacgccgugggcagcaccuggcacuacaacugcaccaccuacgagugcgugaagaccgacgagggcgccaucauccugaacuacaccauggugugcccccccuucaacgagaccgagugcaagaugaacgagggcaucgugaagcuguacaacgagggcugcugcaagaucugcaagagagaggagagaaucugccagaaggugaucaucaagagcgugaucagaaagcaggacugcaugagccagagccccaucaacguggccagcugcgacggcaagugccccagcgccaccaucuacaacaucaacaucgagagccaccugagauucugcaagugcugcagagagaacggcgugagaaaccugagcgugccccuguacugcagcggcaacggcaccgagaucauguacacccugcaggagcccaucgacugcaccugccaguggaacuaa

SEQ ID NO: 21078 - RNA, 1434 nt, Artificial Sequence
  OTOL1__Homo_sapiens__NP_001073909
auguggauguucagcuggcugugcgccauccugaucauccuggccaucgccggcaugaacaccaucgccaagaccaccccccacaccaaguucaccaagaagagcgaggagagagagaugcccaagggccugaagcccagcagcggccccccccccgaggaggaggagacccuguucaccgagauggccgagauggccgagcccaucaccaagcccagcgcccuggacagcguguucggcaccgccacccugagccccuucgagaacuucacccuggaccccgccgacuucuuccugaacugcugcgacugcugcagccccgugcccggccagaagggcgagcccggcgagaccggccagcccggccccaagggcgaggccggcaaccugggcauccccggcccccccggcguggugggcccccagggccccagaggcuacaagggcgagaagggccugaagggcgagagaggcgaccagggcgugcccggcuaccccggcaagcccggcgcccagggcgagcccggccccaagggcgacaagggcaacaucggccugggcggcgugaagggccagaagggcagcaagggcgacaccugcggcaacugcaccaagggcgagaagggcgaccagggcgccaugggcagccccggccugcacggcggccccggcgccaagggcgagaagggcgagaugggcgagaagggcgagaugggcgacaagggcugcugcggcgacagcggcgagagaggcggcaagggccagaagggcgagggcggcaugaagggcgagaagggcagcaagggcgacagcggcauggagggcaagagcggcagaaacggccugcccggcgccaagggcgaccccggcaucaagggcgagaagggcgagcugggcccccccggccugcugggccccaccggccccaagggcgacaucggcaacaagggcgugagaggccccaccggcaagaagggcagcagaggcuucaagggcagcaagggcgagcuggccagagugcccagaagcgccuucagcgccggccugagcaagcccuuccccccccccaacauccccaucaaguucgagaagauccuguacaacgaccagggcaacuacagccccgugaccggcaaguucaacugcagcauccccggcaccuacguguucagcuaccacaucaccgugagaggcagacccgccagaaucagccugguggcccagaacaagaagcaguucaagagcagagagacccuguacggccaggagaucgaccaggccagccugcuggugauccugaagcugagcgccggcgaccagguguggcuggaggugagcaaggacuggaacggcguguacgugagcgccgaggacgacagcaucuucaccggcuuccugcuguaccccgaggagaccagcggcaucagccccuaa

SEQ ID NO: 21079 - RNA, 1839 nt, Artificial Sequence
  OTOP1__Homo_sapiens__NP_819056
augcuggagggccugggcagccccgccagccccagagccgccgccagcgccagcguggccggcagcagcggccccgccgccugcagcccccccagcagcagcgcccccagaagccccgagagccccgcccccagaagaggcggcgugagagccagcgugccccagaagcuggccgagaugcugagcagccaguacggccugaucguguucguggccggccugcugcugcugcuggccugggccgugcacgccgccggcgugagcaagagcgaccugcugugcuuccugaccgcccugaugcugcugcagcugcuguggaugcugugguacgugggcagaagcagcgcccacagaagacuguucagacugaaggacacccacgccggcgccggcuggcugagaggcagcaucacccuguucgccgugaucaccgugauccugggcugccugaagaucggcuacuucaucggcuucagcgagugccugagcgccaccgagggcguguuccccgugacccacagcgugcacacccugcugcagguguacuuccuguggggccacgccaaggacaucauccagagcuucaagacccuggagagauucggcgugauccacagcguguucaccaaccugcugcugugggccaacggcgugcugaacgagagcaagcaccagcugaacgagcacaaggagagacugaucacccugggcuucggcaacaucaccaccgugcuggacgaccacaccccccagugcaacugcaccccccccacccugugcaccgccaucagccacggcaucuacuaccuguaccccuucaacaucgaguaccagauccuggccagcaccaugcuguacgugcuguggaagaacaucggcagaaagguggacagccaccagcaccagaagaugcaguucaagagcgacggcgugauggugggcgccgugcugggccugaccgugcuggccgccaccaucgccgugguggugguguaccugauccacaucggcagaagcaagaccaagagcgagagcgcccugaucauguucuaccuguacgccaucacccugcugaugcugaugggcgccgccggccuggccggcaucagaaucuacagaaucgacgagaagagccuggacgagagcaagaaccccgccagaaagcuggacagcgaccugcuggugggcaccgccagcggcagcuggcugaucagcuggggcagcauccuggccauccugugcgccgagggccaccccagauacaccugguacaaccugcccuacagcauccuggccaucguggagaaguacauccagaaccuguucaucuucgagagcauccacagagagcccgagaagcugagcgaggacauccagacccugagaguggugaccgugugcaacggcaacaccaugccccuggccagcagcugccccaagagcggcggcguggccagagacguggccccccagggcaaggacaugccccccgccgccaacggcaacgugugcaugagagagagccacgacaaggaggaggagaagcaggaggagagcagcuggggcggcagccccagccccgugagacugcccagauuccugcagggcaacgccaagagaaaggugcugagaaacaucgccgccuuccuguuccugugcaacaucagccuguggaucccccccgccuucggcugcagacccgaguacgacaacggccuggaggagaucguguucggcuucgagcccuggaucaucguggugaaccuggccaugcccuucagcaucuucuacagaaugcacgccgccgccagccuguucgagguguacugcaagaucuaa

SEQ ID NO: 21080 - RNA, 387 nt, Artificial Sequence
  OTOR__Homo_sapiens__NP_064542
auggccagaauccugcugcuguuccugcccggccugguggccgugugcgccgugcacggcaucuucauggacagacuggccagcaagaagcugugcgccgacgacgagugcguguacaccaucagccuggccagcgcccaggaggacuacaacgcccccgacugcagauucaucaacgugaagaagggccagcagaucuacguguacagcaagcuggugaaggagaacggcgccggcgaguucugggccggcagcguguacggcgacggccaggacgagaugggcguggugggcuacuuccccagaaaccuggugaaggagcagagaguguaccaggaggccaccaaggaggugcccaccaccgacaucgacuucuucugcgaguaa

SEQ ID NO: 21081 - RNA, 978 nt, Artificial Sequence
  OTP__Homo_sapiens__NP_115485
augcugagccacgccgaccugcuggacgccagacugggcaugaaggacgccgccgagcugcugggccacagagaggccgugaagugcagacugggcgugggcggcagcgaccccggcggccaccccggcgaccuggcccccaacagcgaccccguggagggcgccacccugcugcccggcgaggacaucaccaccgugggcagcacccccgccagccuggccgugagcgccaaggaccccgacaagcagcccggcccccagggcggccccaaccccagccaggccggccagcagcagggccagcagaagcagaagagacacagaaccagauucacccccgcccagcugaacgagcuggagagaagcuucgccaagacccacuaccccgacaucuucaugagagaggagcuggcccugagaaucggccugaccgagagcagagugcaggugugguuccagaacagaagagccaaguggaagaagagaaagaagaccaccaacguguucagagcccccggcacccugcugcccacccccggccugccccaguuccccagcgccgccgccgccgccgccgccgccaugggcgacagccugugcagcuuccacgccaacgacaccagaugggccgccgccgccaugcccggcgugagccagcugccccugccccccgcccugggcagacagcaggccauggcccagagccugagccagugcagccuggccgccggccccccccccaacagcaugggccugagcaacagccuggccggcagcaacggcgccggccugcagagccaccuguaccagcccgccuuccccggcauggugcccgccagccugcccggccccagcaacgugagcggcagcccccagcugugcagcagccccgacagcagcgacguguggagaggcaccagcaucgccagccugagaagaaaggcccuggagcacaccgugagcaugagcuucaccuaa

SEQ ID NO: 21082 - RNA, 816 nt, Artificial Sequence
  OTUB1__Homo_sapiens__NP_060140
auggccgccgaggagccccagcagcagaagcaggagccccugggcagcgacagcgagggcgugaacugccuggccuacgacgaggccaucauggcccagcaggacagaauccagcaggagaucgccgugcagaacccccuggugagcgagagacuggagcugagcgugcuguacaaggaguacgccgaggacgacaacaucuaccagcagaagaucaaggaccugcacaagaaguacagcuacaucagaaagaccagacccgacggcaacugcuucuacagagccuucggcuucagccaccuggaggcccugcuggacgacagcaaggagcugcagagauucaaggccgugagcgccaagagcaaggaggaccuggugagccagggcuucaccgaguucaccaucgaggacuuccacaacaccuucauggaccugaucgagcagguggagaagcagaccagcguggccgaccugcuggccagcuucaacgaccagagcaccagcgacuaccuggugguguaccugagacugcugaccagcggcuaccugcagagagagagcaaguucuucgagcacuucaucgagggcggcagaaccgugaaggaguucugccagcaggagguggagcccaugugcaaggagagcgaccacauccacaucaucgcccuggcccaggcccugagcgugagcauccagguggaguacauggacagaggcgagggcggcaccaccaacccccacaucuuccccgagggcagcgagcccaagguguaccugcuguacagacccggccacuacgacauccuguacaaguaa

SEQ ID NO: 21083 - RNA, 1446 nt, Artificial Sequence
  OTUD1__Homo_sapiens__NP_001138845
augcagcuguacagcagcgugugcacccacuaccccgccggcgcccccggccccaccgccgccgcccccgccccccccgccgccgccacccccuucaaggugagccugcagccccccggcgccgccggcgccgcccccgagcccgagaccggcgagugccagcccgccgccgccgccgagcacagagaggccgccgccgugcccgccgccaagaugcccgccuucagcagcugcuucgagguggugagcggcgccgccgcccccgccagcgccgccgccggcccccccggcgccagcugcaagcccccccugcccccccacuacaccagcaccgcccagaucaccgugagagcccugggcgccgacagacugcugcugcacggccccgaccccgugcccggcgccgccggcagcgccgccgcccccagaggcagaugccugcugcuggcccccgcccccgccgcccccgugccccccagaagaggcagcagcgccuggcugcuggaggagcugcugagacccgacugccccgagcccgccggccuggacgccaccagagagggccccgacagaaacuucagacugagcgagcacagacaggcccuggccgccgccaagcacagaggccccgccgccacccccggcagccccgaccccggccccggccccuggggcgaggagcaccuggccgagagaggccccagaggcugggagagaggcggcgacagaugcgacgcccccggcggcgacgccgccagaagacccgaccccgaggccgaggccccccccgccggcagcaucgaggccgcccccagcagcgccgccgagcccgugaucgugagcagaagcgaccccagagacgagaagcuggcccuguaccuggccgagguggagaagcaggacaaguaccugagacagagaaacaaguacagauuccacaucauccccgacggcaacugccuguacagagccgugagcaagaccguguacggcgaccagagccugcacagagagcugagagagcagaccgugcacuacaucgccgaccaccuggaccacuucagcccccugaucgagggcgacgugggcgaguucaucaucgccgccgcccaggacggcgccugggccggcuaccccgagcugcuggccaugggccagaugcugaacgugaacauccaccugaccaccggcggcagacuggagagccccaccgugagcaccaugauccacuaccugggccccgaggacagccugagacccagcaucuggcugagcuggcugagcaacggccacuacgacgccguguucgaccacagcuaccccaaccccgaguacgacaacuggugcaagcagacccaggugcagagaaagagagacgaggagcuggccaagagcauggccaucagccugagcaagauguacaucgagcagaacgccugcagcuaa

SEQ ID NO: 21084 - RNA, 3150 nt, Artificial Sequence
  OTUD4__Homo_sapiens__NP_001096123
auggccugcauccacuaccugagagagaacagagagaaguucgaggccuucaucgagggcagcuucgaggaguaccugaagagacuggagaacccccaggagugggugggccagguggagaucagcgcccugagccugauguacagaaaggacuucaucaucuacagagagcccaacgugagccccagccaggugaccgagaacaacuuccccgagaaggugcugcugugcuucagcaacggcaaccacuacgacaucguguaccccaucaaguacaaggagagcagcgccaugugccagagccugcuguacgagcugcuguacgagaagguguucaagaccgacgugagcaagaucgugauggagcuggacacccuggagguggccgacgaggacaacagcgagaucagcgacagcgaggacgacagcugcaagagcaagaccgccgccgccgccgccgacgugaacggcuucaagccccugagcggcaacgagcagcugaagaacaacggcaacagcaccagccugccccugagcagaaaggugcugaagagccugaaccccgccguguacagaaacguggaguacgagaucuggcugaagagcaagcaggcccagcagaagagagacuacagcaucgccgccggccugcaguacgaggugggcgacaagugccaggugagacuggaccacaacggcaaguuccugaacgccgacgugcagggcauccacagcgagaacggccccgugcugguggaggagcugggcaagaagcacaccagcaagaaccugaaggcccccccccccgagagcuggaacaccgugagcggcaagaagaugaagaagcccagcaccagcggccagaacuuccacagcgacguggacuacagaggccccaagaaccccagcaagcccaucaaggcccccagcgcccugccccccagacugcagcaccccagcggcgugagacagcacgccuucagcagccacagcagcggcagccagagccagaaguucagcagcgagcacaagaaccugagcagaacccccagccagaucaucagaaagcccgacagagagagaguggaggacuucgaccacaccagcagagagagcaacuacuucggccugagccccgaggagagaagagagaagcaggccaucgaggagagcagacugcuguacgagauccagaacagagacgagcaggccuuccccgcccugagcagcagcagcgugaaccagagcgccagccagagcagcaaccccugcgugcagagaaagagcagccacgugggcgacagaaagggcagcagaagaagaauggacaccgaggagagaaaggacaaggacagcauccacggccacagccagcuggacaagagacccgagcccagcacccuggagaacaucaccgacgacaaguacgccaccgugagcagccccagcaagagcaagaagcuggagugccccagccccgccgagcagaagcccgccgagcacgugagccugagcaaccccgccccccugcuggugagccccgaggugcaccugacccccgccgugcccagccugcccgccaccgugcccgccuggcccagcgagcccaccaccuucggccccaccggcgugcccgcccccauccccgugcugagcgugacccagacccugaccaccggccccgacagcgccgugagccaggcccaccugacccccagccccgugcccgugagcauccaggccgugaaccagccccugaugccccugccccagacccugagccuguaccaggacccccuguaccccggcuuccccugcaacgagaagggcgacagagccaucgugccccccuacagccugugccagaccggcgaggaccugcccaaggacaagaacauccugagauucuucuucaaccugggcgugaaggccuacagcugccccaugugggccccccacagcuaccuguacccccugcaccaggccuaccuggccgccugcagaauguaccccaaggugcccgugcccguguacccccacaaccccugguuccaggaggcccccgccgcccagaacgagagcgacugcaccugcaccgacgcccacuuccccaugcagaccgaggccagcgugaacggccagaugccccagcccgagaucggcccccccaccuucagcagcccccuggugaucccccccagccaggugagcgagagccacggccagcugagcuaccaggccgaccuggagagcgagacccccggccagcugcugcacgccgacuacgaggagagccugagcggcaagaacauguucccccagcccagcuucggccccaaccccuuccugggccccgugcccaucgccccccccuucuucccccacgugugguacggcuaccccuuccagggcuucaucgagaaccccgugaugagacagaacaucgugcugcccagcgacgagaagggcgagcuggaccugagccuggagaaccuggaccugagcaaggacugcggcagcgugagcaccguggacgaguuccccgaggccagaggcgagcacgugcacagccugcccgaggccagcgugagcagcaagcccgacgagggcagaaccgagcagagcagccagaccagaaaggccgacaccgcccuggccagcaucccccccguggccgagggcaaggcccacccccccacccagauccugaacagagagagagagaccgugcccguggagcuggagcccaagagaaccauccagagccugaaggagaagaccgagaaggugaaggaccccaagaccgccgccgacguggugagccccggcgccaacagcguggacagcagagugcagagacccaaggaggagagcagcgaggacgagaacgaggugagcaacauccugagaagcggcagaagcaagcaguucuacaaccagaccuacggcagcagaaaguacaagagcgacuggggcuacagcggcagaggcggcuaccagcacgugagaagcgaggagagcuggaagggccagcccagcagaagcagagacgagggcuaccaguaccacagaaacgugagaggcagacccuucagaggcgacagaagaagaagcggcaugggcgacggccacagaggccagcacaccuaa

SEQ ID NO: 21085 - RNA, 2781 nt, Artificial Sequence
  OTUD7A__Homo_sapiens__NP_570971
auggugagcagcgugcugcccaaccccaccagcgccgagugcugggccgcccugcugcacgaccccaugacccuggacauggacgccgugcugagcgacuucgugagaagcaccggcgccgagcccggccuggccagagaccugcuggagggcaagaacugggaccugaccgccgcccugagcgacuacgagcagcugagacaggugcacaccgccaaccugccccacguguucaacgagggcagaggccccaagcagcccgagagagagccccagcccggccacaagguggagagacccugccugcagagacaggacgacaucgcccaggagaagagacugagcagaggcaucagccacgccagcagcgccaucgugagccuggccagaagccacguggccagcgagugcaacaacgagcaguucccccuggagaugcccaucuacaccuuccagcugcccgaccugagcguguacagcgaggacuucagaagcuucaucgagagagaccugaucgagcaggccaccaugguggcccuggagcaggccggcagacugaacugguggagcaccgugugcaccagcugcaagagacugcugccccuggccaccaccggcgacggcaacugccugcugcacgccgccagccugggcauguggggcuuccacgacagagaccuggugcugagaaaggcccuguacaccaugaugagaaccggcgccgagagagaggcccugaagagaagauggagauggcagcagacccagcagaacaaggaggaggagugggagagagaguggaccgagcugcugaagcuggccagcagcgagcccagaacccacuucagcaagaacggcggcaccggcggcggcguggacaacagcgaggaccccguguacgagagccuggaggaguuccacguguucgugcuggcccacauccugagaagacccaucguggugguggccgacaccaugcugagagacagcggcggcgaggccuucgcccccauccccuucggcggcaucuaccugccccuggaggugccccccaacagaugccacugcagcccccuggugcuggccuacgaccaggcccacuucagcgcccuggugagcauggagcagagagaccagcagagagagcaggccgugaucccccugaccgacagcgagcacaagcugcugccccugcacuucgccguggaccccggcaaggacugggaguggggcaaggacgacaacgacaacgccagacuggcccaccugauccugagccuggaggccaagcugaaccugcugcacagcuacaugaacgugaccuggaucagaauccccagcgagaccagagccccccuggcccagcccgagagccccaccgccagcgccggcgaggacgugcagagccuggccgacagccuggacagcgacagagacagcgugugcagcaacagcaacagcaacaacggcaagaacggcaaggacaaggagaaggagaagcagagaaaggagaaggacaagaccagagccgacagcguggccaacaagcugggcagcuucagcaagacccugggcaucaagcugaagaagaacaugggcggccugggcggccuggugcacggcaagaugggcagagccaacagcgccaacggcaagaacggcgacagcgccgagagaggcaaggagaagaaggccaagagcagaaagggcagcaaggaggagagcggcgccagcgccagcaccagccccagcgagaagaccacccccagccccaccgacaaggccgccggcgccagccccgccgagaagggcggcggccccagaggcgacgccuggaaguacagcaccgacgugaagcugagccugaacauccugagagccgccaugcagggcgagagaaaguucaucuucgccggccugcugcugaccagccacagacaccaguuccacgaggagaugaucggcuacuaccugaccagcgcccaggagagauucagcgccgagcaggagcagagaagaagagacgccgccaccgccgccgccgccgccgccgccgccgccgccgccaccgccaagagaccccccagaagacccgagaccgagggcgugcccgugcccgagagagccagccccggcccccccacccagcuggugcugaagcugaaggagagacccagccccggccccgccgccggcagagccgccagagccgccgccggcggcaccgccagccccggcggcggcgccagaagagccagcgccagcggccccgugcccggcagaagcccccccgcccccgccagacagagcgugauccacgugcaggccagcggcgccagagacgaggccugcgcccccgccgugggcgcccugagacccugcgccaccuacccccagcagaacagaagccugagcagccagagcuacagccccgccagagccgccgcccugagaaccgugaacaccguggagagccuggccagagccgugcccggcgcccugcccggcgccgccggcaccgccggcgccgccgagcacaagagccagaccuacaccaacggcuucggcgcccugagagacggccuggaguucgccgacgccgacgcccccaccgccagaagcaacggcgagugcggcagaggcggccccggccccgugcagagaagaugccagagagagaacugcgccuucuacggcagagccgagaccgagcacuacugcagcuacugcuacagagaggagcugagaagaagaagagaggccagaggcgccagacccuaa

SEQ ID NO: 21086 - RNA, 2559 nt, Artificial Sequence
  OTUD7B__Homo_sapiens__XP_011508087
augacccuggacauggacgccgugcugagcgacuucgugagaagcaccggcgccgagcccggccuggccagagaccugcuggagggcaagaacugggacgugaacgccgcccugagcgacuucgagcagcugagacaggugcacgccggcaaccugccccccagcuucagcgagggcagcggcggcagcagaacccccgagaagggcuucagcgacagagagcccaccagaccccccagacccauccugcagagacaggacgacaucgugcaggagaagagacugagcagaggcaucagccacgccagcagcagcaucgugagccuggccagaagccacgugagcagcaacggcggcggcggcggcagcaacgagcacccccuggagaugcccaucugcgccuuccagcugcccgaccugaccguguacaacgaggacuucagaagcuucaucgagagagaccugaucgagcagagcaugcugguggcccuggagcaggccggcagacugaacuggugggugagcguggaccccaccagccagagacugcugccccuggccaccaccggcgacggcaacugccugcugcacgccgccagccugggcauguggggcuuccacgacagagaccugaugcugagaaaggcccuguacgcccugauggagaagggcguggagaaggaggcccugaagagaagauggagauggcagcagacccagcagaacaaggagagcggccugguguacaccgaggacgaguggcagaaggaguggaacgagcugaucaagcuggccagcagcgagcccagaaugcaccugggcaccaacggcgccaacugcggcggcguggagagcagcgaggagcccguguacgagagccuggaggaguuccacguguucgugcuggcccacgugcugagaagacccaucguggugguggccgacaccaugcugagagacagcggcggcgaggccuucgcccccauccccuucggcggcaucuaccugccccuggaggugcccgccagccagugccacagaagcccccuggugcuggccuacgaccaggcccacuucagcgcccuggugagcauggagcagaaggagaacaccaaggagcaggccgugaucccccugaccgacagcgaguacaagcugcugccccugcacuucgccguggaccccggcaagggcugggaguggggcaaggacgacagcgacaacgugagacuggccagcgugauccugagccuggaggugaagcugcaccugcugcacagcuacaugaacgugaaguggaucccccugagcagcgacgcccaggugaagaccagccccaccagcacccuggccccccuggcccagcccgagagccccaccgccagcgccggcgacgagcccagaagcacccccgagagcggcgacagcgacaaggagagcgugggcagcagcagcaccagcaacgagggcggcagaagaaaggagaagagcaagagagacagagagaaggacaagaagagagccgacagcguggccaacaagcugggcagcuucggcaagacccugggcagcaagcugaagaagaacaugggcggccugaugcacagcaagggcagcaagcccggcggcgugggcaccggccugggcggcagcagcggcaccgagacccuggagaagaagaagaagaacagccugaagagcuggaagggcggcaaggaggaggccgccggcgacggccccgugagcgagaagccccccgccgagagcgugggcaacggcggcagcaaguacagccaggaggugaugcagagccugagcauccugagaaccgccaugcagggcgagggcaaguucaucuucgugggcacccugaagaugggccacagacaccaguaccaggaggagaugauccagagauaccugagcgacgccgaggagagauuccuggccgagcagaagcagaaggaggccgagagaaagaucaugaacggcggcaucggcggcggccccccccccgccaagaagcccgagcccgacgccagagaggagcagcccaccggcccccccgccgagagcagagccauggccuucagcaccggcuaccccggcgacuucaccauccccagacccagcggcggcggcgugcacugccaggagcccagaagacagcuggccggcggccccugcgugggcggccugccccccuacgccaccuuccccagacagugcccccccggcagacccuacccccaccaggacagcauccccagccuggagcccggcagccacagcaaggacggccugcacagaggcgcccugcugcccccccccuacagaguggccgacagcuacagcaacggcuacagagagccccccgagcccgacggcugggccggcggccugagaggccugccccccacccagaccaagugcaagcagcccaacugcagcuucuacggccaccccgagaccaacaacuucugcagcugcugcuacagagaggagcugagaagaagagagagagagcccgacggcgagcugcuggugcacagauucuaa

SEQ ID NO: 21087 - RNA, 1059 nt, Artificial Sequence
  OTULIN__Homo_sapiens__NP_612357
augagcagaggcaccaugccccagcccgaggccuggcccggcgccagcugcgccgagacccccgccagagaggccgccgccaccgccagagacggcggcaaggccgccgccagcggccagcccagacccgagaugcagugccccgccgagcacgaggaggacauguacagagccgccgacgagaucgagaaggagaaggagcugcugauccacgagagaggcgccagcgagcccagacugagcguggcccccgagauggacaucauggacuacugcaagaaggaguggagaggcaacacccagaaggccaccugcaugaagaugggcuacgaggaggugagccagaaguucaccagcaucagaagagugagaggcgacaacuacugcgcccugagagccacccuguuccaggccaugagccaggccgugggccugccccccuggcugcaggaccccgagcugaugcugcugcccgagaagcugaucagcaaguacaacuggaucaagcaguggaagcugggccugaaguucgacggcaagaacgaggaccugguggacaagaucaaggagagccugacccugcugagaaagaagugggccggccuggccgagaugagaaccgccgaggccagacagaucgccugcgacgagcuguucaccaacgaggccgaggaguacagccuguacgaggccgugaaguuccugaugcugaacagagccaucgagcuguacaacgacaaggagaagggcaaggaggugcccuucuucagcgugcugcuguucgccagagacaccagcaacgaccccggccagcugcugagaaaccaccugaaccaggugggccacaccggcggccuggagcagguggagauguuccugcuggccuacgccgugagacacaccauccagguguacagacugagcaaguacaacaccgaggaguucaucaccguguaccccaccgacccccccaaggacuggcccguggugacccugaucgccgaggacgacagacacuacaacauccccgugagagugugcgaggagaccagccuguaa

SEQ ID NO: 21088 - RNA, 1065 nt, Artificial Sequence
  OTX1__Homo_sapiens__NP_055377
augaugagcuaccugaagcagccccccuacggcaugaacggccugggccuggccggccccgccauggaccugcugcaccccagcgugggcuaccccgccacccccagaaagcagagaagagagagaaccaccuucaccagaagccagcuggacgugcuggaggcccuguucgccaagaccagauaccccgacaucuucaugagagaggagguggcccugaagaucaaccugcccgagagcagagugcaggugugguucaagaacagaagagccaagugcagacagcagcagcagagcggcagcggcaccaagagcagacccgccaagaagaagagcagccccgugagagagagcagcggcagcgagagcagcggccaguucaccccccccgccgugagcagcagcgccagcagcagcagcagcgccagcagcagcagcgccaaccccgccgccgccgccgccgccggccugggcggcaaccccguggccgccgccagcagccugagcacccccgccgccagcagcaucuggagccccgccagcaucagccccggcagcgcccccgccagcgugagcgugcccgagccccuggccgcccccagcaacaccagcugcaugcagagaagcguggccgccggcgccgccaccgccgccgccagcuaccccaugagcuacggccagggcggcagcuacggccagggcuaccccacccccagcagcagcuacuucggcggcguggacugcagcagcuaccuggcccccaugcacagccaccaccacccccaccagcugagccccauggcccccagcagcauggccggccaccaccaccaccacccccacgcccaccacccccugagccagagcagcggccaccaccaccaccaccaccaccaccaccaccagggcuacggcggcagcggccuggccuucaacagcgccgacugccuggacuacaaggagcccggcgccgccgccgccagcagcgccuggaagcugaacuucaacagccccgacugccuggacuacaaggaccaggccagcuggagauuccaggugcuguaa

SEQ ID NO: 21089 - RNA, 870 nt, Artificial Sequence
  OTX2__Homo_sapiens__NP_001257453
augaugagcuaccugaagcagccccccuacgccgugaacggccugagccugaccaccagcggcauggaccugcugcaccccagcgugggcuaccccgccacccccagaaagcagagaagagagagaaccaccuucaccagagcccagcuggacgugcuggaggcccuguucgccaagaccagauaccccgacaucuucaugagagaggagguggcccugaagaucaaccugcccgagagcagagugcaggugugguucaagaacagaagagccaagugcagacagcagcagcagcagcagcagaacggcggccagaacaaggugagacccgccaagaagaagaccagccccgccagagaggugagcagcgagagcggcaccagcggccaguucaccccccccagcagcaccagcgugcccaccaucgccagcagcagcgcccccgugagcaucuggagccccgccagcaucagcccccugagcgacccccugagcaccagcagcagcugcaugcagagaagcuaccccaugaccuacacccaggccagcggcuacagccagggcuacgccggcagcaccagcuacuucggcggcauggacugcggcagcuaccugacccccaugcaccaccagcugcccggccccggcgccacccugagccccaugggcaccaacgccgugaccagccaccugaaccagagccccgccagccugagcacccagggcuacggcgccagcagccugggcuucaacagcaccaccgacugccuggacuacaaggaccagaccgccagcuggaagcugaacuucaacgccgacugccuggacuacaaggaccagaccagcagcuggaaguuccaggugcuguaa

SEQ ID NO: 21090 - RNA, 684 nt, Artificial Sequence
  OVCA2__Homo_sapiens__NP_543012
auggccgcccagagaccccugagagugcugugccuggccggcuucagacagagcgagagaggcuucagagagaagaccggcgcccugagaaaggcccugagaggcagagccgagcuggugugccugagcggcccccaccccgugcccgacccccccggccccgagggcgccagaagcgacuucggcagcugcccccccgaggagcagcccagaggcuggugguucagcgagcaggaggccgacguguucagcgcccuggaggagcccgccgugugcagaggccuggaggagagccugggcaugguggcccaggcccugaacagacugggccccuucgacggccugcugggcuucagccagggcgccgcccuggccgcccuggugugcgcccugggccaggccggcgaccccagauucccccugcccagauucauccugcuggugagcggcuucugccccagaggcaucggcuucaaggagagcauccugcagagaccccugagccugcccagccugcacguguucggcgacaccgacaaggugauccccagccaggagagcgugcagcuggccagccaguuccccggcgccaucacccugacccacagcggcggccacuucauccccgccgccgccccccagagacaggccuaccugaaguuccuggaccaguucgccgaguaa

SEQ ID NO: 21091 - RNA, 804 nt, Artificial Sequence
  OVOL1__Homo_sapiens__NP_004552
augcccagagccuuccuggugaagaagcccugcgugagcaccugcaagagaaacuggagcgagcugcccgacgaggagagaggcgagaucuacgugcccgugagccugggcuucugccccccccagcccuacagagagcccgagcccagcguggccgagccccccagcugcccccuggcccugaacaugagccugagagacagcagcuacagcauggcccccggccccugcgugguggcccagcugcccagcgaggacaugggccaccugaccgacccccagagcagagaccacggcuuccugagaaccaagaugaaggugacccugggcgacagccccagcggcgaccuguucaccugcagagugugccagaaggccuucaccuaccagagaaugcugaacagacacaugaagugccacaacgacgugaagagacaccugugcaccuacugcggcaagggcuucaacgacaccuucgaccugaagagacacgugagaacccacaccggcgugagacccuacaagugcagccugugcgacaaggccuucacccagagaugcagccuggagagccaccugaagaagauccacggcgugcagcagaaguacgccuacaaggagagaagagccaagcuguacgugugcgaggagugcggcugcaccagcgagagccaggagggccacgugcugcaccugaaggagcaccaccccgacagcccccugcugagaaagaccagcaagaagguggccguggcccugcagaacaccgugaccagccugcugcagggcagcccccaccuguaa

SEQ ID NO: 21092 - RNA, 828 nt, Artificial Sequence
  OVOL2__Homo_sapiens__NP_067043
augcccaagguguuccuggugaagagaagaagccugggcgugagcgugagaagcugggacgagcugcccgacgagaagagagccgacaccuacauccccgugggccugggcagacugcugcacgacccccccgaggacugcagaagcgacggcggcagcagcagcggcagcggcagcagcagcgccggcgagcccggcggcgccgagagcagcagcagcccccacgcccccgagagcgagacccccgagcccggcgacgccgagggccccgacggccaccuggccaccaagcagagacccguggccagaagcaagaucaaguucaccaccggcaccugcagcgacagcguggugcacagcugcgaccugugcggcaagggcuucagacugcagagaaugcugaacagacaccugaagugccacaaccaggugaagagacaccugugcaccuucugcggcaagggcuucaacgacaccuucgaccugaagagacacgugagaacccacaccggcaucagacccuacaagugcaacgugugcaacaaggccuucacccagagaugcagccuggagagccaccugaagaagauccacggcgugcagcagcaguacgccuacaagcagagaagagacaagcuguacgugugcgaggacugcggcuacaccggccccacccaggaggaccuguaccugcacgugaacagcgcccaccccggcagcagcuuccugaagaagaccagcaagaagcuggccgcccugcugcagggcaagcugaccagcgcccaccaggagaacaccagccugagcgaggaggaggagagaaaguaa

SEQ ID NO: 21093 - RNA, 1488 nt, Artificial Sequence
  OXA1L__Homo_sapiens__NP_005006
auggugaccuggcuguacagauuccugcccaccagcaacauggccgccaagcugagaagccugcugccccccgaccugagacugcaguucuggcugcacgccagacugcagaagugcuuccugagcagaggcugcggcagcuacugcgccggcgccaaggccagcccccugcccggcaagauggccaugggccugaugugcggcagaagagagcugcugagacugcugcagagcggcagaagagugcacagcguggccggccccagccaguggcugggcaagccccugaccaccagacugcuguuccccgccgcccccugcugcugcagaccccacuaccuguuccuggccgccagcggccccagaagccugagcaccagcgccaucagcuucgccgaggugcaggugcaggccccccccgugguggccgccacccccagccccaccgccgugcccgagguggccagcggcgagaccgccgacguggugcagaccgccgccgagcagagcuucgccgagcugggccugggcagcuacacccccgugggccugauccagaaccugcuggaguucaugcacguggaccugggccugcccugguggggcgccaucgccgccugcaccguguucgccagaugccugaucuucccccugaucgugaccggccagagagaggccgccagaauccacaaccaccugcccgagauccagaaguucagcagcagaaucagagaggccaagcuggccggcgaccacaucgaguacuacaaggccagcagcgagauggcccuguaccagaagaagcacggcaucaagcuguacaagccccugauccugcccgugacccaggcccccaucuucaucagcuucuucaucgcccugagagagauggccaaccugcccgugcccagccugcagaccggcggccuguggugguuccaggaccugaccgugagcgaccccaucuacauccugccccuggccgugaccgccaccaugugggccgugcuggagcugggcgccgagaccggcgugcagagcagcgaccugcaguggaugagaaacgugaucagaaugaugccccugaucacccugcccaucaccaugcacuuccccaccgccguguucauguacuggcugagcagcaaccuguucagccuggugcaggugagcugccugagaauccccgccgugagaaccgugcugaagaucccccagagaguggugcacgaccuggacaagcugccccccagagagggcuuccuggagagcuucaagaagggcuggaagaacgccgagaugaccagacagcugagagagagagagcagagaaugagaaaccagcuggagcuggccgccagaggcccccugagacagaccuucacccacaacccccugcugcagcccggcaaggacaacccccccaacauccccagcagcagcagcaagcccaagagcaaguaccccuggcacgacacccugggcuaa

SEQ ID NO: 21094 - RNA, 1563 nt, Artificial Sequence
  OXCT1__Homo_sapiens__NP_000427
auggccgcccugaagcugcugagcagcggccugagacugugcgccagcgccagaggcagcggcgccaccugguacaagggcugcgugugcagcuucagcaccagcgcccacagacacaccaaguucuacaccgaccccguggaggccgugaaggacauccccgacggcgccaccgugcuggugggcggcuucggccugugcggcauccccgagaaccugaucgacgcccugcugaagaccggcgugaagggccugaccgccgugagcaacaacgccggcguggacaacuucggccugggccugcugcugagaagcaagcagaucaagagaauggugagcagcuacgugggcgagaacgccgaguucgagagacaguaccugagcggcgagcuggagguggagcugaccccccagggcacccuggccgagagaaucagagccggcggcgccggcgugcccgccuucuacacccccaccggcuacggcacccuggugcaggagggcggcagccccaucaaguacaacaaggacggcagcguggccaucgccagcaagcccagagaggugagagaguucaacggccagcacuucauccuggaggaggccaucaccggcgacuucgcccuggugaaggccuggaaggccgacagagccggcaacgugaucuucagaaagagcgccagaaacuucaaccugcccaugugcaaggccgccgagaccaccgugguggagguggaggagaucguggacaucggcgccuucgcccccgaggacauccacaucccccagaucuacgugcacagacugaucaagggcgagaaguacgagaagagaaucgagagacugagcaucagaaaggagggcgacggcgaggccaagagcgccaagcccggcgacgacgugagagagagaaucaucaagagagccgcccuggaguucgaggacggcauguacgccaaccugggcaucggcaucccccugcuggccagcaacuucaucagccccaacaucaccgugcaccugcagagcgagaacggcgugcugggccugggccccuaccccagacagcacgaggccgacgccgaccugaucaacgccggcaaggagaccgugaccauccugcccggcgccagcuucuucagcagcgacgagagcuucgccaugaucagaggcggccacguggaccugaccaugcugggcgccaugcaggugagcaaguacggcgaccuggccaacuggaugauccccggcaagauggugaagggcaugggcggcgccauggaccuggugagcagcgccaagaccaaggugguggugaccauggagcacagcgccaagggcaacgcccacaagaucauggagaagugcacccugccccugaccggcaagcagugcgugaacagaaucaucaccgagaaggccguguucgacguggacaagaagaagggccugacccugaucgagcugugggagggccugaccguggacgacgugcagaagagcaccggcugcgacuucgccgugagccccaagcugaugcccaugcagcagaucgccaacuaa

SEQ ID NO: 21095 - RNA, 1272 nt, Artificial Sequence
  OXER1__Homo_sapiens__NP_683765
augcugugccacagaggcggccagcugaucgugcccaucaucccccugugccccgagcacagcugcagaggcagaagacugcagaaccugcugagcggccccuggcccaagcagcccauggagcugcacaaccugagcagccccagccccagccugagcagcagcgugcugccccccagcuucagccccagccccagcagcgcccccagcgccuucaccaccgugggcggcagcagcggcggccccugccaccccaccagcagcagccuggugagcgccuuccuggcccccauccuggcccuggaguucgugcugggccuggugggcaacagccuggcccuguucaucuucugcauccacaccagacccuggaccagcaacaccguguuccuggugagccugguggccgccgacuuccugcugaucagcaaccugccccugagaguggacuacuaccugcugcacgagaccuggagauucggcgccgccgccugcaaggugaaccuguucaugcugagcaccaacagaaccgccagcgugguguuccugaccgccaucgcccugaacagauaccugaagguggugcagccccaccacgugcugagcagagccagcgugggcgccgccgccagaguggccggcggccugugggugggcauccugcugcugaacggccaccugcugcugagcaccuucagcggccccagcugccugagcuacagagugggcaccaagcccagcgccagccugagauggcaccaggcccuguaccugcuggaguucuuccugccccuggcccugauccuguucgccaucgugagcaucggccugaccaucagaaacagaggccugggcggccaggccggcccccagagagccaugagagugcuggccauggugguggccguguacaccaucugcuuccugcccagcaucaucuucggcauggccagcaugguggccuucuggcugagcgccugcagaagccuggaccugugcacccagcuguuccacggcagccuggccuucaccuaccugaacagcgugcuggaccccgugcuguacugcuucagcagccccaacuuccugcaccagagcagagcccugcugggccugaccagaggcagacagggccccgugagcgacgagagcagcuaccagcccagcagacaguggagauacagagaggccagcagaaaggccgaggccaucggcaagcugaaggugcagggcgaggugagccuggagaaggagggcagcagccagggcuaa

SEQ ID NO: 21096 - RNA, 1014 nt, Artificial Sequence
  OXGR1__Homo_sapiens__XP_005254103
augaacgagccccuggacuaccuggccaacgccagcgacuuccccgacuacgccgccgccuucggcaacugcaccgacgagaacaucccccugaagaugcacuaccugcccgugaucuacggcaucaucuuccuggugggcuuccccggcaacgccguggugaucagcaccuacaucuucaagaugagacccuggaagagcagcaccaucaucaugcugaaccuggccugcaccgaccugcuguaccugaccagccugcccuuccugauccacuacuacgccagcggcgagaacuggaucuucggcgacuucaugugcaaguucaucagauucagcuuccacuucaaccuguacagcagcauccuguuccugaccugcuucagcaucuucagauacugcgugaucauccaccccaugagcugcuucagcauccacaagaccagaugcgccgugguggccugcgccgugguguggaucaucagccugguggccgugauccccaugaccuuccugaucaccagcaccaacagaaccaacagaagcgccugccuggaccugaccagcagcgacgagcugaacaccaucaagugguacaaccugauccugaccgccaccaccuucugccugccccuggugaucgugacccugugcuacaccaccaucauccacacccugacccacggccugcagaccgacagcugccugaagcagaaggccagaagacugaccauccugcugcugcuggccuucuacgugugcuuccugcccuuccacauccugagagugaucagaaucgagagcagacugcugagcaucagcugcagcaucgagaaccagauccacgaggccuacaucgugagcagaccccuggccgcccugaacaccuucggcaaccugcugcuguacgugguggugagcgacaacuuccagcaggccgugugcagcaccgugagaugcaaggugagcggcaaccuggagcaggccaagaagaucagcuacagcaacaaccccuaa

SEQ ID NO: 21097 - RNA, 2625 nt, Artificial Sequence
  OXR1__Homo_sapiens__NP_001185461
augaccaaggacaagaacagccccggccugaagaagaagagccagagcguggacaucaacgcccccggcuucaacccccuggccggcgccggcaagcagaccccccaggccagcaagccccccgcccccaagacccccaucaucgaggaggagcagaacaacgccgccaacacccagaagcaccccagcagaagaagcgagcugaagagauucuacaccaucgacaccggccagaagaagacccuggacaagaaggacggcagaagaaugagcuuccagaagcccaagggcaccaucgaguacaccguggagagcagagacagccugaacagcaucgcccugaaguucgacaccacccccaacgagcuggugcagcugaacaagcuguucagcagagccguggugaccggccaggugcuguacgugcccgaccccgaguacgugagcagcguggagagcagccccagccugagccccgugagcccccugagccccaccagcagcgaggccgaguucgacaagaccaccaaccccgacgugcaccccaccgaggccacccccagcagcaccuucaccggcaucagacccgccagaguggugagcagcaccagcgaggaggaggaggccuucaccgagaaguuccugaagaucaacugcaaguacaucaccagcggcaagggcaccgugagcggcgugcugcuggugacccccaacaacaucauguucgacccccacaagaacgacccccuggugcaggagaacggcugcgaggaguacggcaucaugugccccauggaggaggugaugagcgccgccauguacaaggagauccuggacagcaagaucaaggagagccugcccaucgacaucgaccagcugagcggcagagacuucugccacagcaagaagaugaccggcagcaacaccgaggagaucgacagcagaaucagagacgccggcaacgacagcgccagcaccgcccccagaagcaccgaggagagccugagcgaggacguguucaccgagagcgagcugagccccaucagagaggagcuggugagcagcgacgagcugagacaggacaagagcagcggcgccagcagcgagagcgugcagaccgugaaccaggccgagguggagagccugaccgugaagagcgagagcaccggcacccccggccaccugagaagcgacaccgagcacagcaccaacgaggugggcacccugugccacaagaccgaccugaacaaccuggagauggccaucaaggaggaccagaucgccgacaacuuccagggcaucagcggccccaaggaggacagcaccagcaucaagggcaacagcgaccaggacagcuuccugcacgagaacagccugcaccaggaggagagccagaaggagaacaugcccugcggcgagaccgccgaguucaagcagaagcagagcgugaacaagggcaagcagggcaaggagcagaaccaggacagccagaccgaggccgaggagcugagaaagcuguggaagacccacaccaugcagcagaccaagcagcagagagagaacauccagcaggugagccagaaggaggccaagcacaagaucaccagcgccgacggccacaucgagagcagcgcccugcugaaggagaagcagagacacagacugcacaaguuccugugccugagagugggcaagcccaugagaaagaccuucgugagccaggccagcgccaccaugcagcaguacgcccagagagacaagaagcacgaguacugguucgccgugccccaggagagaaccgaccaccuguacgccuucuucauccaguggagccccgagaucuacgccgaggacaccggcgaguacaccagagagcccggcuucaucguggugaagaagaucgaggagagcgagaccaucgaggacagcagcaaccaggccgccgccagagagugggagguggugagcguggccgaguaccacagaagaaucgacgcccugaacaccgaggagcugagaacccugugcagaagacugcagaucaccaccagagaggacaucaacagcaagcagguggccaccgugaaggccgaccuggagagcgagagcuucagacccaaccugagcgaccccagcgagcugcugcugcccgaccagaucgagaagcugaccaagcaccugccccccagaaccaucggcuaccccuggacccugguguacggcaccggcaagcacggcaccagccugaagacccuguacagaaccaugaccggccuggacacccccgugcugauggugaucaaggacagcgacggccagguguucggcgcccuggccagcgagccccugaaggugagcgacggcuucuacggcaccggcgagaccuucguguucaccuucugccccgaguucgagguguucaaguggaccggcgacaacauguucuucaucaagggcgacauggacagccuggccuucggcggcggcggcggcgaguucgcccuguggcuggacggcgaccuguaccacggcagaagccacagcugcaagaccuucggcaacagaacccugagcaagaaggaggacuucuucauccaggacaucgagaucugggccuucgaguaa

SEQ ID NO: 21098 - RNA, 1584 nt, Artificial Sequence
  OXSR1__Homo_sapiens__NP_005100
augagcgaggacagcagcgcccugcccuggagcaucaacagagacgacuacgagcugcaggaggugaucggcagcggcgccaccgccguggugcaggccgccuacugcgcccccaagaaggagaagguggccaucaagagaaucaaccuggagaagugccagaccagcauggacgagcugcugaaggagauccaggccaugagccagugccaccaccccaacaucgugagcuacuacaccagcuucguggugaaggacgagcuguggcuggugaugaagcugcugagcggcggcagcgugcuggacaucaucaagcacaucguggccaagggcgagcacaagagcggcgugcuggacgagagcaccaucgccaccauccugagagaggugcuggagggccuggaguaccugcacaagaacggccagauccacagagacgugaaggccggcaacauccugcugggcgaggacggcagcgugcagaucgccgacuucggcgugagcgccuuccuggccaccggcggcgacaucaccagaaacaaggugagaaagaccuucgugggcacccccugcuggauggcccccgaggugauggagcaggugagaggcuacgacuucaaggccgacaucuggagcuucggcaucaccgccaucgagcuggccaccggcgccgcccccuaccacaaguacccccccaugaaggugcugaugcugacccugcagaacgacccccccagccuggagaccggcgugcaggacaaggagaugcugaagaaguacggcaagagcuucagaaagaugaucagccugugccugcagaaggaccccgagaagagacccaccgccgccgagcugcugagacacaaguucuuccagaaggccaagaacaaggaguuccugcaggagaagacccugcagagagcccccaccaucagcgagagagccaagaaggugagaagagugcccggcagcagcggcagacugcacaagaccgaggacggcggcugggaguggagcgacgacgaguucgacgaggagagcgaggagggcaaggccgccaucagccagcugagaagccccagagugaaggagagcaucagcaacagcgagcuguuccccaccaccgaccccgugggcacccugcugcaggugcccgagcagaucagcgcccaccugccccagcccgccggccagaucgccacccagcccacccaggugagccugccccccaccgccgagcccgccaagaccgcccaggcccugagcagcggcagcggcagccaggagaccaagauccccaucagccuggugcugagacugagaaacagcaagaaggagcugaacgacaucagauucgaguucacccccggcagagacaccgccgagggcgugagccaggagcugaucagcgccggccugguggacggcagagaccuggugaucguggccgccaaccugcagaagaucguggaggagccccagagcaacagaagcgugaccuucaagcuggccagcggcguggagggcagcgacauccccgacgacggcaagcugaucggcuucgcccagcugagcaucagcuaa

SEQ ID NO: 21099 - RNA, 378 nt, Artificial Sequence
  OXT__Homo_sapiens__XP_011527540
auggccggccccagccuggccugcugccugcugggccugcuggcccugaccagcgccugcuacauccagaacugcccccugggcggcaagagagccgcccccgaccuggacgugagaaagugccugcccugcggccccggcggcaagggcagaugcuucggccccaacaucugcugcgccgaggagcugggcugcuucgugggcaccgccgaggcccugagaugccaggaggagaacuaccugcccagccccugccagagcggccagaaggccugcggcagcggcggcagaugcgccgugcugggccugugcugcagccccgacggcugccacgccgaccccgccugcgacgccgaggccaccuucagccagagauaa

SEQ ID NO: 21100 - RNA, 1170 nt, Artificial Sequence
  OXTR__Homo_sapiens__NP_000907
auggagggcgcccuggccgccaacuggagcgccgaggccgccaacgccagcgccgccccccccggcgccgagggcaacagaaccgccggcccccccagaagaaacgaggcccuggccagaguggagguggccgugcugugccugauccugcugcuggcccugagcggcaacgccugcgugcugcuggcccugagaaccaccagacagaagcacagcagacuguucuucuucaugaagcaccugagcaucgccgaccuggugguggccguguuccaggugcugccccagcugcugugggacaucaccuucagauucuacggccccgaccugcugugcagacuggugaaguaccugcagguggugggcauguucgccagcaccuaccugcugcugcugaugagccuggacagaugccuggccaucugccagccccugagaagccugagaagaagaaccgacagacuggccgugcuggccaccuggcugggcugccugguggccagcgccccccaggugcacaucuucagccugagagagguggccgacggcguguucgacugcugggccguguucauccagcccuggggccccaaggccuacaucaccuggaucacccuggccguguacaucgugcccgugaucgugcuggccgccugcuacggccugaucagcuucaagaucuggcagaaccugagacugaagaccgccgccgccgccgccgccgaggcccccgagggcgccgccgccggcgacggcggcagaguggcccuggccagagugagcagcgugaagcugaucagcaaggccaagaucagaaccgugaagaugaccuucaucaucgugcuggccuucaucgugugcuggacccccuucuucuucgugcagauguggagcgugugggacgccaacgcccccaaggaggccagcgccuucaucaucgugaugcugcuggccagccugaacagcugcugcaaccccuggaucuacaugcuguucaccggccaccuguuccacgagcuggugcagagauuccugugcugcagcgccagcuaccugaagggcagaagacugggcgagaccagcgccagcaagaagagcaacagcagcagcuucgugcugagccacagaagcagcagccagagaagcugcagccagcccagcaccgccuaa

SEQ ID NO: 21101 - RNA, 1200 nt, Artificial Sequence
  P2RX1__Homo_sapiens__NP_002549
auggccagaagauuccaggaggagcuggccgccuuccuguucgaguacgacacccccagaauggugcuggugagaaacaagaaggugggcgugaucuucagacugauccagcugguggugcugguguacgugaucggcuggguguuccuguacgagaagggcuaccagaccagcagcggccugaucagcagcgugagcgugaagcugaagggccuggccgugacccagcugcccggccugggcccccaggugugggacguggccgacuacguguuccccgcccagggcgacaacagcuucguggugaugaccaacuucaucgugacccccaagcagacccagggcuacugcgccgagcaccccgagggcggcaucugcaaggaggacagcggcugcacccccggcaaggccaagagaaaggcccagggcaucagaaccggcaagugcguggccuucaacgacaccgugaagaccugcgagaucuucggcuggugccccguggagguggacgacgacauccccagacccgcccugcugagagaggccgagaacuucacccuguucaucaagaacagcaucagcuuccccagauucaaggugaacagaagaaaccugguggaggaggugaacgccgcccacaugaagaccugccuguuccacaagacccugcacccccugugccccguguuccagcugggcuacguggugcaggagagcggccagaacuucagcacccuggccgagaagggcggcguggugggcaucaccaucgacuggcacugcgaccuggacuggcacgugagacacugcagacccaucuacgaguuccacggccuguacgaggagaagaaccugagccccggcuucaacuucagauucgccagacacuucguggagaacggcaccaacuacagacaccuguucaagguguucggcaucagauucgacauccugguggacggcaaggccggcaaguucgacaucauccccaccaugaccaccaucggcagcggcaucggcaucuucggcguggccaccgugcugugcgaccugcugcugcugcacauccugcccaagagacacuacuacaagcagaagaaguucaaguacgccgaggacaugggccccggcgccgccgagagagaccuggccgccaccagcagcacccugggccugcaggagaacaugagaaccagcuaa

SEQ ID NO: 21102 - RNA, 1113 nt, Artificial Sequence
  P2RX2__Homo_sapiens__NP_001269093
auggccgccgcccagcccaaguaccccgccggcgccaccgccagaagacuggccagaggcugcuggagcgcccugugggacuacgagacccccaaggugaucguggugagaaacagaagacugggcgugcuguacagagccgugcagcugcugauccugcuguacuucgugugguacguguucaucgugcagaagagcuaccaggagagcgagaccggccccgagagcagcaucaucaccaaggugaagggcaucaccaccagcgagcacaaggugugggacguggaggaguacgugaagccccccgagagcaucagagugcacaacgccaccugccugagcgacgccgacugcguggccggcgagcuggacaugcugggcaacggcgcccugcaggaccugagaggcgugagacuggugcccggcggcagauggggccugugccagcccaucagcggcuacgacggccccaaguuccaccacccccaccaggagcagcacccccugccccagaucccccugcugcagggccagcacagaagaccccacagaagagugcccgaggcccugcacgugcccagaggccugagaccccugcugccccaccugcaggccggccuguacagaggcgagggcuggggcgagcugcacagagccagaacccagggcagaggcggcgugaucggcgugaucaucaacugggacugcgaccuggaccugcccgccagcgagugcaaccccaaguacagcuucagaagacuggaccccaagcacgugcccgccagcagcggcuacaacuucagauucgccaaguacuacaagaucaacggcaccaccaccagaacccugaucaaggccuacggcaucagaaucgacgugaucgugcacggccaggccggcaaguucagccugauccccaccaucaucaaccuggccaccgcccugaccagcgugggcgugggcagcuuccugugcgacuggauccugcugaccuucaugaacaagaacaagguguacagccacaagaaguucgacaagaugguggacacccccgccagcgagcccgcccaggccagcacccccaccgaccccaagggccuggcccagcuguaa

SEQ ID NO: 21103 - RNA, 1194 nt, Artificial Sequence
  P2RX3__Homo_sapiens__XP_011543372
augaacugcaucagcgacuucuucaccuacgagaccaccaagagcgugguggugaagagcuggaccaucggcaucaucaacagaguggugcagcugcugaucaucagcuacuucgugggcuggguguuccugcacgagaaggccuaccaggugagagacaccgccaucgagagcagcguggugaccaaggugaagggcagcggccuguacgccaacagagugauggacgugagcgacuacgugacccccccccagggcaccagcguguucgugaucaucaccaagaugaucgugaccgagaaccagaugcagggcuucugccccgagagcgaggagaaguacagaugcgugagcgacagccagugcggccccgagagacugcccggcggcggcauccugaccggcagaugcgugaacuacagcagcgugcugagaaccugcgagauccagggcuggugccccaccgagguggacaccguggagacccccaucaugauggaggccgagaacuucaccaucuucaucaagaacagcaucagauucccccuguucaacuucgagaagggcaaccugcugcccaaccugaccgccagagacaugaagaccugcagauuccaccccgacaaggaccccuucugccccauccugagagugggcgacguggugaaguucgccggccaggacuucgccaagcuggccagaaccggcggcgugcugggcaucaagaucggcugggugugcgaccuggacaaggccugggaccagugcauccccaaguacagcuucaccagacuggacagcgugagcgagaagagcagcgugagccccggcuacaacuucagauucgccaaguacuacaagauggagaacggcagcgaguacagaacccugcugaaggccuucggcaucagauucgacgugcugguguacggcaacgccggcaaguucaacaucauccccaccaucaucagcagcguggccgccuucaccagcgugggcgugggcaccgugcugugcgacaucauccugcugaacuuccugaagggcgccgaccaguacaaggccaagaaguucgaggaggugaacgagaccacccugaagaucgccgcccugaccaaccccguguaccccagcgaccagaccaccgccgagaagcagagcaccgacagcggcgccuucagcaucggccacuaa

SEQ ID NO: 21104 - RNA, 1215 nt, Artificial Sequence
  P2RX4__Homo_sapiens__NP_001243725
auggccggcugcugcgccgcccuggccgccuuccuguucgaguacgacacccccagaaucgugcugaucagaagcagaaaggugggccugaugaacagagccgugcagcugcugauccuggccuacgugaucggcugcuaccacccccaccuggccgagguggagauggagagccccagaagauggguguucgugugggagaagggcuaccaggagaccgacagcguggugagcagcgugaccaccaaggugaagggcguggccgugaccaacaccagcaagcugggcuucagaaucugggacguggccgacuacgugauccccgcccaggaggagaacagccuguucgugaugaccaacgugauccugaccaugaaccagacccagggccugugccccgagauccccgacgccaccaccgugugcaagagcgacgccagcugcaccgccggcagcgccggcacccacagcaacggcgugagcaccggcagaugcguggccuucaacggcagcgugaagaccugcgagguggccgccuggugccccguggaggacgacacccacgugccccagcccgccuuccugaaggccgccgagaacuucacccugcuggugaagaacaacaucugguaccccaaguucaacuucagcaagagaaacauccugcccaacaucaccaccaccuaccugaagagcugcaucuacgacgccaagaccgaccccuucugccccaucuucagacugggcaagaucguggagaacgccggccacagcuuccaggacauggccguggagggcggcaucaugggcauccaggugaacugggacugcaaccuggacagagccgccagccugugccugcccagauacagcuucagaagacuggacaccagagacguggagcacaacgugagccccggcuacaacuucagauucgccaaguacuacagagaccuggccggcaacgagcagagaacccugaucaaggccuacggcaucagauucgacaucaucguguucggcaaggccggcaaguucgacaucauccccaccaugaucaacaucggcagcggccuggcccugcugggcauggccaccgugcugugcgacaucaucgugcuguacugcaugaagaagagacuguacuacagagagaagaaguacaaguacguggaggacuacgagcagggccuggccagcgagcuggaccaguaa

SEQ ID NO: 21105 - RNA, 1266 nt, Artificial Sequence
  P2RX5__Homo_sapiens__NP_001191448
augggccaggccggcugcaagggccugugccugagccuguucgacuacaagaccgagaaguacgugaucgccaagaacaagaaggugggccugcuguacagacugcugcaggccagcauccuggccuaccuggugguguggguguuccugaucaagaagggcuaccaggacguggacaccagccugcagagcgccgugaucaccaaggugaagggcguggccuucaccaacaccagcgaccugggccagagaaucugggacguggccgacuacgugauccccgcccagggcgagaacguguucuucguggugaccaaccugaucgugacccccaaccagagacagaacgugugcgccgagaacgagggcauccccgacggcgccugcagcaaggacagcgacugccacgccggcgaggccgugaccgccggcaacggcgugaagaccggcagaugccugagaagagagaaccuggccagaggcaccugcgagaucuucgccuggugcccccuggagaccagcagcagacccgaggagcccuuccugaaggaggccgaggacuucaccaucuucaucaagaaccacaucagauuccccaaguucaacuucagcaacaacgugauggacgugaaggacagaagcuuccugaagagcugccacuucggccccaagaaccacuacugccccaucuucagacugggcagcgugaucagaugggccggcagcgacuuccaggacaucgcccuggagggcggcgugaucggcaucaacaucgaguggaacugcgaccuggacaaggccgccagcgagugccacccccacuacagcuucagcagacuggacaacaagcugagcaagagcgugagcagcggcuacaacuucagauucgccagauacuacagagacgccgccggcguggaguucagaacccugaugaaggccuacggcaucagauucgacgugauggugaacggcaagggcgccuucuucugcgaccuggugcugaucuaccugaucaagaagagagaguucuacagagacaagaaguacgaggaggugagaggccuggaggacagcagccaggaggccgaggacgaggccagcggccugggccugagcgagcagcugaccagcggccccggccugcugggcaugcccgagcagcaggagcugcaggagccccccgaggccaagagaggcagcagcagccagaagggcaacggcagcgugugcccccagcugcuggagccccacagaagcaccuaa

SEQ ID NO: 21106 - RNA, 1248 nt, Artificial Sequence
  P2RX6__Homo_sapiens__NP_001153026
augugcccccagcuggccggcgccggcagcaugggcagccccggcgccaccaccggcuggggccugcuggacuacaagaccgagaagugggcccugcuggccaagaagggcuaccaggagagagaccuggagccccaguucagcaucaucaccaagcugaagggcgugagcgugacccagaucaaggagcugggcaacagacugugggacguggccgacuucgugaagcccccccagggcgagaacguguucuuccuggugaccaacuuccuggugacccccgcccaggugcagggcagaugccccgagcaccccagcgugccccuggccaacugcuggguggacgaggacugccccgagggcgagggcggcacccacagccacggcgugaagaccggccagugcgugguguucaacggcacccacagaaccugcgagaucuggagcuggugccccguggagagcggcguggugcccagcagaccccugcuggcccaggcccagaacuucacccuguucaucaagaacaccgugaccuucagcaaguucaacuucagcaagagcaacgcccuggagaccugggaccccaccuacuucaagcacugcagauacgagccccaguucagccccuacugccccguguucagaaucggcgaccugguggccaaggccggcggcaccuucgaggaccuggcccugcugggcggcagcgugggcaucagagugcacugggacugcgaccuggacaccggcgacagcggcugcuggccccacuacagcuuccagcugcaggagaagagcuacaacuucagaaccgccacccacuggugggagcagcccggcguggaggccagaacccugcugaagcuguacggcaucagauucgacauccuggugaccggccaggccggcaaguucggccugauccccaccgccgugacccugggcaccggcgccgccuggcugggcguggugaccuucuucugcgaccugcugcugcuguacguggacagagaggcccacuucuacuggagaaccaaguacgaggaggccaaggcccccaaggccaccgccaacagcguguggagagagcuggcccuggccagccaggccagacuggccgagugccugagaagaagcagcgcccccgcccccaccgccaccgccgccggcagccagacccagacccccggcuggcccugccccagcagcgacacccaccugcccacccacagcggcagccuguaa

SEQ ID NO: 21107 - RNA, 1788 nt, Artificial Sequence
  P2RX7__Homo_sapiens__NP_002553
augcccgccugcugcagcugcagcgacguguuccaguacgagaccaacaaggugaccagaauccagagcaugaacuacggcaccaucaagugguucuuccacgugaucaucuucagcuacgugugcuucgcccuggugagcgacaagcuguaccagagaaaggagcccgugaucagcagcgugcacaccaaggugaagggcaucgccgaggugaaggaggagaucguggagaacggcgugaagaagcuggugcacagcguguucgacaccgccgacuacaccuucccccugcagggcaacagcuucuucgugaugaccaacuuccugaagaccgagggccaggagcagagacugugccccgaguaccccaccagaagaacccugugcagcagcgacagaggcugcaagaagggcuggauggacccccagagcaagggcauccagaccggcagaugcgugguguacgagggcaaccagaagaccugcgaggugagcgccuggugccccaucgaggccguggaggaggcccccagacccgcccugcugaacagcgccgagaacuucaccgugcugaucaagaacaacaucgacuuccccggccacaacuacaccaccagaaacauccugcccggccugaacaucaccugcaccuuccacaagacccagaacccccagugccccaucuucagacugggcgacaucuucagagagaccggcgacaacuucagcgacguggccauccagggcggcaucaugggcaucgagaucuacugggacugcaaccuggacagaugguuccaccacugcagacccaaguacagcuucagaagacuggacgacaagaccaccaacgugagccuguaccccggcuacaacuucagauacgccaaguacuacaaggagaacaacguggagaagagaacccugaucaagguguucggcaucagauucgacauccugguguucggcaccggcggcaaguucgacaucauccagcuggugguguacaucggcagcacccugagcuacuucggccuggccgccguguucaucgacuuccugaucgacaccuacagcagcaacugcugcagaagccacaucuaccccuggugcaagugcugccagcccugcguggugaacgaguacuacuacagaaagaagugcgagagcaucguggagcccaagcccacccugaaguacgugagcuucguggacgagagccacaucagaauggugaaccagcagcugcugggcagaagccugcaggacgugaagggccaggaggugcccagacccgccauggacuucaccgaccugagcagacugccccuggcccugcacgacaccccccccauccccggccagcccgaggagauccagcugcugagaaaggaggccacccccagaagcagagacagccccguguggugccagugcggcagcugccugcccagccagcugcccgagagccacagaugccuggaggagcugugcugcagaaagaagcccggcgccugcaucaccaccagcgagcuguucagaaagcuggugcugagcagacacgugcugcaguuccugcugcuguaccaggagccccugcuggcccuggacguggacagcaccaacagcagacugagacacugcgccuacagaugcuacgccaccuggagauucggcagccaggacauggccgacuucgccauccugcccagcugcugcagauggagaaucagaaaggaguuccccaagagcgagggccaguacagcggcuucaagagccccuacuaa

SEQ ID NO: 21108 - RNA, 1125 nt, Artificial Sequence
  P2RY11__Homo_sapiens__NP_002557
auggccgccaacgugagcggcgccaagagcugccccgccaacuuccuggccgccgccgacgacaagcugagcggcuuccagggcgacuuccuguggcccauccuggugguggaguuccugguggccguggccagcaacggccuggcccuguacagauucagcaucagaaagcagagacccuggcaccccgccgugguguucagcgugcagcuggccgugagcgaccugcugugcgcccugacccugcccccccuggccgccuaccuguacccccccaagcacuggagauacggcgaggccgccugcagacuggagagauuccuguucaccugcaaccugcugggcagcgugaucuucaucaccugcaucagccugaacagauaccugggcaucgugcaccccuucuucgccagaagccaccugagacccaagcacgccugggccgugagcgccgccggcugggugcuggccgcccugcuggccaugcccacccugagcuucagccaccugaagagaccccagcagggcgccggcaacugcagcguggccagacccgaggccugcaucaagugccugggcaccgccgaccacggccuggccgccuacagagccuacagccuggugcuggccggccugggcugcggccugccccugcugcugacccuggccgccuacggcgcccugggcagagccgugcugagaagccccggcaugaccguggccgagaagcugagaguggccgcccugguggccagcggcguggcccuguacgccagcagcuacgugcccuaccacaucaugagagugcugaacguggacgccagaagaagauggagcaccagaugccccagcuucgccgacaucgcccaggccaccgccgcccuggagcugggccccuacgugggcuaccaggugaugagaggccugaugccccuggccuucugcgugcacccccugcuguacauggccgccgugcccagccugggcugcugcugcagacacugccccggcuacagagacagcuggaaccccgaggacgccaagagcaccggccaggcccugccccugaacgccaccgccgcccccaagcccagcgagccccagagcagagagcugagccaguaa

SEQ ID NO: 21109 - RNA, 1029 nt, Artificial Sequence
  P2RY12__Homo_sapiens__NP_795345
augcaggccguggacaaccugaccagcgcccccggcaacaccagccugugcaccagagacuacaagaucacccaggugcuguucccccugcuguacaccgugcuguucuucgugggccugaucaccaacggccuggccaugagaaucuucuuccagaucagaagcaagagcaacuucaucaucuuccugaagaacaccgugaucagcgaccugcugaugauccugaccuuccccuucaagauccugagcgacgccaagcugggcaccggcccccugagaaccuucgugugccaggugaccagcgugaucuucuacuucaccauguacaucagcaucagcuuccugggccugaucaccaucgacagauaccagaagaccaccagacccuucaagaccagcaaccccaagaaccugcugggcgccaagauccugagcguggugaucugggccuucauguuccugcugagccugcccaacaugauccugaccaacagacagcccagagacaagaacgugaagaagugcagcuuccugaagagcgaguucggccugguguggcacgagaucgugaacuacaucugccaggugaucuucuggaucaacuuccugaucgugaucgugugcuacacccugaucaccaaggagcuguacagaagcuacgugagaaccagaggcgugggcaaggugcccagaaagaaggugaacgugaagguguucaucaucaucgccguguucuucaucugcuucgugcccuuccacuucgccagaauccccuacacccugagccagaccagagacguguucgacugcaccgccgagaacacccuguucuacgugaaggagagcacccuguggcugaccagccugaacgccugccuggaccccuucaucuacuucuuccugugcaagagcuucagaaacagccugaucagcaugcugaagugccccaacagcgccaccagccugagccaggacaacagaaagaaggagcaggacggcggcgaccccaacgaggagacccccauguaa

SEQ ID NO: 21110 - RNA, 1065 nt, Artificial Sequence
  P2RY13__Homo_sapiens__NP_795713
augaccgccgccaucagaagacagagagagcugagcauccugcccaaggugacccuggaggccaugaacaccaccgugaugcagggcuucaacagaagcgagagaugccccagagacaccagaaucgugcagcugguguuccccgcccuguacaccgugguguuccugaccggcauccugcugaacacccuggcccuguggguguucgugcacauccccagcagcagcaccuucaucaucuaccugaagaacacccugguggccgaccugaucaugacccugaugcugcccuucaagauccugagcgacagccaccuggcccccuggcagcugagagccuucgugugcagauucagcagcgugaucuucuacgagaccauguacgugggcaucgugcugcugggccugaucgccuucgacagauuccugaagaucaucagaccccugagaaacaucuuccugaagaagcccguguucgccaagaccgugagcaucuucaucugguucuuccuguucuucaucagccugcccaacaccauccugagcaacaaggaggccacccccagcagcgugaagaagugcgccagccugaagggcccccugggccugaaguggcaccagauggugaacaacaucugccaguucaucuucuggaccguguucauccugaugcugguguucuacguggugaucgccaagaagguguacgacagcuacagaaagagcaagagcaaggacagaaagaacaacaagaagcuggagggcaagguguucguggugguggccguguucuucgugugcuucgcccccuuccacuucgccagagugcccuacacccacagccagaccaacaacaagaccgacugcagacugcagaaccagcuguucaucgccaaggagaccacccuguuccuggccgccaccaacaucugcauggacccccugaucuacaucuuccugugcaagaaguucaccgagaagcugcccugcaugcagggcagaaagaccaccgccagcagccaggagaaccacagcagccagaccgacaacaucacccugggcuaa

SEQ ID NO: 21111 - RNA, 1017 nt, Artificial Sequence
  P2RY14__Homo_sapiens__NP_055694
augaucaacagcaccagcacccagccccccgacgagagcugcagccagaaccugcugaucacccagcagaucauccccgugcuguacugcaugguguucaucgccggcauccugcugaacggcgugagcggcuggaucuucuucuacgugcccagcagcaagagcuucaucaucuaccugaagaacaucgugaucgccgacuucgugaugagccugaccuuccccuucaagauccugggcgacagcggccugggccccuggcagcugaacguguucgugugcagagugagcgccgugcuguucuacgugaacauguacgugagcaucguguucuucggccugaucagcuucgacagauacuacaagaucgugaagccccuguggaccagcuucauccagagcgugagcuacagcaagcugcugagcgugaucguguggaugcugaugcugcugcuggccgugcccaacaucauccugaccaaccagagcgugagagaggugacccagaucaagugcaucgagcugaagagcgagcugggcagaaaguggcacaaggccagcaacuacaucuucguggccaucuucuggaucguguuccugcugcugaucguguucuacaccgccaucaccaagaagaucuucaagagccaccugaagagcagcagaaacagcaccagcgugaagaagaagagcagcagaaacaucuucagcaucguguucguguucuucgugugcuucgugcccuaccacaucgccagaauccccuacaccaagagccagaccgaggcccacuacagcugccagagcaaggagauccugagauacaugaaggaguucacccugcugcugagcgccgccaacgugugccuggaccccaucaucuacuucuuccugugccagcccuucagagagauccugugcaagaagcugcacaucccccugaaggcccagaacgaccuggacaucagcagaaucaagagaggcaacaccacccuggagagcaccgacacccuguaa

SEQ ID NO: 21112 - RNA, 1122 nt, Artificial Sequence
  P2RY1__Homo_sapiens__NP_002554
augaccgaggugcuguggcccgccgugcccaacggcaccgacgccgccuuccuggccggccccggcagcagcuggggcaacagcaccguggccagcaccgccgccgugagcagcagcuucaagugcgcccugaccaagaccggcuuccaguucuacuaccugcccgccguguacauccugguguucaucaucggcuuccugggcaacagcguggccaucuggauguucguguuccacaugaagcccuggagcggcaucagcguguacauguucaaccuggcccuggccgacuuccuguacgugcugacccugcccgcccugaucuucuacuacuucaacaagaccgacuggaucuucggcgacgccaugugcaagcugcagagauucaucuuccacgugaaccuguacggcagcauccuguuccugaccugcaucagcgcccacagauacagcggcgugguguacccccugaagagccugggcagacugaagaagaagaacgccaucugcaucagcgugcugguguggcugaucguggugguggccaucagccccauccuguucuacagcggcaccggcgugagaaagaacaagaccaucaccugcuacgacaccaccagcgacgaguaccugagaagcuacuucaucuacagcaugugcaccaccguggccauguucugcgugccccuggugcugauccugggcugcuacggccugaucgugagagcccugaucuacaaggaccuggacaacagcccccugagaagaaagagcaucuaccuggugaucaucgugcugaccguguucgccgugagcuacauccccuuccacgugaugaagaccaugaaccugagagccagacuggacuuccagacccccgccaugugcgccuucaacgacagaguguacgccaccuaccaggugaccagaggccuggccagccugaacagcugcguggaccccauccuguacuuccuggccggcgacaccuucagaagaagacugagcagagccaccagaaaggccagcagaagaagcgaggccaaccugcagagcaagagcgaggacaugacccugaacauccugcccgaguucaagcagaacggcgacaccagccuguaa

SEQ ID NO: 21113 - RNA, 1134 nt, Artificial Sequence
  P2RY2__Homo_sapiens__NP_788085
auggccgccgaccugggccccuggaacgacaccaucaacggcaccugggacggcgacgagcugggcuacagaugcagauucaacgaggacuucaaguacgugcugcugcccgugagcuacggcguggugugcgugcugggccugugccugaacgccguggcccuguacaucuuccugugcagacugaagaccuggaacgccagcaccaccuacauguuccaccuggccgugagcgacgcccuguacgccgccagccugccccugcugguguacuacuacgccagaggcgaccacuggcccuucagcaccgugcugugcaagcuggugagauuccuguucuacaccaaccuguacugcagcauccuguuccugaccugcaucagcgugcacagaugccugggcgugcugagaccccugagaagccugagauggggcagagccagauacgccagaagaguggccggcgccgugugggugcuggugcuggccugccaggcccccgugcuguacuucgugaccaccagcgccagaggcggcagagugaccugccacgacaccagcgcccccgagcuguucagcagauucguggccuacagcagcgugaugcugggccugcuguucgccgugcccuucgccgugauccuggugugcuacgugcugauggccagaagacugcugaagcccgccuacggcaccagcggcggccugcccagagccaagagaaagagcgugagaaccaucgccguggugcuggccguguucgcccugugcuuccugcccuuccacgugaccagaacccuguacuacagcuucagaagccuggaccugagcugccacacccugaacgccaucaacauggccuacaaggugaccagaccccuggccagcgccaacagcugccuggaccccgugcuguacuuccuggccggccagagacuggugagauucgccagagacgccaagccccccaccggccccagccccgccacccccgccagaagaagacugggccugagaagaagcgacagaaccgacaugcagagaaucgaggacgugcugggcagcagcgaggacagcagaagaaccgagagcacccccgccggcagcgagaacaccaaggacaucagacuguaa

SEQ ID NO: 21114 - RNA, 1098 nt, Artificial Sequence
  P2RY4__Homo_sapiens__NP_002556
auggccagcaccgagagcagccugcugagaagccugggccugagccccggccccggcagcagcgagguggagcuggacugcugguucgacgaggacuucaaguucauccugcugcccgugagcuacgccgugguguucgugcugggccugggccugaacgcccccacccuguggcuguucaucuucagacugagacccugggacgccaccgccaccuacauguuccaccuggcccugagcgacacccuguacgugcugagccugcccacccugaucuacuacuacgccgcccacaaccacuggcccuucggcaccgagaucugcaaguucgugagauuccuguucuacuggaaccuguacugcagcgugcuguuccugaccugcaucagcgugcacagauaccugggcaucugccacccccugagagcccugagauggggcagacccagacuggccggccugcugugccuggccguguggcuggugguggccggcugccuggugcccaaccuguucuucgugaccaccagcaacaagggcaccaccgugcugugccacgacaccaccagacccgaggaguucgaccacuacgugcacuucagcagcgccgugaugggccugcuguucggcgugcccugccuggugacccuggugugcuacggccugauggccagaagacuguaccagccccugcccggcagcgcccagagcagcagcagacugagaagccugagaaccaucgccguggugcugaccguguucgccgugugcuucgugcccuuccacaucaccagaaccaucuacuaccuggccagacugcuggaggccgacugcagagugcugaacaucgugaacgugguguacaaggugaccagaccccuggccagcgccaacagcugccuggaccccgugcuguaccugcugaccggcgacaaguacagaagacagcugagacagcugugcggcggcggcaagccccagcccagaaccgccgccagcagccuggcccuggugagccugcccgaggacagcagcugcagaugggccgccaccccccaggacagcagcugcagcacccccagagccgacagacuguaa

SEQ ID NO: 21115 - RNA, 987 nt, Artificial Sequence
  P2RY6__Homo_sapiens__NP_001264134
auggagugggacaacggcaccggccaggcccugggccugccccccaccaccugcguguacagagagaacuucaagcagcugcugcugccccccguguacagcgccgugcuggccgccggccugccccugaacaucugcgugaucacccagaucugcaccagcagaagagcccugaccagaaccgccguguacacccugaaccuggcccuggccgaccugcuguacgccugcagccugccccugcugaucuacaacuacgcccagggcgaccacuggcccuucggcgacuucgccugcagacuggugagauuccuguucuacgccaaccugcacggcagcauccuguuccugaccugcaucagcuuccagagauaccugggcaucugccacccccuggcccccuggcacaagagaggcggcagaagagccgccuggcuggugugcguggccguguggcuggccgugaccacccagugccugcccaccgccaucuucgccgccaccggcauccagagaaacagaaccgugugcuacgaccugagcccccccgcccuggccacccacuacaugcccuacggcauggcccugaccgugaucggcuuccugcugcccuucgccgcccugcuggccugcuacugccugcuggccugcagacugugcagacaggacggccccgccgagcccguggcccaggagagaagaggcaaggccgccagaauggccguggugguggccgccgccuucgccaucagcuuccugcccuuccacaucaccaagaccgccuaccuggccgugagaagcacccccggcgugcccugcaccgugcuggaggccuucgccgccgccuacaagggcaccagacccuucgccagcgccaacagcgugcuggaccccauccuguucuacuucacccagaagaaguucagaagaagaccccacgagcugcugcagaagcugaccgccaaguggcagagacagggcagauaa

SEQ ID NO: 21116 - RNA, 1080 nt, Artificial Sequence
  P2RY8__Homo_sapiens__XP_005274835
augcaggugcccaacagcaccggccccgacaacgccacccugcagaugcugagaaaccccgccaucgccguggcccugcccgugguguacagccugguggccgccgugagcauccccggcaaccuguucagccugugggugcugugcagaagaaugggccccagaagccccagcgugaucuucaugaucaaccugagcgugaccgaccugaugcuggccagcgugcugcccuuccagaucuacuaccacugcaacagacaccacuggguguucggcgugcugcugugcaacguggugaccguggccuucuacgccaacauguacagcagcauccugaccaugaccugcaucagcguggagagauuccugggcgugcuguacccccugagcagcaagagauggagaagaagaagauacgccguggccgccugcgccggcaccuggcugcugcugcugaccgcccugagcccccuggccagaaccgaccugaccuaccccgugcacgcccugggcaucaucaccugcuucgacgugcugaaguggaccaugcugcccagcguggccaugugggccguguuccuguucaccaucuucauccugcuguuccugauccccuucgugaucaccguggccugcuacaccgccaccauccugaagcugcugagaaccgaggaggcccacggcagagagcagagaagaagagccgugggccuggccgccguggugcugcuggccuucgugaccugcuucgcccccaacaacuucgugcugcuggcccacaucgugagcagacuguucuacggcaagagcuacuaccacguguacaagcugacccugugccugagcugccugaacaacugccuggaccccuucguguacuacuucgccagcagagaguuccagcugagacugagagaguaccugggcugcagaagagugcccagagacacccuggacaccagaagagagagccuguucagcgccagaaccaccagcgugagaagcgaggccggcgcccaccccgagggcauggagggcgccaccagacccggccugcagagacaggagagcguguucuaa

SEQ ID NO: 21117 - RNA, 1584 nt, Artificial Sequence
  P3H2__Homo_sapiens__NP_001127890
auggagaugcagcagaacaucgagaacuacagagccaccgccggcguggaggcccugcagcugguggacagagaggccaagccccacauggagagcuacaacgccggcgugaagcacuacgaggccgacgacuucgagauggccaucagacacuucgagcaggcccugagagaguacuucguggaggacaccgagugcagaacccugugcgagggcccccagagauucgaggaguacgaguaccugggcuacaaggccggccuguacgaggccaucgccgaccacuacaugcaggugcuggugugccagcacgagugcgugagagagcuggccaccagacccggcagacugagccccaucgagaacuuccugccccugcacuacgacuaccugcaguucgccuacuacagagugggcgaguacgugaaggcccuggagugcgccaaggccuaccugcugugccaccccgacgacgaggacgugcuggacaacguggacuacuacgagagccugcuggacgacagcaucgaccccgccagcaucgaggccagagaggaccugaccauguucgugaagagacacaagcuggagagcgagcugaucaagagcgccgccgagggccugggcuucagcuacaccgagcccaacuacuggaucagauacggcggcagacaggacgagaacagagugcccagcggcgugaacguggagggcgccgaggugcacggcuucagcaugggcaagaagcugagccccaagaucgacagagaccugagagagggcggcccccugcuguacgagaacaucaccuucguguacaacagcgagcagcugaacggcacccagagagugcugcuggacaacgugcugagcgaggagcagugcagagagcugcacagcguggccagcggcaucaugcuggugggcgacggcuacagaggcaagaccagcccccacacccccaacgagaaguucgagggcgccaccgugcugaaggcccugaagagcggcuacgagggcagagugccccugaagagcgccagacuguucuacgacaucagcgagaaggccagaagaaucguggagagcuacuucaugcugaacagcacccuguacuucagcuacacccacauggugugcagaaccgcccugagcggccagcaggacagaagaaacgaccugagccaccccauccacgccgacaacugccugcuggaccccgaggccaacgagugcuggaaggagccccccgccuacaccuucagagacuacagcgcccugcuguacaugaacgacgacuucgagggcggcgaguucaucuucaccgagauggacgccaagaccgugaccgccagcaucaagcccaagugcggcagaaugaucagcuucagcagcggcggcgagaacccccacggcgugaaggccgugaccaagggcaagagaugcgccguggcccugugguucacccuggacccccuguacagagagcuggagagaauccaggccgacgaggugaucgccauccuggaccaggagcagcagggcaagcacgagcugaacaucaaccccaaggacgagcuguaa

SEQ ID NO: 21118 - RNA, 2211 nt, Artificial Sequence
  P3H3__Homo_sapiens__NP_055077
augcugagacugcugagaccccugcugcugcugcugcugcugcccccccccggcagccccgagccccccggccugacccagcugagccccggcgcccccccccaggcccccgaccugcuguacgccgacggccugagagccuacgccgccggcgccugggcccccgccguggcccugcugagagaggcccugagaagccaggccgcccugggcagagugagacuggacugcggcgccagcugcgccgccgaccccggcgccgcccugcccgccgugcugcugggcgcccccgagcccgacagcggccccggccccacccagggcagcugggagagacagcugcugagagccgcccugagaagagccgacugccugacccagugcgccgccagaagacugggccccggcggcgccgccagacugagagugggcagcgcccugagagacgccuucagaagaagagagcccuacaacuaccugcagagagccuacuaccagcugaagaagcuggaccuggccgccgccgccgcccacaccuucuucguggccaaccccaugcaccugcagaugagagaggacauggccaaguacagaagaaugagcggcgugagaccccagagcuucagagaccuggagacccccccccacugggccgccuacgacaccggccuggagcugcugggcagacaggaggccggccuggcccugcccagacuggaggaggcccugcagggcagccuggcccagauggagagcugcagagccgacugcgagggccccgaggagcagcagggcgccgaggaggaggaggacggcgccgccagccagggcggccuguacgaggccaucgccggccacuggauccaggugcugcagugcagacagagaugcgugggcgagaccgccaccagacccggcagaagcuuccccgugcccgacuuccugcccaaccagcugagaagacugcacgaggcccacgcccaggugggcaaccugagccaggccaucgagaacgugcugagcgugcugcuguucuaccccgaggacgaggccgccaagagagcccugaaccaguaccaggcccagcugggcgagcccagacccggccugggccccagagaggacauccagagauucauccugagaagccugggcgagaagagacagcuguacuacgccauggagcaccugggcaccagcuucaaggaccccgaccccuggacccccgccgcccugauccccgaggcccugagagagaagcugagagaggaccaggagaagagacccugggaccacgagcccgugaagcccaagccccugaccuacuggaaggacgugcugcugcuggagggcgugacccugacccaggacagcagacagcugaacggcagcgagagagccgugcuggacggccugcugacccccgccgagugcggcgugcugcugcagcuggccaaggacgccgccggcgccggcgccagaagcggcuacagaggcagaagaagcccccacaccccccacgagagauucgagggccugaccgugcugaaggccgcccagcuggccagagccggcaccgugggcagccagggcgccaagcugcugcuggaggugagcgagagagugagaacccugacccaggccuacuucagccccgagagaccccugcaccugagcuucacccaccuggugugcagaagcgccaucgagggcgagcaggagcagagaauggaccugagccaccccgugcacgccgacaacugcgugcuggaccccgacaccggcgagugcuggagagagccccccgccuacaccuacagagacuacagcggccugcuguaccugaacgacgacuuccagggcggcgaccuguucuucaccgagcccaacgcccugaccgugaccgccagagugagacccagaugcggcagacugguggccuucagcagcggcguggagaacccccacggcgugugggccgugaccagaggcagaagaugcgcccuggcccuguggcacaccugggcccccgagcacagagagcaggaguggaucgaggccaaggagcugcugcaggagagccaggaggaggaggaggaggaggaggaggagaugcccagcaaggaccccagccccgagccccccagcagaagacaccagagagugcaggacaagaccggcagagcccccagagugagagaggagcuguaa

SEQ ID NO: 21119 - RNA, 1314 nt, Artificial Sequence
  P3H4__Homo_sapiens__NP_006446
auggccagaguggccuggggccugcuguggcugcugcugggcagcgccggcgcccaguacgagaaguacagcuucagaggcuucccccccgaggaccugaugccccuggccgccgccuacggccacgcccuggagcaguacgagggcgagagcuggagagagagcgccagauaccuggaggccgcccugagacugcacagacugcugagagacagcgaggccuucugccacgccaacugcagcggccccgcccccgccgccaagcccgaccccgacggcggcagagccgacgagugggccugcgagcugagacuguucggcagagugcuggagagagccgccugccugagaagaugcaagagaacccugcccgccuuccaggugcccuacccccccagacagcugcugagagacuuccagagcagacugcccuaccaguaccugcacuacgcccuguucaaggccaacagacuggagaaggccguggccgccgccuacaccuuccugcagagaaaccccaagcacgagcugaccgccaaguaccugaacuacuaccagggcaugcuggacguggccgacgagagccugaccgaccuggaggcccagcccuacgaggccguguuccugagagccgugaagcuguacaacagcggcgacuucagaagcagcaccgaggacauggagagagcccugagcgaguaccuggccguguucgccagaugccuggccggcugcgagggcgcccacgagcagguggacuucaaggacuucuaccccgccaucgccgaccuguucgccgagagccugcagugcaagguggacugcgaggccaaccugacccccaacgugggcggcuacuucguggacaaguucguggccaccauguaccacuaccugcaguucgccuacuacaagcugaacgacgugagacaggccgccagaagcgccgccagcuacaugcuguucgaccccaaggacagcgugaugcagcagaaccugguguacuacagauuccacagagccagauggggccuggaggaggaggacuuccagcccagagaggaggccaugcuguaccacaaccagaccgccgagcugagagagcugcuggaguucacccacauguaccugcagagcgacgacgagauggagcuggaggagaccgagcccccccuggagcccgaggacgcccugagcgacgccgaguucgagggcgagggcgacuacgaggagggcauguacgccgacugguggcaggagcccgacgccaagggcgacgaggccgaggccgagcccgagcccgagcuggccuaa

SEQ ID NO: 21120 - RNA, 1605 nt, Artificial Sequence
  P4HA1__Homo_sapiens__NP_000908
augaucugguacauccugaucaucggcauccugcugccccagagccuggcccaccccggcuucuucaccagcaucggccagaugaccgaccugauccacaccgagaaggaccuggugaccagccugaaggacuacaucaaggccgaggaggacaagcuggagcagaucaagaagugggccgagaagcuggacagacugaccagcaccgccaccaaggaccccgagggcuucgugggccaccccgugaacgccuucaagcugaugaagagacugaacaccgaguggagcgagcuggagaaccuggugcugaaggacaugagcgacggcuucaucagcaaccugaccauccagagacaguacuuccccaacgacgaggaccaggugggcgccgccaaggcccugcugagacugcaggacaccuacaaccuggacaccgacaccaucagcaagggcaaccugcccggcgugaagcacaagagcuuccugaccgccgaggacugcuucgagcugggcaagguggccuacaccgaggccgacuacuaccacaccgagcuguggauggagcaggcccugagacagcuggacgagggcgagaucagcaccaucgacaaggugagcgugcuggacuaccugagcuacgccguguaccagcagggcgaccuggacaaggcccugcugcugaccaagaagcugcuggagcuggaccccgagcaccagagagccaacggcaaccugaaguacuucgaguacaucauggccaaggagaaggacgugaacaagagcgccagcgacgaccagagcgaccagaagaccacccccaagaagaagggcguggccguggacuaccugcccgagagacagaaguacgagaugcugugcagaggcgagggcaucaagaugacccccagaagacagaagaagcuguucugcagauaccacgacggcaacagaaaccccaaguucauccuggcccccgccaagcaggaggacgagugggacaagcccagaaucaucagauuccacgacaucaucagcgacgccgagaucgagaucgugaaggaccuggccaagcccagacugagcagagccaccgugcacgaccccgagaccggcaagcugaccaccgcccaguacagagugagcaagagcgccuggcugagcggcuacgagaaccccguggugagcagaaucaacaugagaauccaggaccugaccggccuggacgugagcaccgccgaggagcugcagguggccaacuacggcgugggcggccaguacgagccccacuucgacuucgccagaaaggacgagcccgacgccuucaaggagcugggcaccggcaacagaaucgccaccuggcuguucuacaugagcgacgugagcgccggcggcgccaccguguuccccgaggugggcgccagcguguggcccaagaagggcaccgccguguucugguacaaccuguucgccagcggcgagggcgacuacagcaccagacacgccgccugccccgugcuggugggcaacaagugggugagcaacaaguggcugcacgagagaggccaggaguucagaagacccugcacccugagcgagcuggaguaa

SEQ ID NO: 21121 - RNA, 1608 nt, Artificial Sequence
  P4HA2__Homo_sapiens__XP_005272177
augaagcugugggugagcgcccugcugauggccugguucggcgugcugagcugcgugcaggccgaguucuucaccagcaucggccacaugaccgaccugaucuacgccgagaaggagcuggugcagagccugaaggaguacauccugguggaggaggccaagcugagcaagaucaagagcugggccaacaagauggaggcccugaccagcaagagcgccgccgacgccgagggcuaccuggcccaccccgugaacgccuacaagcuggugaagagacugaacaccgacuggcccgcccuggaggaccuggugcugcaggacagcgccgccggcuucaucgccaaccugagcgugcagagacaguucuuccccaccgacgaggacgagaucggcgccgccaaggcccugaugagacugcaggacaccuacagacuggaccccggcaccaucagcagaggcgagcugcccggcaccaaguaccaggccaugcugagcguggacgacugcuucggcaugggcagaagcgccuacaacgagggcgacuacuaccacaccgugcuguggauggagcaggugcugaagcagcuggacgccggcgaggaggccaccaccaccaagagccaggugcuggacuaccugagcuacgccguguuccagcugggcgaccugcacagagcccuggagcugaccagaagacugcugagccuggaccccagccacgagagagccggcggcaaccugagauacuucgagcagcugcuggaggaggagagagagaagacccugaccaaccagaccgaggccgagcuggccacccccgagggcaucuacgagagacccguggacuaccugcccgagagagacguguacgagagccugugcagaggcgagggcgugaagcugacccccagaagacagaagagacuguucugcagauaccaccacggcaacagagccccccagcugcugaucgcccccuucaaggaggaggacgagugggacagcccccacaucgugagauacuacgacgugaugagcgacgaggagaucgagagaaucaaggagaucgccaagcccaagcuggccagagccaccgugagagaccccaagaccggcgugcugaccguggccagcuacagagugagcaagagcagcuggcuggaggaggacgacgaccccgugguggccagagugaacagaagaaugcagcacaucaccggccugaccgugaagaccgccgagcugcugcagguggccaacuacggcgugggcggccaguacgagccccacuucgacuucagcagaaacgacgagagagacaccuucaagcaccugggcaccggcaacagaguggccaccuuccugaacuacaugagcgacguggaggccggcggcgccaccguguuccccgaccugggcgccgccaucuggcccaagaagggcaccgccguguucugguacaaccugcugagaagcggcgagggcgacuacagaaccagacacgccgccugccccgugcuggugggcugcaagugggugagcaacaagugguuccacgagagaggccaggaguuccugagacccugcggcagcaccgagguggacuaa

SEQ ID NO: 21122 - RNA, 1527 nt, Artificial Sequence
  P4HB__Homo_sapiens__NP_000909
augcugagaagagcccugcugugccuggccguggccgcccuggugagagccgacgcccccgaggaggaggaccacgugcuggugcugagaaagagcaacuucgccgaggcccuggccgcccacaaguaccugcugguggaguucuacgcccccuggugcggccacugcaaggcccuggcccccgaguacgccaaggccgccggcaagcugaaggccgagggcagcgagaucagacuggccaagguggacgccaccgaggagagcgaccuggcccagcaguacggcgugagaggcuaccccaccaucaaguucuucagaaacggcgacaccgccagccccaaggaguacaccgccggcagagaggccgacgacaucgugaacuggcugaagaagagaaccggccccgccgccaccacccugcccgacggcgccgccgccgagagccugguggagagcagcgagguggccgugaucggcuucuucaaggacguggagagcgacagcgccaagcaguuccugcaggccgccgaggccaucgacgacauccccuucggcaucaccagcaacagcgacguguucagcaaguaccagcuggacaaggacggcguggugcuguucaagaaguucgacgagggcagaaacaacuucgagggcgaggugaccaaggagaaccugcuggacuucaucaagcacaaccagcugccccuggugaucgaguucaccgagcagaccgcccccaagaucuucggcggcgagaucaagacccacauccugcuguuccugcccaagagcgugagcgacuacgacggcaagcugagcaacuucaagaccgccgccgagagcuucaagggcaagauccuguucaucuucaucgacagcgaccacaccgacaaccagagaauccuggaguucuucggccugaagaaggaggagugccccgccgugagacugaucacccuggaggaggagaugaccaaguacaagcccgagagcgaggagcugaccgccgagagaaucaccgaguucugccacagauuccuggagggcaagaucaagccccaccugaugagccaggagcugcccgaggacugggacaagcagcccgugaaggugcuggugggcaagaacuucgaggacguggccuucgacgagaagaagaacguguucguggaguucuacgcccccuggugcggccacugcaagcagcuggcccccaucugggacaagcugggcgagaccuacaaggaccacgagaacaucgugaucgccaagauggacagcaccgccaacgagguggaggccgugaaggugcacagcuuccccacccugaaguucuuccccgccagcgccgacagaaccgugaucgacuacaacggcgagagaacccuggacggcuucaagaaguuccuggagagcggcggccaggacggcgccggcgacgacgacgaccuggaggaccuggaggaggccgaggagcccgacauggaggaggacgacgaccagaaggccgugaaggacgagcuguaa

SEQ ID NO: 21123 - RNA, 1692 nt, Artificial Sequence
  P4HTM__Homo_sapiens__NP_808807
auggccgccgccgccgugaccggccagagacccgagaccgccgccgccgaggaggccagcagaccccagugggccccccccgaccacugccaggcccaggccgccgccggccugggcgacggcgaggacgcccccgugagaccccugugcaagcccagaggcaucugcagcagagccuacuuccuggugcugaugguguucgugcaccuguaccugggcaacgugcuggcccugcugcuguucgugcacuacagcaacggcgacgagagcagcgaccccggcccccagcacagagcccagggccccggccccgagcccacccugggcccccugaccagacuggagggcaucaaggugggccacgagagaaaggugcagcuggugaccgacagagaccacuucaucagaacccugagccugaagccccugcuguucgagauccccggcuuccugaccgacgaggagugcagacugaucauccaccuggcccagaugaagggccugcagagaagccagauccugcccaccgaggaguacgaggaggccaugagcaccaugcaggugagccagcuggaccuguucagacugcuggaccagaacagagacggccaccugcagcugagagaggugcuggcccagaccagacugggcaacggcugguggaugacccccgagagcauccaggagauguacgccgccaucaaggccgaccccgacggcgacggcgugcugagccugcaggaguucagcaacauggaccugagagacuuccacaaguacaugagaagccacaaggccgagagcagcgagcuggugagaaacagccaccacaccuggcuguaccagggcgagggcgcccaccacaucaugagagccaucagacagagagugcugagacugaccagacugagccccgagaucguggagcugagcgagccccugcagguggugagauacggcgagggcggccacuaccacgcccacguggacagcggccccguguaccccgagaccaucugcagccacaccaagcugguggccaacgagagcgugcccuucgagaccagcugcagacaggugagccccaacuggggccugcccagcauccugagacccggcacccccaugacccaggcccagcccugcaccgugggcgugccccugggcaugggccccggcgaccacugggugauccccgugagccccugggagcacccccagcugggcaccugcagcgugcccccccugcccuacagcuacaugaccgugcuguucuaccugaacaacgugaccggcggcggcgagaccguguuccccguggccgacaacagaaccuacgacgagaugagccugauccaggacgacguggaccugagagacaccagaagacacugcgacaagggcaaccugagagugaagccccagcagggcaccgccguguucugguacaacuaccugcccgacggccagggcugggugggcgacguggacgacuacagccugcacggcggcugccuggugaccagaggcaccaaguggaucgccaacaacuggaucaacguggaccccagcagagccagacaggcccuguuccagcaggagauggccagacuggccagagagggcggcaccgacagccagcccgagugggcccuggacagagccuacagagacgccagaguggagcuguaa

SEQ ID NO: 21124 - RNA, 1185 nt, Artificial Sequence
  PA2G4__Homo_sapiens__NP_006182
augagcggcgaggacgagcagcaggagcagaccaucgccgaggaccugguggugaccaaguacaagaugggcggcgacaucgccaacagagugcugagaagccugguggaggccagcagcagcggcgugagcgugcugagccugugcgagaagggcgacgccaugaucauggaggagaccggcaagaucuucaagaaggagaaggagaugaagaagggcaucgccuuccccaccagcaucagcgugaacaacugcgugugccacuucagcccccugaagagcgaccaggacuacauccugaaggagggcgaccuggugaagaucgaccugggcgugcacguggacggcuucaucgccaacguggcccacaccuucgugguggacguggcccagggcacccaggugaccggcagaaaggccgacgugaucaaggccgcccaccugugcgccgaggccgcccugagacuggugaagcccggcaaccagaacacccaggugaccgaggccuggaacaagguggcccacagcuucaacugcacccccaucgagggcaugcugagccaccagcugaagcagcacgugaucgacggcgagaagaccaucauccagaaccccaccgaccagcagaagaaggaccacgagaaggccgaguucgaggugcacgagguguacgccguggacgugcuggugagcagcggcgagggcaaggccaaggacgccggccagagaaccaccaucuacaagagagaccccagcaagcaguacggccugaagaugaagaccagcagagccuucuucagcgagguggagagaagauucgacgccaugcccuucacccugagagccuucgaggacgagaagaaggccagaaugggcgugguggagugcgccaagcacgagcugcugcagcccuucaacgugcuguacgagaaggagggcgaguucguggcccaguucaaguucaccgugcugcugaugcccaacggccccaugagaaucaccagcggccccuucgagcccgaccuguacaagagcgagauggaggugcaggacgccgagcugaaggcccugcugcagagcagcgccagcagaaagacccagaagaagaagaagaagaaggccagcaagaccgccgagaacgccaccagcggcgagacccuggaggagaacgaggccggcgacuaa

SEQ ID NO: 21125 - RNA, 1911 nt, Artificial Sequence
  PABPC1__Homo_sapiens__XP_005250918
augaaccccagcgcccccagcuaccccauggccagccuguacgugggcgaccugcaccccgacgugaccgaggccaugcuguacgagaaguucagccccgccggccccauccugagcaucagagugugcagagacaugaucaccagaagaagccugggcuacgccuacgugaacuuccagcagcccgccgacgccgagagagcccuggacaccaugaacuucgacgugaucaagggcaagcccgugagaaucauguggagccagagagaccccagccugagaaagagcggcgugggcaacaucuucaucaagaaccuggacaagagcaucgacaacaaggcccuguacgacaccuucagcgccuucggcaacauccugagcugcaagguggugugcgacgagaacggcagcaagggcuacggcuucgugcacuucgagacccaggaggccgccgagagagccaucgagaagaugaacggcaugcugcugaacgacagaaagguguucgugggcagauucaagagcagaaaggagagagaggccgagcugggcgccagagccaaggaguucaccaacguguacaucaagaacuucggcgaggacauggacgacgagagacugaaggaccuguucggcaaguucggccccgcccugagcgugaaggugaugaccgacgagagcggcaagagcaagggcuucggcuucgugagcuucgagagacacgaggacgcccagaaggccguggacgagaugaacggcaaggagcugaacggcaagcagaucuacgugggcagagcccagaagaagguggagagacagaccgagcugaagagaaaguucgagcagaugaagcaggacagaaucaccagauaccagggcgugaaccuguacgugaagaaccuggacgacggcaucgacgacgagagacugagaaaggaguucagccccuucggcaccaucaccagcgccaaggugaugauggagggcggcagaagcaagggcuucggcuucgugugcuucagcagccccgaggaggccaccaaggccgugaccgagaugaacggcagaaucguggccaccaagccccuguacguggcccuggcccagagaaaggaggagagacaggcccaccugaccaaccaguacaugcagagaauggccagcgugagagccgugcccaaccccgugaucaaccccuaccagcccgccccccccagcggcuacuucauggccgccaucccccagacccagaacagagccgccuacuacccccccagccagaucgcccagcugagacccagccccagauggaccgcccagggcgccagaccccaccccuuccagaacaugcccggcgccaucagacccgccgcccccagaccccccuucagcaccaugagacccgccagcagccaggugcccagagugaugagcacccagagaguggccaacaccagcacccagaccaugggccccagacccgccgccgccgccgccgccgccacccccgccgugagaaccgugccccaguacaaguacgccgccggcgugagaaacccccagcagcaccugaacgcccagccccaggugaccaugcagcagcccgccgugcacgugcagggccaggagccccugaccgccagcaugcuggccagcgcccccccccaggagcagaagcagaugcugggcgagagacuguucccccugauccaggccaugcaccccacccuggccggcaagaucaccggcaugcugcuggagaucgacaacagcgagcugcugcacaugcuggagagccccgagagccugagaagcaagguggacgaggccguggccgugcugcaggcccaccaggccaaggaggccgcccagaaggccgugaacagcgccaccggcgugcccaccguguaa

SEQ ID NO: 21126 - RNA, 1896 nt, Artificial Sequence
  PABPC3__Homo_sapiens__NP_112241
augaaccccagcacccccagcuaccccaccgccagccuguacgugggcgaccugcaccccgacgugaccgaggccaugcuguacgagaaguucagccccgccggccccauccugagcaucagaaucugcagagaccugaucaccagcggcagcagcaacuacgccuacgugaacuuccagcacaccaaggacgccgagcacgcccuggacaccaugaacuucgacgugaucaagggcaagcccgugagaaucauguggagccagagagaccccagccugagaaagagcggcgugggcaacaucuucgugaagaaccuggacaagagcaucaacaacaaggcccuguacgacaccgugagcgccuucggcaacauccugagcugcaacguggugugcgacgagaacggcagcaagggcuacggcuucgugcacuucgagacccacgaggccgccgagagagccaucaagaagaugaacggcaugcugcugaacggcagaaagguguucgugggccaguucaagagcagaaaggagagagaggccgagcugggcgccagagccaaggaguuccccaacguguacaucaagaacuucggcgaggacauggacgacgagagacugaaggaccuguucggcaaguucggccccgcccugagcgugaaggugaugaccgacgagagcggcaagagcaagggcuucggcuucgugagcuucgagagacacgaggacgcccagaaggccguggacgagaugaacggcaaggagcugaacggcaagcagaucuacgugggcagagcccagaagaagguggagagacagaccgagcugaagagaaccuucgagcagaugaagcaggacagaaucaccagauaccagguggugaaccuguacgugaagaaccuggacgacggcaucgacgacgagagacugagaaaggccuucagccccuucggcaccaucaccagcgccaaggugaugauggagggcggcagaagcaagggcuucggcuucgugugcuucagcagccccgaggaggccaccaaggccgugaccgagaugaacggcagaaucguggccaccaagccccuguacguggcccuggcccagagaaaggaggagagacaggccuaccugaccaacgaguacaugcagagaauggccagcgugagagccgugcccaaccagagagccccccccagcggcuacuucaugaccgccgugccccagacccagaaccacgccgccuacuacccccccagccagaucgccagacugagacccagccccagauggaccgcccagggcgccagaccccaccccuuccagaacaagcccagcgccaucagacccggcgcccccagagugcccuucagcaccaugagacccgccagcagccaggugcccagagugaugagcacccagagaguggccaacaccagcacccagaccgugggccccagacccgccgccgccgccgccgccgccgccacccccgccgugagaaccgugcccagauacaaguacgccgccggcgugagaaacccccagcagcacagaaacgcccagccccaggugaccaugcagcagcuggccgugcacgugcagggccaggagacccugaccgccagcagacuggccagcgcccccccccagaagcagaagcagaugcugggcgagagacuguucccccugauccaggccaugcaccccacccuggccggcaagaucaccggcaugcugcuggagaucgacaacagcgagcugcuguacaugcuggagagccccgagagccugagaagcaagguggacgaggccguggccgugcugcaggcccaccaggccaaggaggccacccagaaggccgugaacagcgccaccggcgugcccaccguguaa

SEQ ID NO: 21127 - RNA, 1287 nt, Artificial Sequence
  PABPC4L__Homo_sapiens__NP_001108206
augagagugcugcccgagcugggcgagagcugccugaacagcaucgccuggccccugugcggcgaccccgaggccagcacccuggagcccggccagagcugcgaccuggugagcccccacagagacugcagcaagaacagcagaggccagacccacagcggcaaggacaaggagaugaacguggccgccaaguacagaauggccagccuguacgugggcgaccugcacgccgacgugaccgaggaccugcuguucagaaaguucagcaccgugggccccgugcugagcaucagaaucugcagagaccaggugaccagaagaagccugggcuacgccuacgugaacuuccugcagcuggccgacgcccagaaggcccuggacaccaugaacuucgacaucaucaagggcaagagcaucagacugauguggagccagagagacgccuaccugagaagaagcggcaucggcaacguguucaucaagaaccuggacaagagcaucgacaacaagacccuguacgagcacuucagcgccuucggcaagauccugagcagcaaggugaugagcgacgaccagggcagcaagggcuacgccuucgugcacuuccagaaccagagcgccgccgacagagccaucgaggagaugaacggcaagcugcugaagggcugcaagguguucgugggcagauucaagaacagaaaggacagagaggccgagcugagaagcaaggccagcgaguucaccaacguguacaucaagaacuucggcggcgacauggacgacgagagacugaaggacguguucagcaaguacggcaagacccugagcgugaaggugaugaccgacagcagcggcaagagcaagggcuucggcuucgugagcuucgacagccacgaggccgccaagaaggccguggaggagaugaacggcagagacaucaacggccagcugaucuucgugggcagagcccagaagaagguggagagacaggccgagcugaagcagauguucgagcagcugaagagagagagaaucagaggcugccagggcgugaagcuguacaucaagaaccuggacgacaccaucgacgacgagaagcugagaaacgaguucagcagcuucggcagcaucagcagagugaaggugaugcaggaggagggccagagcaagggcuucggccugaucugcuucagcagccccgaggacgccaccaaggccaugaccgagaugaacggcagaauccugggcagcaagccccugagcaucgcccuggcccagagacacuaa

SEQ ID NO: 21128 - RNA, 921 nt, Artificial Sequence
  PABPN1__Homo_sapiens__NP_004634
auggccgccgccgccgccgccgccgccgccgccggcgccgccggcggcagaggcagcggccccggcagaagaagacaccuggugcccggcgccggcggcgaggccggcgagggcgcccccggcggcgccggcgacuacggcaacggccuggagagcgaggagcuggagcccgaggagcugcugcuggagcccgagcccgagcccgagcccgaggaggagccccccagacccagagccccccccggcgcccccggccccggccccggcagcggcgcccccggcagccaggaggaggaggaggagcccggccugguggagggcgaccccggcgacggcgccaucgaggaccccgagcuggaggccaucaaggccagagugagagagauggaggaggaggccgagaagcugaaggagcugcagaacgagguggagaagcagaugaacaugagccccccccccggcaacgccggccccgugaucaugagcaucgaggagaagauggaggccgacgccagaagcaucuacgugggcaacguggacuacggcgccaccgccgaggagcuggaggcccacuuccacggcugcggcagcgugaacagagugaccauccugugcgacaaguucagcggccaccccaagggcuucgccuacaucgaguucagcgacaaggagagcgugagaaccagccuggcccuggacgagagccuguucagaggcagacagaucaaggugauccccaagagaaccaacagacccggcaucagcaccaccgacagaggcuuccccagagccagauacagagccagaaccaccaacuacaacagcagcagaagcagauucuacagcggcuucaacagcagacccagaggcagaguguacagaggcagagccagagccaccagcugguacagccccuacuaa

SEQ ID NO: 21129 - RNA, 774 nt, Artificial Sequence
  PACRG__Homo_sapiens__NP_001073848
augguggccgagaaggagacccugagccugaacaagugccccgacaagaugcccaagagaaccaagcugcuggcccagcagccccugcccgugcaccagccccacagccuggugagcgagggcuucaccgugaaggccaugaugaagaacagcguggugagaggcccccccgccgccggcgccuucaaggagagacccaccaagcccaccgccuucagaaaguucuacgagagaggcgacuuccccaucgcccuggagcacgacagcaagggcaacaagaucgccuggaagguggagaucgagaagcuggacuaccaccacuaccugccccuguucuucgacggccugugcgagaugaccuuccccuacgaguucuucgccagacagggcauccacgacaugcuggagcacggcggcaacaagauccugcccgugcugccccagcugaucauccccaucaagaacgcccugaaccugagaaacagacaggugaucugcgugacccugaaggugcugcagcaccugguggugagcgccgagauggugggcaaggcccuggugcccuacuacagacagauccugcccgugcugaacaucuucaagaacaugaacgugaacagcggcgacggcaucgacuacagccagcagaagagagagaacaucggcgaccugauccaggagacccuggaggccuucgagagauacggcggcgagaacgccuucaucaacaucaaguacguggugcccaccuacgagagcugccugcugaacuaa

SEQ ID NO: 21130 - RNA, 2892 nt, Artificial Sequence
  PACS1__Homo_sapiens__NP_060496
auggccgagagaggcggcgccggcggcggccccggcggcgccggcggcggcagcggccagagaggcagcggcguggcccagagcccccagcagccccccccccagcagcagcagcagcagcccccccagcagcccaccccccccaagcuggcccaggccaccagcagcagcagcagcaccagcgccgccgccgccagcagcagcagcagcagcaccagcaccagcauggccguggccguggccagcggcagcgccccccccggcggccccggccccggcagaacccccgcccccgugcagaugaaccuguacgccaccugggagguggacagaagcagcagcagcugcgugcccagacuguucagccugacccugaagaagcuggugaugcugaaggagauggacaaggaccugaacagcguggugaucgccgugaagcugcagggcagcaagagaauccugagaagcaacgagaucgugcugcccgccagcggccugguggagaccgagcugcagcugaccuucagccugcaguacccccacuuccugaagagagacgccaacaagcugcagaucaugcugcagagaagaaagagauacaagaacagaaccauccugggcuacaagacccuggccgugggccugaucaacauggccgaggugaugcagcaccccaacgagggcgcccuggugcugggccugcacagcaacgugaaggacgugagcgugcccguggccgagaucaagaucuacagccugagcagccagcccaucgaccacgagggcaucaagagcaagcugagcgacagaagccccgacaucgacaacuacagcgaggaggaggaggagagcuucagcagcgagcaggagggcagcgacgacccccugcacggccaggaccuguucuacgaggacgaggaccugagaaaggugaagaagaccagaagaaagcugaccagcaccagcgccaucaccagacagcccaacaucaagcagaaguucguggcccugcugaagagauucaaggugagcgacgaggugggcuucggccuggagcacgugagcagagagcagaucagagagguggaggaggaccuggacgagcuguacgacagccuggagauguacaaccccagcgacagcggccccgagauggaggagaccgagagcauccugagcacccccaagcccaagcugaagcccuucuucgagggcaugagccagagcagcagccagaccgagaucggcagccugaacagcaagggcagccugggcaaggacaccaccagccccauggagcuggccgcccuggagaagaucaagagcaccuggaucaagaaccaggacgacagccugaccgagaccgacacccuggagaucaccgaccaggacauguucggcgacgccagcaccagccugguggugcccgagaaggugaagacccccaugaagagcagcaagaccgaccugcagggcagcgccagccccagcaagguggagggcgugcacacccccagacagaagagaagcaccccccugaaggagagacagcugagcaagccccugagcgagagaaccaacagcagcgacagcgagagaagccccgaccugggccacagcacccagauccccagaaaggugguguacgaccagcugaaccagauccuggugagcgacgccgcccugcccgagaacgugauccuggugaacaccaccgacuggcagggccaguacguggccgagcugcugcaggaccagagaaagcccguggugugcaccugcagcaccguggaggugcaggccgugcugagcgcccugcugaccagaauccagagauacugcaacugcaacagcagcaugcccagacccgugaagguggccgccgugggcggccagagcuaccugagcagcauccugagauucuucgugaagagccuggccaacaagaccagcgacuggcugggcuacaugagauuccugaucaucccccugggcagccaccccguggccaaguaccugggcagcguggacagcaaguacagcagcagcuuccuggacagcggcuggagagaccuguucagcagaagcgagccccccgugagcgagcagcuggacguggccggcagagugaugcaguacgugaacggcgccgccaccacccaccagcugcccguggccgaggccaugcugaccugcagacacaaguuccccgacgaggacagcuaccagaaguucauccccuucaucggcguggugaaggugggccugguggaggacagccccagcaccgccggcgacggcgacgacagccccguggugagccugaccgugcccagcaccagcccccccagcagcagcggccugagcagagacgccaccgccaccccccccagcagccccagcaugagcagcgcccuggccaucgugggcagccccaacagccccuacggcgacgugaucggccugcagguggacuacuggcugggccaccccggcgagagaagaagagagggcgacaagagagacgccagcagcaagaacacccugaagagcguguucagaagcgugcaggugagcagacugccccacagcggcgaggcccagcugagcggcaccauggccaugaccguggugaccaaggagaagaacaagaaggugcccaccaucuuccugagcaagaagcccagagagaaggagguggacagcaagagccaggugaucgagggcaucagcagacugaucugcagcgccaagcagcagcagaccaugcugagagugagcaucgacggcguggaguggagcgacaucaaguucuuccagcuggccgcccaguggcccacccacgugaagcacuuccccgugggccuguucagcggcagcaaggccaccuaa

SEQ ID NO: 21131 - RNA, 2715 nt, Artificial Sequence
  PACS2__Homo_sapiens__NP_001094383
auggccgagagaggcagacugggccugcccggcgcccccggcgcccugaacacccccgugcccaugaaccuguucgccaccugggagguggacggcagcagccccagcugcgugcccagacugugcagccugacccugaagaagcuggugguguucaaggagcuggagaaggagcugaucagcguggugaucgccgugaagaugcagggcagcaagagaauccugagaagccacgagaucgugcugccccccagcggccagguggagaccgaccuggcccugaccuucagccugcaguacccccacuuccugaagagagagggcaacaagcugcagaucaugcugcagagaagaaagagauacaagaacagaaccauccugggcuacaagacccuggccgccggcagcaucagcauggccgaggugaugcagcaccccagcgagggcggccaggugcugagccugugcagcagcaucaaggaggcccccgugaaggccgccgagaucuggaucgccagccugagcagccagcccaucgaccacgaggacagcaccaugcaggccggccccaaggccaagagcaccgacaacuacagcgaggaggaguacgagagcuucagcagcgagcaggaggccagcgacgacgccgugcagggccaggaccuggacgaggacgacuucgacgugggcaagcccaagaagcagagaagaagcaucgugagaaccaccagcaugaccagacagcagaacuucaagcagaaggugguggcccugcugagaagauucaaggugagcgacgaggugcuggacagcgagcaggaccccgccgagcacauccccgaggccgaggaggaccuggaccugcuguacgacacccuggacauggagcaccccagcgacagcggccccgacauggaggacgacgacagcgugcugagcacccccaagcccaagcugagacccuacuucgagggccugagccacagcagcagccagaccgagaucggcagcauccacagcgccagaagccacaaggagccccccagccccgccgacgugcccgagaagaccagaagccugggcggcagacagcccagcgacagcgugagcgacaccguggcccugggcgugcccggccccagagagcaccccggccagcccgaggacagccccgaggccgaggccagcacccuggacguguucaccgagagacugccccccagcggcagaaucaccaagaccgagagccuggugauccccagcaccagaagcgagggcaagcaggccggcagaagaggcagaagcaccagccugaaggagagacaggccgccagaccccagaacgagagagccaacagccuggacaacgagagaugccccgacgccagaagccagcugcaggugcagcugcagauccccagaaagaccguguacgaccagcugaaccacauccugaucagcgacgaccagcugcccgagaacaucauccuggugaacaccagcgacuggcagggccaguuccugagcgacgugcugcagagacacacccugcccguggugugcaccugcagccccgccgacgugcaggccgccuucagcaccaucgugagcagaauccagagauacugcaacugcaacagccagccccccacccccgugaagaucgccguggccggcgcccagcacuaccugagcgccauccugagacuguucguggagcagcugagccacaagacccccgacuggcugggcuacaugagauuccuggugaucccccugggcagccaccccguggccagauaccugggcagcguggacuacagauacaacaacuucuuccaggaccuggccuggagagaccuguucaacaagcuggaggcccagagcgccgugcaggacacccccgacaucgugagcagaaucacccaguacaucgccggcgccaacugcgcccaccagcugcccaucgccgaggccaugcugaccuacaagcagaagagaaagaagcacuuccacuucgacuucacccugagccccgacgaggagagcagccagaaguucauccccuucgugggcguggugaaggugggcaucguggagcccagcagcgccaccagcggcgacagcgacgacgccgcccccagcggcagcggcacccugagcagcaccccccccagcgccagccccgccgccaaggaggccagccccaccccccccagcagccccagcgugagcggcggccugagcagccccagccagggcgugggcgccgagcugaugggccugcagguggacuacuggaccgccgcccagcccgccgacagaaagagagacgccgagaagaaggaccugcccgugaccaagaacacccugaagugcaccuucagaagccugcaggugagcagacugcccagcagcggcgaggccgccgccacccccaccaugagcaugaccguggugaccaaggagaagaacaagaaggugauguuccugcccaagaaggccaaggacaaggacguggagagcaagagccagugcaucgagggcaucagcagacugaucugcaccgccagacagcagcagaacaugcugagagugcugaucgacggcguggagugcagcgacgugaaguucuuccagcuggccgcccaguggagcagccacgugaagcacuuccccaucugcaucuucggccacagcaaggccaccuucuaa

SEQ ID NO: 21132 - RNA, 1335 nt, Artificial Sequence
  PACSIN1__Homo_sapiens__XP_011512843
augagcagcagcuacgacgaggccagccuggcccccgaggagaccaccgacagcuucugggaggugggcaacuacaagagaaccgugaagagaaucgacgacggccacagacugugcaacgaccugaugaacugcgugcaggagagagccaagaucgagaaggccuacggccagcagcugaccgacugggccaagagauggagacagcugaucgagaagggcccccaguacggcagccuggagagagccuggggcgccaucaugaccgaggccgacaaggugagcgagcugcaccaggaggugaagaacaaccugcugaacgaggaccuggagaaggugaagaacuggcagaaggacgccuaccacaagcagaucaugggcggcuucaaggagaccaaggaggccgaggacggcuucagaaaggcccagaagcccugggccaagaagaugaaggagcuggaggccgccaagaaggccuaccaccuggccugcaaggaggagaagcuggccaugaccagagagaugaacagcaagaccgagcagagcgugacccccgagcagcagaagaagcugcaggacaagguggacaagugcaagcaggacgugcagaagacccaggagaaguacgagaaggugcuggaggacgugggcaagaccaccccccaguacauggagaacauggagcagguguucgagcagugccagcaguucgaggagaagagacugguguuccugaaggaggugcugcuggacaucaagagacaccugaaccuggccgagaacagcagcuacauccacguguacagagagcuggagcaggccaucagaggcgccgacgcccaggaggaccugagaugguucagaagcaccagcggccccggcaugcccaugaacuggccccaguucgaggaguggaaccccgaccugccccacaccaccaccaagaaggagaagcagcccaagaaggccgagggcguggcccugaccaacgccaccggcgccguggagagcaccagccaggccggcgacagaggcagcgugagcagcuacgacagaggccagcccuacgccaccgaguggagcgacgacgagagcggcaaccccuucggcggcagcgagaccaacggcggcgccaaccccuucgaggacgacagcaagggcgugagagugagagcccuguacgacuacgacggccaggagcaggacgagcugagcuucaaggccggcgacgagcugaccaagcugggcgaggaggacgagcagggcuggugcagaggcagacuggacagcggccagcugggccuguaccccgccaacuacguggaggccaucuaa

SEQ ID NO: 21133 - RNA, 1461 nt, Artificial Sequence
  PACSIN2__Homo_sapiens__NP_001171899
augagcgugaccuacgacgacagcgugggcguggaggugagcagcgacagcuucugggaggugggcaacuacaagagaaccgugaagagaaucgacgacggccacagacugugcagcgaccugaugaacugccugcacgagagagccagaaucgagaaggccuacgcccagcagcugaccgagugggccagaagauggagacagcugguggagaagggcccccaguacggcaccguggagaaggccuggauggccuucaugagcgaggccgagagagugagcgagcugcaccuggaggugaaggccagccugaugaacgacgacuucgagaagaucaagaacuggcagaaggaggccuuccacaagcagaugaugggcggcuucaaggagaccaaggaggccgaggacggcuucagaaaggcccagaagcccugggccaagaagcugaaggagguggaggccgccaagaaggcccaccacgccgccugcaaggaggagaagcuggccaucagcagagaggccaacagcaaggccgaccccagccugaaccccgagcagcugaagaagcugcaggacaagaucgagaagugcaagcaggacgugcugaagaccaaggagaaguacgagaagagccugaaggagcuggaccagggcaccccccaguacauggagaacauggagcagguguucgagcagugccagcaguucgaggagaagagacugagauucuucagagaggugcugcuggaggugcagaagcaccuggaccugagcaacguggccggcuacaaggccaucuaccacgaccuggagcagagcaucagagccgccgacgccguggaggaccugagaugguucagagccaaccacggccccggcauggccaugaacuggccccaguucgaggaguggagcgccgaccugaacagaacccugagcagaagagagaagaagaaggccaccgacggcgugacccugaccggcaucaaccagaccggcgaccagagccugcccagcaagcccagcagcacccugaacgugcccagcaaccccgcccagagcgcccagagccagagcagcuacaaccccuucgaggacgaggacgacaccggcagcaccgugagcgagaaggacgacaccaaggccaagaacgugagcagcuacgagaagacccagagcuaccccaccgacuggagcgacgacgagagcaacaaccccuucagcagcaccgacgccaacggcgacagcaaccccuucgacgacgacgccaccagcggcaccgaggugagagugagagcccuguacgacuacgagggccaggagcacgacgagcugagcuucaaggccggcgacgagcugaccaagauggaggacgaggacgagcagggcuggugcaagggcagacuggacaacggccaggugggccuguaccccgccaacuacguggaggccauccaguaa

SEQ ID NO: 21134 - RNA, 1806 nt, Artificial Sequence
  PADI4__Homo_sapiens__XP_011539452
auggcccagggcacccugaucagagugacccccgagcagcccacccacgccgugugcgugcugggcacccugacccagcuggacaucugcagcagcgcccccgaggacugcaccagcuucagcaucaacgccagccccggcguggugguggacaucgcccacggcccccccgccaagaagaagagcaccggcagcagcaccuggccccuggaccccggcguggaggugacccugaccaugaagguggccagcggcagcaccggcgaccagaaggugcagaucagcuacuacggccccaagaccccccccgugaaggcccugcuguaccugaccggcguggaccugcaggacaugagccugaugacccugagcaccaagacccccaaggacuucuucaccaaccacacccuggugcugcacguggccagaagcgagauggacaaggugagaguguuccaggccaccagaggcaagcugagcagcaagugcagcguggugcugggccccaaguggcccagccacuaccugauggugcccggcggcaagcacaacauggacuucuacguggaggcccuggccuuccccgacaccgacuuccccggccugaucacccugaccaucagccugcuggacaccagcaaccuggagcugcccgaggccgugguguuccaggacagcgugguguucagaguggcccccuggaucaugacccccaacacccagcccccccaggagguguacgccugcagcaucuucgagaacgaggacuuccugaagagcgugaccacccuggccaugaaggccaagugcaagcugaccaucugccccgaggaggagaacauggacgaccaguggaugcaggacgagauggagaucggcuacauccaggccccccacaagacccugcccgugguguucgacagccccagaaacagaggccugaaggaguuccccaucaagagagugaugggccccgacuucggcuacgugaccagaggcccccagaccggcggcaucagcggccuggacagcuucggcaaccuggaggugagcccccccgugaccgugagaggcaaggaguacccccugggcagaauccuguucggcgacagcugcuaccccagcaacgacagcagacagaugcaccaggcccugcaggacuuccugagcgcccagcaggugcaggcccccgugaagcuguacagcgacuggcugagcgugggccacguggacgaguuccugagcuucgugcccgcccccgacagaaagggcuucagacugcugcuggccagccccagaagcugcuacaagcuguuccaggagcagcagaacgagggccacggcgaggcccugcuguucgagggcaucaagaagaagaagcagcagaagaucaagaacauccugagcaacaagacccugagagagcacaacagcuucguggagagaugcaucgacuggaacagagagcugcugaagagagagcugggccuggccgagagcgacaucaucgacaucccccagcuguucaagcugaaggaguucagcaaggccgaggccuucuuccccaacauggugaacaugcuggugcugggcaagcaccugggcauccccaagcccuucggccccgugaucaacggcagaugcugccuggaggagaaggugugcagccugcuggagccccugggccugcagugcaccuucaucaacgacuucuucaccuaccacaucagacacggcgaggugcacugcggcaccaacgugagaagaaagcccuucagcuucaagugguggaacauggugcccuaa

SEQ ID NO: 21135 - RNA, 543 nt, Artificial Sequence
  PAEP__Homo_sapiens__NP_001018059
augcugugccugcugcugacccugggcguggcccuggugugcggcgugcccgccauggacaucccccagaccaagcaggaccuggagcugcccaagcuggccggcaccuggcacagcauggccauggccaccaacaacaucagccugauggccacccugaaggccccccugagagugcacaucaccagccugcugcccacccccgaggacaaccuggagaucgugcugcacagaugggagaacaacagcugcguggagaagaaggugcugggcgagaagaccgagaaccccaagaaguucaagaucaacuacaccguggccaacgaggccacccugcuggacaccgacuacgacaacuuccuguuccugugccugcaggacaccaccacccccauccagagcaugaugugccaguaccuggccagagugcugguggaggacgacgagaucaugcagggcuucaucagagccuucagaccccugcccagacaccugugguaccugcuggaccugaagcagauggaggagcccugcagauucuaa

SEQ ID NO: 21136 - RNA, 1458 nt, Artificial Sequence
  PAF1__Homo_sapiens__NP_001243755
auggcccccaccauccagacccaggcccagagagaggacggccacagaagcggcguggugugcagagugaaguacugcaacagccugcccgacauccccuucgaccccaaguucaucaccuaccccuucgaccagaacagauucgugcaguacaaggccaccagccuggagaagcagcacaagcacgaccugcugaccgagcccgaccugggcgugaccaucgaccugaucaaccccgacaccuacagaaucgaccccaacgugcugcuggaccccgccgacgagaagcugcuggaggaggagauccaggcccccaccagcagcaagagaagccagcagcacgccaagguggugcccuggaugagaaagaccgaguacaucagcaccgaguucaacagauacggcaucagcaacgagaagcccgaggugaagaucggcgugagcgugaagcagcaguucaccgaggaggagaucuacaaggacagagacagccagaucaccgccaucgagaagaccuucgaggacgcccagaagagcaucagccagcacuacagcaagcccagagugacccccguggaggugaugcccguguuccccgacuucaagauguggaucaaccccugcgcccaggugaucuucgacagcgaccccgcccccaaggacaccagcggcgccgccgcccuggagaugaugagccaggccaugaucagaggcaugauggacgaggagggcaaccaguucguggccuacuuccugcccguggaggagacccugaagaagagaaagagagaccaggaggaggagauggacuacgcccccgacgacguguacgacuacaagaucgccagagaguacaacuggaacgugaagaacaaggccagcaagggcuacgaggagaacuacuucuucaucuucagagagggcgacggcguguacuacaacgagcuggagaccagagugagacugagcaagagaagagccaaggccggcgugcagagcggcaccaacgcccugcugguggugaagcacagagacaugaacgagaaggagcuggaggcccaggaggccagaaaggcccagcuggagaaccacgagcccgaggaggaggaggaggaggagauggagaccgaggagaaggaggccggcggcagcgugaugcugauccugagaaccaugcccacccugaugaugagaaccgaggacagacccaagguggccgugaccaugauccagaccgccgccgccaugggcguggccagcggcgccggcgccaccgccgccgcccccgugcccagccccguggccgccagcaccagacccagaagaauggccgugaagcugcagcugcugauccccgugaagcugaucgugaccgugaccgagagccagggcauccagggcugguucagacaccacuacugcgagcagcagagcaccuuccugguggugugccuguaa

SEQ ID NO: 21137 - RNA, 1233 nt, Artificial Sequence
  PAFAH1B1__Homo_sapiens__NP_000421
auggugcugagccagagacagagagacgagcugaacagagccaucgccgacuaccugagaagcaacggcuacgaggaggccuacagcguguucaagaaggaggccgagcuggacgugaacgaggagcuggacaagaaguacgccggccugcuggagaagaaguggaccagcgugaucagacugcagaagaaggugauggagcuggagagcaagcugaacgaggccaaggaggaguucaccagcggcggcccccugggccagaagagagaccccaaggaguggauccccagaccccccgagaaguacgcccugagcggccacagaagccccgugaccagagugaucuuccaccccguguucagcgugauggugagcgccagcgaggacgccaccaucaaggugugggacuacgagaccggcgacuucgagagaacccugaagggccacaccgacagcgugcaggacaucagcuucgaccacagcggcaagcugcuggccagcugcagcgccgacaugaccaucaagcugugggacuuccagggcuucgagugcaucagaaccaugcacggccacgaccacaacgugagcagcguggccaucaugcccaacggcgaccacaucgugagcgccagcagagacaagaccaucaagaugugggaggugcagaccggcuacugcgugaagaccuucaccggccacagagagugggugagaauggugagacccaaccaggacggcacccugaucgccagcugcagcaacgaccagaccgugagagugugggugguggccaccaaggagugcaaggccgagcugagagagcacgagcacgugguggagugcaucagcugggcccccgagagcagcuacagcagcaucagcgaggccaccggcagcgagaccaagaagagcggcaagcccggccccuuccugcugagcggcagcagagacaagaccaucaagaugugggacgugagcaccggcaugugccugaugacccuggugggccacgacaacugggugagaggcgugcuguuccacagcggcggcaaguucauccugagcugcgccgacgacaagacccugagagugugggacuacaagaacaagagaugcaugaagacccugaacgcccacgagcacuucgugaccagccuggacuuccacaagaccgcccccuacguggugaccggcagcguggaccagaccgugaaggugugggagugcagauaa

SEQ ID NO: 21138 - RNA, 609 nt, Artificial Sequence
  PAFAH1B2__Homo_sapiens__NP_001171675
augagccagggcgacagcaaccccgccgccaucccccacgccgccgaggacauccagggcgacgacagauggaugagccagcacaacagauucgugcuggacugcaaggacaaggagcccgacgugcuguucgugggcgacagcauggugcagcugaugcagcaguacgagaucuggagagagcuguucagcccccugcacgcccugaacuucggcaucggcggcgacaccaccagacacgugcuguggagacugaagaacggcgagcuggagaacaucaagcccaaggugaucguggugugggugggcaccaacaaccacgagaacaccgccgaggagguggccggcggcaucgaggccaucgugcagcugaucaacaccagacagccccaggccaagaucaucgugcugggcaaggccgccgccagcaaguacagcaucagcgagaucgugagacuggagcagggcagcgugaacuggagcaucggcaccuaccccgacgacacccccgccaccaccagacccgccauccugcagcuguucaccggcaagaugagcagaaucaccaugaaggagaagagcagauggaccgaggagauccugcacuaa

SEQ ID NO: 21139 - RNA, 1251 nt, Artificial Sequence
  PAFAH2__Homo_sapiens__XP_011539830
augaccguggcccccagcgugagcgccagcaaguucagcagcggcaagagcuucgacagccccggcgacgagaugggcgugaaccagagcgugggcuucccccccgugaccggcccccaccuggugggcugcggcgacgugauggagggccagaaccugcagggcagcuucuucagacuguucuaccccugccagaaggccgaggagaccauggagcagccccuguggauccccagauacgaguacugcaccggccuggccgaguaccugcaguucaacaagagaugcggcggccugcuguucaaccuggccgugggcagcugcagacugcccgugagcuggaacggccccuucaagaccaaggacagcggcuacccccugaucaucuucagccacggccugggcgccuucagaacccuguacagcgccuucugcauggagcuggccagcagaggcuucgugguggccgugcccgagcacagagacagaagcgccgccaccaccuacuucugcaagcaggcccccgaggagaaccagcccaccaacgagagccugcaggaggaguggauccccuucagaagaguggaggagggcgagaaggaguuccacgugagaaacccccaggugcaccagagagugagcgagugccugagagugcugaagauccugcaggaggugaccgccggccagaccguguucaacauccugcccggcggccuggaccugaugacccugaagggcaacaucgacaugagcagaguggccgugaugggccacagcuucggcggcgccaccgccauccuggcccuggccaaggagacccaguucagaugcgccguggcccuggacgccuggauguucccccuggagagagacuucuaccccaaggccagaggccccguguucuucaucaacaccgagaaguuccagaccauggagagcgugaaccugaugaagaagaucugcgcccagcacgagcagagcagaaucaucaccgugcugggcagcgugcacagaagccagaccgacuucgccuucgugaccggcaaccugaucggcaaguucuucagcaccgagaccagaggcagccuggaccccuacgagggccaggaggugauggugagagccaugcuggccuuccugcagaagcaccuggaccugaaggaggacuacaaccaguggaacaaccugaucgagggcaucggccccagccugacccccggcgccccccaccaccugagcagccuguaa

SEQ ID NO: 21140 - RNA, 1299 nt, Artificial Sequence
  PAG1__Homo_sapiens__XP_011515867
augggccccgccggcagccugcugggcagcggccagaugcagaucacccuguggggcagccuggccgccguggccaucuucuucgugaucaccuuccugaucuuccugugcagcagcugcgacagagagaagaagcccagacagcacagcggcgaccacgagaaccugaugaacgugcccagcgacaaggagauguucagcagaagcgugaccagccuggccaccgacgcccccgccagcagcgagcagaacggcgcccugaccaacggcgacauccugagcgaggacagcacccugaccugcaugcagcacuacgaggaggugcagaccagcgccagcgaccugcuggacagccaggacagcaccggcaagcccaagugccaccagagcagagagcugcccagaaucccccccgagagcgccguggacaccaugcugaccgccagaagcguggacggcgaccagggccugggcauggagggccccuacgaggugcugaaggacagcagcagccaggagaacaugguggaggacugccuguacgagaccgugaaggagaucaaggagguggccgccgccgcccaccuggagaagggccacagcggcaaggccaagagcaccagcgccagcaaggagcugcccggcccccagaccgagggcaaggccgaguucgccgaguacgccagcguggacagaaacaagaagugcagacagagcgugaacguggagagcauccugggcaacagcugcgaccccgaggaggaggcccccccccccgugcccgugaagcugcuggacgagaacgagaaccugcaggagaaggagggcggcgaggccgaggagagcgccaccgacaccaccagcgagaccaacaagagauucagcagccugagcuacaagagcagagaggaggaccccacccugaccgaggaggagaucagcgccauguacagcagcgugaacaagcccggccagcuggugaacaagagcggccagagccugaccgugcccgagagcaccuacaccagcauccagggcgacccccagagaagccccagcagcugcaacgaccuguacgccaccgugaaggacuucgagaagacccccaacagcacccugccccccgccggcagacccagcgaggagcccgagcccgacuacgaggccauccagacccugaacagagaggaggagaaggccacccugggcaccaacggccaccacggccuggugcccaaggagaacgacuacgagagcaucagcgaccugcagcagggcagagacaucaccagacuguaa

SEQ ID NO: 21141 - RNA, 441 nt, Artificial Sequence
  PAGE1__Homo_sapiens__NP_003776
augggcuuccugagaagacugaucuacagaagaagacccaugaucuacguggagagcagcgaggagagcagcgacgagcagcccgacgagguggagagccccacccagagccaggacagcacccccgccgaggagagagaggacgagggcgccagcgccgcccagggccaggagcccgaggccgacagccaggagcuggugcagcccaagaccggcugcgagcugggcgacggccccgacaccaagagagugugccugagaaacgaggagcagaugaagcugcccgccgagggccccgagcccgaggccgacagccaggagcaggugcaccccaagaccggcugcgagagaggcgacggccccgacgugcaggagcugggccugcccaaccccgaggaggugaagacccccgaggaggacgagggccagagccagcccuaa

SEQ ID NO: 21142 - RNA, 309 nt, Artificial Sequence
  PAGE4__Homo_sapiens__NP_008934
augagcgccagagugagaagcagaagcagaggcagaggcgacggccaggaggcccccgacgugguggccuucguggcccccggcgagagccagcaggaggagccccccaccgacaaccaggacaucgagcccggccaggagagagagggcaccccccccaucgaggagagaaagguggagggcgacugccaggagauggaccuggagaagaccagaagcgagagaggcgacggcagcgacgugaaggagaagaccccccccaaccccaagcacgccaagaccaaggaggccggcgacggccagcccuaa

SEQ ID NO: 21143 - RNA, 333 nt, Artificial Sequence
  PAGE5__Homo_sapiens__NP_001013453
augagcgagcacgugaccagaagccagagcagcgagagaggcaacgaccaggagagcagccagcccgugggccccgugaucgugcagcagcccaccgaggagaagagacaggaggaggagccccccaccgacaaccagggcaucgcccccagcggcgagaucaagaacgagggcgcccccgccgugcagggcaccgacguggaggccuuccagcaggagcuggcccugcugaagaucgaggacgcccccggcgacggccccgacgugagagagggcacccugcccaccuucgaccccaccaaggugcuggaggccggcgagggccagcuguaa

SEQ ID NO: 21144 - RNA, 765 nt, Artificial Sequence
  PAGR1__Homo_sapiens__NP_078792
augagccuggccagaggccacggcgacaccgccgccagcaccgccgccccccugagcgaggagggcgaggugaccagcggccugcaggcccuggccguggaggacaccggcggccccagcgccagcgccggcaaggccgaggacgagggcgagggcggcagagaggagaccgagagagagggcagcggcggcgaggaggcccagggcgaggugcccagcgccggcggcgaggagcccgccgaggaggacagcgaggacuggugcgugcccugcagcgacgaggagguggagcugcccgccgacggccagcccuggaugcccccccccagcgagauccagagacuguacgagcugcuggccgcccacggcacccuggagcugcaggccgagauccugcccagaagaccccccacccccgaggcccagagcgaggaggagagaagcgacgaggagcccgaggccaaggaggaggaggaggagaagccccacaugcccaccgaguucgacuucgacgacgagcccgugacccccaaggacagccugaucgacagaagaagaacccccggcagcagcgccagaagccagaagagagaggccagacuggacaaggugcugagcgacaugaagagacacaagaagcuggaggagcagauccugagaaccggcagagaccuguucagccuggacagcgaggaccccagccccgccagccccccccugagaagcagcggcagcagccuguuccccagacagagaaaguacuaa

SEQ ID NO: 21145 - RNA, 1359 nt, Artificial Sequence
  PAH__Homo_sapiens__NP_000268
augagcaccgccgugcuggagaaccccggccugggcagaaagcugagcgacuucggccaggagaccagcuacaucgaggacaacugcaaccagaacggcgccaucagccugaucuucagccugaaggaggaggugggcgcccuggccaaggugcugagacuguucgaggagaacgacgugaaccugacccacaucgagagcagacccagcagacugaagaaggacgaguacgaguucuucacccaccuggacaagagaagccugcccgcccugaccaacaucaucaagauccugagacacgacaucggcgccaccgugcacgagcugagcagagacaagaagaaggacaccgugcccugguuccccagaaccauccaggagcuggacagauucgccaaccagauccugagcuacggcgccgagcuggacgccgaccaccccggcuucaaggaccccguguacagagccagaagaaagcaguucgccgacaucgccuacaacuacagacacggccagcccauccccagaguggaguacauggaggaggagaagaagaccuggggcaccguguucaagacccugaagagccuguacaagacccacgccugcuacgaguacaaccacaucuucccccugcuggagaaguacugcggcuuccacgaggacaacaucccccagcuggaggacgugagccaguuccugcagaccugcaccggcuucagacugagacccguggccggccugcugagcagcagagacuuccugggcggccuggccuucagaguguuccacugcacccaguacaucagacacggcagcaagcccauguacacccccgagcccgacaucugccacgagcugcugggccacgugccccuguucagcgacagaagcuucgcccaguucagccaggagaucggccuggccagccugggcgcccccgacgaguacaucgagaagcuggccaccaucuacugguucaccguggaguucggccugugcaagcagggcgacagcaucaaggccuacggcgccggccugcugagcagcuucggcgagcugcaguacugccugagcgagaagcccaagcugcugccccuggagcuggagaagaccgccauccagaacuacaccgugaccgaguuccagccccuguacuacguggccgagagcuucaacgacgccaaggagaaggugagaaacuucgccgccaccauccccagacccuucagcgugagauacgaccccuacacccagagaaucgaggugcuggacaacacccagcagcugaagauccuggccgacagcaucaacagcgagaucggcauccugugcagcgcccugcagaagaucaaguaa

SEQ ID NO: 21146 - RNA, 1278 nt, Artificial Sequence
  PAICS__Homo_sapiens__NP_001072992
auggccaccgccgaggugcugaacaucggcaagaagcuguacgagggcaagaccaaggagguguacgagcugcuggacagccccggcaaggugcugcugcagagcaaggaccagaucaccgccggcaacgccgccagaaagaaccaccuggagggcaaggccgccaucagcaacaagaucaccagcugcaucuuccagcugcugcaggaggccggcaucaagaccgccuucaccagaaagugcggcgagaccgccuucaucgccccccagugcgagaugauccccaucgagugggugugcagaagaaucgccaccggcagcuuccugaagagaaaccccggcgugaaggagggcuacaaguucuacccccccaagguggagcuguucuucaaggacgacgccaacaacgacccccaguggagcgaggagcagcugaucgccgccaaguucugcuucgccggccugcugaucggccagaccgagguggacaucaugagccacgccacccaggccaucuucgagauccuggagaagagcuggcugccccagaacugcacccugguggacaugaagaucgaguucggcguggacgugaccaccaaggagaucgugcuggccgacgugaucgacaacgacagcuggagacuguggcccagcggcgacagaagccagcagaaggacaagcagagcuacagagaccugaaggaggugacccccgagggccugcagauggugaagaagaacuucgaguggguggccgagagaguggagcugcugcugaagagcgagagccagugcagagugguggugcugaugggcagcaccagcgaccugggccacugcgagaagaucaagaaggccugcggcaacuucggcauccccugcgagcugagagugaccagcgcccacaagggccccgacgagacccugagaaucaaggccgaguacgagggcgacggcauccccaccguguucguggccguggccggcagaagcaacggccugggccccgugaugagcggcaacaccgccuaccccgugaucagcugccccccccugacccccgacuggggcgugcaggacguguggagcagccugagacugcccagcggccugggcugcagcaccgugcugagccccgagggcagcgcccaguucgccgcccagaucuucggccugagcaaccaccugguguggagcaagcugagagccagcauccugaacaccuggaucagccugaagcaggccgacaagaagaucagagagugcaaccuguaa

SEQ ID NO: 21147 - RNA, 1440 nt, Artificial Sequence
  PAIP1__Homo_sapiens__NP_006442
augagcgacggcuucgacagagcccccggcgccggcagaggcagaagcagaggccugggcagaggcggcggcggccccgagggcggcggcuuccccaacggcgccggccccgccgagagagccagacaccagcccccccagcccaaggcccccggcuuccugcagccccccccccugagacagcccagaaccacccccccccccggcgcccagugcgaggugcccgccagcccccagagacccagcagacccggcgcccugcccgagcagaccagaccccugagagccccccccagcagccaggacaagaucccccagcagaacagcgagagcgccauggccaagccccagguggugguggcccccgugcugaugagcaagcugagcgugaacgcccccgaguucuaccccagcggcuacagcagcagcuacaccgagagcuacgaggacggcugcgaggacuaccccacccugagcgaguacgugcaggacuuccugaaccaccugaccgagcagcccggcagcuucgagaccgagaucgagcaguucgccgagacccugaacggcugcgugaccaccgacgacgcccugcaggagcugguggagcugaucuaccagcaggccaccagcauccccaacuucagcuacaugggcgccagacugugcaacuaccugagccaccaccugaccaucagcccccagagcggcaacuucagacagcugcugcugcagagaugcagaaccgaguacgaggugaaggaccaggccgccaagggcgacgaggugaccagaaagagauuccacgccuucgugcuguuccugggcgagcuguaccugaaccuggagaucaagggcaccaacggccaggugaccagagccgacauccugcaggugggccugagagagcugcugaacgcccuguucagcaaccccauggacgacaaccugaucugcgccgugaagcugcugaagcugaccggcagcgugcuggaggacgccuggaaggagaagggcaagauggacauggaggagaucauccagagaaucgagaacguggugcuggacgccaacugcagcagagacgugaagcagaugcugcugaagcugguggagcugagaagcagcaacuggggcagagugcacgccaccagcaccuacagagaggccacccccgagaacgaccccaacuacuucaugaacgagcccaccuucuacaccagcgacggcgugcccuucaccgccgccgaccccgacuaccaggagaaguaccaggagcugcuggagagagaggacuucuuccccgacuacgaggagaacggcaccgaccugagcggcgccggcgaccccuaccuggacgacaucgacgacgagauggaccccgagaucgaggaggccuacgagaaguucugccuggagagcgagagaaagagaaagcaguaa

SEQ ID NO: 21148 - RNA, 384 nt, Artificial Sequence
  PAIP2__Homo_sapiens__XP_011541730
augaaggaccccagcagaagcagcaccagccccagcaucaucaacgaggacgugaucaucaacggccacagccacgaggacgacaaccccuucgccgaguacauguggauggagaacgaggaggaguucaacagacagaucgaggaggagcugugggaggaggaguucaucgagagaugcuuccaggagaugcuggaggaggaggaggagcacgagugguucauccccgccagagaccugccccagaccauggaccagauccaggaccaguucaacgaccuggugaucagcgacggcagcagccuggaggaccugguggugaagagcaaccugaaccccaacgccaaggaguucgugcccggcgugaaguacggcaacaucuaa

SEQ ID NO: 21149 - RNA, 1638 nt, Artificial Sequence
  PAK1__Homo_sapiens__NP_002567
augagcaacaacggccuggacauccaggacaagccccccgccccccccaugagaaacaccagcaccaugaucggcgccggcagcaaggacgccggcacccugaaccacggcagcaagccccugccccccaaccccgaggagaagaagaagaaggacagauucuacagaagcauccugcccggcgacaagaccaacaagaagaaggagaaggagagacccgagaucagccugcccagcgacuucgagcacaccauccacgugggcuucgacgccgugaccggcgaguucaccggcaugcccgagcagugggccagacugcugcagaccagcaacaucaccaagagcgagcagaagaagaacccccaggccgugcuggacgugcuggaguucuacaacagcaagaagaccagcaacagccagaaguacaugagcuucaccgacaagagcgccgaggacuacaacagcagcaacgcccugaacgugaaggccgugagcgagacccccgccgugccccccgugagcgaggacgaggacgacgacgacgacgacgccacccccccccccgugaucgcccccagacccgagcacaccaagagcguguacaccagaagcgugaucgagccccugcccgugacccccaccagagacguggccaccagccccaucagccccaccgagaacaacaccaccccccccgacgcccugaccagaaacaccgagaagcagaagaagaagcccaagaugagcgacgaggagauccuggagaagcugagaagcaucgugagcgugggcgaccccaagaagaaguacaccagauucgagaagaucggccagggcgccagcggcaccguguacaccgccauggacguggccaccggccaggagguggccaucaagcagaugaaccugcagcagcagcccaagaaggagcugaucaucaacgagauccuggugaugagagagaacaagaaccccaacaucgugaacuaccuggacagcuaccuggugggcgacgagcuguggguggugauggaguaccuggccggcggcagccugaccgacguggugaccgagaccugcauggacgagggccagaucgccgccgugugcagagagugccugcaggcccuggaguuccugcacagcaaccaggugauccacagagacaucaagagcgacaacauccugcugggcauggacggcagcgugaagcugaccgacuucggcuucugcgcccagaucacccccgagcagagcaagagaagcaccauggugggcacccccuacuggauggcccccgagguggugaccagaaaggccuacggccccaagguggacaucuggagccugggcaucauggccaucgagaugaucgagggcgagccccccuaccugaacgagaacccccugagagcccuguaccugaucgccaccaacggcacccccgagcugcagaaccccgagaagcugagcgccaucuucagagacuuccugaacagaugccuggagauggacguggagaagagaggcagcgccaaggagcugcugcagcaccaguuccugaagaucgccaagccccugagcagccugaccccccugaucgccgccgccaaggaggccaccaagaacaaccacuaa

SEQ ID NO: 21150 - RNA, 1179 nt, Artificial Sequence
  PAK1IP1__Homo_sapiens__NP_060376
auggagcugguggccggcugcuacgagcaggugcuguucggcuucgccgugcaccccgagcccgaggccugcggcgaccacgagcaguggacccugguggccgacuucacccaccacgcccacaccgccagccugagcgccguggccgugaacagcagauucguggugaccggcagcaaggacgagaccauccacaucuacgacaugaagaagaagaucgagcacggcgcccuggugcaccacagcggcaccaucaccugccugaaguucuacggcaacagacaccugaucagcggcgccgaggacggccugaucugcaucugggacgccaagaagugggagugccugaagagcaucaaggcccacaagggccaggugaccuuccugagcauccaccccagcggcaagcuggcccugagcgugggcaccgacaagacccugagaaccuggaaccugguggagggcagaagcgccuucaucaagaacaucaagcagaacgcccacaucguggaguggagccccagaggcgagcaguacguggugaucauccagaacaagaucgacaucuaccagcuggacaccgccagcaucagcggcaccaucaccaacgagaagagaaucagcagcgugaaguuccugagcgagagcgugcuggccguggccggcgacgaggaggugaucagauucuucgacugcgacagccuggugugccugugcgaguucaaggcccacgagaacagagugaaggacauguucagcuucgagauccccgagcaccacgugaucgugagcgccagcagcgacggcuucaucaagauguggaagcugaagcaggacaagaaggugccccccagccugcugugcgagaucaacaccaacgccagacugaccugccugggcguguggcuggacaagguggccgacaugaaggagagccugccccccgccgccgagcccagccccgugagcaaggagcagagcaagaucggcaagaaggagcccggcgacaccgugcacaaggaggagaagagaagcaagcccaacaccaagaagagaggccugaccggcgacagcaagaaggccaccaaggagagcggccugaucagcaccaagaagagaaagaugguggagaugcuggagaagaagagaaagaagaagaagaucaagaccaugcaguaa

SEQ ID NO: 21151 - RNA, 1575 nt, Artificial Sequence
  PAK2__Homo_sapiens__NP_002568
augagcgacaacggcgagcuggaggacaagccccccgccccccccgugagaaugagcagcaccaucuucagcaccggcggcaaggacccccugagcgccaaccacagccugaagccccugcccagcgugcccgaggagaagaagcccagacacaagaucaucagcaucuucagcggcaccgagaagggcagcaagaagaaggagaaggagagacccgagaucagcccccccagcgacuucgagcacaccauccacgugggcuucgacgccgugaccggcgaguucaccggcaugcccgagcagugggccagacugcugcagaccagcaacaucaccaagcuggagcagaagaagaacccccaggccgugcuggacgugcugaaguucuacgacagcaacaccgugaagcagaaguaccugagcuucaccccccccgagaaggacggcuuccccagcggcacccccgcccugaacgccaagggcaccgaggcccccgccguggugaccgaggaggaggacgacgacgaggagaccgccccccccgugaucgcccccagacccgaccacaccaagagcaucuacaccagaagcgugaucgaccccgugcccgcccccgugggcgacagccacguggacggcgccgccaagagccuggacaagcagaagaagaagaccaagaugaccgacgaggagaucauggagaagcugagaaccaucgugagcaucggcgaccccaagaagaaguacaccagauacgagaagaucggccagggcgccagcggcaccguguucaccgccaccgacguggcccugggccaggagguggccaucaagcagaucaaccugcagaagcagcccaagaaggagcugaucaucaacgagauccuggugaugaaggagcugaagaaccccaacaucgugaacuuccuggacagcuaccuggugggcgacgagcuguucguggugauggaguaccuggccggcggcagccugaccgacguggugaccgagaccugcauggacgaggcccagaucgccgccgugugcagagagugccugcaggcccuggaguuccugcacgccaaccaggugauccacagagacaucaagagcgacaacgugcugcugggcauggagggcagcgugaagcugaccgacuucggcuucugcgcccagaucacccccgagcagagcaagagaagcaccauggugggcacccccuacuggauggcccccgagguggugaccagaaaggccuacggccccaagguggacaucuggagccugggcaucauggccaucgagaugguggagggcgagccccccuaccugaacgagaacccccugagagcccuguaccugaucgccaccaacggcacccccgagcugcagaaccccgagaagcugagccccaucuucagagacuuccugaacagaugccuggagauggacguggagaagagaggcagcgccaaggagcugcugcagcaccccuuccugaagcuggccaagccccugagcagccugaccccccugaucauggccgccaaggaggccaugaagagcaacagauaa

SEQ ID NO: 21152 - RNA, 1635 nt, Artificial Sequence
  PAK3__Homo_sapiens__NP_001121639
augagcgacggccuggacaacgaggagaagccccccgcccccccccugagaaugaacagcaacaacagagacagcagcgcccugaaccacagcagcaagccccugcccauggcccccgaggagaagaacaagaaggccagacugagaagcaucuuccccggcggcggcgacaagaccaacaagaagaaggagaaggagagacccgagaucagccugcccagcgacuucgagcacaccauccacgugggcuucgacgccgugaccggcgaguucaccggcauccccgagcagugggccagacugcugcagaccagcaacaucaccaagcuggagcagaagaagaacccccaggccgugcuggacgugcugaaguucuacgacagcaaggagaccgugaacaaccagaaguacaugagcuucaccagcggcgacaagagcgcccacggcuacaucgccgcccaccccagcagcaccaagaccgccagcgagcccccccuggccccccccgugagcgaggaggaggacgaggaggaggaggaggaggaggacgagaacgagcccccccccgugaucgcccccagacccgagcacaccaagagcaucuacaccagaagcgugguggagagcaucgccagccccgccgugcccaacaaggaggugaccccccccagcgccgagaacgccaacagcagcacccuguacagaaacaccgacagacagagaaagaagagcaagaugaccgacgaggagauccuggagaagcugagaagcaucgugagcgugggcgaccccaagaagaaguacaccagauucgagaagaucggccagggcgccagcggcaccguguacaccgcccuggacaucgccaccggccaggagguggccaucaagcagaugaaccugcagcagcagcccaagaaggagcugaucaucaacgagauccuggugaugagagagaacaagaaccccaacaucgugaacuaccuggacagcuaccuggugggcgacgagcuguggguggugauggaguaccuggccggcggcagccugaccgacguggugaccgagaccugcauggacgagggccagaucgccgccgugugcagagagugccugcaggcccuggacuuccugcacagcaaccaggugauccacagagacaucaagagcgacaacauccugcugggcauggacggcagcgugaagcugaccgacuucggcuucugcgcccagaucacccccgagcagagcaagagaagcaccauggugggcacccccuacuggauggcccccgagguggugaccagaaaggccuacggccccaagguggacaucuggagccugggcaucauggccaucgagaugguggagggcgagccccccuaccugaacgagaacccccugagagcccuguaccugaucgccaccaacggcacccccgagcugcagaaccccgagagacugagcgccguguucagagacuuccugaacagaugccuggagauggacguggacagaagaggcagcgccaaggagcugcugcagcaccccuuccugaagcuggccaagccccugagcagccugaccccccugaucaucgccgccaaggaggccaucaagaacagcagcagauaa

SEQ ID NO: 21153 - RNA, 1776 nt, Artificial Sequence
  PAK4__Homo_sapiens__NP_001014832
auguucggcaagagaaagaagagaguggagaucagcgcccccagcaacuucgagcacagagugcacaccggcuucgaccagcacgagcagaaguucaccggccugcccagacaguggcagagccugaucgaggagagcgccagaagacccaagccccugguggaccccgccugcaucaccagcauccagcccggcgcccccaagaccaucgugagaggcagcaagggcgccaaggacggcgcccugacccugcugcuggacgaguucgagaacaugagcgugaccagaagcaacagccugagaagagacagcccccccccccccgccagagccagacaggagaacggcaugcccgaggagcccgccaccaccgccagaggcggccccggcaaggccggcagcagaggcagauucgccggccacagcgaggccggcggcggcagcggcgacagaagaagagccggccccgagaagagacccaagagcagcagagagggcagcggcggcccccaggagagcagcagagacaagagaccccugagcggccccgacgugggcaccccccagcccgccggccuggccagcggcgccaagcuggccgccggcagacccuucaacaccuaccccagagccgacaccgaccaccccagcagaggcgcccagggcgagccccacgacguggcccccaacggccccagcgccggcggccuggccaucccccagagcagcagcagcagcagcagaccccccaccagagccagaggcgcccccagccccggcgugcugggcccccacgccagcgagccccagcuggccccccccgccugcacccccgccgcccccgccgugcccggcccccccggccccagaagcccccagagagagccccagagagugagccacgagcaguucagagccgcccugcagcuggugguggaccccggcgaccccagaagcuaccuggacaacuucaucaagaucggcgagggcagcaccggcaucgugugcaucgccaccgugagaagcagcggcaagcugguggccgugaagaagauggaccugagaaagcagcagagaagagagcugcuguucaacgagguggugaucaugagagacuaccagcacgagaacgugguggagauguacaacagcuaccuggugggcgacgagcuguggguggugauggaguuccuggagggcggcgcccugaccgacaucgugacccacaccagaaugaacgaggagcagaucgccgccgugugccuggccgugcugcaggcccugagcgugcugcacgcccagggcgugauccacagagacaucaagagcgacagcauccugcugacccacgacggcagagugaagcugagcgacuucggcuucugcgcccaggugagcaaggaggugcccagaagaaagagccuggugggcacccccuacuggauggcccccgagcugaucagcagacugcccuacggccccgagguggacaucuggagccugggcaucauggugaucgagaugguggacggcgagccccccuacuucaacgagcccccccugaaggccaugaagaugaucagagacaaccugccccccagacugaagaaccugcacaaggugagccccagccugaagggcuuccuggacagacugcuggugagagaccccgcccagagagccaccgccgccgagcugcugaagcaccccuuccuggccaaggccggcccccccgccagcaucgugccccugaugagacagaacagaaccagauaa

SEQ ID NO: 21154 - RNA, 2046 nt, Artificial Sequence
  PAK6__Homo_sapiens__NP_001263646
auguucagaaagaagaagaagaagagacccgagaucagcgccccccagaacuuccagcacagagugcacaccagcuucgaccccaaggagggcaaguucgugggccugcccccccaguggcagaacauccuggacacccugagaagacccaagcccgugguggaccccagcagaaucaccagagugcagcugcagcccaugaagaccguggugagaggcagcgccaugcccguggacggcuacaucagcggccugcugaacgacauccagaagcugagcgugaucagcagcaacacccugagaggcagaagccccaccagcagaagaagagcccagagccugggccugcugggcgacgagcacugggccaccgaccccgacauguaccugcagagcccccagagcgagagaaccgacccccacggccuguaccugagcugcaacggcggcacccccgccggccacaagcagaugcccuggcccgagccccagagccccagagugcugcccaacggccuggccgccaaggcccagagccugggccccgccgaguuccagggcgccagccagagaugccugcagcugggcgccugccugcagagcagcccccccggcgccagcccccccaccggcaccaacagacacggcaugaaggccgccaagcacggcagcgaggaggccagaccccagagcugccuggugggcagcgccaccggcagacccggcggcgagggcagccccagccccaagaccagagagagcagccugaagagaagacuguucagaagcauguuccugagcaccgccgccaccgccccccccagcagcagcaagcccggcccccccccccagagcaagcccaacagcagcuucagacccccccagaaggacaacccccccagccugguggccaaggcccagagccugcccagcgaccagcccgugggcaccuucagcccccugaccaccagcgacaccagcagcccccagaagagccugagaaccgcccccgccaccggccagcugcccggcagaagcagccccgccggcagccccagaaccuggcacgcccagaucagcaccagcaaccuguaccugccccaggaccccaccguggccaagggcgcccuggccggcgaggacaccggcguggugacccacgagcaguucaaggccgcccugagaauggugguggaccagggcgaccccagacugcugcuggacagcuacgugaagaucggcgagggcagcaccggcaucgugugccuggccagagagaagcacagcggcagacagguggccgugaagaugauggaccugagaaagcagcagagaagagagcugcuguucaacgagguggugaucaugagagacuaccagcacuucaacgugguggagauguacaagagcuaccuggugggcgaggagcugugggugcugauggaguuccugcagggcggcgcccugaccgacaucgugagccaggugagacugaacgaggagcagaucgccaccgugugcgaggccgugcugcaggcccuggccuaccugcacgcccagggcgugauccacagagacaucaagagcgacagcauccugcugacccuggacggcagagugaagcugagcgacuucggcuucugcgcccagaucagcaaggacgugcccaagagaaagagccuggugggcacccccuacuggauggcccccgaggugaucagcagaagccuguacgccaccgagguggacaucuggagccugggcaucauggugaucgagaugguggacggcgagccccccuacuucagcgacagccccgugcaggccaugaagagacugagagacagccccccccccaagcugaagaacagccacaaggugagccccgugcugagagacuuccuggagagaaugcuggugagagacccccaggagagagccaccgcccaggagcugcuggaccaccccuuccugcugcagaccggccugcccgagugccuggugccccugauccagcuguacagaaagcagaccagcaccugcuaa

SEQ ID NO: 21155 - RNA, 2160 nt, Artificial Sequence
  PAK7__Homo_sapiens__NP_065074
auguucggcaagaagaagaagaagaucgagaucagcggccccagcaacuucgagcacagagugcacaccggcuucgacccccaggagcagaaguucaccggccugccccagcaguggcacagccugcuggccgacaccgccaacagacccaagcccaugguggaccccagcugcaucacccccauccagcuggcccccaugaagaccaucgugagaggcaacaagcccugcaaggagaccagcaucaacggccugcuggaggacuucgacaacaucagcgugaccagaagcaacagccugagaaaggagagcccccccacccccgaccagggcgccagcagccacggccccggccacgccgaggagaacggcuucaucaccuucagccaguacagcagcgagagcgacaccaccgccgacuacaccaccgagaaguacagagagaagagccuguacggcgacgaccuggaccccuacuacagaggcagccacgccgccaagcagaacggccacgugaugaagaugaagcacggcgaggccuacuacagcgaggugaagccccugaagagcgacuucgccagauucagcgccgacuaccacagccaccuggacagccugagcaagcccagcgaguacagcgaccugaagugggaguaccagagagccagcagcagcagcccccuggacuacagcuuccaguucacccccagcagaaccgccggcaccagcggcugcagcaaggagagccuggccuacagcgagagcgaguggggccccagccuggacgacuacgacagaagacccaagagcagcuaccugaaccagaccagcccccagcccaccaugagacagagaagcagaagcggcagcggccugcaggagcccaugaugcccuucggcgccagcgccuucaagacccacccccagggccacagcuacaacagcuacaccuaccccagacugagcgagcccaccaugugcauccccaagguggacuacgacagagcccagauggugcugagccccccccugagcggcagcgacaccuaccccagaggccccgccaagcugccccagagccagagcaagagcggcuacagcagcagcagccaccaguaccccagcggcuaccacaaggccacccuguaccaccaccccagccugcagagcagcagccaguacaucagcaccgccagcuaccugagcagccugagccugagcagcagcaccuaccccccccccagcuggggcagcagcagcgaccagcagcccagcagagugagccacgagcaguucagagccgcccugcagcugguggugagccccggcgaccccagagaguaccuggccaacuucaucaagaucggcgagggcagcaccggcaucgugugcaucgccaccgagaagcacaccggcaagcagguggccgugaagaagauggaccugagaaagcagcagagaagagagcugcuguucaacgagguggugaucaugagagacuaccaccacgacaacgugguggacauguacagcagcuaccuggugggcgacgagcuguggguggugauggaguuccuggagggcggcgcccugaccgacaucgugacccacaccagaaugaacgaggagcagaucgccaccgugugccugagcgugcugagagcccugagcuaccugcacaaccagggcgugauccacagagacaucaagagcgacagcauccugcugaccagcgacggcagaaucaagcugagcgacuucggcuucugcgcccaggugagcaaggaggugcccaagagaaagagccuggugggcacccccuacuggauggcccccgaggugaucagcagacugcccuacggcaccgagguggacaucuggagccugggcaucauggugaucgagaugaucgacggcgagccccccuacuucaacgagcccccccugcaggccaugagaagaaucagagacagccugccccccagagugaaggaccugcacaaggugagcagcgugcugagaggcuuccuggaccugaugcuggugagagagcccagccagagagccaccgcccaggagcugcugggccaccccuuccugaagcuggccggcccccccagcugcaucgugccccugaugagacaguacagacaccacuaa

SEQ ID NO: 21156 - RNA, 3561 nt, Artificial Sequence
  PALB2__Homo_sapiens__NP_078951
auggacgagccccccggcaagccccugagcugcgaggagaaggagaagcugaaggagaagcuggccuuccugaagagagaguacagcaagacccuggccagacugcagagagcccagagagccgagaagaucaagcacagcaucaagaagaccguggaggagcaggacugccugagccagcaggaccugagcccccagcugaagcacagcgagcccaagaacaagaucugcguguacgacaagcugcacaucaagacccaccuggacgaggagaccggcgagaagaccagcaucacccuggacgugggccccgagagcuucaaccccggcgacggccccggcggccugcccauccagagaaccgacgacacccaggagcacuucccccacagagugagcgaccccagcggcgagcagaagcagaagcugcccagcagaagaaagaagcagcagaagagaaccuucaucagccaggagagagacugcguguucggcaccgacagccugagacugagcggcaagagacugaaggagcaggaggagaucagcagcaagaaccccgccagaagccccgugaccgagaucagaacccaccugcugagccugaagagcgagcugcccgacagccccgagcccgugaccgagaucaacgaggacagcgugcugaucccccccaccgcccagcccgagaagggcguggacaccuuccugagaagacccaacuucaccagagccaccaccgugccccugcagacccugagcgacagcggcagcagccagcaccuggagcacaucccccccaagggcagcagcgagcugaccacccacgaccugaagaacaucagauucaccagccccgugagccuggaggcccagggcaagaagaugaccgugagcaccgacaaccugcuggugaacaaggccaucagcaagagcggccagcugcccaccagcagcaaccuggaggccaacaucagcugcagccugaacgagcugaccuacaacaaccugcccgccaacgagaaccagaaccugaaggagcagaaccagaccgagaagagccugaagagccccagcgacacccuggacggcagaaacgagaaccugcaggagagcgagauccugagccagcccaagagccugagccuggaggccaccagcccccugagcgccgagaagcacagcugcaccgugcccgagggccugcuguuccccgccgaguacuacgugagaaccaccagaagcaugagcaacugccagagaaagguggccguggaggccgugauccagagccaccuggacgugaagaagaagggcuucaagaacaagaacaaggacgccagcaagaaccugaaccugagcaacgaggagaccgaccagagcgagaucagaaugagcggcaccugcaccggccagcccagcagcagaaccagccagaagcugcugagccugaccaaggugagcagccccgccggccccaccgaggacaacgaccugagcagaaaggccguggcccaggcccccggcagaagauacaccggcaagagaaagagcgccugcacccccgccagcgaccacugcgagccccugcugcccaccagcagccugagcaucgugaacagaagcaaggaggaggugaccagccacaaguaccagcacgagaagcuguucauccaggugaagggcaagaagagcagacaccagaaggaggacagccugagcuggagcaacagcgccuaccugagccuggacgacgacgccuucaccgcccccuuccacagagacggcaugcugagccugaagcagcugcugagcuuccugagcaucaccgacuuccagcugcccgacgaggacuucggcccccugaagcuggagaaggugaagagcugcagcgagaagcccguggagcccuucgagagcaagauguucggcgagagacaccugaaggagggcagcugcaucuuccccgaggagcugagccccaagagaauggacaccgagauggaggaccuggaggaggaccugaucgugcugcccggcaagagccaccccaagagacccaacagccagagccagcacaccaagaccggccugagcagcagcauccugcuguacaccccccugaacaccguggcccccgacgacaacgacagacccaccaccgacaugugcagccccgccuuccccauccugggcaccacccccgccuucggcccccagggcagcuacgagaaggccagcaccgagguggccggcagaaccugcugcaccccccagcuggcccaccugaaggacagcgugugccuggccagcgacaccaagcaguucgacagcagcggcagccccgccaagccccacaccacccugcaggugagcggcagacagggccagcccaccugcgacugcgacagcgugccccccggcacccccccccccaucgagagcuucaccuucaaggagaaccagcugugcagaaacaccugccaggagcugcacaagcacagcguggagcagaccgagaccgccgagcugcccgccagcgacagcaucaaccccggcaaccugcagcuggugagcgagcugaagaaccccagcggcagcugcagcguggacgugagcgccauguucugggagagagccggcugcaaggagcccugcaucaucaccgccugcgaggacguggugagccuguggaaggcccuggacgccuggcagugggagaagcuguacaccuggcacuucgccgaggugcccgugcugcagaucgugcccgugcccgacguguacaaccuggugugcguggcccugggcaaccuggagaucagagagaucagagcccuguucugcagcagcgacgacgagagcgagaagcaggugcugcugaagagcggcaacaucaaggccgugcugggccugaccaagagaagacuggugagcagcagcggcacccugagcgaccagcagguggaggugaugaccuucgccgaggacggcggcggcaaggagaaccaguuccugaugccccccgaggagaccauccugaccuucgccgaggugcagggcaugcaggaggcccugcugggcaccaccaucaugaacaacaucgugaucuggaaccugaagaccggccagcugcugaagaagaugcacaucgacgacagcuaccaggccagcgugugccacaaggccuacagcgagaugggccugcuguucaucgugcugagccaccccugcgccaaggagagcgagagccugagaagccccguguuccagcugaucgugaucaaccccaagaccacccugagcgugggcgugaugcuguacugccugccccccggccaggccggcagauuccuggagggcgacgugaaggaccacugcgccgccgccauccugaccagcggcaccaucgccaucugggaccugcugcugggccagugcaccgcccugcugccccccgugagcgaccagcacuggagcuucgugaaguggagcggcaccgacagccaccugcuggccggccagaaggacggcaacaucuucguguaccacuacagcuaa

SEQ ID NO: 21157 - RNA, 2571 nt, Artificial Sequence
  PALD1__Homo_sapiens__NP_055246
augggcaccaccgccagcaccgcccagcagaccgugagcgccggcacccccuucgagggccugcagggcagcggcaccauggacagcagacacagcgugagcauccacagcuuccagagcaccagccugcacaacagcaaggccaagagcaucauccccaacaagguggcccccguggugaucaccuacaacugcaaggaggaguuccagauccacgacgagcugcugaaggcccacuacacccugggcagacugagcgacaacacccccgagcacuaccuggugcagggcagauacuuccuggugagagacgugaccgagaagauggacgugcugggcaccgugggcagcugcggcgcccccaacuucagacaggugcagggcggccugaccguguucggcaugggccagcccagccugagcggcuucagaagagugcugcagaagcugcagaaggacggccacagagagugcgugaucuucugcgugagagaggagcccgugcuguuccugagagccgacgaggacuucgugagcuacacccccagagacaagcagaaccugcacgagaaccugcagggccugggccccggcgugagaguggagagccuggagcuggccaucagaaaggagauccacgacuucgcccagcugagcgagaacaccuaccacguguaccacaacaccgaggaccuguggggcgagccccacgccguggccauccacggcgaggacgaccugcacgugaccgaggagguguacaagagaccccuguuccugcagcccaccuacagauaccacagacugccccugcccgagcagggcagcccccuggaggcccagcuggacgccuucgugagcgugcugagagagacccccagccugcugcagcugagagacgcccacggccccccccccgcccugguguucagcugccagaugggcgugggcagaaccaaccugggcauggugcugggcacccugauccugcugcacagaagcggcaccaccagccagcccgaggccgcccccacccaggccaagccccugcccauggagcaguuccaggugauccagagcuuccugagaauggugccccagggcagaagaaugguggaggagguggacagagccaucaccgccugcgccgagcugcacgaccugaaggagguggugcuggagaaccagaagaagcuggagggcaucagacccgagagccccgcccagggcagcggcagcagacacagcguguggcagagagcccuguggagccuggagagauacuucuaccugauccuguucaacuacuaccugcacgagcaguacccccuggccuucgcccugagcuucagcagauggcugugcgcccaccccgagcuguacagacugcccgugacccugagcagcgccggccccguggcccccagagaccugaucgccagaggcagccugagagaggacgaccuggugagccccgacgcccugagcaccgugagagagauggacguggccaacuucagaagagugcccagaaugcccaucuacggcaccgcccagcccagcgccaaggcccugggcagcauccuggccuaccugaccgacgccaagagaagacugagaaagguggugugggugagccugagagaggaggccgugcuggagugcgacggccacaccuacagccugagauggcccggcccccccguggcccccgaccagcuggagacccuggaggcccagcugaaggcccaccugagcgagcccccccccggcaaggagggcccccugaccuacagauuccagaccugccugaccaugcaggagguguucagccagcacagaagagccugccccggccugaccuaccacagaauccccaugcccgacuucugcgcccccagagaggaggacuucgaccagcugcuggaggcccugagagccgcccugagcaaggaccccggcaccggcuucguguucagcugccugagcggccagggcagaaccaccaccgccauggugguggccgugcuggccuucuggcacauccagggcuuccccgaggugggcgaggaggagcuggugagcgugcccgacgccaaguucaccaagggcgaguuccagguggugaugaagguggugcagcugcugcccgacggccacagagugaagaaggagguggacgccgcccuggacaccgugagcgagaccaugacccccaugcacuaccaccugagagagaucaucaucugcaccuacagacaggccaaggccgccaaggaggcccaggagaugagaagacugcagcugagaagccugcaguaccuggagagauacgugugccugauccuguucaacgccuaccugcaccuggagaaggccgacagcuggcagagacccuucagcaccuggaugcaggagguggccagcaaggccggcaucuacgagauccugaacgagcugggcuuccccgagcuggagagcggcgaggaccagcccuucagcagacugagauacagauggcaggagcagagcugcagccuggagcccagcgcccccgaggaccugcuguaa

SEQ ID NO: 21158 - RNA, 3372 nt, Artificial Sequence
  PALLD__Homo_sapiens__NP_001159580
augagcggcaccagcagccacgagagcuucuacgacagccugagcgacaugcaggaggagagcaagaacaccgacuucuuccccggccugagcgccuuccugagccaggaggagaucaacaagagccuggaccuggccagaagagccaucgccgacagcgagaccgaggacuucgacagcgagaaggagaucagccagaucuucagcaccagccccgccagccugugcgagcaccccagccacaaggagaccaagcugggcgagcacgccagcagaagaccccaggacaacagaagcacccccgugcagccccuggccgagaagcagaccaagagcaucagcagccccgugagcaagagaaagcccgccaugagcccccugcugaccagacccagcuacaucagaagccugagaaaggccgagaagagaggcgccaagacccccagcaccaacgugaagcccaagaccccccaccagagaaagggcggcccccagagccagcugugcgacaaggccgccaaccugaucgaggagcugaccagcaucuucaaggccgccaagcccagaaacagaagccccaacggcgagagcagcagccccgacagcggcuaccugagccccaagaaccagcccagcgcccugcugagcgccagcgccagccagagccccauggaggaccagggcgagauggagagagaggugaagagccccggcgccagacacugcuaccaggacaaccaggaccuggccgugccccacaacagaaagagccacccccagccccacagcgcccugcacuuccccgccgcccccagauucauccagaagcugagaagccaggagguggccgagggcagcagaguguaccuggagugcagagugaccggcaaccccacccccagagugagaugguucugcgagggcaaggagcugcacaacacccccgacauccagauccacugcgagggcggcgaccugcacacccugaucaucgccgaggccuucgaggacgacaccggcagauacaccugccuggccaccaaccccagcggcagcgacaccaccagcgccgagguguucaucgagggcgccagcagcaccgacagcgacagcgagagccuggccuucaagagcagagccggcgccaugccccaggcccagaagaagaccaccagcgugagccugaccaucggcagcagcagccccaagaccggcgugaccaccgccgugauccagccccugagcgugcccgugcagcaggugcacagccccaccagcuaccugugcagacccgacggcaccaccaccgccuacuucccccccguguucaccaaggagcugcagaacaccgccguggccgagggccaggugguggugcuggagugcagagugagaggcgcccccccccugcaggugcagugguucagacagggcagcgagauccaggacagccccgacuucagaauccugcagaagaagcccagaagcaccgccgagcccgaggagaucugcacccuggugaucgccgagaccuuccccgaggacgccggcaucuucaccugcagcgccagaaacgacuacggcagcgccaccagcaccgcccagcugguggugaccagcgccaacaccgagaacugcagcuacgagagcaugggcgagagcaacaacgaccacuuccagcacuuccccccccccccccccauccuggagaccagcagccuggagcuggccagcaagaagcccagcgagauccagcaggugaacaaccccgagcugggccugagcagagccgcccugcagaugcaguucaacgccgccgagagagagaccaacggcgugcaccccagcagaggcgugaacggccugaucaacggcaaggccaacagcaacaagagccugcccacccccgccgugcugcugagccccaccaaggagccccccccccugcuggccaagcccaagcugggcuuccccaagaaggccagcagaaccgccagaaucgccagcgacgaggagauccagggcaccaaggacgccgugauccaggaccuggagagaaagcugagauucaaggaggaccugcugaacaacggccagcccagacugaccuacgaggagagaauggccagaagacugcugggcgccgacagcgccaccguguucaacauccaggagcccgaggaggagaccgccaaccaggacaucggcagcccccacgccagcgugggcagcccccuggacggccagaaggaguacaaggugagcagcugcgagcagagacugaucagcgagaucgaguacagacuggagagaagccccguggacgagagcggcgacgaggugcaguacggcgacgugcccguggagaacggcauggcccccuucuucgagaugaagcugaagcacuacaagaucuucgagggcaugcccgugaccuucaccugcagaguggccggcaaccccaagcccaagaucuacugguucaaggacggcaagcagaucagccccaagagcgaccacuacaccauccagagagaccuggacggcaccugcagccugcacaccaccgccagcacccuggacgacgacggcaacuacaccaucauggccgccaacccccagggcagaaucagcugcaccggcagacugauggugcaggccgugaaccagagaggcagaagccccagaagccccagcggccacccccacgugagaagacccagaagcagaagcagagacagcggcgacgagaacgagcccauccaggagagauucuucagaccccacuuccugcaggcccccggcgaccugaccgugcaggagggcaagcugugcagaauggacugcaaggugagcggccugcccacccccgaccugagcuggcagcuggacggcaagcccgugagacccgacagcgcccacaagaugcuggugagagagaacggcgugcacagccugaucaucgagcccgugaccagcagagacgccggcaucuacaccugcaucgccaccaacagagccggccagaacagcuucagccuggagcuggugguggccgccaaggaggcccacaagccccccguguucaucgagaagcugcagaacaccggcguggccgacggcuaccccgugagacuggagugcagagugcugggcgugccccccccccagaucuucuggaagaaggagaacgagagccugacccacagcaccgacagagugagcaugcaccaggacaaccacggcuacaucugccugcugauccagggcgccaccaaggaggacgccggcugguacaccgugagcgccaagaacgaggccggcaucgugagcugcaccgccagacuggacguguacaucagcagacacuaa

SEQ ID NO: 21159 - RNA, 3312 nt, Artificial Sequence
  PALM2-AKAP2__Homo_sapiens__NP_009134
auggccgaggccgagcugcacaaggagagacugcaggccaucgccgagaagagaaagagacagaccgagaucgagggcaagagacagcagcuggacgagcagauccugcugcugcagcacagcaagagcaaggugcugagagagaaguggcugcugcagggcauccccgccggcaccgccgaggaggaggaggccagaagaagacagagcgaggaggacgaguucagagugaagcagcuggaggacaacauccagagacuggagcaggagauccagacccuggagagcgaggagagccagaucagcgccaaggagcagaucauccuggagaagcugaaggagaccgagaagagcuucaaggacuuccagaagggcuucagcagcaccgacggcgacgccgugaacuacaucagcagccagcugcccgaccugcccauccugugcagcagaaccgccgagcccagccccggccaggacggcaccagcagagccgccggcgugggcugggagaacgugcugcugaaggagggcgagagcgccagcaacgccaccgagaccagcggccccgacaugaccaucaagaagcccccccagcugagcgaggacgacaucuggcugaagagcgagggcgacaacuacagcgccacccugcuggagcccgccgccagcagccugagccccgaccacaagaacauggagaucgaggugagcguggccgagugcaagagcgugcccggcaucaccagcaccccccaccccauggaccaccccagcgccuucuacagccccccccacaacggccugcugaccgaccaccacgagagccuggacaacgacguggccagagagaucagauaccuggacgaggugcuggaggccaacugcugcgacagcgccguggacggcaccuacaacggcaccagcagccccgagcccggcgccguggugcuggugggcggccugagcccccccgugcacgaggccacccagcccgagcccaccgagagaaccgccagcagacaggcccccccccacaucgagcugagcaacagcagccccgaccccauggccgaggccgagagaaccaacggccacagccccagccagcccagagacgcccugggcgacagccugcaggugcccgugagccccagcagcaccaccagcagcagaugcagcagcagagacggcgaguucacccugaccacccugaagaaggaggccaaguucgagcugagagccuuccacgaggacaagaagcccagcaagcuguucgaggacgacgagcacgagaaggagcaguacugcaucagaaaggugagacccagcgaggagaugcuggagcuggagaaggagagaagagagcugaucagaagccaggccgugaagaagaaccccggcaucgccgccaagugguggaaccccccccaggagaagaccaucgaggagcagcuggacgaggagcaccuggagagccacaagaaguacaaggagagaaaggagagaagagcccagcaggagcagcugcugcugcagaagcagcugcagcagcagcagcagcagccccccagccagcugugcaccgcccccgccagcagccacgagagagccagcaugaucgacaaggccaaggaggacaucgugaccgagcagaucgacuucagcgccgccagaaagcaguuccagcugauggagaacagcagacaggccguggccaagggccagagcacccccagacuguucagcaucaagcccuucuacagaccccugggcagcgugaacagcgacaagccccugaccaaccccagaccccccagcgugggcggcccccccgaggacagcggcgccagcgccgccaagggccagaagagccccggcgcccuggagacccccagcgccgccggcagccagggcaacaccgccagccagggcaaggagggccccuacagcgagcccagcaagagaggcccccugagcaagcugugggccgaggacggcgaguucaccagcgccagagccgugcugaccguggugaaggacgacgaccacggcauccuggaccaguucagcagaagcgugaacgugagccugacccaggaggagcuggacagcggccuggacgagcugagcgugagaagccaggacaccaccgugcuggagacccugagcaacgacuucagcauggacaacaucagcgacagcggcgccagcaacgagaccaccaacgcccugcaggagaacagccuggccgacuucagccugccccagaccccccagaccgacaaccccagcgagggcagaggcgagggcgugagcaagagcuucagcgaccacggcuucuacagccccagcagcacccugggcgacagcccccugguggacgacccccuggaguaccaggccggccugcuggugcagaacgccauccagcaggccaucgccgagcagguggacaaggccgugagcaagaccagcagagacggcgccgagcagcagggccccgaggccaccguggaggaggccgaggccgccgccuucggcagcgagaagccccagagcauguucgagcccccccaggugagcagccccgugcaggagaagagagacgugcugcccaagauccugcccgccgaggacagagcccugagagagagaggccccccccagccccugcccgccgugcagcccagcggccccaucaacauggaggagaccagacccgagggcagcuacuucagcaaguacagcgaggccgccgagcugagaagcaccgccagccugcuggccacccaggagagcgacgugauggugggccccuucaagcugagaagcagaaagcagagaacccugagcaugaucgaggaggagaucagagccgcccaggagagagaggaggagcugaagagacagagacaggugcugcagagcacccagagccccagaaccaagaacgcccccagccugcccagcagaaccugcuacaagaccgcccccggcaagaucgagaaggugaagcccccccccagccccaccaccgagggccccagccugcagcccgaccuggcccccgaggaggccgccggcacccagagacccaagaaccugaugcagacccugauggaggacuacgagacccacaagagcaagagaagagagagaauggacgacagcagcuacaccagcaagcugcugagcugcaaggugaccagcgaggugcuggaggccaccagagugaacagaagaaagagcgcccuggcccugagaugggaggccggcaucuacgccaaccaggaggaggaggacaacgaguaa

SEQ ID NO: 21160 - RNA, 378 nt, Artificial Sequence
  PAM16__Homo_sapiens__NP_057153
auggccaaguaccuggcccagaucaucgugaugggcgugcagguggugggcagagccuucgccagagcccugagacaggaguucgccgccagcagagccgccgccgacgccagaggcagagccggccacagaagcgccgccgccagcaaccugagcggccugagccugcaggaggcccagcagauccugaacgugagcaagcugagccccgaggaggugcagaagaacuacgagcaccuguucaaggugaacgacaagagcgugggcggcagcuucuaccugcagagcaagguggugagagccaaggagagacuggacgaggagcugaagauccaggcccaggaggacagagagaagggccagaugccccacaccuaa

SEQ ID NO: 21161 - RNA, 2664 nt, Artificial Sequence
  PAM__Homo_sapiens__NP_620177
auggccggcagagugcccagccugcuggugcugcugguguuccccagcagcugccuggccuucagaagcccccugagcguguucaagagauucaaggagaccaccagacccuucagcaacgagugccugggcaccaccagacccguggugcccaucgacagcagcgacuucgcccuggacaucagaaugcccggcgugacccccaagcagagcgacaccuacuucugcaugagcaugagaauccccguggacgaggaggccuucgugaucgacuucaagcccagagccagcauggacaccgugcaccacaugcugcuguucggcugcaacaugcccagcagcaccggcagcuacugguucugcgacgagggcaccugcaccgacaaggccaacauccuguacgccugggccagaaacgccccccccaccagacugcccaagggcgugggcuucagagugggcggcgagaccggcagcaaguacuucgugcugcaggugcacuacggcgacaucagcgccuucagagacaacaacaaggacugcagcggcgugagccugcaccugaccagacugccccagccccugaucgccggcauguaccugaugaugagcguggacaccgugauccccgccggcgagaagguggugaacagcgacaucagcugccacuacaagaacuaccccaugcacguguucgccuacagagugcacacccaccaccugggcaagguggugagcggcuacagagugagaaacggccaguggacccugaucggcagacagagcccccagcugccccaggccuucuaccccgugggccaccccguggacgugagcuucggcgaccugcuggccgccagaugcguguucaccggcgagggcagaaccgaggccacccacaucggcggcaccagcagcgacgagaugugcaaccuguacaucauguacuacauggaggccaagcacgccgugagcuucaugaccugcacccagaacguggcccccgacauguucagaaccaucccccccgaggccaacauccccauccccgugaagagcgacauggugaugaugcacgagcaccacaaggagaccgaguacaaggacaagaucccccugcugcagcagcccaagagagaggaggaggaggugcuggaccagggcgacuucuacagccugcugagcaagcugcugggcgagagagaggacguggugcacgugcacaaguacaaccccaccgagaaggccgagagcgagagcgaccugguggccgagaucgccaacguggugcagaagaaggaccugggcagaagcgacgccagagagggcgccgagcacgagagaggcaacgccauccuggugagagacagaauccacaaguuccacagacuggugagcacccugagaccccccgagagcagaguguucagccugcagcagcccccccccggcgagggcaccugggagcccgagcacaccggcgacuuccacauggaggaggcccuggacuggcccggcguguaccugcugcccggccaggugagcggcguggcccuggaccccaagaacaaccuggugaucuuccacagaggcgaccacgugugggacggcaacagcuucgacagcaaguucguguaccagcagaucggccugggccccaucgaggaggacaccauccuggugaucgaccccaacaacgccgccgugcugcagagcagcggcaagaaccuguucuaccugccccacggccugagcaucgacaaggacggcaacuacugggugaccgacguggcccugcaccagguguucaagcuggaccccaacaacaaggagggccccgugcugauccugggcagaagcaugcagcccggcagcgaccagaaccacuucugccagcccaccgacguggccguggaccccggcaccggcgccaucuacgugagcgacggcuacugcaacagcagaaucgugcaguucagccccagcggcaaguucaucacccaguggggcgaggagagcagcggcagcagcccccugcccggccaguucaccgugccccacagccuggcccuggugccccugcugggccagcugugcguggccgacagagagaacggcagaauccagugcuucaagaccgacaccaaggaguucgugagagagaucaagcacagcagcuucggcagaaacguguucgccaucagcuacauccccggccugcuguucgccgugaacggcaagccccacuucggcgaccaggagcccgugcagggcuucgugaugaacuucagcaacggcgagaucaucgacaucuucaagcccgugagaaagcacuucgacaugccccacgacaucguggccagcgaggacggcaccguguacaucggcgacgcccacaccaacaccguguggaaguucacccugaccgagaagcuggagcacagaagcgugaagaaggccggcaucgaggugcaggagaucaagggcaagggcagcggcggccugaaccugggcaacuucuucgccagcagaaagggcuacagcagaaagggcuucgacagacugagcaccgagggcagcgaccaggagaaggaggacgacggcagcgagagcgaggaggaguacagcgccccccugcccgcccuggcccccagcagcagcuaa

SEQ ID NO: 21162 - RNA, 2163 nt, Artificial Sequence
  PAMR1__Homo_sapiens__NP_001001991
auggagcugggcugcuggacccagcugggccugaccuuccugcagcugcugcugaucagcagccugcccagagaguacaccgugaucaacgaggccugccccggcgccgaguggaacaucaugugcagagagugcugcgaguacgaccagaucgagugcgugugccccggcaagagagagguggugggcuacaccauccccugcugcagaaacgaggagaacgagugcgacagcugccugauccaccccggcugcaccaucuucgagaacugcaagagcugcagaaacggcagcuggggcggcacccuggacgacuucuacgugaagggcuucuacugcgccgagugcagagccggcugguacggcggcgacugcaugagaugcggccaggugcugagagcccccaagggccagauccugcuggagagcuacccccugaacgcccacugcgaguggaccauccacgccaagcccggcuucgugauccagcugagauucgugaugcugagccuggaguucgacuacaugugccaguacgacuacguggaggugagagacggcgacaacagagacggccagaucaucaagagagugugcggcaacgagagacccgcccccauccagagcaucggcagcagccugcacgugcuguuccacagcgacggcagcaagaacuucgacggcuuccacgccaucuacgaggagaucaccgccugcagcagcagccccugcuuccacgacggcaccugcgugcuggacaaggccggcagcuacaagugcgccugccuggccggcuacaccggccagagaugcgagaaccugcuggaggagagaaacugcagcgaccccggcggccccgugaacggcuaccagaagaucaccggcggccccggccugaucaacggcagacacgccaagaucggcaccguggugagcuucuucugcaacaacagcuacgugcugagcggcaacgagaagagaaccugccagcagaacggcgaguggagcggcaagcagcccaucugcaucaaggccugcagagagcccaagaucagcgaccuggugagaagaagagugcugcccaugcaggugcagagcagagagaccccccugcaccagcuguacagcgccgccuucagcaagcagaagcugcagagcgcccccaccaagaagcccgcccugcccuucggcgaccugcccaugggcuaccagcaccugcacacccagcugcaguacgagugcaucagccccuucuacagaagacugggcagcagcagaagaaccugccugagaaccggcaaguggagcggcagagcccccagcugcauccccaucugcggcaagaucgagaacaucaccgcccccaagacccagggccugagauggcccuggcaggccgccaucuacagaagaaccagcggcgugcacgacggcagccugcacaagggcgccugguuccuggugugcagcggcgcccuggugaacgagagaaccguggugguggccgcccacugcgugaccgaccugggcaaggugaccaugaucaagaccgccgaccugaagguggugcugggcaaguucuacagagacgacgacagagacgagaagaccauccagagccugcagaucagcgccaucauccugcaccccaacuacgaccccauccugcuggacgccgacaucgccauccugaagcugcuggacaaggccagaaucagcaccagagugcagcccaucugccuggccgccagcagagaccugagcaccagcuuccaggagagccacaucaccguggccggcuggaacgugcuggccgacgugagaagccccggcuucaagaacgacacccugagaagcggcguggugagcgugguggacagccugcugugcgaggagcagcacgaggaccacggcauccccgugagcgugaccgacaacauguucugcgccagcugggagcccaccgcccccagcgacaucugcaccgccgagaccggcggcaucgccgccgugagcuuccccggcagagccagccccgagcccagauggcaccugaugggccuggugagcuggagcuacgacaagaccugcagccacagacugagcaccgccuucaccaaggugcugcccuucaaggacuggaucgagagaaacaugaaguaa

SEQ ID NO: 21163 - RNA, 3609 nt, Artificial Sequence
  PAN2__Homo_sapiens__NP_001120932
augaacuucgagggccuggaccccggccuggccgaguacgcccccgccaugcacagcgcccuggaccccgugcuggacgcccaccugaaccccagccugcugcagaacguggagcuggaccccgagggcguggcccuggaggcccugcccgugcaggagagcgugcacaucauggagggcguguacagcgagcugcacagcgugguggccgaggugggcgugcccgugagcgugagccacuucgaccugcacgaggagaugcugugggugggcagccacggcggccacgccaccagcuucuucggccccgcccuggagagauacagcagcuuccaggugaacggcagcgacgacaucagacagauccagagccuggagaacggcauccuguuccugaccaagaacaaccugaaguacauggccagaggcggccugaucaucuucgacuaccugcuggacgagaacgaggacaugcacagccugcugcugaccgacagcagcacccugcuggugggcggccugcagaaccacauccuggagaucgaccugaacaccgugcaggagacccagaaguacgccguggagacccccggcgugaccaucaugagacagaccaacagauucuucuucugcggccacaccagcggcaaggugagccugagagaccugagaaccuucaagguggagcacgaguucgacgccuucagcggcagccugagcgacuucgacgugcacggcaaccugcuggccgccugcggcuucagcagcagacugaccggccuggccugcgacagauuccugaagguguacgaccugagaaugaugagagccaucaccccccugcaggugcacguggaccccgccuuccugagauucauccccaccuacaccagcagacuggccaucaucagccagagcggccagugccaguucugcgagcccaccggccuggccaaccccgccgacaucuuccacgugaaccccgugggcccccugcugaugaccuucgacgugagcgccagcaagcaggcccuggccuucggcgacagcgagggcugcgugcaccuguggaccgacagccccgagcccagcuucaaccccuacagcagagagaccgaguucgcccugcccugccugguggacagccugcccccccuggacuggagccaggaccugcugccccugagccugauccccgugccccugaccaccgacacccugcugagcgacuggcccgccgccaacagcgcccccgcccccagaagagccccccccguggacgccgagauccugagaaccaugaagaaggugggcuucaucggcuacgcccccaaccccagaaccagacugagaaaccagauccccuacagacugaaggagagcgacagcgaguucgacagcuucagccaggugaccgagagccccgugggcagagaggaggagccccaccugcacauggugagcaagaaguacagaaaggugaccaucaaguacagcaagcugggccuggaggacuucgacuucaagcacuacaacaagacccuguucgccggccuggagccccacauccccaacgccuacugcaacugcaugauccaggugcuguacuuccuggagcccgugagaugccugauccagaaccaccugugccagaaggaguucugccuggccugcgagcugggcuuccuguuccacaugcuggaccugagcagaggcgaccccugccagggcaacaacuuccugagagccuucagaaccauccccgaggccagcgcccugggccugauccuggccgacagcgacgaggccagcggcaagggcaaccuggccagacugauccagagauggaacagauucauccugacccagcugcaccaggacaugcaggagcuggagaucccccaggccuacagaggcgccggcggcagcagcuucugcagcagcggcgacagcgugaucggccagcuguucagcugcgagauggagaacugcagccugugcagaugcggcagcgagaccgugagagccagcagcacccugcuguucacccugagcuaccccgacggcagcaagagcgacaagaccggcaagaacuacgacuucgcccaggugcugaagagaagcaucugccuggaccagaacacccaggccuggugcgacaccugcgagaaguaccagcccaccauccagaccagaaacaucagacaccugcccgacauccuggugaucaacugcgaggugaacagcagcaaggaggccgacuucuggagaaugcaggccgagguggccuucaagauggccgugaagaagcacggcggcgagaucagcaagaacaaggaguucgcccuggccgacuggaaggagcugggcagccccgagggcgugcuggugugccccagcaucgaggagcugaagaacguguggcugcccuucagcaucagaaugaagaugaccaagaacaagggccuggacgugugcaacuggaccgacggcgacgagaugcaguggggccccgccagagccgaggaggagcacggcguguacguguacgaccugauggccaccguggugcacauccuggacagcagaaccggcggcagccugguggcccacaucaaggugggcgagaccuaccaccagagaaaggagggcgugacccaccagcagugguaccuguucaacgacuuccugaucgagcccaucgacaagcacgaggccgugcaguucgacaugaacuggaaggugcccgccauccuguacuacgugaagagaaaccugaacagcagauacaaccugaacaucaagaaccccaucgaggccagcgugcugcuggccgaggccagccuggccagaaagcagagaaagacccacaccaccuucaucccccugaugcugaacgagaugccccagaucggcgaccuggugggccuggacgccgaguucgugacccugaacgaggaggaggccgagcugagaagcgacggcaccaagagcaccaucaagcccagccagaugagcguggccagaaucaccugcgugagaggccagggccccaacgagggcauccccuucaucgacgacuacaucagcacccaggagcaggugguggacuaccugacccaguacagcggcaucaagcccggcgaccuggacgccaagaucagcagcaagcaccugaccacccugaagagcaccuaccugaagcugagauuccugaucgacaucggcgugaaguucgugggccacggccugcagaaggacuucagagugaucaaccugauggugcccaaggaccaggugcuggacaccguguaccuguuccacaugcccagaaagagaaugaucagccugagauuccuggccugguacuuccuggaccugaagauccagggcgagacccacgacagcaucgaggacgccagaaccgcccugcagcuguacagaaaguaccuggagcugagcaagaacggcaccgagcccgagagcuuccacaaggugcugaagggccuguacgagaagggcagaaagauggacuggaaggugcccgagcccgagggccagaccagccccaagaacgccgccguguucagcagcgugcuggcccuguaa

SEQ ID NO: 21164 - RNA, 2664 nt, Artificial Sequence
  PAN3__Homo_sapiens__NP_787050
augaacagcggcggcggccugcccccccccagcgccgccgccagccccagcagcagcagccuggccgccgccguggccgugguggccccccccggcgugggcggcgugcccggcggcgccgccgugggcgugaagcugaaguacugcagauacuacgccaaggacaagaccugcuucuacggcgaggagugccaguuccugcacgaggaccccgccgccggcgccgcccccggccugggccugcacagcaacagcgugccccuggcccuggccggcgcccccguggccggcuucccccccggcgccguggccggcggcggcgccggccccccccccggccccaagaagcccgaccugggcgaccccggcaccggcgccgccgccggcggcggcggcagcagcggcggccuggacggccccagacuggccauccccggcauggacggcggcgcccugaccgacaccagccugaccgacagcuacuucagcaccagcuucaucggcgugaacggcuucggcagccccguggagaccaaguacccccugaugcagagaaugaccaacagcagcagcagccccagccugcugaacgacagcgccaagcccuacagcgcccacgacccccugaccagccccgccagcagccuguucaacgacuucggcgcccugaacaucagccagagaagaaagcccagaaaguacagacugggcaugcuggaggagagacuggugcccaugggcagcaaggccagaaaggccaagaaccccaucggcugccuggccgacagaugcaagagcggcgugcccaucaacauggugugguggaacagagugaccgagaacaaccugcagacccccaaccccaccgccagcgaguucauccccaagggcggcagcaccagcagacugagcaacgugagccagagcaacaugagcgccuucagccagguguucagccaccccagcaugggcagccccgccaccgccggccuggcccccggcaugagccugagcgccggcagcagcccccugcacagccccaagaucaccccccacaccagccccgcccccagaagaagaagccacacccccaaccccgccagcuacauggugcccagcagcgccagcaccagcgugaacaaccccgugagccagacccccagcagcggccaggugauccagaaggagaccgugggcggcaccaccuacuucuacaccgacaccacccccgccccccugaccggcaugguguuccccaacuaccacaucuacccccccaccgccccccacguggccuacaugcagcccaaggccaacgcccccagcuucuucauggccgacgagcugagacaggagcugaucaacagacaccugaucaccauggcccagaucgaccaggccgacaugcccgccgugcccaccgagguggacagcuaccacagccuguucccccuggagccccugcccccccccaacagaauccagaagagcagcaacuucggcuacaucaccagcugcuacaaggccgugaacagcaaggacgaccugcccuacugccugagaagaauccacggcuucagacuggugaacaccaagugcauggugcugguggacauguggaagaagauccagcacagcaacaucgugacccugagagagguguucaccaccaaggccuucgccgagcccagccugguguucgccuacgacuuccacgccggcggcgagaccaugaugagcagacacuucaacgaccccaacgccgacgccuacuucaccaagagaaaguggggccagcacgagggcccccugcccagacagcacgccggccugcugcccgagagccugaucugggccuacaucgugcagcugagcagcgcccugagaaccauccacaccgccggccuggccugcagagugauggaccccaccaagauccugaucaccggcaagaccagacugagagugaacugcgugggcguguucgacgugcugaccuucgacaacagccagaacaacaacccccuggcccugauggcccaguaccagcaggccgaccugaucagccugggcaagguggugcuggcccuggccugcaacagccuggccggcauccagagagagaaccugcagaaggccauggagcuggugaccaucaacuacagcagcgaccugaagaaccugauccuguaccugcugaccgaccagaacagaaugagaagcgugaacgacaucaugcccaugaucggcgccagauucuacacccagcuggacgccgcccagaugagaaacgacgugaucgaggaggaccuggccaaggaggugcagaacggcagacuguucagacugcuggccaagcugggcaccaucaacgagagacccgaguuccagaaggaccccaccuggagcgagaccggcgacagauaccugcugaagcuguucagagaccaccuguuccaccaggugaccgaggccggcgcccccuggaucgaccugagccacaucaucagcugccugaacaagcuggacgccggcgugcccgagaagaucagccugaucagcagagacgagaagagcgugcugguggugaccuacagcgaccugaagagaugcuucgagaacaccuuccaggagcugaucgccgccgccaacggccagcuguaa

SEQ ID NO: 21165 - RNA, 945 nt, Artificial Sequence
  PANK1__Homo_sapiens__NP_612189
augaagcugaucaacggcaagaagcagaccuuccccugguucggcauggacaucggcggcacccuggugaagcugguguacuucgagcccaaggacaucaccgccgaggaggagcaggaggagguggagaaccugaagagcaucagaaaguaccugaccagcaacaccgccuacggcaagaccggcaucagagacgugcaccuggagcugaagaaccugaccaugugcggcagaaagggcaaccugcacuucaucagauuccccagcugcgccaugcacagauucauccagaugggcagcgagaagaacuucagcagccugcacaccacccugugcgccaccggcggcggcgccuucaaguucgaggaggacuucagaaugaucgccgaccugcagcugcacaagcuggacgagcuggacugccugauccagggccugcuguacguggacagcgugggcuucaacggcaagcccgagugcuacuacuucgagaaccccaccaaccccgagcugugccagaagaagcccuacugccuggacaaccccuaccccaugcugcuggugaacaugggcagcggcgugagcauccuggccguguacagcaaggacaacuacaagagagugaccggcaccagcuucggcaacaugaugagcaaggagaagagagacagcaucagcaaggaggaccuggccagagccacccuggugaccaucaccaacaacaucggcagcaucgccagaaugugcgcccugaacgagaacaucgacagagugguguucgugggcaacuuccugagaaucaacauggugagcaugaagcugcuggccuacgccauggacuucuggagcaagggccagcugaaggcccuguuccuggagcacgagggcuacuucggcgccgugggcgcccugcuggagcuguucaagaugaccgacgacaaguaa

SEQ ID NO: 21166 - RNA, 1713 nt, Artificial Sequence
  PANK2__Homo_sapiens__NP_705902
augagaagacugggccccuuccaccccagagugcacugggccgccccccccagccugagcagcggccugcacagacugcuguuccugagaggcaccagaauccccagcagcaccacccugagcccccccagacacgacagccugagccuggacggcggcaccgugaacccccccagagugagagagcccaccggcagagaggccuucggccccagccccgccagcagcgacuggcugcccgccagauggagaaacggcagaggcggcagacccagagccagacugugcagcggcuggaccgccgccgaggaggccagaagaaaccccacccugggcggccugcugggcagacagagacugcugcugagaaugggcggcggcagacugggcgcccccauggagagacacggcagagccagcgccaccagcgugagcagcgccggcgagcaggccgccggcgaccccgagggcagaagacaggagccccugagaagaagagccagcagcgccagcgugcccgccgugggcgccagcgccgagggcaccagaagagacagacugggcagcuacagcggccccaccagcgugagcagacagagaguggagagccugagaaagaagagaccccuguuccccugguucggccuggacaucggcggcacccuggugaagcugguguacuucgagcccaaggacaucaccgccgaggaggaggaggaggagguggagagccugaagagcaucagaaaguaccugaccagcaacguggccuacggcagcaccggcaucagagacgugcaccuggagcugaaggaccugacccugugcggcagaaagggcaaccugcacuucaucagauuccccacccacgacaugcccgccuucauccagaugggcagagacaagaacuucagcagccugcacaccguguucugcgccaccggcggcggcgccuacaaguucgagcaggacuuccugaccaucggcgaccugcagcugugcaagcuggacgagcuggacugccugaucaagggcauccuguacaucgacagcgugggcuucaacggcagaagccagugcuacuacuucgagaaccccgccgacagcgagaagugccagaagcugcccuucgaccugaagaaccccuacccccugcugcuggugaacaucggcagcggcgugagcauccuggccguguacagcaaggacaacuacaagagagugaccggcaccagccugggcggcggcaccuucuucggccugugcugccugcugaccggcugcaccaccuucgaggaggcccuggagauggccagcagaggcgacagcaccaagguggacaagcuggugagagacaucuacggcggcgacuacgagagauucggccugcccggcugggccguggccagcagcuucggcaacaugaugagcaaggagaagagagaggccgugagcaaggaggaccuggccagagccacccugaucaccaucaccaacaacaucggcagcaucgccagaaugugcgcccugaacgagaacaucaaccaggugguguucgugggcaacuuccugagaaucaacaccaucgccaugagacugcuggccuacgcccuggacuacuggagcaagggccagcugaaggcccuguucagcgagcacgagggcuacuucggcgccgugggcgcccugcuggagcugcugaagauccccuaa

SEQ ID NO: 21167 - RNA, 1281 nt, Artificial Sequence
  PANX1__Homo_sapiens__NP_056183
auggccaucgcccagcuggccaccgaguacguguucagcgacuuccugcugaaggagcccaccgagcccaaguucaagggccugagacuggagcuggccguggacaagauggugaccugcaucgccgugggccugccccugcugcugaucagccuggccuucgcccaggagaucagcaucggcacccagaucagcugcuucagccccagcagcuucagcuggagacaggccgccuucguggacagcuacugcugggccgccgugcagcagaagaacagccugcagagcgagagcggcaaccugccccuguggcugcacaaguucuuccccuacauccugcugcuguucgccauccugcuguaccugcccccccuguucuggagauucgccgccgccccccacaucugcagcgaccugaaguucaucauggaggagcuggacaagguguacaacagagccaucaaggccgccaagagcgccagagaccuggacaugagagacggcgccugcagcgugcccggcgugaccgagaaccugggccagagccugugggaggugagcgagagccacuucaaguaccccaucguggagcaguaccugaagaccaagaagaacagcaacaaccugaucaucaaguacaucagcugcagacugcugacccugaucaucauccugcuggccugcaucuaccugggcuacuacuucagccugagcagccugagcgacgaguucgugugcagcaucaagagcggcauccugagaaacgacagcaccgugcccgaccaguuccagugcaagcugaucgccgugggcaucuuccagcugcugagcgugaucaaccuggugguguacgugcugcuggcccccguggugguguacacccuguucgugcccuucagacagaagaccgacgugcugaagguguacgagauccugcccaccuucgacgugcugcacuucaagagcgagggcuacaacgaccugagccuguacaaccuguuccuggaggagaacaucagcgaggugaagagcuacaagugccugaaggugcuggagaacaucaagagcagcggccagggcaucgaccccaugcugcugcugaccaaccugggcaugaucaagauggacgugguggacggcaagacccccaugagcgccgagaugagagaggagcagggcaaccagaccgccgagcugcagggcaugaacaucgacagcgagaccaaggccaacaacggcgagaagaacgccagacagagacugcuggacagcagcugcuaa

SEQ ID NO: 21168 - RNA, 2034 nt, Artificial Sequence
  PANX2__Homo_sapiens__NP_443071
augcaccaccugcuggagcagagcgccgacauggccaccgcccugcuggccggcgagaagcugagagagcugauccugcccggcgcccaggacgacaaggccggcgcccuggccgcccugcugcugcagcugaagcuggagcugcccuucgacagaguggugaccaucggcaccgugcuggugcccauccugcuggugacccugguguucaccaagaacuucgccgaggagcccaucuacugcuacaccccccacaacuucaccagagaccaggcccuguacgccagaggcuacugcuggaccgagcugagagacgcccugcccggcguggacgccagccuguggcccagccuguucgagcacaaguuccugcccuacgcccugcuggccuucgccgccaucauguacgugcccgcccugggcugggaguuccuggccagcaccagacugaccagcgagcugaacuuccugcugcaggagaucgacaacugcuaccacagagccgccgagggcagagcccccaagaucgagaagcagauccagagcaagggccccggcaucaccgagagagagaagagagagaucaucgagaacgccgagaaggagaagagccccgagcagaaccuguucgagaaguaccuggagagaagaggcagaagcaacuuccuggccaagcuguaccuggccagacacgugcugauccugcugcugagcgccgugcccaucagcuaccugugcaccuacuacgccacccagaagcagaacgaguucaccugcgcccugggcgccagccccgacggcgccgccggcgccggccccgccgugagagugagcugcaagcugcccagcgugcagcugcagagaaucaucgccggcguggacaucgugcugcugugcgugaugaaccugaucauccuggugaaccugauccaccuguucaucuucagaaagagcaacuucaucuucgacaagcugcacaaggugggcaucaagaccagaagacaguggagaagaagccaguucugcgacaucaacauccuggccauguucugcaacgagaacagagaccacaucaagagccugaacagacuggacuucaucaccaacgagagcgaccugauguacgacaacguggugagacagcugcuggccgcccuggcccagagcaaccacgacgccacccccaccgugagagacagcggcgugcagaccguggaccccagcgccaaccccgccgagcccgacggcgccgccgagccccccguggugaagagacccagaaagaagaugaaguggauccccaccagcaacccccugccccagcccuucaaggagccccuggccaucaugagaguggagaacagcaaggccgagaagcccaagcccgccagaagaaagaccgccaccgacacccugaucgccccccugcuggacagaagcgcccaccacuacaagggcggcggcggcgaccccggccccggccccgcccccgcccccgcccccccccccgcccccgacaagaagcacgccagacacuucagccuggacgugcaccccuacauccugggcaccaagaaggccaaggccgaggccgugcccgccgcccugcccgccagcagaagccaggagggcggcuuccugagccaggccgaggacugcggccugggccuggcccccgcccccaucaaggacgccccccugcccgagaaggagauccccuaccccaccgagcccgccagagccggccugcccagcggcggccccuuccacgugagaagcccccccgccgcccccgccguggccccccugacccccgccagccugggcaaggccgagccccugaccauccugagcagaaacgccacccacccccugcugcacaucaacacccuguacgaggccagagaggaggaggacggcggccccagacugccccaggacgugggcgaccugaucgccauccccgccccccagcagauccugaucgccaccuucgacgagcccagaaccguggugagcaccguggaguucuaa

SEQ ID NO: 21169 - RNA, 1536 nt, Artificial Sequence
  PAOX__Homo_sapiens__NP_690875
auggagagcaccggcagcgugggcgaggcccccggcggccccagagugcugguggugggcggcggcaucgccggccugggcgccgcccagagacugugcggccacagcgccuucccccaccugagagugcuggaggccaccgccagagccggcggcagaaucagaagcgagagaugcuucggcggcgugguggaggugggcgcccacuggauccacggccccagcagaggcaaccccguguuccagcuggccgccgaguacggccugcugggcgagaaggagcugagccaggagaaccagcugguggagaccggcggccacgugggccugcccagcgugagcuacgccagcagcggcgccagcgugagccugcagcugguggccgagauggccacccuguucuacggccugaucgaccagaccagagaguuccugcacgccgccgagacccccgugcccagcgugggcgaguaccugaagaaggagaucggccagcacguggccggcuggaccgaggacgaggagaccagaaagcugaagcuggccgugcugaacagcuucuucaaccuggagugcugcgugagcggcacccacagcauggaccugguggcccuggcccccuucggcgaguacaccgugcugcccggccuggacugcaccuucagcaagggcuaccagggccugaccaacugcaugauggccgcccugcccgaggacaccgugguguucgagaagcccgugaagaccauccacuggaacggcagcuuccaggaggccgccuuccccggcgagaccuuccccgugagcguggagugcgaggacggcgacagauuccccgcccaccacgugaucgugaccgugccccugggcuuccugagagagcaccuggacaccuucuucgaccccccccugcccgccgagaaggccgaggccaucagaaagaucggcuucggcaccaacaacaagaucuuccuggaguucgaggagcccuucugggagcccgacugccagcugauccagcuggugugggaggacaccagcccccuggaggacgccgcccccgagcugcaggacgccugguucagaaagcugaucggcuucguggugcugcccgccuucgccagcgugcacgugcugugcggcuucaucgccggccuggagagcgaguucauggagacccugagcgacgaggaggugcugcugugccugacccaggugcugagaagagugaccggcaaccccagacugcccgcccccaagagcgugcugagaagcagauggcacagcgcccccuacaccagaggcagcuacagcuacguggccgugggcagcaccggcggcgaccuggaccugcuggcccagccccugcccgccgacggcgccggcgcccagcugcagauccuguucgccggcgaggccacccacagaaccuucuacagcaccacccacggcgcccugcugagcggcuggagagaggccgacagacugcugagccugugggccccccaggugcagcagcccagacccagacuguaa

SEQ ID NO: 21170 - RNA, 2379 nt, Artificial Sequence
  PAPD7__Homo_sapiens__XP_005248291
auggaccccagaguggccuggauccagcccgagcagaagggccccgccaacgcccuguggaugcagaucugggagaccagccagggcgugggcagaggcggcagcggcuucgccagcuacuucugccugaacagccccgcccuggacaccgccgccgccgccggcgccgccggcagaggcagcggcggccugggccccgcccugcccgccgccagcccccccccccccggccccaccgcccccgccgcccugccccccgcccugcugaccgcccugggccccgccgccgagggcgccagaagacugcacaagagccccagccugagcagcagcagcagcagcagcagcagcaacgccgagagcggcaccgagagccccggcugcagcagcagcagcagcagcagcgccagccugggcagacccggcggcggcagaggcggcgccuucuucaacuucgccgacggcgcccccagcgcccccggcaccgccaacggccaccccggccccagaggccccgcccccgccggcagccccagccagcaccaguuccaccccggcagaagaaagagagagaacaaggccagcaccuacggccugaacuaccugcugagcggcagcagagccgccgcccugagcggcggcggcggccccggcgcccaggcccccagacccggcacccccuggaagagcagagccuacagccccggcauccagggccugcacgaggagaucaucgacuucuacaacuucaugagccccugccccgaggaggccgccaugagaagagagguggugaagagaaucgagaccguggugaaggaccuguggcccaccgccgacgugcagaucuucggcagcuucagcaccggccuguaccugcccaccagcgacaucgaccuggugguguucggcaagugggagagacccccccugcagcugcuggagcaggcccugagaaagcacaacguggccgagcccugcagcaucaaggugcuggacaaggccaccgugcccaucaucaagcugaccgaccaggagaccgaggugaagguggacaucagcuucaacauggagaccggcgugagagccgccgaguucaucaagaacuacaugaagaaguacagccugcugcccuaccugauccuggugcugaagcaguuccugcugcagagagaccugaacgagguguucaccggcggcaucagcagcuacagccugauccugauggccaucagcuuccugcagcugcaccccagaaucgacgccagaagagccgacgagaaccugggcaugcugcugguggaguucuucgagcuguacggcagaaacuucaacuaccugaagaccggcaucagaaucaaggagggcggcgccuacaucgccaaggaggagaucaugaaggccaugaccagcggcuacagacccagcaugcugugcaucgaggacccccugcugcccggcaacgacgugggcagaagcagcuacggcgccaugcaggugaagcagguguucgacuacgccuacaucgugcugagccacgccgugagcccccuggccagaagcuaccccaacagagacgccgagagcacccugggcagaaucaucaaggugacccaggaggugaucgacuacagaagauggaucaaggagaaguggggcagcaaggcccaccccagccccggcauggacagcagaaucaagaucaaggagagaaucgccaccugcaacggcgagcagacccagaacagagagcccgagagccccuacggccagagacugacccugagccugagcagcccccagcugcugagcagcggcagcagcgccagcagcgugagcagccugagcggcagcgacguggacagcgacaccccccccugcaccacccccagcguguaccaguucagccugcaggcccccgccccccugauggccggccugcccaccgcccugcccaugcccagcggcaagccccagcccaccaccagcagaacccugaucaugaccaccaacaaccagaccagauucaccauccccccccccacccugggcguggcccccgugcccugcagacaggccggcguggagggcaccgccagccugaaggccgugcaccacaugagcagccccgccauccccagcgccagccccaacccccugagcagcccccaccuguaccacaagcagcacaacggcaugaagcugagcaugaagggcagccacggccacacccagggcggcggcuacagcagcgugggcagcggcggcgugagaccccccgugggcaacagaggccaccaccaguacaacagaaccggcuggagaagaaagaagcacacccacaccagagacagccugcccgugagccugagcagauaa

SEQ ID NO: 21171 - RNA, 1317 nt, Artificial Sequence
  PAPL__Homo_sapiens__NP_001004318
augcacccccugcccggcuacuggagcugcuacugccugcugcugcuguucagccugggcgugcagggcagccugggcgcccccagcgccgcccccgagcaggugcaccugagcuaccccggcgagcccggcagcaugaccgugaccuggaccaccugggugcccaccagaagcgaggugcaguucggccugcagcccagcggcccccugccccugagagcccagggcaccuucgugcccuucguggacggcggcauccugagaagaaagcuguacauccacagagugacccugagaaagcugcugcccggcgugcaguacguguacagaugcggcagcgcccagggcuggagcagaagauucagauucagagcccugaagaacggcgcccacuggagccccagacuggccguguucggcgaccugggcgccgacaaccccaaggccgugcccagacugagaagagacacccagcagggcauguacgacgccgugcugcacgugggcgacuucgccuacaaccuggaccaggacaacgccagagugggcgacagauucaugagacugaucgagcccguggccgccagccugcccuacaugaccugccccggcaaccacgaggagagauacaacuucagcaacuacaaggccagauucagcaugcccggcgacaacgagggccugugguacagcugggaccugggccccgcccacaucaucagcuucagcaccgagguguacuucuuccugcacuacggcagacaccuggugcagagacaguucagauggcuggagagcgaccugcagaaggccaacaagaacagagccgccagacccuggaucaucaccaugggccacagacccauguacugcagcaacgccgaccuggacgacugcaccagacacgagagcaaggugagaaagggccugcagggcaagcuguacggccuggaggaccuguucuacaaguacggcguggaccugcagcugugggcccacgagcacagcuacgagagacuguggcccaucuacaacuaccagguguucaacggcagcagagagaugcccuacaccaaccccagaggccccgugcacaucaucaccggcagcgccggcugcgaggagagacugacccccuucgccguguuccccagacccuggagcgccgugagagugaaggaguacggcuacaccagacugcacauccugaacggcacccacauccacauccagcaggugagcgacgaccaggacggcaagaucguggacgacguguggguggugagaccccuguucggcagaagaauguaccuguaa

SEQ ID NO: 21172 - RNA, 858 nt, Artificial Sequence
  PAPOLA__Homo_sapiens__NP_001238935
augcccuuccccgugaccacccagggcagccagcagacccagcccccccagaagcacuacggcaucaccagccccaucagccuggccgcccccaaggagaccgacugcgugcugacccagaagcugaucgagacccugaagcccuucggcguguucgaggaggaggaggagcugcagagaagaauccugauccugggcaagcugaacaaccuggugaaggaguggaucagagagaucagcgagagcaagaaccugccccagagcgugaucgagaacgugggcggcaagaucuucaccuucggcagcuacagacugggcgugcacaccaagggcgccgacaucgacgcccugugcguggcccccagacacguggacagaagcgacuucuucaccagcuucuacgacaagcugaagcugcaggaggaggugaaggaccugagagccguggaggaggccuucgugcccgugaucaagcugugcuucgacggcaucgagaucgacauccuguucgccagacuggcccugcagaccauccccgaggaccuggaccugagagacgacagccugcugaagaaccuggacaucagaugcaucagaagccugaacggcugcagagugaccgacgagauccugcaccuggugcccaacaucgacaacuucagacugacccugagagccaucaagcugugggccaagagacacaacaucuacagcaacauccugggcuuccugggcggcgugagcugggccaugcugguggccagaaccugccagcuguaccccaacgccaucgccagcacccuggugcacaaguucuuccugguguucagcaagugguacguguucagacuguacuaa

SEQ ID NO: 21173 - RNA, 2211 nt, Artificial Sequence
  PAPOLG__Homo_sapiens__NP_075045
augaaggagaugagcgccaacaccgugcuggacagccagagacagcagaagcacuacggcaucaccagccccaucagccuggccagccccaaggagaucgaccacaucuacacccagaagcugaucgacgccaugaagcccuucggcguguucgaggacgaggaggagcugaaccacagacugguggugcugggcaagcugaacaaccuggugaaggaguggaucagcgacgugagcgagagcaagaaccugccccccagcgugguggccaccgugggcggcaagaucuucaccuucggcagcuacagacugggcgugcacaccaagggcgccgacaucgacgcccugugcguggcccccagacacguggagagaagcgacuucuuccagagcuucuucgagaagcugaagcaccaggacggcaucagaaaccugagagccguggaggacgccuucgugcccgugaucaaguucgaguucgacggcaucgagaucgaccugguguucgccagacuggccauccagaccaucagcgacaaccuggaccugagagacgacagcagacugagaagccuggacaucagaugcaucagaagccugaacggcugcagagugaccgacgagauccugcaccuggugcccaacaaggagaccuucagacugacccugagagccgugaagcugugggccaagagaagaggcaucuacagcaacaugcugggcuuccugggcggcgugagcugggccaugcugguggccagaaccugccagcuguaccccaacgccgccgccagcacccuggugcacaaguucuuccugguguucagcaagugggaguggcccaaccccgugcugcugaagcagcccgaggagagcaaccugaaccugcccgugugggaccccagagugaaccccagcgacagauaccaccugaugcccaucaucacccccgccuacccccagcagaacagcaccuacaacgugagcaccagcaccagaaccgugaugguggaggaguucaagcagggccuggccgugaccgacgagauccugcagggcaagagcgacuggagcaagcugcuggagccccccaacuucuuccagaaguacagacacuacaucgugcugaccgccagcgccagcaccgaggagaaccaccuggagugggugggccugguggagagcaagaucagagugcuggugggcaaccuggagagaaacgaguucaucacccuggcccacgugaacccccagagcuuccccggcaacaaggagcaccacaaggacaacaacuacgugagcaugugguuccugggcaucaucuucagaagaguggagaacgccgagagcgugaacaucgaccugaccuacgacauccagagcuucaccgacaccguguacagacaggccaacaacaucaacaugcugaaggagggcaugaagaucgaggccacccacgugaagaagaagcagcugcaccacuaccugcccgccgagauccugcagaagaagaagaagcagagccugagcgacgugaacagaagcagcggcggccugcagagcaagagacugagccuggacagcagcugccuggacagcagcagagacaccgacaacggcacccccuucaacagccccgccagcaagagcgacagccccagcgugggcgagaccgagagaaacagcgccgagcccgccgccgugaucguggagaagccccugagcgugccccccgcccagggccugagcauccccgugaucggcgccaagguggacagcaccgugaagaccgugagcccccccaccgugugcaccauccccaccguggugggcagaaacgugauccccagaaucaccaccccccacaaccccgcccagggccagccccaccugaacggcaugagcaacaucaccaagaccgugacccccaagagaagccacagccccagcaucgacggcacccccaagagacugaaggacguggagaaguucaucagacuggagagcaccuucaaggaccccagaaccgccgaggagagaaagagaaagagcguggacgccaucggcggcgagagcaugcccauccccaccaucgacaccagcagaaagaagagacugcccagcaaggagcugcccgacagcagcagccccgugcccgccaacaacaucagagugaucaagaacagcaucagacugacccugaacagauaa

SEQ ID NO: 21174 - RNA, 2484 nt, Artificial Sequence
  PAPPA2__Homo_sapiens__NP_068755
augaugugccugaagauccugagaaucagccuggccauccuggccggcugggcccugugcagcgccaacagcgagcugggcuggaccagaaagaagagccugguggagagagagcaccugaaccaggugcugcuggagggcgagagaugcuggcugggcgccaaggugagaagacccagagccagcccccagcaccaccuguucggcguguaccccagcagagccggcaacuaccugagacccuaccccgugggcgagcaggagauccaccacaccggcagaagcaagcccgacaccgagggcaacgccgugagccuggugccccccgaccugaccgagaaccccgccggccugagaggcgccguggaggagcccgccgcccccugggugggcgacagccccaucggccagagcgagcugcugggcgacgacgacgccuaccugggcaaccagagaagcaaggagagccugggcgaggccggcauccagaagggcagcgccauggccgccaccaccaccaccgccaucuucaccacccugaacgagcccaagcccgagacccagagaagaggcugggccaagagcagacagagaagacagguguggaagagaagagccgaggacggccagggcgacagcggcaucagcagccacuuccagcccuggcccaagcacagccugaagcacagagugaagaagagcccccccgaggagagcaaccagaacggcggcgagggcagcuacagagaggccgagaccuucaacagccaggugggccugcccauccuguacuucagcggcagaagagagagacugcugcugagacccgaggugcuggccgagauccccagagaggccuucaccguggaggccugggugaagcccgagggcggccagaacaaccccgccaucaucgccggcguguucgacaacugcagccacaccgugagcgacaagggcugggcccugggcaucagaagcggcaaggacaagggcaagagagacgccagauucuucuucagccugugcaccgacagagugaagaaggccaccauccugaucagccacagcagauaccagcccggcaccuggacccacguggccgccaccuacgacggcagacacauggcccuguacguggacggcacccagguggccagcagccuggaccagagcggcccccugaacagccccuucauggccagcugcagaagccugcugcugggcggcgacagcagcgaggacggccacuacuucagaggccaccugggcacccugguguucuggagcaccgcccugccccagagccacuuccagcacagcagccagcacagcagcggcgaggaggaggccaccgaccuggugcugaccgccagcuucgagcccgugaacaccgagugggugcccuucagagacgagaaguaccccagacuggaggugcugcagggcuucgagcccgagcccgagauccugagcccccugcagcccccccugugcggccagaccgugugcgacaacguggagcugaucagccaguacaacggcuacuggccccugagaggcgagaaggugaucagauaccagguggugaacaucugcgacgacgagggccugaaccccaucgugagcgaggagcagaucagacugcagcacgaggcccugaacgaggccuucagcagauacaacaucagcuggcagcugagcgugcaccaggugcacaacagcacccugagacacagaguggugcuggugaacugcgagcccagcaagaucggcaacgaccacugcgaccccgagugcgagcacccccugaccggcuacgacggcggcgacugcagacugcagggcagaugcuacagcuggaacagaagagacggccugugccacguggagugcaacaacaugcugaacgacuucgacgacggcgacugcugcgacccccagguggccgacgugagaaagaccugcuucgaccccgacagccccaagagagccuacaugagcgugaaggagcugaaggaggcccugcagcugaacagcacccacuuccugaacaucuacuucgccagcagcgugagagaggaccuggccggcgccgccaccuggcccugggacaaggacgccgugacccaccugggcggcaucgugcugagccccgccuacuacggcaugcccggccacaccgacaccaugauccacgaggugggccacgugcugggccuguaccacguguucaagggcgugagcgagagagagagcugcaacgaccccugcaaggagaccgugcccagcauggagaccggcgaccugugcgccgacaccgcccccacccccaagagcgagcugugcagagagcccgagcccaccagcgacaccugcggcuucaccagauuccccggcgcccccuucaccaacuacaugagcuacaccggcaucaccaccgugcuguucugcuuccugcugagaauccacggcggccuguaa

SEQ ID NO: 21175 - RNA, 4884 nt, Artificial Sequence
  PAPPA__Homo_sapiens__NP_002572
augagacuguggagcugggugcugcaccugggccugcugagcgccgcccugggcugcggccuggccgagagacccagaagagccagaagagaccccagagccggcagaccccccagacccgccgccggccccgccaccugcgccaccagagccgccagaggcagaagagccagccccccccccccccccccccccggcggcgccugggaggccgugagagugcccagaagaagacagcagagagaggccagaggcgccaccgaggagcccagcccccccagcagagcccuguacuucagcggcagaggcgagcagcugagacugagagccgaccuggagcugcccagagacgccuucacccugcagguguggcugagagccgagggcggccagagaagccccgccgugaucaccggccuguacgacaagugcagcuacaucagcagagacagaggcuggguggugggcauccacaccaucagcgaccaggacaacaaggaccccagauacuucuucagccugaagaccgacagagccagacaggugaccaccaucaacgcccacagaagcuaccugcccggccaguggguguaccuggccgccaccuacgacggccaguucaugaagcuguacgugaacggcgcccagguggccaccagcggcgagcaggugggcggcaucuucagcccccugacccagaagugcaaggugcugaugcugggcggcagcgcccugaaccacaacuacagaggcuacaucgagcacuucagccuguggaagguggccagaacccagagagagauccugagcgacauggagacccacggcgcccacaccgcccugccccagcugcugcugcaggagaacugggacaacgugaagcacgccuggagccccaugaaggacggcagcagccccaagguggaguucagcaacgcccacggcuuccugcuggacaccagccuggagcccccccugugcggccagacccugugcgacaacaccgaggugaucgccagcuacaaccagcugagcagcuucagacagcccaagguggugagauacagaguggugaaccuguacgaggacgaccacaagaaccccaccgugaccagagagcagguggacuuccagcaccaccagcuggccgaggccuucaagcaguacaacaucagcugggagcuggacgugcuggaggugagcaacagcagccugagaagaagacugauccuggccaacugcgacaucagcaagaucggcgacgagaacugcgaccccgagugcaaccacacccugaccggccacgacggcggcgacugcagacaccugagacaccccgccuucgugaagaagcagcacaacggcgugugcgacauggacugcaacuacgagagauucaacuucgacggcggcgagugcugcgaccccgagaucaccaacgugacccagaccugcuucgaccccgacagcccccacagagccuaccuggacgugaacgagcugaagaacauccugaagcuggacggcagcacccaccugaacaucuucuucgccaagagcagcgaggaggagcuggccggcguggccaccuggcccugggacaaggaggcccugaugcaccugggcggcaucgugcugaaccccagcuucuacggcaugcccggccacacccacaccaugauccacgagaucggccacagccugggccuguaccacguguucagaggcaucagcgagauccagagcugcagcgaccccugcauggagaccgagcccagcuucgagaccggcgaccugugcaacgacaccaaccccgcccccaagcacaagagcugcggcgaccccggccccggcaacgacaccugcggcuuccacagcuucuucaacacccccuacaacaacuucaugagcuacgccgacgacgacugcaccgacagcuucacccccaaccagguggccagaaugcacugcuaccuggaccugguguaccagggcuggcagcccagcagaaagcccgcccccguggcccuggccccccaggugcugggccacaccaccgacagcgugacccuggagugguucccccccaucgacggccacuucuucgagagagagcugggcagcgccugccaccugugccuggagggcagaauccuggugcaguacgccagcaacgccagcagccccaugcccugcagccccagcggccacuggagccccagagaggccgagggccaccccgacguggagcagcccugcaagagcagcgugagaaccuggagccccaacagcgccgugaacccccacaccgugccccccgccugccccgagccccagggcugcuaccuggagcuggaguuccuguacccccuggugcccgagagccugaccaucugggugaccuucgugagcaccgacugggacagcagcggcgccgugaacgacaucaagcugcuggccgugagcggcaagaacaucagccugggcccccagaacguguucugcgacgugccccugaccaucagacugugggacgugggcgaggagguguacggcauccagaucuacacccuggacgagcaccuggagaucgacgccgccaugcugaccagcaccgccgacaccccccugugccugcagugcaagccccugaaguacaagguggugagagaccccccccugcagauggacguggccagcauccugcaccugaacagaaaguucguggacauggaccugaaccugggcagcguguaccaguacugggugaucaccaucagcggcaccgaggagagcgagcccagccccgccgugaccuacauccacggcagcggcuacugcggcgacggcaucauccagaaggaccagggcgagcagugcgacgacaugaacaagaucaacggcgacggcugcagccuguucugcagacaggaggugagcuucaacugcaucgacgagcccagcagaugcuacuuccacgacggcgacggcgugugcgaggaguucgagcagaagaccagcaucaaggacugcggcguguacaccccccagggcuuccuggaccagugggccagcaacgccagcgugagccaccaggaccagcagugccccggcugggugaucaucggccagcccgccgccagccaggugugcagaaccaaggugaucgaccugagcgagggcaucagccagcacgccugguaccccugcaccaucagcuaccccuacagccagcuggcccagaccaccuucuggcugagagccuacuucagccagcccaugguggccgccgccgugaucgugcaccuggugaccgacggcaccuacuacggcgaccagaagcaggagaccaucagcgugcagcugcuggacaccaaggaccagagccacgaccugggccugcacgugcugagcugcagaaacaacccccugaucauccccguggugcacgaccugagccagcccuucuaccacagccaggccgugagagugagcuucagcagcccccugguggccaucagcggcguggcccugagaagcuucgacaacuucgaccccgugacccugagcagcugccagagaggcgagaccuacagccccgccgagcagagcugcgugcacuucgccugcgagaagaccgacugccccgagcuggccguggagaacgccagccugaacugcagcagcagcgacagauaccacggcgcccagugcaccgugagcugcagaaccggcuacgugcugcagaucagaagagacgacgagcugaucaagagccagaccggccccagcgugaccgugaccugcaccgagggcaaguggaacaagcagguggccugcgagcccguggacugcagcauccccgaccaccaccagguguacgccgccagcuucagcugccccgagggcaccaccuucggcagccagugcagcuuccagugcagacaccccgcccagcugaagggcaacaacagccugcugaccugcauggaggacggccuguggagcuuccccgaggcccugugcgagcugaugugccuggcccccccccccgugcccaacgccgaccugcagaccgccagaugcagagagaacaagcacaaggugggcagcuucugcaaguacaagugcaagcccggcuaccacgugcccggcagcagcagaaagagcaagaagagagccuucaagacccagugcacccaggacggcagcuggcaggagggcgccugcgugcccgugaccugcgacccccccccccccaaguuccacggccuguaccagugcaccaacggcuuccaguucaacagcgagugcagaaucaagugcgaggacagcgacgccagccagggccugggcagcaacgugauccacugcagaaaggacggcaccuggaacggcagcuuccacgugugccaggagaugcagggccagugcagcgugcccaacgagcugaacagcaaccugaagcugcagugccccgacggcuacgccaucggcagcgagugcgccaccagcugccuggaccacaacagcgagagcaucauccugcccaugaacgugaccgugagagacaucccccacuggcugaaccccaccagaguggagagaguggugugcaccgccggccugaagugguacccccaccccgcccugauccacugcgugaagggcugcgagcccuucaugggcgacaacuacugcgacgccaucaacaacagagccuucugcaacuacgacggcggcgacugcugcaccagcaccgugaagaccaagaaggugacccccuuccccaugagcugcgaccugcagggcgacugcgccugcagagacccccaggcccaggagcacagcagaaaggaccugagaggcuacagccacggcuaa

SEQ ID NO: 21176 - RNA, 1875 nt, Artificial Sequence
  PAPSS1__Homo_sapiens__NP_005434
auggagauccccggcagccugugcaagaaggugaagcugagcaacaacgcccagaacuggggcaugcagagagccaccaacgugaccuaccaggcccaccacgugagcagaaacaagagaggccagguggugggcaccagaggcggcuucagaggcugcaccguguggcugaccggccugagcggcgccggcaagaccaccgugagcauggcccuggaggaguaccuggugugccacggcauccccugcuacacccuggacggcgacaacaucagacagggccugaacaagaaccugggcuucagccccgaggacagagaggagaacgugagaagaaucgccgagguggccaagcuguucgccgacgccggccuggugugcaucaccagcuucaucagccccuacacccaggacagaaacaacgccagacagauccacgagggcgccagccugcccuucuucgagguguucguggacgccccccugcacgugugcgagcagagagacgugaagggccuguacaagaaggccagagccggcgagaucaagggcuucaccggcaucgacagcgaguacgagaagcccgaggcccccgagcuggugcugaagaccgacagcugcgacgugaacgacugcgugcagcaggugguggagcugcugcaggagagagacaucgugcccguggacgccagcuacgaggugaaggagcuguacgugcccgagaacaagcugcaccuggccaagaccgacgccgagacccugcccgcccugaagaucaacaagguggacaugcagugggugcaggugcuggccgagggcugggccaccccccugaacggcuucaugagagagagagaguaccugcagugccugcacuucgacugccugcuggacggcggcgugaucaaccugagcgugcccaucgugcugaccgccacccacgaggacaaggagagacuggacggcugcaccgccuucgcccugauguacgagggcagaagaguggccauccugagaaaccccgaguucuucgagcacagaaaggaggagagaugcgccagacaguggggcaccaccugcaagaaccaccccuacaucaagauggugauggagcagggcgacuggcugaucggcggcgaccugcaggugcuggacagaguguacuggaacgacggccuggaccaguacagacugacccccaccgagcugaagcagaaguucaaggacaugaacgccgacgccguguucgccuuccagcugagaaaccccgugcacaacggccacgcccugcugaugcaggacacccacaagcagcugcuggagagaggcuacagaagacccgugcugcugcugcacccccugggcggcuggaccaaggacgacgacgugccccugauguggagaaugaagcagcacgccgccgugcuggaggagggcgugcugaaccccgagaccaccgugguggccaucuuccccagccccaugauguacgccggccccaccgaggugcaguggcacugcagagccagaaugguggccggcgccaacuucuacaucgugggcagagaccccgccggcaugccccaccccgagaccggcaaggaccuguacgagcccagccacggcgccaaggugcugaccauggcccccggccugaucacccuggagaucgugcccuucagaguggccgccuacaacaagaagaagaagagaauggacuacuacgacagcgagcaccacgaggacuucgaguucaucagcggcaccagaaugagaaagcuggccagagagggccagaagccccccgagggcuucauggcccccaaggccuggaccgugcugaccgaguacuacaagagccuggagaaggccuaa

SEQ ID NO: 21177 - RNA, 1860 nt, Artificial Sequence
  PAPSS2__Homo_sapiens__NP_001015880
augagcggcaucaagaagcagaagaccgagaaccagcagaagagcaccaacgugguguaccaggcccaccacgugagcagaaacaagagaggccagguggugggcaccagaggcggcuucagaggcugcaccguguggcugaccggccugagcggcgccggcaagaccaccaucagcuucgcccuggaggaguaccuggugagccacgccauccccugcuacagccuggacggcgacaacgugagacacggccugaacagaaaccugggcuucagccccggcgacagagaggagaacaucagaagaaucgccgagguggccaagcuguucgccgacgccggccuggugugcaucaccagcuucaucagccccuucgccaaggacagagagaacgccagaaagauccacgagagcgccggccugcccuucuucgagaucuucguggacgccccccugaacaucugcgagagcagagacgugaagggccuguacaagagagccagagccggcgagaucaagggcuucaccggcaucgacagcgacuacgagaagcccgagacccccgagagagugcugaagaccaaccugagcaccgugagcgacugcgugcaccaggugguggagcugcugcaggagcagaacaucgugcccuacaccaucaucaaggacauccacgagcuguucgugcccgagaacaagcuggaccacgugagagccgaggccgagacccugcccagccugagcaucaccaagcuggaccugcagugggugcaggugcugagcgagggcugggccaccccccugaagggcuucaugagagagaaggaguaccugcaggugaugcacuucgacacccugcuggacggcauggcccugcccgacggcgugaucaacaugagcauccccaucgugcugcccgugagcgccgaggacaagaccagacuggagggcugcagcaaguucgugcuggcccacggcggcagaagaguggccauccugagagacgccgaguucuacgagcacagaaaggaggagagaugcagcagaguguggggcaccaccugcaccaagcacccccacaucaagauggugauggagagcggcgacuggcuggugggcggcgaccugcaggugcuggagaagaucagauggaacgacggccuggaccaguacagacugaccccccuggagcugaagcagaagugcaaggagaugaacgccgacgccguguucgccuuccagcugagaaaccccgugcacaacggccacgcccugcugaugcaggacaccagaagaagacugcuggagagaggcuacaagcaccccgugcugcugcugcacccccugggcggcuggaccaaggacgacgacgugccccuggacuggagaaugaagcagcacgccgccgugcuggaggagggcgugcuggaccccaagagcaccaucguggccaucuuccccagccccaugcuguacgccggccccaccgaggugcaguggcacugcagaagcagaaugaucgccggcgccaacuucuacaucgugggcagagaccccgccggcaugccccaccccgagaccaagaaggaccuguacgagcccacccacggcggcaaggugcugagcauggcccccggccugaccagcguggagaucauccccuucagaguggccgccuacaacaaggccaagaaggccauggacuucuacgaccccgccagacacaacgaguucgacuucaucagcggcaccagaaugagaaagcuggccagagagggcgagaacccccccgacggcuucauggcccccaaggccuggaaggugcugaccgacuacuacagaagccuggagaagaacuaa

SEQ ID NO: 21178 - RNA, 936 nt, Artificial Sequence
  PAQR3__Homo_sapiens__NP_001035292
augcaccagaagcugcugaagagcgcccacuacaucgagcugggcagcuaccaguacuggcccgugcuggugcccagaggcaucagacuguacaccuacgagcagauccccggcagccugaaggacaaccccuacaucaccgacggcuacagagccuaccugcccagcagacugugcaucaagagccuguucauccugagcaacgagaccgugaacaucuggagccaccugcugggcuucuuccuguucuucacccugggcaucuacgacaugaccagcgugcugcccagcgccagcgccagcagagaggacuucgugaucugcagcaucugccuguucugcuuccaggugugcaugcugugcagcgugggcuaccaccuguucagcugccacagaagcgagaagaccugcagaagauggauggcccuggacuacgccggcaucagcaucggcauccugggcugcuacgugagcggcguguucuacgccuucuacugcaacaacuacuggagacagguguaccugaucaccgugcuggccaugauccuggccguguucuucgcccagauccaccccaacuaccugacccagcaguggcagagacugagaagcaucaucuucugcagcgugagcggcuacggcgugauccccacccugcacuggguguggcugaacggcggcaucggcgcccccaucgugcaggacuucgcccccagagugaucgugauguacaugaucgcccugcuggccuuccuguucuacaucagcaaggugcccgagagauacuuccccggccagcugaacuaccugggcagcagccaccagaucuggcacauccuggccguggugaugcuguacugguggcaccagagcaccguguacgugaugcaguacagacacagcaagcccugccccgacuacgugagccaccuguaa

SEQ ID NO: 21179 - RNA, 993 nt, Artificial Sequence
  PAQR5__Homo_sapiens__NP_060175
augcugagccugaagcugcccagacuguucagcaucgaccagaucccccagguguuccacgagcagggcauccuguucggcuacagacacccccagagcagcgccaccgccugcauccugagccuguuccagaugaccaacgagacccugaacaucuggacccaccugcugcccuucugguucuucgccuggagauucgugaccgcccuguacaugaccgacaucaagaacgacagcuacagcuggcccaugcugguguacaugugcaccagcugcguguacccccuggugagcagcugcgcccacaccuucagcagcaugagcaagaacgccagacacaucugcuacuuccuggacuacggcgccgugaaccuguucagccugggcagcgccaucgccuacagcgccuacaccuuccccgacgcccugaugugcaccaccuuccacgacuacuacguggcccuggccgugcugaacaccauccugagcaccggccugagcugcuacagcagauuccuggagauccagaagcccagacugugcaaggugaucagagugcuggccuucgccuaccccuacaccugggacagccugcccaucuucuacagacuguuccuguuccccggcgagagcgcccagaacgaggccaccagcuaccaccagaagcacaugaucaugacccugcuggccagcuuccuguacagcgcccaccugcccgagagacuggcccccggcagauucgacuacaucggccacagccaccagcuguuccacgugugcgugauccuggccacccacaugcagauggaggccauccugcuggacaagacccugagaaaggaguggcugcuggccaccagcaagcccuucagcuucagccagaucgccggcgccauccugcugugcaucaucuucagccugagcaacaucaucuacuucagcgccgcccuguacagaauccccaagcccgagcugcacaagaaggagaccuaa

SEQ ID NO: 21180 - RNA, 1041 nt, Artificial Sequence
  PAQR7__Homo_sapiens__XP_011539164
auggccauggcccagaagcugagccaccugcugcccagccugagacaggugauccaggagccccagcugagccugcagcccgagcccguguucaccguggacagagccgaggugcccccccuguucuggaagcccuacaucuacgccggcuacagaccccugcaccagaccuggagauucuacuucagaacccuguuccagcagcacaacgaggccgugaacguguggacccaccugcuggccgcccuggugcugcugcugagacuggcccuguucguggagaccguggacuucuggggcgacccccacgcccugccccuguucaucaucgugcuggccagcuucaccuaccugagcuucagcgcccuggcccaccugcugcaggccaagagcgaguucuggcacuacagcuucuucuuccuggacuacgugggcguggccguguaccaguucggcagcgcccuggcccacuucuacuacgccaucgagcccgccuggcacgcccaggugcaggccguguuccugcccauggccgccuuccuggccuggcugagcugcaucggcagcugcuacaacaaguacauccagaagcccggccugcugggcagaaccugccaggaggugcccagcgugcuggccuacgcccuggacaucagccccguggugcacagaaucuucgugagcagcgaccccaccaccgacgaccccgcccugcuguaccacaagugccaggugguguucuuccugcuggccgccgccuucuucagcaccuucaugcccgagagaugguuccccggcagcugccacguguucggccagggccaccagcuguuccacaucuuccuggugcugugcacccuggcccagcuggaggccguggcccuggacuacgaggccagaagacccaucuacgagccccugcacacccacuggccccacaacuucagcggccuguuccugcugaccgugggcagcagcauccugaccgccuuccugcugagccagcuggugcagagaaagcuggaccagaagaccaaguaa

SEQ ID NO: 21181 - RNA, 3618 nt, Artificial Sequence
  PARD3B__Homo_sapiens__NP_001289698
augaaggugaccgugugcuucggcagaaccggcaucguggugcccugcaaggagggccagcugagagugggcgagcugacccagcaggcccugcagagauaccugaagaccagagagaagggccccggcuacugggugaagauccaccaccuggaguacaccgacggcggcauccuggaccccgacgacgugcuggccgacgugguggaggacaaggacaagcugaucgccguguucgaggagcaggagccccugcacaagaucgagagccccagcggcaaccccgccgacagacagagccccgacgccuucgagaccgagguggccgcccagcuggccgccuucaagcccaucggcggcgagaucgaggugacccccagcgcccugaagcugggcaccccccugcuggugagaagaagcagcgaccccgugcccggcccccccgccgacacccagcccagcgccagccaccccggcggccagagccugaagcugguggugcccgacagcacccagaaccuggaggacagagaggugcugaacggcgugcagaccgagcugcugaccagccccagaaccaaggacacccugagcgacaugaccagaaccguggagaucagcggcgagggcggcccccugggcauccacguggugcccuucuucagcagccugagcggcagaauccugggccuguucaucagaggcaucgaggacaacagcagaagcaagagagagggccuguuccacgagaacgagugcaucgugaagaucaacaacguggaccugguggacaagaccuucgcccaggcccaggacguguucagacaggccaugaagagccccagcgugcugcugcacgugcugcccccccagaacagagagcaguacgagaagagcgugaucggcagccugaacaucuucggcaacaacgacggcgugcugaagaccaaggugcccccccccgugcacggcaagagcggccugaagaccgccaaccugaccggcaccgacagccccgagaccgacgccagcgccagccugcagcagaacaagagccccagagugcccagacugggcggcaagcccagcagccccagccugagcccccugaugggcuucggcagcaacaagaacgccaagaagaucaagaucgaccugaagaagggccccgagggccugggcuucaccguggugaccagagacagcagcauccacggccccggccccaucuucgugaagaacauccugcccaagggcgccgccaucaaggacggcagacugcagagcggcgacagaauccuggaggugaacggcagagacgugaccggcagaacccaggaggagcugguggccaugcugagaagcaccaagcagggcgagaccgccagccuggugaucgccagacaggagggccacuuccugcccagagagcugaagggcgagcccgacugcugcgcccugagccuggagaccagcgagcagcugaccuucgagaucccccugaacgacagcggcagcgccggccugggcgugagccugaagggcaacaagagcagagagaccggcaccgaccugggcaucuucaucaagagcaucauccacggcggcgccgccuucaaggacggcagacugagaaugaacgaccagcugaucgccgugaacggcgagagccugcugggcaagagcaaccacgaggccauggagacccugagaagaagcaugagcauggagggcaacaucagaggcaugauccagcuggugauccugagaagacccgagagacccauggaggaccccgccgagugcggcgccuucagcaagcccugcuucgagaacugccagaacgccgugaccaccagcagaagaaacgacaacagcauccugcacccccugggcaccugcagcccccaggacaagcagaagggccugcugcugcccaacgacggcugggccgagagcgaggugccccccagccccaccccccacagcgcccugggccugggccuggaggacuacagccacagcagcggcguggacagcgccguguacuuccccgaccagcacaucaacuucagaagcgugacccccgccagacagcccgagagcaucaaccugaaggccagcaagagcauggaccuggugcccgacgagagcaaggugcacagccuggccggccagaagagcgagagccccagcaaggacuucggccccacccugggccugaagaagagcagcagccuggagagccugcagaccgccguggccgaggugagaaagaacgaccugcccuuccacagacccagaccccacauggugagaggcagaggcugcaacgagagcuucagagccgccaucgacaagagcuacgacggccccgaggagaucgaggccgacggccugagcgacaagagcagccacagcggccagggcgcccugaacugcgagagcgccccccagggcaacagcgagcuggaggacauggagaacaaggccagaaaggugaagaagaccaaggagaaggagaagaagaaggagaagggcaagcugaaggugaaggagaagaagagaaaggaggagaacgaggaccccgagagaaagaucaagaagaagggcuucggcgccaugcugagauucggcaagaagaaggaggacaagggcggcaaggccgagcagaagggcacccugaagcacggcggccugagagaggaggagcuggagaagaugaaggaggagagagagagaaucggcgccaagcaccaggagcugagagagaagcaggccagaggccugcuggacuacgccaccggcgccaucggcagcguguacgacauggacgacgacgagauggaccccaacuacgccagagugaaccacuucagagagcccugcaccagcgccaacguguucagaagccccagcccccccagagccggccccuucggcuaccccagagacggccacccccugagccccgagagagaccaccuggagggccuguacgccaaggugaacaagcccuaccacccccuggugcccgccgacagcggcagacccaccggcggcagcaccgacagaauccagaagcugagaaaggaguacuaccaggccagaagagagggcuucccccuguacgaggacgacgagggcagagccagacccagcgaguacgaccugcugugggugcccggcagaggccccgacggcaacgcccacaaccugagauucgagggcauggagagacaguacgccagccugcccagaggcggccccgccgaccccguggacuaccugcccgccgcccccagaggccuguacaaggagagagagcugcccuacuaccccggcgcccaccccaugcacccccccaagggcagcuaccccagacccaccgagcugagaguggccgaccugagauacccccagcacuacccccccccccccgccccccagcacaagggccccuucagacaggacgugccccccagccccccccagcaccagagaaugcccgccuaccaggagaccggcagacccggccccagaggcggcagccccgaccaguaccccuacagaacccaggacagcagacagaagaaccccaugaccgccgccguguaa

SEQ ID NO: 21182 - RNA, 4062 nt, Artificial Sequence
  PARD3__Homo_sapiens__NP_001171714
augaaggugaccgugugcuucggcagaaccagagugguggugcccugcggcgacggccacaugaagguguucagccugauccagcaggccgugaccagauacagaaaggccaucgccaaggaccccaacuacuggauccaggugcacagacuggagcacggcgacggcggcauccuggaccuggacgacauccugugcgacguggccgacgacaaggacagacugguggccguguucgacgagcaggacccccaccacggcggcgacggcaccagcgccagcagcaccggcacccagagccccgagaucuucggcagcgagcugggcaccaacaacgugagcgccuuccagcccuaccaggccaccagcgagaucgaggugacccccagcgugcugagagccaacaugccccugcacgugagaagaagcagcgaccccgcccugaucggccugagcaccagcgugagcgacagcaacuucagcagcgaggagcccagcagaaagaaccccaccagauggagcaccaccgccggcuuccugaagcagaacaccgccggcagccccaagaccugcgacagaaagaaggacgagaacuacagaagccugcccagagacaccagcaacuggagcaaccaguuccagagagacaacgccagaagcagccugagcgccagccaccccauggugggcaaguggcuggagaagcaggagcaggacgaggacggcaccgaggaggacaacagcagaguggagcccgugggccacgccgacaccggccuggagcacauccccaacuucagccuggacgacauggugaagcugguggaggugcccaacgacggcggcccccugggcauccacguggugcccuucagcgccagaggcggcagaacccugggccugcuggugaagagacuggagaagggcggcaaggccgagcacgagaaccuguucagagagaacgacugcaucgugagaaucaacgacggcgaccugagaaacagaagauucgagcaggcccagcacauguucagacaggccaugagaacccccaucaucugguuccacguggugcccgccgccaacaaggagcaguacgagcagcugagccagagcgagaagaacaacuacuacagcagcagauucagccccgacagccaguacaucgacaacagaagcgugaacagcgccggccugcacaccgugcagagagcccccagacugaaccacccccccgagcagaucgacagccacagcagacugccccacagcgcccaccccagcggcaagccccccagcgcccccgccagcgccccccagaacguguucagcaccaccgugagcagcggcuacaacaccaagaagaucggcaagagacugaacauccagcugaagaagggcaccgagggccugggcuucagcaucaccagcagagacgugaccaucggcggcagcgcccccaucuacgugaagaacauccugcccagaggcgccgccauccaggacggcagacugaaggccggcgacagacugaucgaggugaacggcguggaccuggugggcaagagccaggaggagguggugagccugcugagaagcaccaagauggagggcaccgugagccugcugguguucagacaggaggacgccuuccaccccagagagcugaacgccgagcccagccagaugcagauccccaaggagaccaaggccgaggacgaggacaucgugcugacccccgacggcaccagagaguuccugaccuucgaggugccccugaacgacagcggcagcgccggccugggcgugagcgugaagggcaacagaagcaaggagaaccacgccgaccugggcaucuucgugaagagcaucaucaacggcggcgccgccagcaaggacggcagacugagagugaacgaccagcugaucgccgugaacggcgagagccugcugggcaagaccaaccaggacgccauggagacccugagaagaagcaugagcaccgagggcaacaagagaggcaugauccagcugaucguggccagaagaaucagcaagugcaacgagcugaagagccccggcagcccccccggccccgagcugcccaucgagaccgcccuggacgacagagagagaagaaucagccacagccuguacagcggcaucgagggccuggacgagagccccagcagaaacgccgcccugagcagaaucaugggcaaguaccagcugagccccaccgugaacaugccccaggacgacaccgugaucaucgaggacgacagacugcccgugcugcccccccaccugagcgaccagagcagcagcagcagccacgacgacgugggcuucgugaccgccgacgccggcaccugggccaaggccgccaucagcgacagcgccgacugcagccugagccccgacguggaccccgugcuggccuuccagagagagggcuucggcagacagagcaugagcgagaagagaaccaagcaguucagcgacgccagccagcuggacuucgugaagaccagaaagagcaagagcauggaccugggcaucgccgacgagaccaagcugaacaccguggacgaccagaaggccggcagccccagcagagacgugggccccagccugggccugaagaagagcagcagccuggagagccugcagaccgccguggccgaggugacccugaacggcgacauccccuuccacagacccagacccagaaucaucagaggcagaggcugcaacgagagcuucagagccgccaucgacaagagcuacgacaagcccgccguggacgacgacgacgagggcauggagacccuggaggaggacaccgaggagagcagcagaagcggcagagagagcgugagcaccgccagcgaccagcccagccacagccuggagagacagaugaacggcaaccaggagaagggcgacaagaccgacagaaagaaggacaagaccggcaaggagaagaagaaggacagagacaaggagaaggacaagaugaaggccaagaagggcaugcugaagggccugggcgacauguucagauucggcaagcacagaaaggacgacaagaucgagaagaccggcaagaucaagauccaggagagcuucaccagcgaggaggagagaaucagaaugaagcaggagcaggagagaauccaggccaagaccagagaguucagagagagacaggccagagagagagacuacgccgagauccaggacuuccacagaaccuucggcugcgacgacgagcugauguacggcggcgugagcagcuacgagggcagcauggcccugaacgccagaccccagagccccagagagggccacaugauggacgcccuguacgcccaggugaagaagcccagaaacagcaagcccagccccguggacagcaacagaagcacccccagcaaccacgacagaauccagagacugagacaggaguuccagcaggccaagcaggacgaggacguggaggacagaagaagaaccuacagcuucgagcagcccuggcccaacgccagacccgccacccagagcggcagacacagcgugagcguggaggugcagaugcagagacagagacaggaggagagagagagcagccagcaggcccagagacaguacagcagccugcccagacagagcagaaagaacgccagcagcgugagccaggacagcugggagcagaacuacagccccggcgagggcuuccagagcgccaaggagaaccccagauacagcagcuaccagggcagcagaaacggcuaccugggcggccacggcuucaacgccagagugaugcuggagacccaggagcugcugagacaggagcagagaagaaaggagcagcagaugaagaagcagccccccagcgagggccccagcaacuacgacagcuacaagaaggugcaggaccccagcuacgccccccccaagggccccuucagacaggacgugccccccagccccagccagguggccagacugaacagacugcagacccccgagaagggcagacccuucuacagcuaa

SEQ ID NO: 21183 - RNA, 1038 nt, Artificial Sequence
  PARD6A__Homo_sapiens__NP_001032358
auggccagaccccagagaacccccgccagaagccccgacagcaucguggaggugaagagcaaguucgacgccgaguucagaagauucgcccugcccagagccagcgugagcggcuuccaggaguucagcagacugcugagagccgugcaccagauccccggccuggacgugcugcugggcuacaccgacgcccacggcgaccugcugccccugaccaacgacgacagccugcacagagcccuggccagcggcccccccccccugagacugcuggugcagaagagagaggccgacagcagcggccuggccuucgccagcaacagccugcagagaagaaagaagggccugcugcugagacccguggccccccugagaaccagacccccccugcugaucagccugccccaggacuucagacaggugagcagcgugaucgacguggaccugcugcccgagacccacagaagagugagacugcacaagcacggcagcgacagaccccugggcuucuacaucagagacggcaugagcgugagaguggccccccagggccuggagagagugcccggcaucuucaucagcagacuggugagaggcggccuggccgagagcaccggccugcuggccgugagcgacgagauccuggaggugaacggcaucgagguggccggcaagacccuggaccaggugaccgacaugaugguggccaacagccacaaccugaucgugaccgugaagcccgccaaccagagaaacaacguggugagaggcgccagcggcagacugaccggcccccccagcgccggccccggccccgccgagcccgacagcgacgacgacagcagcgaccuggugaucgagaacagacagccccccagcagcaacggccugagccagggcccccccugcugggaccugcaccccggcugcagacaccccggcaccagaagcagccugcccagccuggacgaccaggagcaggccagcagcggcuggggcagcagaaucagaggcgacggcagcggcuucagccuguaa

SEQ ID NO: 21184 - RNA, 1119 nt, Artificial Sequence
  PARD6B__Homo_sapiens__NP_115910
augaacagaagccacagacacggcgccggcagcggcugccugggcaccauggaggugaagagcaaguucggcgccgaguucagaagauucagccuggagagaagcaagcccggcaaguucgaggaguucuacggccugcugcagcacgugcacaagauccccaacguggacgugcuggugggcuacgccgacauccacggcgaccugcugcccaucaacaacgacgacaacuaccacaaggccgugagcaccgccaacccccugcugagaaucuucauccagaagaaggaggaggccgacuacagcgccuucggcaccgacacccugaucaagaagaagaacgugcugaccaacgugcugagacccgacaaccacagaaagaagccccacaucgugaucagcaugccccaggacuucagacccgugagcagcaucaucgacguggacauccugcccgagacccacagaagagugagacuguacaaguacggcaccgagaagccccugggcuucuacaucagagacggcagcagcgugagagugaccccccacggccuggagaaggugcccggcaucuucaucagcagacuggugcccggcggccuggcccagagcaccggccugcuggccgugaacgacgaggugcuggaggugaacggcaucgaggugagcggcaagagccuggaccaggugaccgacaugaugaucgccaacagcagaaaccugaucaucaccgugagacccgccaaccagagaaacaacguggugagaaacagcagaaccagcggcagcagcggccagagcaccgacaacagccugcugggcuacccccagcagaucgagcccagcuucgagcccgaggacgaggacagcgaggaggacgacaucaucaucgaggacaacggcgugccccagcagauccccaaggccgugcccaacaccgagagccuggagagccugacccagaucgagcugagcuucgagagcggccagaacggcuucauccccagcaacgaggugagccuggccgccaucgccagcagcagcaacaccgaguucgagacccacgcccccgaccagaagcugcuggaggaggacggcaccaucaucacccuguaa

SEQ ID NO: 21185 - RNA, 2685 nt, Artificial Sequence
  PARG__Homo_sapiens__NP_001290415
auggacaccaagggcaucaagaccgccgagagcgagagccuggacagcaaggagaacaacaacaccagaaucgagagcaugaugagcagcgugcagaaggacaacuucuaccagcacaacguggagaagcuggagaacgugagccagcugagccuggacaagagccccaccgagaagagcacccaguaccugaaccagcaccagaccgccgccaugugcaaguggcagaacgagggcaagcacaccgagcagcugcuggagagcgagccccagaccgugacccuggugcccgagcaguucagcaacgccaacaucgacagaagcccccagaacgacgaccacagcgacaccgacagcgaggagaacagagacaaccagcaguuccugaccaccgugaagcuggccaacgccaagcagaccaccgaggacgagcaggccagagaggccaagagccaccagaagugcagcaagagcugcgaccccggcgaggacugcgccagcugccagcaggacgagaucgacguggugcccgagagcccccugagcgacgugggcagcgaggacgugggcaccggccccaagaacgacaacaagcugaccagacaggagagcugccugggcaacagcccccccuucgagaaggagagcgagcccgagagccccauggacguggacaacagcaagaacagcugccaggacagcgaggccgacgaggagaccagccccggcuucgacgagcaggaggacggcagcagcagccagaccgccaacaagcccagcagauuccaggccagagacgccgacaucgaguucagaaagagauacagcaccaagggcggcgaggugagacugcacuuccaguucgagggcggcgagagcagaaccggcaugaacgaccugaacgccaagcugcccggcaacaucagcagccugaacguggagugcagaaacagcaagcagcacggcaagaaggacagcaagaucaccgaccacuucaugagacugcccaaggccgaggacagaagaaaggagcagugggagaccaagcaccagagaaccgagagaaagauccccaaguacgugcccccccaccugagccccgacaagaaguggcugggcacccccaucgaggagaugagaagaaugcccagaugcggcaucagacugccccugcugagacccagcgccaaccacaccgugaccaucagaguggaccugcugagagccggcgaggugcccaagcccuuccccacccacuacaaggaccugugggacaacaagcacgugaagaugcccugcagcgagcagaaccuguaccccguggaggacgagaacggcgagagaaccgccggcagcagaugggagcugauccagaccgcccugcugaacaaguucaccagaccccagaaccugaaggacgccauccugaaguacaacguggccuacagcaagaagugggacuucaccgcccugaucgacuucugggacaaggugcuggaggaggccgaggcccagcaccuguaccagagcauccugcccgacauggugaagaucgcccugugccugcccaacaucugcacccagcccaucccccugcugaagcagaagaugaaccacagcaucaccaugagccaggagcagaucgccagccugcuggccaacgccuucuucugcaccuuccccagaagaaacgccaagaugaagagcgaguacagcagcuaccccgacaucaacuucaacagacuguucgagggcagaagcagcagaaagcccgagaagcugaagacccuguucugcuacuucagaagagugaccgagaagaagcccaccggccuggugaccuucaccagacagagccuggaggacuuccccgagugggagagaugcgagaagccccugaccagacugcacgugaccuacgagggcaccaucgaggagaacggccagggcaugcugcagguggacuucgccaacagauucgugggcggcggcgugaccagcgccggccuggugcaggaggagaucagauuccugaucaaccccgagcugaucaucagcagacuguucaccgaggugcuggaccacaacgagugccugaucaucaccggcaccgagcaguacagcgaguacaccggcuacgccgagaccuacagauggagcagaagccacgaggacggcagcgagagagacgacuggcagagaagaugcaccgagaucguggccaucgacgcccugcacuucagaagauaccuggaccaguucgugcccgagaagaugagaagagagcugaacaaggccuacugcggcuuccugagacccggcgugagcagcgagaaccugagcgccguggccaccggcaacuggggcugcggcgccuucggcggcgacgccagacugaaggcccugauccagauccuggccgccgccgccgccgagagagacgugguguacuucaccuucggcgacagcgagcugaugagagacaucuacagcaugcacaucuuccugaccgagagaaagcugaccgugggcgacguguacaagcugcugcugagauacuacaacgaggagugcagaaacugcagcacccccggccccgacaucaagcuguaccccuucaucuaccacgccguggagagcugcgccgagaccgccgaccacagcggccagagaaccggcaccuaa

SEQ ID NO: 21186 - RNA, 1398 nt, Artificial Sequence
  PARK2__Homo_sapiens__NP_004553
augaucguguucgugagauucaacagcagccacggcuuccccguggagguggacagcgacaccagcaucuuccagcugaaggaggugguggccaagagacagggcgugcccgccgaccagcugagagugaucuucgccggcaaggagcugagaaacgacuggaccgugcagaacugcgaccuggaccagcagagcaucgugcacaucgugcagagacccuggagaaagggccaggagaugaacgccaccggcggcgacgaccccagaaacgccgccggcggcugcgagagagagccccagagccugaccagaguggaccugagcagcagcgugcugcccggcgacagcgugggccuggccgugauccugcacaccgacagcagaaaggacagcccccccgccggcagccccgccggcagaagcaucuacaacagcuucuacguguacugcaagggccccugccagagagugcagcccggcaagcugagagugcagugcagcaccugcagacaggccacccugacccugacccagggccccagcugcugggacgacgugcugauccccaacagaaugagcggcgagugccagagcccccacugccccggcaccagcgccgaguucuucuucaagugcggcgcccaccccaccagcgacaaggagaccagcguggcccugcaccugaucgccaccaacagcagaaacaucaccugcaucaccugcaccgacgugagaagccccgugcugguguuccagugcaacagcagacacgugaucugccuggacugcuuccaccuguacugcgugaccagacugaacgacagacaguucgugcacgacccccagcugggcuacagccugcccugcguggccggcugccccaacagccugaucaaggagcugcaccacuucagaauccugggcgaggagcaguacaacagauaccagcaguacggcgccgaggagugcgugcugcagaugggcggcgugcugugccccagacccggcugcggcgccggccugcugcccgagcccgaccagagaaaggugaccugcgagggcggcaacggccugggcugcggcuucgccuucugcagagagugcaaggaggccuaccacgagggcgagugcagcgccguguucgaggccagcggcaccaccacccaggccuacagaguggacgagagagccgccgagcaggccagaugggaggccgccagcaaggagaccaucaagaagaccaccaagcccugccccagaugccacgugcccguggagaagaacggcggcugcaugcacaugaagugcccccagccccagugcagacuggaguggugcuggaacugcggcugcgaguggaacagagugugcaugggcgaccacugguucgacguguaa

SEQ ID NO: 21187 - RNA, 990 nt, Artificial Sequence
  PARL__Homo_sapiens__NP_001032728
auggccuggagaggcugggcccagagaggcuggggcugcggccaggccuggggcgccagcgugggcggcagaagcugcgaggagcugaccgccgugcugacccccccccagcugcugggcagaagauucaacuucuucauccagcagaagugcggcuucagaaaggcccccagaaagguggagcccagaagaagcgaccccggcaccagcggcgaggccuacaagagaagcgcccugaucccccccguggaggagaccguguucuaccccagccccuaccccaucagaagccugaucaagccccuguucuucaccgugggcuucaccggcugcgccuucggcagcgccgccaucuggcaguacgagagccugaagagcagagugcagagcuacuucgacggcaucaaggccgacuggcuggacagcaucagaccccagaaggagggcgacuucagaaaggagaucaacaagugguggaacaaccugagcgacggccagagaaccgugaccggcaucaucgccgccaacgugcugguguucugccuguggagagugcccagccugcagagaaccaugaucagauacuucaccagcaaccccgccagcagcgugaucagcaacuucgugagcuacgugggcaagguggccaccggcagauacggccccagccugggcgccagcggcgccaucaugaccgugcuggccgccgugugcaccaagauccccgagggcagacuggccaucaucuuccugcccauguucaccuucaccgccggcaacgcccugaaggccaucaucgccauggacaccgccggcaugauccugggcuggaaguucuucgaccacgccgcccaccugggcggcgcccuguucggcaucugguacgugaccuacggccacgagcugaucuggaagaacagagagccccuggugaagaucuggcacgagaucagaaccaacggccccaagaagggcggcggcagcaaguaa

SEQ ID NO: 21188 - RNA, 933 nt, Artificial Sequence
  PARM1__Homo_sapiens__NP_056208
augguguacaagacccuguucgcccugugcauccugaccgccggcuggagagugcagagccugcccaccagcgccccccugagcgugagccugcccaccaacaucgugccccccaccaccaucuggaccagcagcccccagaacaccgacgccgacaccgccagccccagcaacggcacccacaacaacagcgugcugcccgugaccgccagcgcccccaccagccugcugcccaagaacaucagcaucgagagcagagaggaggagaucaccagccccggcagcaacugggagggcaccaacaccgaccccagccccagcggcuucagcagcaccagcggcggcgugcaccugaccaccacccuggaggagcacagcagcggcacccccgaggccggcguggccgccacccugagccagagcgccgccgagccccccacccugaucagcccccaggcccccgccagcagccccagcagccugagcaccagcccccccgagguguucagcgccagcgugaccaccaaccacagcagcaccgugaccagcacccagcccaccggcgcccccaccgcccccgagagccccaccgaggagagcagcagcgaccacacccccaccagccacgccaccgccgagcccgugccccaggagaagaccccccccaccaccgugagcggcaaggugaugugcgagcugaucgacauggagaccaccaccaccuuccccagagugaucaugcaggagguggagcacgcccugagcagcggcagcaucgccgccaucaccgugaccgugaucgccguggugcugcugguguucggcguggccgccuaccugaagaucagacacagcagcuacggcagacugcuggacgaccacgacuacggcagcuggggcaacuacaacaacccccuguacgacgacagcuaa

SEQ ID NO: 21189 - RNA, 1737 nt, Artificial Sequence
  PARN__Homo_sapiens__NP_001127949
auggacuuccugcuguuccaguucggccugugcaccuucaaguacgacuacaccgacagcaaguacaucaccaagagcuucaacuucuacguguuccccaagcccuucaacagaagcagccccgacgugaaguucgugugccagagcagcagcaucgacuuccuggccagccagggcuucgacuucaacaagguguucagaaacggcauccccuaccugaaccaggaggaggagagacagcugagagagcaguacgacgagaagagaagccaggccaacggcgccggcgcccugagcuacgugagccccaacaccagcaagugccccgugaccauccccgaggaccagaagaaguucaucgaccaggugguggagaagaucgaggaccugcugcagagcgaggagaacaagaaccuggaccuggagcccugcaccggcuuccagagaaagcugaucuaccagacccugagcuggaaguaccccaagggcauccacguggagacccuggagaccgagaagaaggagagauacaucgugaucagcaagguggacgaggaggagagaaagagaagagagcagcagaagcacgccaaggagcaggaggagcugaacgacgccgugggcuucagcagagugauccacgccaucgccaacagcggcaagcuggugaucggccacaacaugcugcuggacgugaugcacaccgugcaccaguucuacugcccccugcccgccgaccugagcgaguucaaggagaugaccaccugcguguuccccagacugcuggacaccaagcugauggccagcacccagcccuucaaggacaucaucaacaacaccagccuggccgagcuggagaagagacugaaggagacccccuucaacccccccaagguggagagcgccgagggcuuccccagcuacgacaccgccagcgagcagcugcacgaggccggcuacgacgccuacaucaccggccugugcuucaucagcauggccaacuaccugggcagcuuccugagcccccccaagauccacgugagcgccagaagcaagcugaucgagcccuucuucaacaagcuguuccugaugagagugauggacauccccuaccugaaccuggagggccccgaccugcagcccaagagagaccacgugcugcacgugaccuuccccaaggaguggaagaccagcgaccuguaccagcuguucagcgccuucggcaacauccagaucagcuggaucgacgacaccagcgccuucgugagccugagccagcccgagcaggugaagaucgccgugaacaccagcaaguacgccgagagcuacagaauccagaccuacgccgaguacaugggcagaaagcaggaggagaagcagaucaagagaaaguggaccgaggacagcuggaaggaggccgacagcaagagacugaacccccagugcauccccuacacccugcagaaccacuacuacagaaacaacagcuucaccgcccccagcaccgugggcaagagaaaccugagccccagccaggaggaggccggccuggaggacggcgugagcggcgagaucagcgacaccgagcuggagcagaccgacagcugcgccgagccccugagcgagggcagaaagaaggccaagaagcugaagagaaugaagaaggagcugagccccgccggcagcaucagcaagaacagccccgccacccuguucgaggugcccgacaccugguaa

SEQ ID NO: 21190 - RNA, 2106 nt, Artificial Sequence
  PARP12__Homo_sapiens__NP_073587
auggcccaggccggcguggugggcgaggugacccaggugcugugcgccgccggcggcgcccuggagcugcccgagcugagaagaagacugagaaugggccugagcgccgacgcccuggagagacugcugagacagagaggcagauucgugguggccgugagagccggcggcgccgccgccgcccccgagagaguggugcuggccgccagcccccugagacugugcagagcccaccagggcagcaagcccggcugcgugggccugugcgcccagcugcaccugugcagauucaugguguacggcgccugcaaguuccugagagccggcaagaacugcagaaacagccacagccugaccaccgagcacaaccugagcgugcugagaacccacggcguggaccaccugagcuacaacgagcugugccagcugcuguuccagaacgaccccuggcugcugcccgagaucugccagcacuacaacaagggcgacggcccccacggcagcugcgccuuccagaagcagugcaucaagcugcacaucugccaguacuuccugcagggcgagugcaaguucggcaccagcugcaagagaagccacgacuucagcaacagcgagaaccuggagaagcuggagaagcugggcaugagcagcgaccuggugagcagacugcccaccaucuacagaaacgcccacgacaucaagaacaagagcagcgcccccagcagagugcccccccuguucgugccccagggcaccagcgagagaaaggacagcagcggcagcgugagccccaacacccugagccaggaggagggcgaccagaucugccuguaccacaucagaaagagcugcagcuuccaggacaagugccacagagugcacuuccaccugcccuacagauggcaguuccuggacagaggcaagugggaggaccuggacaacauggagcugaucgaggaggccuacugcaaccccaagaucgagagaauccugugcagcgagagcgccagcaccuuccacagccacugccugaacuucaacgccaugaccuacggcgccacccaggccagaagacugagcaccgccagcagcgugaccaagcccccccacuucauccugaccaccgacuggaucugguacuggagcgacgaguucggcagcuggcaggaguacggcagacagggcaccgugcaccccgugaccaccgugagcagcagcgacguggagaaggccuaccuggccuacugcacccccggcagcgacggccaggccgccacccugaaguuccaggccggcaagcacaacuacgagcuggacuucaaggccuucgugcagaagaaccugguguacggcaccaccaagaaggugugcagaagacccaaguacgugagcccccaggacgugaccaccaugcagaccugcaacaccaaguuccccggccccaagagcauccccgacuacugggacagcagcgcccugcccgaccccggcuuccagaagaucacccugagcagcagcagcgaggaguaccagaagguguggaaccuguucaacagaacccugcccuucuacuucgugcagaagaucgagagagugcagaaccuggcccugugggagguguaccaguggcagaagggccagaugcagaagcagaacggcggcaaggccguggacgagagacagcuguuccacggcaccagcgccaucuucguggacgccaucugccagcagaacuucgacuggagagugugcggcgugcacggcaccagcuacggcaagggcagcuacuucgccagagacgccgccuacagccaccacuacagcaagagcgacacccagacccacaccauguuccuggccagagugcuggugggcgaguucgugagaggcaacgccagcuucgugagaccccccgccaaggagggcuggagcaacgccuucuacgacagcugcgugaacagcgugagcgaccccagcaucuucgugaucuucgagaagcaccagguguaccccgaguacgugauccaguacaccaccagcagcaagcccagcgugacccccagcauccugcuggcccugggcagccuguucagcagcagacaguaa

SEQ ID NO: 21191 - RNA, 5406 nt, Artificial Sequence
  PARP14__Homo_sapiens__NP_060024
auggccgugcccggcagcuucccccugcugguggagggcagcuggggccccgacccccccaagaaccugaacaccaagcugcagauguacuuccagagccccaagagaagcggcggcggcgagugcgaggugagacaggaccccagaagccccagcagauuccugguguucuucuaccccgaggacgugagacagaaggugcuggagagaaagaaccacgagcugguguggcagggcaagggcaccuucaagcugaccgugcagcugcccgccacccccgacgagaucgaccacguguucgaggaggagcugcugaccaaggagagcaagaccaaggaggacgugaaggagcccgacgugagcgaggagcuggacaccaagcugccccuggacggcggccuggacaagauggaggacauccccgaggagugcgagaacaucagcagccugguggccuucgagaaccugaaggccaacgugaccgacaucaugcugauccugcugguggagaacaucagcggccugagcaacgacgacuuccagguggagaucaucagagacuucgacguggccguggugaccuuccagaagcacaucgacaccaucagauucguggacgacugcaccaagcaccacagcaucaagcagcugcagcugagccccagacugcuggaggugaccaacaccaucagaguggagaaccugccccccggcgccgacgacuacagccugaagcuguucuucgagaaccccuacaacggcggcggcagaguggccaacguggaguacuuccccgaggagagcagcgcccugaucgaguucuucgacagaaaggugcuggacaccaucauggccaccaagcuggacuucaacaagaugccccugagcguguuccccuacuacgccagccugggcaccgcccuguacggcaaggagaagccccugaucaagcugcccgcccccuucgaggagagccuggaccugccccuguggaaguuccugcagaagaagaaccaccugaucgaggagaucaacgacgagaugagaagaugccacugcgagcugaccuggagccagcugagcggcaaggugaccaucagacccgccgccacccuggugaacgagggcagacccagaaucaagaccuggcaggccgacaccagcaccacccugagcagcaucagaagcaaguacaaggugaaccccaucaagguggaccccaccaugugggacaccaucaagaacgacgugaaggacgacagaauccugaucgaguucgacacccugaaggagauggugauccuggccggcaagagcgaggacgugcagagcaucgaggugcaggugagagagcugaucgagagcaccacccagaagaucaagagagaggagcagagccugaaggagaagaugaucaucagccccggcagauacuuccugcugugccacagcagccugcuggaccaccugcugaccgagugccccgagaucgagaucugcuacgacagagugacccagcaccugugccugaagggccccagcgccgacguguacaaggccaagugcgagauccaggagaagguguacaccauggcccagaagaacauccaggugagccccgagaucuuccaguuccugcagcaggugaacuggaaggaguucagcaagugccuguucaucgcccagaagauccuggcccuguacgagcuggagggcaccaccgugcugcugaccagcugcagcagcgaggcccugcuggaggccgagaagcagaugcugagcgcccugaacuacaagagaaucgagguggagaacaaggaggugcugcacggcaagaaguggaagggccugacccacaaccugcugaagaagcagaacagcagccccaacaccgugaucaucaacgagcugaccagcgagaccaccgccgaggugaucaucaccggcugcgugaaggaggugaacgagaccuacaagcugcuguucaacuucguggagcagaacaugaagaucgagagacugguggaggugaagcccagccuggugaucgacuaccugaagaccgagaagaagcuguucuggcccaagaucaagaaggugaacgugcaggugagcuucaaccccgagaacaagcagaagggcauccugcugaccggcagcaagaccgaggugcugaaggccguggacaucgugaagcaggugugggacagcgugugcgugaagagcgugcacaccgacaagcccggcgccaagcaguucuuccaggacaaggccagauucuaccagagcgagaucaagagacuguucggcugcuacaucgagcugcaggagaacgaggugaugaaggagggcggcagccccgccggccagaagugcuucagcagaaccgugcuggcccccggcguggugcugaucgugcagcagggcgaccuggccagacugcccguggacgugguggugaacgccagcaacgaggaccugaagcacuacggcggccuggccgccgcccugagcaaggccgccggccccgagcugcaggccgacugcgaccagaucgugaagagagagggcagacugcugcccggcaacgccaccaucagcaaggccggcaagcugcccuaccaccacgugauccacgccgugggccccagauggagcggcuacgaggcccccagaugcguguaccugcugagaagagccgugcagcugagccugugccuggccgagaaguacaaguacagaagcaucgccauccccgccaucagcagcggcguguucggcuucccccugggcagaugcguggagaccaucgugagcgccaucaaggagaacuuccaguucaagaaggacggccacugccugaaggagaucuaccugguggacgugagcgagaagaccguggaggccuucgccgaggccgugaagaccguguucaaggccacccugcccgacaccgccgccccccccggccugccccccgccgccgccggccccggcaagaccagcugggagaagggcagccuggugagccccggcggccugcagaugcugcuggugaaggagggcgugcagaacgccaagaccgacgugguggugaacagcgugccccuggaccuggugcugagcagaggcccccugagcaagagccugcuggagaaggccggccccgagcugcaggaggagcuggacaccgugggccagggcguggccgugagcaugggcaccgugcugaagaccagcagcuggaaccuggacugcagauacgugcugcacgugguggcccccgaguggagaaacggcagcaccagcagccugaagaucauggaggacaucaucagagagugcauggagaucaccgagagccugagccugaagagcaucgccuuccccgccaucggcaccggcaaccugggcuuccccaagaacaucuucgccgagcugaucaucagcgagguguucaaguucagcagcaagaaccagcugaagacccugcaggaggugcacuuccugcugcaccccagcgaccacgagaacauccaggccuucagcgacgaguucgccagaagagccaacggcaaccuggugagcgacaagauccccaaggccaaggacacccagggcuucuacggcaccgugagcagccccgacagcggcguguacgagaugaagaucggcagcaucaucuuccagguggccagcggcgacaucaccaaggaggaggccgacgugaucgugaacagcaccagcaacagcuucaaccugaaggccggcgugagcaaggccauccuggagugcgccggccagaacguggagagagagugcagccagcaggcccagcagagaaagaacgacuacaucaucaccggcggcggcuuccugagaugcaagaacaucauccacgugaucggcggcaacgacgugaagagcagcgugagcagcgugcugcaggagugcgagaagaagaacuacagcagcaucugccugcccgccaucggcaccggcaacgccaagcagcaccccgacaagguggccgaggccaucaucgacgccaucgaggacuucgugcagaagggcagcgcccagagcgugaagaaggugaagguggugaucuuccugccccaggugcuggacguguucuacgccaacaugaagaagagagagggcacccagcugagcagccagcagagcgugaugagcaagcuggccagcuuccugggcuucagcaagcagagcccccagaagaagaaccaccuggugcuggagaagaagaccgagagcgccaccuucagagugugcggcgagaacgugaccugcguggaguacgccaucagcuggcugcaggaccugaucgagaaggagcagugccccuacaccagcgaggacgagugcaucaaggacuucgacgagaaggaguaccaggagcugaacgagcugcagaagaagcugaacaucaacaucagccuggaccacaagagaccccugaucaaggugcugggcaucagcagagacgugaugcaggccagagacgagaucgaggccaugaucaagagagugagacuggccaaggagcaggagagcagagccgacugcaucagcgaguucaucgaguggcaguacaacgacaacaacaccagccacugcuucaacaagaugaccaaccugaagcuggaggacgccagaagagagaagaagaagaccguggacgugaagaucaaccacagacacuacaccgugaaccugaacaccuacaccgccaccgacaccaagggccacagccugagcgugcagagacugaccaagagcaagguggacauccccgcccacuggagcgacaugaagcagcagaacuucugcgugguggagcugcugcccagcgaccccgaguacaacaccguggccagcaaguucaaccagaccugcagccacuucagaaucgagaagaucgagagaauccagaaccccgaccuguggaacagcuaccaggccaagaagaagaccauggacgccaagaacggccagaccaugaacgagaagcagcuguuccacggcaccgacgccggcagcgugccccacgugaacagaaacggcuucaacagaagcuacgccggcaagaacgccguggccuacggcaagggcaccuacuucgccgugaacgccaacuacagcgccaacgacaccuacagcagacccgacgccaacggcagaaagcacguguacuacgugagagugcugaccggcaucuacacccacggcaaccacagccugaucgugccccccagcaagaacccccagaaccccaccgaccuguacgacaccgugaccgacaacgugcaccaccccagccuguucguggccuucuacgacuaccaggccuaccccgaguaccugaucaccuucagaaaguaa

SEQ ID NO: 21192 - RNA, 2037 nt, Artificial Sequence
  PARP15__Homo_sapiens__NP_001106995
auggccgcccccggcccccugcccgccgccgcccugagccccggcgcccccacccccagagagcugaugcacggcguggccggcgugaccagcagagccggcagagacagagaggccggcagcgugcugcccgccggcaacagaggcgccagaaaggccagcagaagaagcagcagcagaagcaugagcagagacaacaaguucagcaagaaggacugccugagcaucagaaacgugguggccagcauccagaccaaggagggccugaaccugaagcugaucagcggcgacgugcuguacaucugggccgacgugaucgugaacagcgugcccaugaaccugcagcugggcggcggcccccugagcagagccuuccugcagaaggccggccccaugcugcagaaggagcuggacgacagaagaagagagaccgaggagaaggugggcaacaucuucaugaccagcggcugcaaccuggacugcaaggccgugcugcacgccguggcccccuacuggaacaacggcgccgagaccagcuggcagaucauggccaacaucaucaagaagugccugaccaccguggaggugcugagcuucagcagcaucaccuuccccaugaucggcaccggcagccugcaguuccccaaggccguguucgccaagcugauccugagcgagguguucgaguacagcagcagcaccagacccaucaccagcccccugcaggaggugcacuuccugguguacaccaacgacgacgagggcugccaggccuuccuggacgaguucaccaacuggagcagaaucaaccccaacaaggccagaauccccauggccggcgacacccagggcguggugggcaccgugagcaagcccugcuucaccgccuacgagaugaagaucggcgccaucaccuuccagguggccaccggcgacaucgccaccgagcagguggacgugaucgugaacagcaccgccagaaccuucaacagaaagagcggcgugagcagagccauccuggagggcgccggccaggccguggagagcgagugcgccgugcuggccgcccagccccacagagacuucaucaucacccccggcggcugccugaagugcaagaucaucauccacgugcccggcggcaaggacgugagaaagaccgugaccagcgugcuggaggagugcgagcagagaaaguacaccagcgugagccugcccgccaucggcaccggcaacgccggcaagaaccccaucaccguggccgacaacaucaucgacgccaucguggacuucagcagccagcacagcacccccagccugaagaccgugaagguggugaucuuccagcccgagcugcugaacaucuucuacgacagcaugaagaagagagaccugagcgccagccugaacuuccagagcaccuucagcaugaccaccugcaaccugcccgagcacuggaccgacaugaaccaccagcuguucugcauggugcagcuggagcccggccagagcgaguacaacaccaucaaggacaaguucaccagaaccugcagcagcuacgccaucgagaagaucgagagaauccagaacgccuuccuguggcagagcuaccaggugaagaagagacagauggacaucaagaacgaccacaagaacaacgagagacugcuguuccacggcaccgacgccgacagcgugcccuacgugaaccagcacggcuucaacagaagcugcgccggcaagaacgccgugagcuacggcaagggcaccuacuucgccguggacgccagcuacagcgccaaggacaccuacagcaagcccgacagcaacggcagaaagcacauguacguggugagagugcugaccggcguguucaccaagggcagagccggccuggugacccccccccccaagaacccccacaaccccaccgaccuguucgacagcgugaccaacaacaccagaagccccaagcuguucgugguguucuucgacaaccaggccuaccccgaguaccugaucaccuucaccgccuaa

SEQ ID NO: 21193 - RNA, 3045 nt, Artificial Sequence
  PARP1__Homo_sapiens__NP_001609
auggccgagagcagcgacaagcuguacagaguggaguacgccaagagcggcagagccagcugcaagaagugcagcgagagcauccccaaggacagccugagaauggccaucauggugcagagccccauguucgacggcaaggugccccacugguaccacuucagcugcuucuggaaggugggccacagcaucagacaccccgacguggagguggacggcuucagcgagcugagaugggacgaccagcagaaggugaagaagaccgccgaggccggcggcgugaccggcaagggccaggacggcaucggcagcaaggccgagaagacccugggcgacuucgccgccgaguacgccaagagcaacagaagcaccugcaagggcugcauggagaagaucgagaagggccaggugagacugagcaagaagaugguggaccccgagaagccccagcugggcaugaucgacagaugguaccaccccggcugcuucgugaagaacagagaggagcugggcuucagacccgaguacagcgccagccagcugaagggcuucagccugcuggccaccgaggacaaggaggcccugaagaagcagcugcccggcgugaagagcgagggcaagagaaagggcgacgagguggacggcguggacgagguggccaagaagaagagcaagaaggagaaggacaaggacagcaagcuggagaaggcccugaaggcccagaacgaccugaucuggaacaucaaggacgagcugaagaaggugugcagcaccaacgaccugaaggagcugcugaucuucaacaagcagcaggugcccagcggcgagagcgccauccuggacagaguggccgacggcaugguguucggcgcccugcugcccugcgaggagugcagcggccagcugguguucaagagcgacgccuacuacugcaccggcgacgugaccgccuggaccaagugcauggugaagacccagacccccaacagaaaggagugggugacccccaaggaguucagagagaucagcuaccugaagaagcugaaggugaagaagcaggacagaaucuucccccccgagaccagcgccagcguggccgccacccccccccccagcaccgccagcgcccccgccgccgugaacagcagcgccagcgccgacaagccccugagcaacaugaagauccugacccugggcaagcugagcagaaacaaggacgaggugaaggccaugaucgagaagcugggcggcaagcugaccggcaccgccaacaaggccagccugugcaucagcaccaagaaggagguggagaagaugaacaagaagauggaggaggugaaggaggccaacaucagaguggugagcgaggacuuccugcaggacgugagcgccagcaccaagagccugcaggagcuguuccuggcccacauccugagccccuggggcgccgaggugaaggccgagcccguggaggugguggcccccagaggcaagagcggcgccgcccugagcaagaagagcaagggccaggugaaggaggagggcaucaacaagagcgagaagagaaugaagcugacccugaagggcggcgccgccguggaccccgacagcggccuggagcacagcgcccacgugcuggagaagggcggcaagguguucagcgccacccugggccugguggacaucgugaagggcaccaacagcuacuacaagcugcagcugcuggaggacgacaaggagaacagauacuggaucuucagaagcuggggcagagugggcaccgugaucggcagcaacaagcuggagcagaugcccagcaaggaggacgccaucgagcacuucaugaagcuguacgaggagaagaccggcaacgccuggcacagcaagaacuucaccaaguaccccaagaaguucuacccccuggagaucgacuacggccaggacgaggaggccgugaagaagcugaccgugaaccccggcaccaagagcaagcugcccaagcccgugcaggaccugaucaagaugaucuucgacguggagagcaugaagaaggccaugguggaguacgagaucgaccugcagaagaugccccugggcaagcugagcaagagacagauccaggccgccuacagcauccugagcgaggugcagcaggccgugagccagggcagcagcgacagccagauccuggaccugagcaacagauucuacacccugaucccccacgacuucggcaugaagaagcccccccugcugaacaacgccgacagcgugcaggccaagguggagaugcuggacaaccugcuggacaucgagguggccuacagccugcugagaggcggcagcgacgacagcagcaaggaccccaucgacgugaacuacgagaagcugaagaccgacaucaaggugguggacagagacagcgaggaggccgagaucaucagaaaguacgugaagaacacccacgccaccacccacaacgccuacgaccuggaggugaucgacaucuucaagaucgagagagagggcgagugccagagauacaagcccuucaagcagcugcacaacagaagacugcuguggcacggcagcagaaccaccaacuucgccggcauccugagccagggccugagaaucgccccccccgaggcccccgugaccggcuacauguucggcaagggcaucuacuucgccgacauggugagcaagagcgccaacuacugccacaccagccagggcgaccccaucggccugauccugcugggcgagguggcccugggcaacauguacgagcugaagcacgccagccacaucagcaagcugcccaagggcaagcacagcgugaagggccugggcaagaccacccccgaccccagcgccaacaucagccuggacggcguggacgugccccugggcaccggcaucagcagcggcgugaacgacaccagccugcuguacaacgaguacaucguguacgacaucgcccaggugaaccugaaguaccugcugaagcugaaguucaacuucaagaccagccugugguaa

SEQ ID NO: 21194 - RNA, 1713 nt, Artificial Sequence
  PARP2__Homo_sapiens__NP_001036083
auggccgccagaagaagaagaagcaccggcggcggcagagccagagcccugaacgagagcaagagagugaacaacggcaacaccgcccccgaggacagcagccccgccaagaagaccagaagaugccagagacaggagagcaagaagaugcccguggccggcggcaaggccaacaaggacagaaccgaggacaagcaggacgagagcgugaaggcccugcugcugaagggcaaggcccccguggaccccgagugcaccgccaaggugggcaaggcccacguguacugcgagggcaacgacguguacgacgugaugcugaaccagaccaaccugcaguucaacaacaacaaguacuaccugauccagcugcuggaggacgacgcccagagaaacuucagcguguggaugagauggggcagagugggcaagaugggccagcacagccugguggccugcagcggcaaccugaacaaggccaaggagaucuuccagaagaaguuccuggacaagaccaagaacaacugggaggacagagagaaguucgagaaggugcccggcaaguacgacaugcugcagauggacuacgccaccaacacccaggacgaggaggagaccaagaaggaggagagccugaagagcccccugaagcccgagagccagcuggaccugagagugcaggagcugaucaagcugaucugcaacgugcaggccauggaggagaugaugauggagaugaaguacaacaccaagaaggccccccugggcaagcugaccguggcccagaucaaggccggcuaccagagccugaagaagaucgaggacugcaucagagccggccagcacggcagagcccugauggaggccugcaacgaguucuacaccagaaucccccacgacuucggccugagaacccccccccugaucagaacccagaaggagcugagcgagaagauccagcugcuggaggcccugggcgacaucgagaucgccaucaagcuggugaagaccgagcugcagagccccgagcacccccuggaccagcacuacagaaaccugcacugcgcccugagaccccuggaccacgagagcuacgaguucaaggugaucagccaguaccugcagagcacccacgcccccacccacagcgacuacaccaugacccugcuggaccuguucgagguggagaaggacggcgagaaggaggccuucagagaggaccugcacaacagaaugcugcuguggcacggcagcagaaugagcaacugggugggcauccugagccacggccugagaaucgccccccccgaggcccccaucaccggcuacauguucggcaagggcaucuacuucgccgacaugagcagcaagagcgccaacuacugcuucgccagcagacugaagaacaccggccugcugcugcugagcgagguggcccugggccagugcaacgagcugcuggaggccaaccccaaggccgagggccugcugcagggcaagcacagcaccaagggccugggcaagauggcccccagcagcgcccacuucgugacccugaacggcagcaccgugccccugggccccgccagcgacaccggcauccugaaccccgacggcuacacccugaacuacaacgaguacaucguguacaaccccaaccaggugagaaugagauaccugcugaaggugcaguucaacuuccugcagcugugguaa

SEQ ID NO: 21195 - RNA, 1623 nt, Artificial Sequence
  PARP3__Homo_sapiens__NP_001003931
augagccugcuguuccuggccauggcccccaagcccaagcccugggugcagaccgagggccccgagaagaagaagggcagacaggccggcagagaggaggaccccuucagaagcaccgccgaggcccugaaggccauccccgccgagaagagaaucaucagaguggaccccaccugcccccugagcagcaaccccggcacccagguguacgaggacuacaacugcacccugaaccagaccaacaucgagaacaacaacaacaaguucuacaucauccagcugcugcaggacagcaacagauucuucaccugcuggaacagauggggcagagugggcgaggugggccagagcaagaucaaccacuucaccagacuggaggacgccaagaaggacuucgagaagaaguucagagagaagaccaagaacaacugggccgagagagaccacuucgugagccaccccggcaaguacacccugaucgaggugcaggccgaggacgaggcccaggaggccguggugaagguggacagaggccccgugagaaccgugaccaagagagugcagcccugcagccuggaccccgccacccagaagcugaucaccaacaucuucagcaaggagauguucaagaacaccauggcccugauggaccuggacgugaagaagaugccccugggcaagcugagcaagcagcagaucgccagaggcuucgaggcccuggaggcccuggaggaggcccugaagggccccaccgacggcggccagagccuggaggagcugagcagccacuucuacaccgugaucccccacaacuucggccacagccagcccccccccaucaacagccccgagcugcugcaggccaagaaggacaugcugcuggugcuggccgacaucgagcuggcccaggcccugcaggccgugagcgagcaggagaagaccguggaggaggugccccacccccuggacagagacuaccagcugcugaagugccagcugcagcugcuggacagcggcgcccccgaguacaaggugauccagaccuaccuggagcagaccggcagcaaccacagaugccccacccugcagcacaucuggaaggugaaccaggagggcgaggaggacagauuccaggcccacagcaagcugggcaacagaaagcugcuguggcacggcaccaacauggccgugguggccgccauccugaccagcggccugagaaucaugccccacagcggcggcagagugggcaagggcaucuacuucgccagcgagaacagcaagagcgccggcuacgugaucggcaugaagugcggcgcccaccacgugggcuacauguuccugggcgagguggcccugggcagagagcaccacaucaacaccgacaaccccagccugaagagccccccccccggcuucgacagcgugaucgccagaggccacaccgagcccgaccccacccaggacaccgagcuggagcuggacggccagcaggugguggugccccagggccagcccgugcccugccccgaguucagcagcagcaccuucagccagagcgaguaccugaucuaccaggagagccagugcagacugagauaccugcuggaggugcaccuguaa

SEQ ID NO: 21196 - RNA, 5175 nt, Artificial Sequence
  PARP4__Homo_sapiens__NP_006428
auggugaugggcaucuucgccaacugcaucuucugccugaaggugaaguaccugccccagcagcagaagaagaagcugcagaccgacaucaaggagaacggcggcaaguucagcuucagccugaacccccagugcacccacaucauccuggacaacgccgacgugcugagccaguaccagcugaacagcauccagaagaaccacgugcacaucgccaaccccgacuucaucuggaagagcaucagagagaagagacugcuggacgugaagaacuacgaccccuacaagccccuggacaucacccccccccccgaccagaaggccagcagcagcgaggugaagaccgagggccugugccccgacagcgccaccgaggaggaggacaccguggagcugaccgaguucggcaugcagaacguggagaucccccaccugccccaggacuucgagguggccaaguacaacacccuggagaaggugggcauggagggcggccaggaggccguggugguggagcugcagugcagcagagacagcagagacugccccuuccugaucagcagccacuuccugcuggacgacggcauggagaccagaagacaguucgccaucaagaagaccagcgaggacgccagcgaguacuucgagaacuacaucgaggagcugaagaagcagggcuuccugcugagagagcacuucacccccgaggccacccagcuggccagcgagcagcugcaggcccugcugcuggaggaggugaugaacagcagcacccugagccaggaggugagcgaccugguggagaugaucugggccgaggcccugggccaccuggagcacaugcugcugaagcccgugaacagaaucagccugaacgacgugagcaaggccgagggcauccugcugcuggugaaggccgcccugaagaacggcgagaccgccgagcagcugcagaagaugaugaccgaguucuacagacugaucccccacaagggcaccaugcccaaggaggugaaccugggccugcuggccaagaaggccgaccugugccagcugaucagagacauggugaacgugugcgagaccaaccugagcaagcccaacccccccagccuggccaaguacagagcccugagaugcaagaucgagcacguggagcagaacaccgaggaguuccugagagugagaaaggaggugcugcagaaccaccacagcaagagccccguggacgugcugcagaucuucagagugggcagagugaacgagaccaccgaguuccugagcaagcugggcaacgugagaccccugcugcacggcagccccgugcagaacaucgugggcauccugugcagaggccugcugcugcccaaggugguggaggacagaggcgugcagagaaccgacgugggcaaccugggcagcggcaucuacuucagcgacagccugagcaccagcaucaaguacagccaccccggcgagaccgacggcaccagacugcugcugaucugcgacguggcccugggcaagugcauggaccugcacgagaaggacuucagccugaccgaggccccccccggcuacgacagcgugcacggcgugagccagaccgccagcgugaccaccgacuucgaggacgacgaguucgugguguacaagaccaaccaggugaagaugaaguacaucaucaaguucagcaugcccggcgaccagaucaaggacuuccaccccagcgaccacaccgagcuggaggaguacagacccgaguucagcaacuucagcaagguggaggacuaccagcugcccgacgccaagaccagcagcagcaccaaggccggccugcaggacgccagcggcaaccuggugccccuggaggacgugcacaucaagggcagaaucaucgacaccguggcccaggugaucguguuccagaccuacaccaacaagagccacgugcccaucgaggccaaguacaucuucccccuggacgacaaggccgccgugugcggcuucgaggccuucaucaacggcaagcacaucgugggcgagaucaaggagaaggaggaggcccagcaggaguaccuggaggccgugacccagggccacggcgccuaccugaugagccaggacgcccccgacguguucaccgugagcgugggcaaccugccccccaaggccaaggugcugaucaagaucaccuacaucaccgagcugagcauccugggcaccgugggcguguucuucaugcccgccaccguggcccccuggcagcaggacaaggcccugaacgagaaccugcaggacaccguggagaagaucugcaucaaggagaucggcaccaagcagagcuucagccugaccaugagcaucgagaugcccuacgugaucgaguucaucuucagcgacacccacgagcugaagcagaagagaaccgacugcaaggccgugaucagcaccauggagggcagcagccuggacagcagcggcuucagccugcacaucggccugagcgccgccuaccugcccagaauguggguggagaagcaccccgagaaggagagcgaggccugcaugcugguguuccagcccgaccuggacguggaccugcccgaccuggccagcgagagcgaggugaucaucugccuggacugcagcagcagcauggagggcgugaccuuccugcaggccaagcagaucgcccugcacgcccugagccuggugggcgagaagcagaaggugaacaucauccaguucggcaccggcuacaaggagcuguucagcuaccccaagcacaucaccagcaacaccauggccgccgaguucaucaugagcgccacccccaccaugggcaacaccgacuucuggaagacccugagauaccugagccugcuguaccccgccagaggcagcagaaacauccugcuggugagcgacggccaccugcaggacgagagccugacccugcagcuggugaagagaagcagaccccacaccagacuguucgccugcggcaucggcagcaccgccaacagacacgugcugagaauccugagccagugcggcgccggcguguucgaguacuucaacgccaagagcaagcacagcuggagaaagcagaucgaggaccagaugaccagacugugcagccccagcugccacagcgugagcgugaaguggcagcagcugaaccccgacgugcccgaggcccugcaggcccccgcccaggugcccagccuguuccugaacgacagacugcugguguacggcuucaucccccacugcacccaggccacccugugcgcccugauccaggagaaggaguucagaaccauggugagcaccaccgagcugcagaagaccaccggcaccaugauccacaagcuggccgccagagcccugaucagagacuacgaggacggcauccugcacgagaacgagaccagccacgagaugaagaagcagacccugaagagccugaucaucaagcugagcaaggagaacagccugaucacccaguucaccagcuucguggccguggagaagagagacgagaacgagagccccuuccccgacauccccaaggugagcgagcugaucgccaaggaggacguggacuuccugcccuacaugagcuggcagggcgagccccaggaggccgugagaaaccagagccugcuggccagcagcgaguggcccgagcugagacugagcaagagaaagcacagaaagauccccuucagcaagagaaagauggagcugagccagcccgaggugagcgaggacuucgaggaggacggccugggcgugcugcccgccuucaccagcaaccuggagagaggcggcguggagaagcugcuggaccugagcuggaccgagagcugcaagcccaccgccaccgagccccuguucaagaaggugagccccugggagaccagcaccagcagcuucuuccccauccuggcccccgccgugggcagcuaccugccccccaccgccagagcccacagccccgccagccugagcuucgccagcuacagacagguggccagcuucggcagcgccgccccccccagacaguucgacgccagccaguucagccagggccccgugcccggcaccugcgccgacuggaucccccagagcgccagcugccccaccggccccccccagaacccccccagcagccccuacugcggcaucguguucagcggcagcagccugagcagcgcccagagcgccccccugcagcaccccggcggcuucaccaccagacccagcgccggcaccuuccccgagcuggacagcccccagcugcacuucagccugcccaccgaccccgaccccaucagaggcuucggcagcuaccaccccagcgccagcagccccuuccacuuccagcccagcgccgccagccugaccgccaaccugagacugcccauggccagcgcccugcccgaggcccugugcagccagagcagaaccacccccguggaccugugccugcuggaggagagcgugggcagccuggagggcagcagaugccccguguucgccuuccagagcagcgacaccgagagcgacgagcugagcgaggugcugcaggacagcugcuuccugcagaucaagugcgacaccaaggacgacagcauccugugcuuccuggaggugaaggaggaggacgagaucgugugcauccagcacuggcaggacgccgugcccuggaccgagcugcugagccugcagaccgaggacggcuucuggaagcugacccccgagcugggccugauccugaaccugaacaccaacggccugcacagcuuccugaagcagaagggcauccagagccugggcgugaagggcagagagugccugcuggaccugaucgccaccaugcuggugcugcaguucaucagaaccagacuggagaaggagggcaucguguucaagagccugaugaagauggacgacgccagcaucagcagaaacauccccugggccuucgaggccaucaagcaggccagcgagugggugagaagaaccgagggccaguaccccagcaucugccccagacuggagcugggcaacgacugggacagcgccaccaagcagcugcugggccugcagcccaucagcaccgugagcccccugcacagagugcugcacuacagccagggcuaa

SEQ ID NO: 21197 - RNA, 1893 nt, Artificial Sequence
  PARP6__Homo_sapiens__NP_064599
auggacaucaagggccaguucuggaacgacgacgacagcgagggcgacaacgagagcgaggaguuccuguacggcgugcagggcagcugcgccgccgaccuguacagacacccccagcuggacgccgacaucgaggccgugaaggagaucuacagcgagaacagcgugagcaucagagaguacggcaccaucgacgacguggacaucgaccugcacaucaacaucagcuuccuggacgaggaggugagcaccgccuggaaggugcugagaaccgagcccaucgugcugagacugagauucagccugagccaguaccuggacggccccgagcccagcaucgagguguuccagcccagcaacaaggagggcuucggccugggccugcagcugaagaagauccugggcauguucaccagccagcaguggaagcaccugagcaacgacuuccugaagacccagcaggagaagagacacagcugguucaaggccagcggcaccaucaagaaguucagagccggccugagcaucuucagccccauccccaagagccccagcuuccccaucauccaggacagcaugcugaagggcaagcugggcgugcccgagcugagagugggcagacugaugaacagaagcaucagcugcaccaugaagaaccccaagguggagguguucggcuacccccccagcccccaggccggccugcugugcccccagcacgugggccugcccccccccgccagaaccagcccccuggugagcggccacugcaagaacauccccacccuggaguacggcuuccuggugcagaucaugaaguacgccgagcagagaauccccacccugaacgaguacugcguggugugcgacgagcagcacguguuccagaacggcagcaugcugaagcccgccgugugcaccagagagcugugcguguucagcuucuacacccugggcgugaugagcggcgccgccgaggagguggccaccggcgccgaggugguggaccugcugguggccaugugcagagccgcccuggagagccccagaaagagcaucaucuucgagcccuaccccagcgugguggaccccaccgaccccaagacccuggccuucaaccccaagaagaagaacuacgagagacugcagaaggcccuggacagcgugaugagcaucagagagaugacccagggcagcuaccuggagaucaagaagcagauggacaagcuggacccccuggcccacccccugcugcaguggaucaucagcagcaacagaagccacaucgugaagcugccccugagcagacugaaguucaugcacaccagccaccaguuccugcugcugagcagcccccccgccaaggaggccagauucagaaccgccaagaagcuguacggcagcaccuucgccuuccacggcagccacaucgagaacuggcacagcauccugagaaacggccuggugaacgccagcuacaccaagcugcagcugcacggcgccgccuacggcaagggcaucuaccugagccccaucagcagcaucagcuucggcuacagcggcaugggcaagggccagcacagaaugcccagcaaggacgagcuggugcagagauacaacagaaugaacaccaucccccagaccagaagcauccagagcagauuccugcagagcagaaaccugaacugcaucgcccugugcgaggugaucaccagcaaggaccugcagaagcacggcaacaucugggugugccccgugagcgaccacgugugcaccagauucuucuucguguacgaggacggccaggugggcgacgccaacaucaacacccaggaccccaagauccagaaggagaucaugagagugaucggcacccagguguacaccaacuaa

SEQ ID NO: 21198 - RNA, 2565 nt, Artificial Sequence
  PARP9__Homo_sapiens__NP_001139574
auggacuucagcaugguggccggcgccgccgccuacaacgagaagagcggcagaaucaccagccugagccugcuguuccagaagguguucgcccagaucuucccccaguggagaaagggcaacaccgaggagugccugcccuacaagugcagcgagaccggcgcccugggcgagaacuacagcuggcagauccccaucaaccacaacgacuucaagauccugaagaacaacgagagacagcugugcgaggugcugcagaacaaguucggcugcaucagcacccuggugagccccgugcaggagggcaacagcaagagccugcagguguucagaaagaugcugacccccagaaucgagcugagcguguggaaggacgaccugaccacccacgccguggacgccguggugaacgccgccaacgaggaccugcugcacggcggcggccuggcccuggcccuggugaaggccggcggcuucgagauccaggaggagagcaagcaguucguggccagauacggcaaggugagcgccggcgagaucgccgugaccggcgccggcagacugcccugcaagcagaucauccacgccgugggccccagauggauggagugggacaagcagggcugcaccggcaagcugcagagagccaucgugagcauccugaacuacgugaucuacaagaacacccacaucaagaccguggccauccccgcccugagcagcggcaucuuccaguucccccugaaccugugcaccaagaccaucguggagaccaucagagugagccugcagggcaagcccaugaugagcaaccugaaggagauccaccuggugagcaacgaggaccccaccguggccgccuucaaggccgccagcgaguucauccugggcaagagcgagcugggccaggagaccacccccagcuucaacgccaugguggugaacaaccugacccugcagaucgugcagggccacaucgaguggcagaccgccgacgugaucgugaacagcgugaacccccacgacaucaccgugggccccguggccaagagcauccugcagcaggccggcguggagaugaagagcgaguuccuggccaccaaggccaagcaguuccagagaagccagcuggugcuggugaccaagggcuucaaccuguucugcaaguacaucuaccacgugcuguggcacagcgaguuccccaagccccagauccugaagcacgccaugaaggagugccuggagaagugcaucgagcagaacaucaccagcaucagcuuccccgcccugggcaccggcaacauggagaucaagaaggagaccgccgccgagauccuguucgacgaggugcugaccuucgccaaggaccacgugaagcaccagcugaccgugaaguucgugaucuuccccaccgaccuggagaucuacaaggccuucagcagcgagauggccaagagaagcaagaugcugagccugaacaacuacagcgugccccagagcaccagagaggagaagagagagaacggccuggaggccagaagccccgccaucaaccugaugggcuucaacguggaggagauguacgaggcccacgccuggauccagagaauccugagccugcagaaccaccacaucaucgagaacaaccacauccuguaccugggcagaaaggagcacgacauccugagccagcugcagaagaccagcagcgugagcaucaccgagaucaucagccccggcagaaccgagcuggagaucgagggcgccagagccgaccugaucgagguggugaugaacaucgaggacaugcugugcaaggugcaggaggagauggccagaaagaaggagagaggccuguggagaagccugggccaguggaccauccagcagcagaagacccaggacgagaugaaggagaacaucaucuuccugaagugccccgugccccccacccaggagcugcuggaccagaagaagcaguucgagaagugcggccugcaggugcugaagguggagaagaucgacaacgaggugcugauggccgccuuccagagaaagaagaagaugauggaggagaagcugcacagacagcccgugagccacagacuguuccagcaggugcccuaccaguucugcaacguggugugcagagugggcuuccagagaauguacagcacccccugcgaccccaaguacggcgccggcaucuacuucaccaagaaccugaagaaccuggccgagaaggccaagaagaucagcgccgccgacaagcugaucuacguguucgaggccgaggugcugaccggcuucuucugccagggccacccccugaacaucgugccccccccccugagccccggcgccaucgacggccacgacagcgugguggacaacgugagcagccccgagaccuucgugaucuucagcggcaugcaggccaucccccaguaccuguggaccugcacccaggaguacgugcagagccaggacuacagcagcggccccaugagacccuucgcccagcaccccuggagaggcuucgccagcggcagccccguggacuaa

SEQ ID NO: 21199 - RNA, 1752 nt, Artificial Sequence
  PARPBP__Homo_sapiens__XP_011536808
auggagcugaucauggccguguucaaccagaagagcgugagcgacaugaucaaggaguucagaaagaacuggagagcccugugcaacagcgagagaaccacccugugcggcgccgacagcaugcugcuggcccugcagcugagcauggccgagaacaacaagcagcacagcggcgaguucaccgugagccugagcgacgugcugcugaccuggaaguaccugcugcacgagaagcugaaccugcccguggagaacauggacgugaccgaccacuacgaggacgugagaaagaucuacgacgacuuccugaagaacagcaacaugcuggaccugaucgacguguaccagaagugcagagcccugaccagcaacugcgagaacuacaacaccgugagccccagccagcugcuggacuuccugagcggcaagcaguacgccgugggcgacgagaccgaccugagcauccccaccagccccaccagcaaguacaacagagacaacgagaaggugcagcugcuggccagaaagaucaucuucagcuaccugaaccugcuggugaacagcaagaacgaccuggccguggccuacauccugaacauccccgacagaggccugggcagagaggccuucaccgaccugaagcacgccgccagagagaagcagaugagcaucuuccugguggccaccagcuucaucagaaccaucgagcugggcggcaagggcuacgcccccccccccagcgacccccugagaacccacgugaagggccugagcaacuucaucaacuucaucgacaagcuggacgagauccugggcgagauccccaaccccagcaucgccggcggccagauccugagcgugaucaagaugcagcugaucaagggccagaacagcagagaccccuucugcaaggccaucgaggagguggcccaggaccuggaccugagaaucaagaacaucaucaacagccaggagggcgugguggcccugagcaccaccgacaucagccccgccagacccaagagccacgccaucaaccacggcaccgccuacugcggcagagacaccgugaaggcccugcuggugcugcuggacgaggaggccgccaacgcccccaccaagaacaaggccgagcugcuguacgacgaggagaacaccauccaccaccacggcaccagcauccugacccuguucagaagccccacccaggugaacaacagcaucaagccccugagagagagaaucugcgugagcaugcaggagaagaagaucaagaugaagcagacccugaucagaagccaguucgccugcaccuacaaggacgacuacaugaucagcaaggacaacuggaacaacgugaaccuggccagcaagccccugugcgugcuguacauggagaacgaccugagcgagggcgugaaccccagcgugggcagaagcaccaucggcaccagcuucggcaacgugcaccuggacagaagcaagaacgagaaggugagcagaaagagcaccagccagaccggcaacaagagcagcaagagaaagcagguggaccuggacggcgagaacauccugugcgacaacagaaacgagcccccccagcacaagaacgccaagauccccaagaagagcaacgacagccagaacagacuguacggcaagcuggccaagguggccaagagcaacaagugcaccgccaaggacaagcugaucagcggccaggccaagcugacccaguucuucagacuguaa

SEQ ID NO: 21200 - RNA, 1605 nt, Artificial Sequence
  PARS2__Homo_sapiens__XP_011539505
augagagccgcccugcccggccugagccugggcagaagagagagccacaccgugcuggaggugcccgcccuggagagacccugggaccaccugcugcccgagcccgccuuccccuucuacgugggcgagaacggcggccccggcagaagcgccugcgccagcagaugccagggcgugauggagggccugcugaccagaugcagagcccugcccgcccuggccaccugcagcagacagcugagcggcuacgugcccugcagauuccaccacugcgcccccagaagaggcagaagacugcugcugagcagaguguuccagccccagaaccugagagaggacagagugcugagccugcaggacaagagcgacgaccugaccugcaagagccagagacugaugcugcaggugggccugaucuaccccgccagccccggcugcuaccaccugcugcccuacaccgugagagccauggagaagcuggugagagugaucgaccaggagaugcaggccaucggcggccagaaggugaacaugcccagccugagccccgccgagcuguggcaggccaccaacagaugggaccugaugggcaaggagcugcugagacugagagacagacacggcaaggaguacugccugggccccacccacgaggaggccaucaccgcccugaucgccagccagaagaagcugagcuacaagcagcugcccuuccugcuguaccaggugaccagaaaguucagagacgagcccagacccagauucggccugcugagaggcagagaguucuacaugaaggacauguacaccuucgacagcagccccgaggccgcccagcagaccuacagccuggugugcgacgccuacugcagccuguucaacaagcugggccugcccuucgugaaggugcaggccgacgugggcaccaucggcggcaccgugagccacgaguuccagcugcccguggacaucggcgaggacagacuggccaucugccccagaugcagcuucagcgccaacauggagacccuggaccugagccagaugaacugccccgccugccagggcccccugaccaagaccaagggcaucgaggugggccacaccuucuaccugggcaccaaguacagcagcaucuucaacgcccaguucaccaacgugugcggcaagcccacccuggccgagaugggcugcuacggccugggcgugaccagaauccuggccgccgccaucgaggugcugagcaccgaggacugcgugagauggcccagccugcuggcccccuaccaggccugccugaucccccccaagaagggcagcaaggagcaggccgccagcgagcugaucggccagcuguacgaccacaucaccgaggccgugccccagcugcacggcgaggugcugcuggacgacagaacccaccugaccaucggcaacagacugaaggacgccaacaaguucggcuaccccuucgugaucaucgccggcaagagagcccuggaggaccccgcccacuucgagguguggugccagaacaccggcgagguggccuuccugaccaaggacggcgugauggaccugcugacccccgugcagaccguguaa

SEQ ID NO: 21201 - RNA, 1239 nt, Artificial Sequence
  PARVA__Homo_sapiens__NP_060692
augcugggcaucaucccccugcccuucggcaagccccagccccagagcagaagaagaccccugagaccccccagcgccagcagcgccagcagacccgccagaggcagccugagaagagccauggccaccagcccccagaagagccccagcgugcccaagagccccacccccaagagcccccccagcagaaagaaggacgacagcuuccugggcaagcugggcggcacccuggccagaagaaagaaggccaaggaggugagcgagcugcaggaggagggcaugaacgccaucaaccugccccugagccccauccccuucgagcuggaccccgaggacaccaugcuggaggagaacgaggugagaaccaugguggaccccaacagcagaagcgaccccaagcugcaggagcugaugaaggugcugaucgacuggaucaacgacgugcuggugggcgagagaaucaucgugaaggaccuggccgaggaccuguacgacggccaggugcugcagaagcuguucgagaagcuggagagcgagaagcugaacguggccgaggugacccagagcgagaucgcccagaagcagaagcugcagaccgugcuggagaagaucaacgagacccugaagcugccccccagaagcaucaaguggaacguggacagcgugcacgccaagagccugguggccauccugcaccugcugguggcccugagccaguacuucagagcccccaucagacugcccgaccacgugagcauccagguggugguggugcagaagagagagggcauccugcagagcagacagauccaggaggagaucaccggcaacaccgaggcccugagcggcagacacgagagagacgccuucgacacccuguucgaccacgcccccgacaagcugaacguggugaagaagacccugaucaccuucgugaacaagcaccugaacaagcugaaccuggaggugaccgagcuggagacccaguucgccgacggcguguaccuggugcugcugaugggccugcuggagggcuacuucgugccccugcacagcuucuuccugacccccgacagcuucgagcagaaggugcugaacgugagcuucgccuucgagcugaugcaggacggcggccuggagaagcccaagcccagacccgaggacaucgugaacugcgaccugaagagcacccugagagugcuguacaaccuguucaccaaguacagaaacguggaguaa

SEQ ID NO: 21202 - RNA, 1194 nt, Artificial Sequence
  PARVB__Homo_sapiens__NP_001003828
augcaccacguguucaaggaccaccagagaggcgagaagagaggcuuccugagccccgagaacaagaacugcagaagacuggagcugagaagaggcugcagcugcagcuggggccugugcagccaggcccugauggccagccuggccggcagccugcugcccggcagcgacagaagcggcguggagaccagcgaguacgcccagggcggcgugagcgaccugcaggaggagggcaagaacgccaucaacagccccaugagccccgcccugguggacgugcaccccgaggacacccagcuggaggagaacgaggagagaaccaugaucgaccccaccagcaaggaggaccccaaguucaaggagcuggugaaggugcugcuggacuggaucaacgacgugcugguggaggagagaaucaucgugaagcagcuggaggaggaccuguacgacggccaggugcugcagaagcugcuggagaagcuggccggcugcaagcugaacguggccgaggugacccagagcgagaucggccagaagcagaagcugcagaccgugcuggaggccgugcacgaccugcugagacccagaggcugggcccugagauggagcguggacagcauccacggcaagaaccugguggccauccugcaccugcuggugagccuggccaugcacuucagagcccccaucagacugcccgagcacgugaccgugcagguggugguggugagaaagagagagggccugcugcacagcagccacaucagcgaggagcugaccaccaccaccgagaugaugaugggcagauucgagagagacgccuucgacacccuguucgaccacgcccccgacaagcugagcguggugaagaagagccugaucaccuucgugaacaagcaccugaacaagcugaaccuggaggugaccgagcuggagacccaguucgccgacggcguguaccuggugcugcugaugggccugcuggaggacuacuucgugccccugcaccacuucuaccugacccccgagagcuucgaccagaaggugcacaacgugagcuucgccuucgagcugaugcuggacggcggccugaagaagcccaaggccagacccgaggacguggugaaccuggaccugaagagcacccugagagugcuguacaaccuguucaccaaguacaagaacguggaguaa

SEQ ID NO: 21203 - RNA, 996 nt, Artificial Sequence
  PARVG__Homo_sapiens__NP_001131077
auggagcccgaguuccuguacgaccugcugcagcugcccaagggcguggagccccccgccgaggaggagcugagcaagggcggcaagaagaaguaccugccccccaccagcagaaaggaccccaaguucgaggagcugcagaaggugcugauggaguggaucaacgccacccugcugcccgagcacaucguggugagaagccuggaggaggacauguucgacggccugauccugcaccaccuguuccagagacuggccgcccugaagcuggaggccgaggacaucgcccugaccgccaccagccagaagcacaagcugaccguggugcuggaggccgugaacagaagccugcagcuggaggaguggcaggccaaguggagcguggagagcaucuucaacaaggaccugcugagcacccugcaccugcugguggcccuggccaagagauuccagcccgaccugagccugcccaccaacgugcagguggaggugaucaccaucgagagcaccaagagcggccugaagagcgagaagcugguggagcagcugaccgaguacagcaccgacaaggacgagccccccaaggacguguucgacgagcuguucaagcuggcccccgagaaggugaacgccgugaaggaggccaucgugaacuucgugaaccagaagcuggacagacugggccugagcgugcagaaccuggacacccaguucgccgacggcgugauccugcugcugcugaucggccagcuggagggcuucuuccugcaccugaaggaguucuaccugacccccaacagccccgccgagaugcugcacaacgugacccuggcccuggagcugcugaaggacgagggccugcugagcugccccgugagccccgaggacaucgugaacaaggacgccaagagcacccugagagugcuguacggccuguucugcaagcacacccagaaggcccacagagacagaaccccccacggcgcccccaacuaa

SEQ ID NO: 21204 - RNA, 2322 nt, Artificial Sequence
  PASD1__Homo_sapiens__NP_775764
augaagaugagaggcgagaagagaagagacaaggugaaccccaagagcagccagagaaagcugaacuggauccccagcuuccccaccuacgacuacuucaaccaggugacccugcagcugcuggacggcuucaugaucacccugagcaccgacggcgugaucaucugcguggccgagaacaucagcagccugcugggccaccugcccgccgagaucgugggcaagaagcugcugagccugcugcccgacgaggagaaggacgagguguaccagaagaucauccugaaguucccccugcugaacagcgagacccacaucgaguucugcugccaccugaagagaggcaacguggagcacggcgacagcagcgccuacgagaacgugaaguucaucgugaacgugagagacaucugcaacgaguuccccgugguguucagcggccuguucagcagccaccugugcgccgacuucgccgccugcgugccccaggaggacagacuguaccuggugggcaacgugugcauccugagaacccagcugcugcagcagcuguacaccagcaaggccgugagcgacgaggccgugcugacccaggacagcgacgaggagcccuucgugggcgagcugagcagcagccagggccagagaggccacaccagcaugaaggccguguacguggagcccgccgccgccgccgccgccgccgccaucagcgacgaccagaucgacaucgccgagguggagcaguacggcccccaggagaacgugcacauguucguggacagcgacagcaccuacugcagcagcaccguguuccuggacaccaugcccgagagccccgcccugagccugcaggacuucagaggcgagcccgaggugaacccccuguacagagccgaccccguggaccuggaguucagcguggaccagguggacagcguggaccaggagggccccauggaccagcaggaccccgagaaccccguggccccccuggaccaggccggccugauggaccccguggaccccgaggacagcguggaccugggcgccgccggcgccagcgcccagccccugcagcccagcagccccguggccuacgacaucaucagccaggagcuggagcugaugaagaagcugaaggagcagcuggaggagagaaccuggcugcugcacgacgccauccagaaccagcagaacgcccuggagcugaugauggaccaccugcagaagcagcccaacacccugagacacguggugauccccgaccugcagagcagcgaggccgugcccaagaagcagcagaagcagcacgccggccaggugaagagaccccugccccaccccaaggacgugaagugcuucugcggccugagccugagcaacagccugaagaacaccggcgagcugcaggagcccugcguggccuucaaccagcagcagcuggugcagcaggagcagcaccugaaggagcagcagagacagcugagagagcagcugcagcagcugagagagcagagaaaggugcagaagcagaagaagaugcaggagaagaagaagcugcaggagcagaagaugcaggagaagaagaagcugcaggagcagagaagacagaagaagaagaagcugcaggagagaaagaaguggcagggccagaugcugcagaaggagcccgaggaggagcagcagaagcagcagcugcaggagcagccccugaagcacaacgugaucgugggcaacgagagagugcagaucugccugcagaaccccagagacgugagcgugccccugugcaaccaccccgugagauuccugcaggcccagcccaucgugcccgugcagagagccgccgagcagcagcccagcggcuucuaccaggacgagaacugcggccagcaggaggacgagagccagagcuucuaccccgaggccuaccagggcccccccgugaaccagcugccccugaucgacaccagcaacagcgaggccaucagcagcagcagcaucccccaguuccccaucaccagcgacagcaccaucagcacccuggagaccccccaggacuacaucagacuguggcaggagcugagcgacagccugggccccguggugcaggugaacaccuggagcugcgacgagcagggcacccugcacggccagcccaccuaccaccaggugcaggugagcgaggugggcguggagggcccccccgacccccaggccuuccagggccccgccgccuaccagcccgaccagaugagaagcgccgagcagaccagacugaugcccgccgagcagagagacagcaacaagcccugcuaa

SEQ ID NO: 21205 - RNA, 3993 nt, Artificial Sequence
  PASK__Homo_sapiens__NP_001239048
auggaggacggcggccugaccgccuucgaggaggaccagagaugccugagccagagccugccccugcccgugagcgccgagggccccgccgcccagaccaccgccgagcccagcagaagcuucagcagcgcccacagacaccugagcagaagaaacggccugagcagacugugccagagcagaaccgcccugagcgaggacagauggagcagcuacugccugagcagccuggccgcccagaacaucugcaccagcaagcugcacugccccgccgcccccgagcacaccgaccccagcgagcccagaggcagcgugagcugcugcagccugcugagaggccugagcagcggcuggagcagcccccugcugcccgcccccgugugcaaccccaacaaggccaucuucaccguggacgccaagaccaccgagauccugguggccaacgacaaggccugcggccugcugggcuacagcagccaggaccugaucggccagaagcugacccaguucuuccugagaagcgacagcgacgugguggaggcccugagcgaggagcacauggaggccgacggccacgccgccgugguguucggcaccgugguggacaucaucagcagaagcggcgagaagauccccgugagcguguggaugaagagaaugagacaggagagaagacugugcugcgugguggugcuggagcccguggagagagugagcaccuggguggccuuccagagcgacggcaccgugaccagcugcgacagccuguucgcccaccugcacggcuacgugagcggcgaggacguggccggccagcacaucaccgaccugauccccagcgugcagcugccccccagcggccagcacauccccaagaaccugaagauccagagaagcgugggcagagccagagacggcaccaccuucccccugagccugaagcugaagagccagcccagcagcgaggaggccaccaccggcgaggccgcccccgugagcggcuacagagccagcguguggguguucugcaccaucagcggccugaucacccugcugcccgacggcaccauccacggcaucaaccacagcuucgcccugacccuguucggcuacggcaagaccgagcugcugggcaagaacaucaccuuccugauccccggcuucuacagcuacauggaccuggccuacaacagcagccugcagcugcccgaccuggccagcugccuggacgugggcaacgagagcggcugcggcgagagaacccuggaccccuggcagggccaggaccccgccgagggcggccaggaccccagaaucaacguggugcuggccggcggccacguggugcccagagacgagaucagaaagcugauggagagccaggacaucuucaccggcacccagaccgagcugaucgccggcggccagcugcugagcugccugagcccccagcccgcccccggcguggacaacgugcccgagggcagccugcccgugcacggcgagcaggcccugcccaaggaccagcagaucaccgcccugggcagagaggagcccguggccaucgagagccccggccaggaccugcugggcgagagcagaagcgagcccguggacgugaagcccuucgccagcugcgaggacagcgaggcccccgugcccgccgaggacggcggcagcgacgccggcaugugcggccugugccagaaggcccagcuggagagaaugggcgugagcggccccagcggcagcgaccugugggccggcgccgccguggccaagccccaggccaagggccagcuggccggcggcagccugcugaugcacugccccugcuacggcagcgaguggggccugugguggagaagccaggaccuggcccccagccccagcggcauggccggccugagcuucggcacccccacccuggacgagcccuggcugggcguggagaacgacagagaggagcugcagaccugccugaucaaggagcagcugagccagcugagccuggccggcgcccuggacgugccccacgccgagcuggugcccaccgagugccaggccgugaccgcccccgugagcagcugcgaccugggcggcagagaccugugcggcggcugcaccggcagcagcagcgccugcuacgcccuggccaccgaccugcccggcggccuggaggccguggaggcccaggagguggacgugaacagcuucagcuggaaccugaaggagcuguucuucagcgaccagaccgaccagaccagcagcaacugcagcugcgccaccagcgagcugagagagacccccagcagccuggccgugggcagcgaccccgacgugggcagccugcaggagcagggcagcugcgugcuggacgacagagagcugcugcugcugaccggcaccugcguggaccugggccagggcagaagauucagagagagcugcgugggccacgaccccaccgagccccuggaggugugccuggugagcagcgagcacuacgccgccagcgacagagagagccccggccacgugcccagcacccuggacgccggccccgaggacaccugccccagcgccgaggagcccagacugaacgugcaggugaccagcacccccgugaucgugaugagaggcgccgccggccugcagagagagauccaggagggcgccuacagcggcagcugcuaccacagagacggccugagacugagcauccaguucgaggugagaagaguggagcugcagggccccaccccccuguucugcugcuggcuggugaaggaccugcugcacagccagagagacagcgccgccagaaccagacuguuccuggccagccugcccggcagcacccacagcaccgccgccgagcugaccggccccagccugguggaggugcugagagccagacccugguucgaggagccccccaaggccguggagcuggagggccuggccgccugcgagggcgaguacagccagaaguacagcaccaugagcccccugggcagcggcgccuucggcuucguguggaccgccguggacaaggagaagaacaaggaggugguggugaaguucaucaagaaggagaaggugcuggaggacugcuggaucgaggaccccaagcugggcaaggugacccuggagaucgccauccugagcagaguggagcacgccaacaucaucaaggugcuggacaucuucgagaaccagggcuucuuccagcuggugauggagaagcacggcagcggccuggaccuguucgccuucaucgacagacaccccagacuggacgagccccuggccagcuacaucuucagacaggugagagccggccagagcagacuggugagcgccgugggcuaccugagacugaaggacaucauccacagagacaucaaggacgagaacaucgugaucgccgaggacuucaccaucaagcugaucgacuucggcagcgccgccuaccuggagagaggcaagcuguucuacaccuucugcggcaccaucgaguacugcgcccccgaggugcugaugggcaaccccuacagaggccccgagcuggagauguggagccugggcgugacccuguacacccugguguucgaggagaaccccuucugcgagcuggaggagaccguggaggccgccauccacccccccuaccuggugagcaaggagcugaugagccuggugagcggccugcugcagcccgugcccgagagaagaaccacccuggagaagcuggugaccgaccccugggugacccagcccgugaaccuggccgacuacaccugggaggagguguucagagugaacaagcccgagagcggcgugcugagcgccgccagccuggagaugggcaacagaagccugagcgacguggcccaggcccaggagcugugcggcggccccgugcccggcgaggcccccaacggccagggcugccugcaccccggcgaccccagacugcugaccagcuaa

SEQ ID NO: 21206 - RNA, 381 nt, Artificial Sequence
  PATE1__Homo_sapiens__NP_612151
auggacaagagccugcugcuggagcugcccauccugcugugcugcuucagagcccugagcggcagccugagcaugagaaacgacgccgugaacgagaucguggccgugaagaacaacuuccccgugaucgagaucgugcagugcagaaugugccaccugcaguuccccggcgagaagugcagcagaggcagaggcaucugcaccgccaccaccgaggaggccugcauggugggcagaauguucaagagagacggcaaccccuggcugaccuucaugggcugccugaagaacugcgccgacgugaagggcaucagauggagcguguaccuggugaacuucagaugcugcagaagccacgaccugugcaacgaggaccuguaa

SEQ ID NO: 21207 - RNA, 2064 nt, Artificial Sequence
  PATZ1__Homo_sapiens__NP_055138
auggagagagugaacgacgccagcugcggccccagcggcugcuacaccuaccaggugagcagacacagcaccgagaugcugcacaaccugaaccagcagagaaagaacggcggcagauucugcgacgugcugcugagagugggcgacgagagcuuccccgcccacagagccgugcuggccgccugcagcgaguacuucgagagcguguucagcgcccagcugggcgacggcggcgccgccgacggcggccccgccgacgugggcggcgccaccgccgcccccggcggcggcgccggcggcagcagagagcuggagaugcacaccaucagcagcaagguguucggcgacauccuggacuucgccuacaccagcagaaucguggugagacuggagagcuuccccgagcugaugaccgccgccaaguuccugcugaugagaagcgugaucgagaucugccaggaggugaucaagcagagcaacgugcagauccuggugccccccgccagagccgacaucaugcuguucagaccccccggcaccagcgaccugggcuucccccuggacaugaccaacggcgccgcccuggccgccaacagcaacggcaucgccggcagcaugcagcccgaggaggaggccgccagagccgccggcgccgccaucgccggccaggccagccugcccgugcugcccggcguggacagacugcccaugguggccggcccccugagcccccagcugcugaccagccccuuccccagcguggccagcagcgcccccccccugaccggcaagagaggcagaggcagacccagaaaggccaaccugcuggacagcauguucggcagccccggcggccugagagaggccggcauccugcccugcggccugugcggcaagguguucaccgacgccaacagacugagacagcacgaggcccagcacggcgugaccagccugcagcugggcuacaucgaccugcccccccccagacugggcgagaacggccugcccaucagcgaggaccccgacggccccagaaagagaagcagaaccagaaagcagguggccugcgagaucugcggcaagaucuucagagacguguaccaccugaacagacacaagcugagccacagcggcgagaagcccuacagcugccccgugugcggccugagauucaagagaaaggacagaaugagcuaccacgugagaagccacgacggcagcgugggcaagcccuacaucugccagagcugcggcaagggcuucagcagacccgaccaccugaacggccacaucaagcaggugcacaccagcgagagaccccacaagugccagaccugcaacgccagcuucgccaccagagacagacugagaagccaccuggccugccacgaggacaaggugcccugccaggugugcggcaaguaccugagagccgccuacauggccgaccaccugaagaagcacagcgagggccccagcaacuucugcagcaucugcaacagaggcuucagcagcgccagcuaccugaaggugcacgugaagacccaccacggcgugccccugccccaggugagcagacaccaggagcccauccugaacggcggcgccgccuuccacugcgccagaaccuacggcaacaaggagggccagaagugcagccaccaggaccccaucgagagcagcgacagcuacggcgaccugagcgacgccagcgaccugaagacccccgagaagcagagcgccaacggcagcuucagcugcgacauggccgugcccaagaacaagauggagagcgacggcgagaagaaguaccccugccccgagugcggcagcuucuucagaagcaagagcuaccugaacaagcacauccagaaggugcacgugagagcccugggcggcccccugggcgaccugggccccgcccugggcagccccuucagcccccagcagaacaugagccugcuggagagcuucggcuuccagaucgugcagagcgccuucgccagcagccugguggaccccgagguggaccagcagcccaugggccccgagggcaaguaa

SEQ ID NO: 21208 - RNA, 1023 nt, Artificial Sequence
  PAWR__Homo_sapiens__XP_006719498
auggccaccggcggcuacagaaccagcagcggccugggcggcagcaccaccgacuuccuggaggaguggaaggccaagagagagaagaugagagccaagcagaacccccccggccccgccccccccggcggcggcagcagcgacgccgccggcaagccccccgccggcgcccugggcacccccgccgccgccgccgccaacgagcugaacaacaaccugcccggcggcgcccccgccgcccccgccgugcccggccccggcggcgugaacugcgccgugggcagcgccaugcugaccagagccgcccccggccccagaagaagcgaggacgagccccccgccgccagcgccagcgccgccccccccccccagagagacgaggaggagcccgacggcgugcccgagaagggcaagagcagcggccccagcgccagaaagggcaagggccagaucgagaagagaaagcugagagagaagagaagaagcaccggcguggugaacauccccgccgccgagugccuggacgaguacgaggacgacgaggccggccagaaggagagaaagagagaggacgccaucacccagcagaacaccauccagaacgaggccgugaaccugcuggaccccggcagcagcuaccugcugcaggagccccccagaaccgugagcggcagauacaagagcaccaccagcgugagcgaggaggacgugagcagcagauacagcagaaccgacagaagcggcuuccccagauacaacagagacgccaacgugagcggcacccuggugagcagcagcacccuggagaagaagaucgaggaccuggagaaggagguggugagagagagacaggagaaccugagacuggugagacugaugcaggacaaggaggagaugaucggcaagcugaaggaggagaucgaccugcugaacagagaccuggacgacaucgaggacgagaacgagcagcugaagcaggagaacaagacccugcugaagguggugggccagcugaccagauaa

SEQ ID NO: 21209 - RNA, 1605 nt, Artificial Sequence
  PAX1__Homo_sapiens__NP_006183
augaaguucacccugggccugggcagcagagccuggagagugagcugggagggcgccgccgccgccgccgccggccccggcgccggcggcagcgcccugagaugcagagcccagagagugagcagccccagacugggcagaagaggcagcagacugagcggcgcccugccccugugccugagcagaggcggcggcggcgcccaggcccugcccgacugcgccggccccagccccggccaccccggccaccccggcgccagacagcuggccggcccccuggccauggagcagaccuacggcgaggugaaccagcugggcggcguguucgugaacggcagaccccugcccaacgccaucagacugagaaucguggagcuggcccagcugggcaucagacccugcgacaucagcagacagcugagagugagccacggcugcgugagcaagauccuggccagauacaacgagaccggcagcauccugcccggcgccaucggcggcagcaagcccagagugaccacccccaacguggugaagcacaucagagacuacaagcagggcgaccccggcaucuucgccugggagaucagagacagacugcuggccgacggcgugugcgacaaguacaacgugcccagcgugagcagcaucagcagaauccugagaaacaagaucggcagccuggcccagcccggccccuacgaggccagcaagcagccccccagccagcccacccugcccuacaaccacaucuaccaguaccccuaccccagccccgugagccccaccggcgccaagaugggcagccaccccggcgugcccggcaccgccggccacgugagcauccccagaagcuggcccagcgcccacagcgugagcaacauccugggcaucagaaccuucauggagcagaccggcgcccuggccggcagcgagggcaccgccuacagccccaagauggaggacugggccggcgugaacagaaccgccuuccccgccacccccgccgugaacggccuggagaagcccgcccuggaggccgacaucaaguacacccagagcgccagcacccugagcgccgugggcggcuuccugcccgccugcgccuaccccgccagcaaccagcacggcguguacagcgcccccggcggcggcuaccuggcccccggcccccccuggccccccgcccagggccccccccuggccccccccggcgccggcguggccgugcacggcggcgagcuggccgccgccaugaccuucaagcaccccagcagagagggcagccugcccgcccccgccgccagacccagaacccccagcguggccuacaccgacugccccagcagacccagaccccccagaggcagcagccccagaaccagagccagaagagagagacaggccgaccccggcgcccaggugugcgccgccgcccccgccaucggcaccggcagaaucggcggccuggccgaggaggaggccagcgccggccccagaggcgccagacccgccagcccccaggcccagcccugccuguggcccgaccccccccacuuccuguacuggagcggcuuccugggcuucagcgagcugggcuucuaa

SEQ ID NO: 21210 - RNA, 1185 nt, Artificial Sequence
  PAX2__Homo_sapiens__NP_000269
auggacaugcacugcaaggccgaccccuucagcgccaugcaccccggccacggcggcgugaaccagcugggcggcguguucgugaacggcagaccccugcccgacguggugagacagagaaucguggagcuggcccaccagggcgugagacccugcgacaucagcagacagcugagagugagccacggcugcgugagcaagauccugggcagauacuacgagaccggcagcaucaagcccggcgugaucggcggcagcaagcccaagguggccacccccaaggugguggacaagaucgccgaguacaagagacagaaccccaccauguucgccugggagaucagagacagacugcuggccgagggcaucugcgacaacgacaccgugcccagcgugagcagcaucaacagaaucaucagaaccaaggugcagcagcccuuccaccccacccccgacggcgccggcaccggcgugaccgcccccggccacaccaucgugcccagcaccgccagcccccccgugagcagcgccagcaacgaccccgugggcagcuacagcaucaacggcauccugggcauccccagaagcaacggcgagaagagaaagagagacgaggacgugagcgagggcagcgugcccaacggcgacagccagagcggcguggacagccugagaaagcaccugagagccgacaccuucacccagcagcagcuggaggcccuggacagaguguucgagagacccagcuaccccgacguguuccaggccagcgagcacaucaagagcgagcagggcaacgaguacagccugcccgcccugacccccggccuggacgaggugaagagcagccugagcgccagcaccaaccccgagcugggcagcaacgugagcggcacccagaccuaccccguggugaccggcagagacauggccagcaccacccugcccggcuaccccccccacgugccccccaccggccagggcagcuaccccaccagcacccuggccggcauggugcccggcagcgaguucagcggcaaccccuacagccacccccaguacaccgccuacaacgaggccuggagauucagcaaccccgcccugcugagcagccccuacuacuacagcgccgcccccagaggcagcgcccccgccgccgccgccgccgccuacgacagacacuaa

SEQ ID NO: 21211 - RNA, 648 nt, Artificial Sequence
  PAX3__Homo_sapiens__NP_000429
augaccacccuggccggcgccgugcccagaaugaugagacccggccccggccagaacuaccccagaagcggcuucccccuggaggugagcaccccccugggccagggcagagugaaccagcugggcggcguguucaucaacggcagaccccugcccaaccacaucagacacaagaucguggagauggcccaccacggcaucagacccugcgugaucagcagacagcugagagugagccacggcugcgugagcaagauccugugcagauaccaggagaccggcagcaucagacccggcgccaucggcggcagcaagcccaagcaggugaccacccccgacguggagaagaagaucgaggaguacaagagagagaaccccggcauguucagcugggagaucagagacaagcugcugaaggacgccgugugcgacagaaacaccgugcccagcgugagcagcaucagcagaauccugagaagcaaguucggcaagggcgaggaggaggaggccgaccuggagagaaaggaggccgaggagagcgagaagaaggccaagcacagcaucgacggcauccugagcgagagaggcaagagauggagacugggcagaagaaccugcugggugaccuggagagccagcgccagcuaa

SEQ ID NO: 21212 - RNA, 1032 nt, Artificial Sequence
  PAX4__Homo_sapiens__NP_006184
augaaccagcugggcggccuguucgugaacggcagaccccugccccuggacaccagacagcagaucgugagacuggccgugagcggcaugagacccugcgacaucagcagaauccugaaggugagcaacggcugcgugagcaagauccugggcagauacuacagaaccggcgugcuggagcccaagggcaucggcggcagcaagcccagacuggccaccccccccgugguggccagaaucgcccagcugaagggcgagugccccgcccuguucgccugggagauccagagacagcugugcgccgagggccugugcacccaggacaagacccccagcgugagcagcaucaacagagugcugagagcccugcaggaggaccagggccugcccugcaccagacugagaagccccgccgugcuggcccccgccgugcugaccccccacagcggcagcgagacccccagaggcacccaccccggcaccggccacagaaacagaaccaucuucagccccagccaggccgaggcccuggagaaggaguuccagagaggccaguaccccgacagcguggccagaggcaagcuggccaccgccaccagccugcccgaggacaccgugagagugugguucagcaacagaagagccaaguggagaagacaggagaagcugaagugggagaugcagcugcccggcgccagccagggccugaccgugcccagaguggcccccggcaucaucagcgcccagcagagccccggcagcgugcccaccgccgcccugcccgcccuggagccccugggccccagcugcuaccagcugugcugggccaccgcccccgagagaugccugagcgacaccccccccaaggccugccugaagcccugcuggggccaccugcccccccagcccaacagccuggacagcggccugcugugccugcccugccccagcagccacugccaccuggccagccugagcggcagccaggcccugcuguggcccggcugcccccugcuguacggccuggaguaa

SEQ ID NO: 21213 - RNA, 1074 nt, Artificial Sequence
  PAX5__Homo_sapiens__NP_001267476
auggaccuggagaagaacuaccccacccccagaaccagcagaaccggccacggcggcgugaaccagcugggcggcguguucgugaacggcagaccccugcccgacguggugagacagagaaucguggagcuggcccaccagggcgugagacccugcgacaucagcagacagcugagagugagccacggcugcgugagcaagauccugggcagauacuacgagaccggcagcaucaagcccggcgugaucggcggcagcaagcccaagguggccacccccaaggugguggagaagaucgccgaguacaagagacagaaccccaccauguucgccugggagaucagagacagacugcuggccgagagagugugcgacaacgacaccgugcccagcgugagcagcaucaacagaaucaucagaaccaaggugcagcagccccccaaccagcccgugcccgccagcagccacagcaucgugagcaccggcagcgugacccaggugagcagcgugagcaccgacagcgccggcagcagcuacagcaucagcggcauccugggcaucaccagccccagcgccgacaccaacaagagaaagagagacgagggcauccaggagagccccgugcccaacggccacagccugcccggcagagacuuccugagaaagcagaugagaggcgaccuguucacccagcagcagcuggaggugcuggacagaguguucgagagacagcacuacagcgacaucuucaccaccaccgagcccaucaagcccgagcagaccaccgaguacagcgccauggccagccuggccggcggccuggacgacaugaaggccaaccuggccagccccacccccgccgacaucggcagcagcgugcccggcccccagagcuaccccaucgugaccggcagcgaguucagcggcagccccuacagccacccccaguacagcagcuacaacgacagcuggagauuccccaaccccggccugcugggcagccccuacuacuacagcgccgccgccagaggcgccgccccccccgccgccgccaccgccuacgacagacacuaa

SEQ ID NO: 21214 - RNA, 1311 nt, Artificial Sequence
  PAX6__Homo_sapiens__NP_001245391
augcagaacagccacagcggcgugaaccagcugggcggcguguucgugaacggcagaccccugcccgacagcaccagacagaagaucguggagcuggcccacagcggcgccagacccugcgacaucagcagaauccugcagacccacgccgacgccaaggugcaggugcuggacaaccagaacgugagcaacggcugcgugagcaagauccugggcagauacuacgagaccggcagcaucagacccagagccaucggcggcagcaagcccagaguggccacccccgagguggugagcaagaucgcccaguacaagagagagugccccagcaucuucgccugggagaucagagacagacugcugagcgagggcgugugcaccaacgacaacauccccagcgugagcagcaucaacagagugcugagaaaccuggccagcgagaagcagcagaugggcgccgacggcauguacgacaagcugagaaugcugaacggccagaccggcagcuggggcaccagacccggcugguaccccggcaccagcgugcccggccagcccacccaggacggcugccagcagcaggagggcggcggcgagaacaccaacagcaucagcagcaacggcgaggacagcgacgaggcccagaugagacugcagcugaagagaaagcugcagagaaacagaaccagcuucacccaggagcagaucgaggcccuggagaaggaguucgagagaacccacuaccccgacguguucgccagagagagacuggccgccaagaucgaccugcccgaggccagaauccaggugugguucagcaacagaagagccaaguggagaagagaggagaagcugagaaaccagagaagacaggccagcaacacccccagccacauccccaucagcagcagcuucagcaccagcguguaccagcccaucccccagcccaccacccccgugagcagcuucaccagcggcagcaugcugggcagaaccgacaccgcccugaccaacaccuacagcgcccugccccccaugcccagcuucaccauggccaacaaccugcccaugcagccccccgugcccagccagaccagcagcuacagcugcaugcugcccaccagccccagcgugaacggcagaagcuacgacaccuacacccccccccacaugcagacccacaugaacagccagcccaugggcaccagcggcaccaccagcaccggccugaucagccccggcgugagcgugcccgugcaggugcccggcagcgagcccgacaugagccaguacuggcccagacugcaguaa

SEQ ID NO: 21215 - RNA, 1353 nt, Artificial Sequence
  PAX8__Homo_sapiens__NP_003457
augccccacaacagcaucagaagcggccacggcggccugaaccagcugggcggcgccuucgugaacggcagaccccugcccgagguggugagacagagaaucguggaccuggcccaccagggcgugagacccugcgacaucagcagacagcugagagugagccacggcugcgugagcaagauccugggcagauacuacgagaccggcagcaucagacccggcgugaucggcggcagcaagcccaagguggccacccccaaggugguggagaagaucggcgacuacaagagacagaaccccaccauguucgccugggagaucagagacagacugcuggccgagggcgugugcgacaacgacaccgugcccagcgugagcagcaucaacagaaucaucagaaccaaggugcagcagcccuucaaccugcccauggacagcugcguggccaccaagagccugagccccggccacacccugauccccagcagcgccgugaccccccccgagagcccccagagcgacagccugggcagcaccuacagcaucaacggccugcugggcaucgcccagcccggcagcgacaagagaaagauggacgacagcgaccaggacagcugcagacugagcaucgacagccagagcagcagcagcggccccagaaagcaccugagaaccgacgccuucagccagcaccaccuggagccccuggagugccccuucgagagacagcacuaccccgaggccuacgccagccccagccacaccaagggcgagcagggccuguacccccugccccugcugaacagcacccuggacgacggcaaggccacccugacccccagcaacaccccccugggcagaaaccugagcacccaccagaccuaccccgugguggccgacccccacagccccuucgccaucaagcaggagacccccgaggugagcagcagcagcagcacccccagcagccugagcagcagcgccuuccuggaccugcagcaggugggcagcggcgugccccccuucaacgccuucccccacgccgccagcguguacggccaguucaccggccaggcccugcugagcggcagagagauggugggccccacccugcccggcuaccccccccacauccccaccagcggccagggcagcuacgccagcagcgccaucgccggcaugguggccggcagcgaguacagcggcaacgccuacggccacacccccuacagcagcuacagcgaggccuggagauuccccaacagcagccugcugagcagccccuacuacuacagcagcaccagcagacccagcgccccccccaccaccgccaccgccuucgaccaccuguaa

SEQ ID NO: 21216 - RNA, 1026 nt, Artificial Sequence
  PAX9__Homo_sapiens__NP_006185
auggagcccgccuucggcgaggugaaccagcugggcggcguguucgugaacggcagaccccugcccaacgccaucagacugagaaucguggagcuggcccagcugggcaucagacccugcgacaucagcagacagcugagagugagccacggcugcgugagcaagauccuggccagauacaacgagaccggcagcauccugcccggcgccaucggcggcagcaagcccagagugaccacccccaccguggugaagcacaucagaaccuacaagcagagagaccccggcaucuucgccugggagaucagagacagacugcuggccgacggcgugugcgacaaguacaacgugcccagcgugagcagcaucagcagaauccugagaaacaagaucggcaaccuggcccagcagggccacuacgacagcuacaagcagcaccagcccaccccccagcccgcccugcccuacaaccacaucuacagcuaccccagccccaucaccgccgccgccgccaaggugcccaccccccccggcgugcccgccauccccggcagcguggccaugcccagaaccuggcccagcagccacagcgugaccgacauccugggcaucagaagcaucaccgaccaggugagcgacagcagccccuaccacagccccaagguggaggaguggagcagccugggcagaaacaacuuccccgccgccgccccccacgccgugaacggccuggagaagggcgcccuggagcaggaggccaaguacggccaggcccccaacggccugcccgccgugggcagcuucgugagcgccagcagcauggcccccuaccccacccccgcccaggugagccccuacaugaccuacagcgccgcccccagcggcuacguggccggccacggcuggcagcacgccggcggcaccagccugagcccccacaacugcgacauccccgccagccuggccuucaagggcaugcaggccgccagagagggcagccacagcgugaccgccagcgcccuguaa

SEQ ID NO: 21217 - RNA, 3210 nt, Artificial Sequence
  PAXIP1__Homo_sapiens__NP_031375
augagcgaccaggcccccaaggugcccgaggagauguucagagaggugaaguacuacgccgugggcgacaucgacccccaggugauccagcugcugaaggccggcaaggccaaggaggugagcuacaacgcccuggccagccacaucaucagcgaggacggcgacaaccccgaggugggcgaggccagagagguguucgaccugcccguggugaagcccagcugggugauccugagcgugcagugcggcacccugcugcccgugaacggcuucagccccgagagcugccagaucuucuucggcaucaccgccugccugagccaggugagcagcgaggacagaagcgcccugugggcccuggugaccuucuacggcggcgacugccagcugacccugaacaagaagugcacccaccugaucgugcccgagcccaagggcgagaaguacgagugcgcccugaagagagccagcaucaagaucgugacccccgacugggugcuggacugcgugagcgagaagaccaagaaggacgaggccuucuaccaccccagacugaucaucuacgaggaggaggaggaggaggaggaggaggaggaggagguggagaacgaggagcaggacagccagaacgagggcagcaccgacgagaagagcagccccgccagcagccaggagggcagccccagcggcgaccagcaguucagccccaagagcaacaccgagaagagcaagggcgagcugauguucgacgacagcagcgacagcagccccgagaagcaggagagaaaccugaacuggacccccgccgaggugccccagcuggccgccgccaagagaagacugccccagggcaaggagcccggccugaucaaccugugcgccaacgugccccccgugcccggcaacauccugccccccgaggugagaggcaaccugauggccgccggccagaaccugcagagcagcgagagaagcgagaugaucgccaccuggagccccgccgugagaacccugagaaacaucaccaacaacgccgacauccagcagaugaacagacccagcaacguggcccacauccugcagacccugagcgcccccaccaagaaccuggagcagcaggugaaccacagccagcagggccacaccaacgccaacgccgugcuguucagccaggugaaggugacccccgagacccacaugcugcagcagcagcagcaggcccagcagcagcagcagcagcaccccgugcugcaccugcagccccagcagaucaugcagcugcagcagcagcagcagcagcagaucagccagcagcccuacccccagcagcccccccaccccuucagccagcagcagcagcagcagcagcaggcccacccccaccaguucagccagcagcagcugcaguucccccagcagcagcugcaccccccccagcagcugcacagaccccagcagcagcugcagcccuuccagcagcagcacgcccugcagcagcaguuccaccagcugcagcagcaccagcugcagcagcagcagcuggcccagcugcagcagcagcacagccugcugcagcagcagcagcagcagcagauccagcagcagcagcugcagagaaugcaccagcagcagcagcagcagcagaugcagagccagaccgccccccaccugagccagaccagccaggcccugcagcaccaggugcccccccagcagcccccccagcagcagcagcagcagcagcccccccccagcccccagcagcaccagcuguucggccacgaccccgccguggagauccccgaggagggcuuccugcugggcugcguguucgccaucgccgacuaccccgagcagaugagcgacaagcagcugcuggccaccuggaagagaaucauccaggcccacggcggcaccguggaccccaccuucaccagcagaugcacccaccugcugugcgagagccaggugagcagcgccuacgcccaggccaucagagagagaaagagaugcgugaccgcccacuggcugaacaccgugcugaagaagaagaagauggugcccccccacagagcccugcacuuccccguggccuucccccccggcggcaagcccugcagccagcacaucaucagcgugaccggcuucguggacagcgacagagacgaccugaagcugauggccuaccuggccggcgccaaguacaccggcuaccugugcagaagcaacaccgugcugaucugcaaggagcccaccggccugaaguacgagaaggccaaggaguggagaauccccugcgugaacgcccaguggcugggcgacauccugcugggcaacuucgaggcccugagacagauccaguacagcagauacaccgccuucagccugcaggaccccuucgcccccacccagcaccuggugcugaaccugcuggacgccuggagagugccccugaaggugagcgccgagcugcugaugagcaucagacugccccccaagcugaagcagaacgagguggccaacgugcagcccagcagcaagagagccagaaucgaggacgugcccccccccaccaagaagcugacccccgagcugacccccuucgugcuguucaccggcuucgagcccgugcaggugcagcaguacaucaagaagcuguacauccugggcggcgagguggccgagagcgcccagaagugcacccaccugaucgccagcaaggugaccagaaccgugaaguuccugaccgccaucagcguggugaagcacaucgugacccccgaguggcuggaggagugcuucagaugccagaaguucaucgacgagcagaacuacauccugagagacgccgaggccgaggugcuguucagcuucagccuggaggagagccugaagagagcccacgugagcccccuguucaaggccaaguacuucuacaucacccccggcaucugccccagccugagcaccaugaaggccaucguggagugcgccggcggcaaggugcugagcaagcagcccagcuucagaaagcugauggagcacaagcagaacagcagccugagcgagaucauccugaucagcugcgagaacgaccugcaccugugcagagaguacuucgccagaggcaucgacgugcacaacgccgaguucgugcugaccggcgugcugacccagacccuggacuacgagagcuacaaguucaacuaa

SEQ ID NO: 21218 - RNA, 969 nt, Artificial Sequence
  PBK__Homo_sapiens__XP_006716431
auggagggcaucagcaacuucaagacccccagcaagcugagcgagaagaagaagagcgugcugugcagcacccccaccaucaacauccccgccagccccuucaugcagaagcugggcuucggcaccggcgugaacguguaccugaugaagagaagccccagaggccugagccacagccccugggccgugaagaagaucaaccccaucugcaacgaccacuacagaagcguguaccagaagagacugauggacgaggccaagauccugaagagccugcaccaccccaacaucgugggcuacagagccuucaccgaggccaacgacggcagccugugccuggccauggaguacggcggcgagaagagccugaacgaccugaucgaggagagauacaaggccagccaggaccccuuccccgccgccaucauccugaagguggcccugaacauggccagaggccugaaguaccugcaccaggagaagaagcugcugcacggcgacaucaagagcagcaacguggugaucaagggcgacuucgagaccaucaagaucugcgacgugggcgugagccugccccuggacgagaacaugaccgugaccgaccccgaggccugcuacaucggcaccgagcccuggaagcccaaggaggccguggaggagaacggcgugaucaccgacaaggccgacaucuucgccuucggccugacccugugggagaugaugacccugagcaucccccacaucaaccugagcaacgacgacgacgacgaggacaagaccuucgacgagagcgacuucgacgacgaggccuacuacgccgcccugggcaccagaccccccaucaacauggaggagcuggacgagagcuaccagaaggugaucgagcuguucagcgugugcaccaacgaggaccccaaggacagacccagcgccgcccacaucguggaggcccuggagaccgacguguaa

SEQ ID NO: 21219 - RNA, 843 nt, Artificial Sequence
  PBLD__Homo_sapiens__NP_001028255
augaagcugcccaucuucaucgccgacgccuucaccgccagagccuucagaggcaaccccgccgccgugugccugcuggagaacgagcuggacgaggacaugcaccagaagaucgccagagagaugaaccugagcgagaccgccuucaucagaaagcugcaccccaccgacaacuucgcccagagcagcugcuucggccugagaugguucacccccgccagcgaggugccccugugcggccacgccacccuggccagcgccgccgugcuguuccacaagaucaagaacaugaacagcacccugaccuucgugacccugagcggcgagcugagagccagaagagccgaggacggcaucgugcuggaccugccccuguaccccgcccacccccaggacuuccacgagguggaggaccugaucaagaccgccaucggcaacacccuggugcaggacaucugcuacagccccgacacccagaagcugcuggugagacugagcgacguguacaacagaagcuuccuggagaaccugaaggugaacaccgagaaccugcugcagguggagaacaccggcaaggugaagggccugauccugacccugaagggcgagcccggcggccagacccaggccuucgacuucuacagcagauacuucgcccccugggugggcguggccgaggaccccgugaccggcagcgcccacgccgugcugagcagcuacuggagccagcaccugggcaagaaggagaugcacggcagaaccgcccuguaccaguuccuguucuaccugcccaacagcaagcugguguuccugcugaucugcaccaucccccugaagauguaa

SEQ ID NO: 21220 - RNA, 408 nt, Artificial Sequence
  PBOV1__Homo_sapiens__NP_067648
augagagccuuccugagaaaccagaaguacgaggacaugcacaacaucauccacauccugcagaucagaaagcugagacacagacugagcaacuuccccagacugcccggcauccuggcccccgagaccgugcugcugcccuucugcuacaagguguucagaaagaaggagaaggugaagagaagccagaaggccaccgaguucaucgacuacagcaucgagcagagccaccacgccauccugaccccccugcagacccaccugaccaugaagggcagcagcaugaagugcagcagccugagcagcgaggccauccuguucacccugacccugcagcugacccagacccugggccuggagugcugccugcuguaccugagcaagaccauccacccccagaucaucuaa

SEQ ID NO: 21221 - RNA, 4749 nt, Artificial Sequence
  PBRM1__Homo_sapiens__NP_060783
augggcagcaagagaagaagagccaccagccccagcagcagcgugagcggcgacuucgacgacggccaccacagcgugagcacccccggccccagcagaaagagaagaagacugagcaaccugcccaccguggaccccaucgccgugugccacgagcuguacaacaccaucagagacuacaaggacgagcagggcagacugcugugcgagcuguucaucagagcccccaagagaagaaaccagcccgacuacuacgagguggugagccagcccaucgaccugaugaagauccagcagaagcugaagauggaggaguacgacgacgugaaccugcugaccgccgacuuccagcugcuguucaacaacgccaagagcuacuacaagcccgacagccccgaguacaaggccgccugcaagcugugggaccuguaccugagaaccagaaacgaguucgugcagaagggcgaggccgacgacgaggacgacgacgaggacggccaggacaaccagggcaccgugaccgagggcagcagccccgccuaccugaaggagauccuggagcagcugcuggaggccaucgugguggccaccaaccccagcggcagacugaucagcgagcuguuccagaagcugcccagcaaggugcaguaccccgacuacuacgccaucaucaaggagcccaucgaccugaagaccaucgcccagagaauccagaacggcagcuacaagagcauccacgccauggccaaggacaucgaccugcuggccaagaacgccaagaccuacaacgagcccggcagccagguguucaaggacgccaacagcaucaagaagaucuucuacaugaagaaggccgagaucgagcaccacgagauggccaagagcagccugagaaugagaacccccagcaaccuggccgccgccagacugaccggccccagccacagcaagggcagccugggcgaggagagaaaccccaccagcaaguacuacagaaacaagagagccgugcagggcggcagacugagcgccaucaccauggcccugcaguacggcagcgagagcgaggaggacgccgcccuggccgccgccagauacgaggagggcgagagcgaggccgagagcaucaccagcuucauggacgugagcaaccccuucuaccagcuguacgacaccgugagaagcugcagaaacaaccagggccagcugaucgccgagcccuucuaccaccugcccagcaagaagaaguaccccgacuacuaccagcagaucaagaugcccaucagccugcagcagaucagaaccaagcugaagaaccaggaguacgagacccuggaccaccuggagugcgaccugaaccugauguucgagaacgccaagagauacaacgugcccaacagcgccaucuacaagagagugcugaagcugcagcaggugaugcaggccaagaagaaggagcuggccagaagagacgacaucgaggacggcgacagcaugaucagcagcgccaccagcgacaccggcagcgccaagagaaagagcaagaagaacaucagaaagcagagaaugaagauccuguucaacguggugcuggaggccagagagcccggcagcggcagaagacugugcgaccuguucauggugaagcccagcaagaaggacuaccccgacuacuacaagaucauccuggagcccauggaccugaagaucaucgagcacaacaucagaaacgacaaguacgccggcgaggagggcaugaucgaggacaugaagcugauguucagaaacgccagacacuacaacgaggagggcagccagguguacaacgacgcccacauccuggagaagcugcugaaggagaagagaaaggagcugggcccccugcccgacgacgacgacauggccagccccaagcugaagcugagcagaaagagcggcaucagccccaagaagagcaaguacaugacccccaugcagcagaagcugaacgagguguacgaggccgugaagaacuacaccgacaagagaggcagaagacugagcgccaucuuccugagacugcccagcagaagcgagcugcccgacuacuaccugaccaucaagaagcccauggacauggagaagaucagaagccacaugauggccaacaaguaccaggacaucgacagcaugguggaggacuucgugaugauguucaacaacgccugcaccuacaacgagcccgagagccugaucuacaaggacgcccuggugcugcacaaggugcugcuggagaccagaagagaccuggagggcgacgaggacagccacgugcccaacgugacccugcugauccaggagcugauccacaaccuguucgugagcgugaugagccaccaggacgacgagggcagaugcuacagcgacagccuggccgagauccccgccguggaccccaacuuccccaacaagcccccccugaccuucgacaucaucagaaagaacguggagaacaacagauacagaagacuggaccuguuccaggagcacauguucgaggugcuggagagagccagaagaaugaacagaaccgacagcgagaucuacgaggacgccguggagcugcagcaguucuucaucaagaucagagacgagcugugcaagaacggcgagauccugcugagccccgcccugagcuacaccaccaagcaccugcacaacgacguggagaaggagagaaaggagaagcugcccaaggagaucgaggaggacaagcugaagagagaggaggagaagagagaggccgagaagagcgaggacagcagcggcgccgccggccugagcggccugcacagaaccuacagccaggacugcagcuucaagaacagcauguaccacgugggcgacuacguguacguggagcccgccgaggccaaccugcagccccacaucgugugcaucgagagacugugggaggacagcgccgagaaggagguguucaagagcgacuacuacaacaaggugcccgugagcaagauccugggcaagugcguggugauguucgugaaggaguacuucaagcugugccccgagaacuucagagacgaggacguguucgugugcgagagcagauacagcgccaagaccaagagcuucaagaagaucaagcuguggaccaugcccaucagcagcgugagauucgugcccagagacgugccccugcccguggugagaguggccagcguguucgccaacgccgacaagggcgacgacgagaagaacaccgacaacagcgaggacagcagagccgaggacaacuucaaccuggagaaggagaaggaggacgugcccguggagaugagcaacggcgagcccggcugccacuacuucgagcagcugcacuacaacgacauguggcugaaggugggcgacugcguguucaucaagagccacggccuggugagacccagagugggcagaaucgagaaggugugggugagagacggcgccgccuacuucuacggccccaucuucauccaccccgaggagaccgagcacgagcccaccaagauguucuacaagaaggagguguuccugagcaaccuggaggagaccugccccaugaccugcauccugggcaagugcgccgugcugagcuucaaggacuuccugagcugcagacccaccgagauccccgagaacgacauccugcugugcgagagcagauacaacgagagcgacaagcagaugaagaaguucaagggccugaagagauucagccugagcgccaaggugguggacgacgagaucuacuacuucagaaagcccaucgugccccagaaggagcccagcccccugcuggagaagaagauccagcugcuggaggccaaguucgccgagcuggagggcggcgacgacgacaucgaggagaugggcgaggaggacagcgagagcacccccaagagcgccaagggcagcgccaagaaggagggcagcaagagaaagaucaacaugagcggcuacauccuguucagcagcgagaugagagccgugaucaaggcccagcaccccgacuacagcuucggcgagcugagcagacuggugggcaccgaguggagaaaccuggagaccgccaagaaggccgaguacgagggcaugaugggcggcuacccccccggccugcccccccugcagggccccguggacggccuggugagcaugggcagcaugcagccccugcaccccggcggcccccccccccaccaccugccccccggcgugcccggccugcccggcauccccccccccggcgugaugaaccagggcguggcccccauggugggcacccccgcccccggcggcagccccuacggccagcaggugggcgugcugggcccccccggccagcaggcccccccccccuaccccggcccccaccccgccggcccccccgugauccagcagcccaccacccccauguucguggcccccccccccaagacccagagacugcugcacagcgaggccuaccugaaguacaucgagggccugagcgccgagagcaacagcaucagcaagugggaccagacccuggccgccagaagaagagacgugcaccugagcaaggagcaggagagcagacugcccagccacuggcugaagagcaagggcgcccacaccaccauggccgacgcccuguggagacugagagaccugaugcugagagacacccugaacaucagacaggccuacaaccuggagaacguguaa

SEQ ID NO: 21222 - RNA, 1044 nt, Artificial Sequence
  PBX1__Homo_sapiens__NP_001191890
auggacgagcagcccagacugaugcacagccacgccggcgugggcauggccggccaccccggccugagccagcaccugcaggacggcgccggcggcaccgagggcgagggcggcagaaagcaggacaucggcgacauccugcagcagaucaugaccaucaccgaccagagccuggacgaggcccaggccagaaagcacgcccugaacugccacagaaugaagcccgcccuguucaacgugcugugcgagaucaaggagaagaccgugcugagcaucagaggcgcccaggaggaggagcccaccgacccccagcugaugagacuggacaacaugcugcuggccgagggcguggccggccccgagaagggcggcggcagcgccgccgccgccgccgccgccgccgccagcggcggcgccggcagcgacaacagcguggagcacagcgacuacagagccaagcugagccagaucagacagaucuaccacaccgagcuggagaaguacgagcaggccugcaacgaguucaccacccacgugaugaaccugcugagagagcagagcagaaccagacccaucagccccaaggagaucgagagaauggugagcaucauccacagaaaguucagcagcauccagaugcagcugaagcagagcaccugcgaggccgugaugauccugagaagcagauuccuggacgccagaagaaagagaagaaacuucaacaagcaggccaccgagauccugaacgaguacuucuacagccaccugagcaaccccuaccccagcgaggaggccaaggaggagcuggccaagaagugcggcaucaccgugagccaggugagcaacugguucggcaacaagagaaucagauacaagaagaacaucggcaaguuccaggaggaggccaacaucuacgccgccaagaccgccgugaccgccaccaacgugagcgcccacggcagccaggccaacagccccagcacccccaacagcgccggcggcuaccccagccccugcuaccagcccgacagaagaauccaguaa

SEQ ID NO: 21223 - RNA, 1293 nt, Artificial Sequence
  PBX2__Homo_sapiens__NP_002577
auggacgagagacugcugggcccccccccccccggcggcggcagaggcggccugggccuggugagcggcgagcccggcggccccggcgagccccccggcggcggcgaccccggcggcggcagcggcggcgugcccggcggcagaggcaagcaggacaucggcgacauccugcagcagaucaugaccaucaccgaccagagccuggacgaggcccaggccaagaagcacgcccugaacugccacagaaugaagcccgcccuguucagcgugcugugcgagaucaaggagaagaccggccugagcaucagaagcagccaggaggaggagcccguggacccccagcugaugagacuggacaacaugcugcuggccgagggcguggccggccccgagaagggcggcggcagcgccgccgccgccgccgccgccgccgccagcggcggcggcgugagccccgacaacagcaucgagcacagcgacuacagaagcaagcuggcccagaucagacacaucuaccacagcgagcuggagaaguacgagcaggccugcaacgaguucaccacccacgugaugaaccugcugagagagcagagcagaaccagacccguggcccccaaggagauggagagaauggugagcaucauccacagaaaguucagcgccauccagaugcagcugaagcagagcaccugcgaggccgugaugauccugagaagcagauuccuggacgccagaagaaagagaagaaacuucagcaagcaggccaccgaggugcugaacgaguacuucuacagccaccugagcaaccccuaccccagcgaggaggccaaggaggagcuggccaagaagugcggcaucaccgugagccaggugagcaacugguucggcaacaagagaaucagauacaagaagaacaucggcaaguuccaggaggaggccaacaucuacgccgugaagaccgccgugagcgugacccagggcggccacagcagaaccagcagccccaccccccccagcagcgccggcagcggcggcagcuucaaccugagcggcagcggcgacauguuccugggcaugcccggccugaacggcgacagcuacagcgccagccagguggagagccugagacacagcaugggccccggcggcuacggcgacaaccugggcggcggccagauguacagccccagagagaugagagccaacggcagcuggcaggaggccgugacccccagcagcgugaccagccccaccgagggccccggcagcgugcacagcgacaccagcaacuaa

SEQ ID NO: 21224 - RNA, 1080 nt, Artificial Sequence
  PBX3__Homo_sapiens__NP_001128250
augaagcccgcccuguucagcgugcugugcgagaucaaggagaagaccggccugagcaucagaggcgcccaggaggaggacccccccgacccccagcugaugagacuggacaacaugcugcuggccgagggcgugagcggccccgagaagggcggcggcagcgccgccgccgccgccgccgccgccgccagcggcggcagcagcgacaacagcaucgagcacagcgacuacagagccaagcugacccagaucagacagaucuaccacaccgagcuggagaaguacgagcaggccugcaacgaguucaccacccacgugaugaaccugcugagagagcagagcagaaccagacccaucagccccaaggagaucgagagaauggugggcaucauccacagaaaguucagcagcauccagaugcagcugaagcagagcaccugcgaggccgugaugauccugagaagcagauuccuggacgccagaagaaagagaagaaacuucagcaagcaggccaccgagauccugaacgaguacuucuacagccaccugagcaaccccuaccccagcgaggaggccaaggaggagcuggccaagaagugcagcaucaccgugagccaggugagcaacugguucggcaacaagagaaucagauacaagaagaacaucggcaaguuccaggaggaggccaaccuguacgccgccaagaccgccgugaccgccgcccacgccguggccgccgccgugcagaacaaccagaccaacagccccaccacccccaacagcggcagcagcggcagcuucaaccugcccaacagcggcgacauguucaugaacaugcagagccugaacggcgacagcuaccagggcagccaggugggcgccaacgugcagagccagguggacacccugagacacgugaucaaccagaccggcggcuacagcgacggccugggcggcaacagccuguacagcccccacaaccugaacgccaacggcggcuggcaggacgccaccacccccagcagcgugaccagccccaccgagggccccggcagcgugcacagcgacaccagcaacuaa

SEQ ID NO: 21225 - RNA, 1125 nt, Artificial Sequence
  PBX4__Homo_sapiens__NP_079521
auggccgccccccccagacccgcccccagcccccccgcccccagaagacuggacaccagcgacgugcugcagcagaucauggccaucaccgaccagagccuggacgaggcccaggccagaaagcacgcccugaacugccacagaaugaagcccgcccuguucagcgugcugugcgagaucaaggagaagaccguggugagcaucagaggcauccaggacgaggacccccccgacgcccagcugcugagacuggacaacaugcugcuggccgagggcgugugcagacccgagaagagaggcagaggcggcgccguggccagagccggcaccgccacccccggcggcugccccaacgacaacagcaucgagcacagcgacuacagagccaagcugagccagaucagacagaucuaccacagcgagcuggagaaguacgagcaggccugcagagaguucaccacccacgugaccaaccugcugcaggagcagagcagaaugagacccgugagccccaaggagaucgagagaauggugggcgccauccacggcaaguucagcgccauccagaugcagcugaagcagagcaccugcgaggccgugaugacccugagaagcagacugcuggacgccagaagaaagagaagaaacuucagcaagcaggccaccgaggugcugaacgaguacuucuacagccaccugaacaaccccuaccccagcgaggaggccaaggaggagcuggccagaaagggcggccugaccaucagccaggugagcaacugguucggcaacaagagaaucagauacaagaagaacaugggcaaguuccaggaggaggccaccaucuacaccggcaagaccgccguggacaccaccgaggugggcgugcccggcaaccacgccagcugccugagcacccccagcagcggcagcagcggccccuucccccugcccagcgccggcgacgccuuccugacccugagaacccuggccagccugcagcccccccccggcggcggcugccugcagagccaggcccagggcagcuggcagggcgccaccccccagcccgccaccgccagccccgccggcgaccccggcagcaucaacagcagcaccagcaacuaa

SEQ ID NO: 21226 - RNA, 315 nt, Artificial Sequence
  PCBD1__Homo_sapiens__NP_000272
auggccggcaaggcccacagacugagcgccgaggagagagaccagcugcugcccaaccugagagccgugggcuggaacgagcuggagggcagagacgccaucuucaagcaguuccacuucaaggacuucaacagagccuucggcuucaugaccagaguggcccugcaggccgagaagcuggaccaccaccccgagugguucaacguguacaacaaggugcacaucacccugagcacccacgagugcgccggccugagcgagagagacaucaaccuggccagcuucaucgagcagguggccgugagcaugaccuaa

SEQ ID NO: 21227 - RNA, 393 nt, Artificial Sequence
  PCBD2__Homo_sapiens__NP_115527
auggccgccgugcugggcgcccugggcgccaccagaagacugcuggccgcccugagaggccagagccugggccuggccgccaugagcagcggcacccacagacugaccgccgaggagagaaaccaggccauccuggaccugaaggccgccggcuggagcgagcugagcgagagagacgccaucuacaaggaguucagcuuccacaacuucaaccaggccuucggcuucaugagcagaguggcccugcaggccgagaagaugaaccaccaccccgagugguucaacguguacaacaaggugcagaucacccugaccagccacgacugcggcgagcugaccaagaaggacgugaagcuggccaaguucaucgagaaggccgccgccagcguguaa

SEQ ID NO: 21228 - RNA, 1071 nt, Artificial Sequence
  PCBP1__Homo_sapiens__NP_006187
auggacgccggcgugaccgagagcggccugaacgugacccugaccaucagacugcugaugcacggcaaggaggugggcagcaucaucggcaagaagggcgagagcgugaagagaaucagagaggagagcggcgccagaaucaacaucagcgagggcaacugccccgagagaaucaucacccugaccggccccaccaacgccaucuucaaggccuucgccaugaucaucgacaagcuggaggaggacaucaacagcagcaugaccaacagcaccgccgccagcagaccccccgugacccugagacugguggugcccgccacccagugcggcagccugaucggcaagggcggcugcaagaucaaggagaucagagagagcaccggcgcccaggugcagguggccggcgacaugcugcccaacagcaccgagagagccaucaccaucgccggcgugccccagagcgugaccgagugcgugaagcagaucugccuggugaugcuggagacccugagccagagcccccagggcagagugaugaccauccccuaccagcccaugcccgccagcagccccgugaucugcgccggcggccaggacagaugcagcgacgccgccggcuacccccacgccacccacgaccuggagggccccccccuggacgccuacagcauccagggccagcacaccaucagcccccuggaccuggccaagcugaaccagguggccagacagcagagccacuucgccaugaugcacggcggcaccggcuucgccggcaucgacagcagcagccccgaggugaagggcuacugggccagccuggacgccagcacccagaccacccacgagcugaccauccccaacaaccugaucggcugcaucaucggcagacagggcgccaacaucaacgagaucagacagaugagcggcgcccagaucaagaucgccaaccccguggagggcagcagcggcagacaggugaccaucaccggcagcgccgccagcaucagccuggcccaguaccugaucaacgccagacugagcagcgagaagggcaugggcugcagcuaa

SEQ ID NO: 21229 - RNA, 996 nt, Artificial Sequence
  PCBP2__Homo_sapiens__NP_001092090
auggacaccggcgugaucgagggcggccugaacgugacccugaccaucagacugcugaugcacggcaaggaggugggcagcaucaucggcaagaagggcgagagcgugaagaagaugagagaggagagcggcgccagaaucaacaucagcgagggcaacugccccgagagaaucaucacccuggccggccccaccaacgccaucuucaaggccuucgccaugaucaucgacaagcuggaggaggacaucagcagcagcaugaccaacagcaccgccgccagcagaccccccgugacccugagacugguggugcccgccagccagugcggcagccugaucggcaagggcggcugcaagaucaaggagaucagagagagcaccggcgcccaggugcagguggccggcgacaugcugcccaacagcaccgagagagccaucaccaucgccggcaucccccagagcaucaucgagugcgugaagcagaucugcguggugaugcuggagagcccccccaagggcgugaccauccccuacagacccaagcccagcagcagccccgugaucuucgccggcggccaggccuacaccauccagggccaguacgccaucccccagcccgaccugaccaagcugcaccagcuggccaugcagcagagccacuuccccaugacccacggcaacaccggcuucagcggcaucgagagcagcagccccgaggugaagggcuacugggccggccuggacgccagcgcccagaccaccagccacgagcugaccauccccaacgaccugaucggcugcaucaucggcagacagggcgccaagaucaacgagaucagacagaugagcggcgcccagaucaagaucgccaaccccguggagggcagcaccgacagacaggugaccaucaccggcagcgccgccagcaucagccuggcccaguaccugaucaacgugagacugagcagcgagaccggcggcaugggcagcagcuaa

SEQ ID NO: 21230 - RNA, 1038 nt, Artificial Sequence
  PCBP3__Homo_sapiens__NP_001123613
augggcgagggcgacgccuucugggcccccagcgugcugccccacagcacccugagcacccugagccaccacccccagccccaguucggcagaagaauggagagcaaggugagcgagggcggccugaacgugacccugaccaucagacugcugaugcacggcaaggaggugggcagcaucaucggcaagaagggcgagaccgugaagaagaugagagaggagagcggcgccagaaucaacaucagcgagggcaacugccccgagagaaucgugaccaucaccggccccaccgacgccaucuucaaggccuucgccaugaucgccuacaaguucgaggaggacaucaucaacagcaugagcaacagccccgccaccagcaagccccccgugacccugagacugguggugcccgccagccagugcggcagccugaucggcaagggcggcagcaagaucaaggagaucagagagagcaccggcgcccaggugcagguggccggcgacaugcugcccaacagcaccgagagagccgugaccaucagcggcacccccgacgccaucauccagugcgugaagcagaucugcguggugaugcuggaggccuacaccauccagggccaguacgccaucccccaccccgaccugaccaagcugcaccagcuggccaugcagcagacccccuuccccccccugggccagaccaaccccgccuuccccggcgagaagcugccccugcacagcagcgaggaggcccagaaccugaugggccagagcagcggccuggacgccagcccccccgccagcacccacgagcugaccauccccaacgaccugaucggcugcaucaucggcagacagggcaccaagaucaacgagaucagacagaugagcggcgcccagaucaagaucgccaacgccaccgagggcagcagcgagagacagaucaccaucaccggcacccccgccaacaucagccuggcccaguaccugaucaacgccagacugaccagcgaggugaccggcaugggcacccuguaa

SEQ ID NO: 21231 - RNA, 1281 nt, Artificial Sequence
  PCBP4__Homo_sapiens__XP_005265387
auggaggccggccagguggccgccagaacccacagccagguggccguggcccccgccagccccgacagaaugagcggcagcgacggcggccuggaggaggagcccgagcugagcaucacccugacccugagaaugcugaugcacggcaaggaggugggcagcaucaucggcaagaagggcgagaccgugaagagaaucagagagcagagcagcgccagaaucaccaucagcgagggcagcugccccgagagaaucaccaccaucaccggcagcaccgccgccguguuccacgccgugagcaugaucgccuucaagcuggacgaggaccugugcgccgcccccgccaacggcggcaacgugagcagaccccccgugacccugagacuggugauccccgccagccagugcggcagccugaucggcaaggccggcaccaagaucaaggagaucagagagaccaccggcgcccaggugcagguggccggcgaccugcugcccaacagcaccgagagagccgugaccgugagcggcgugcccgacgccaucauccugugcgugagacagaucugcgccgugauccuggagagcccccccaagggcgccaccauccccuaccaccccagccugagccugggcaccgugcugcugagcgccaaccagggcuucagcgugcagggccaguacggcgccgugacccccgccgaggugaccaagcugcagcagcugagcagccacgccgugcccuucgccacccccagcguggugcccggccuggaccccggcacccagaccagcagccaggaguuccuggugcccaacgaccugaucggcugcgugaucggcagacagggcagcaagaucagcgagaucagacagaugagcggcgcccacaucaagaucggcaaccaggccgagggcgccggcgagagacacgugaccaucaccggcagccccgugagcaucgcccuggcccaguaccugaucaccgccugccuggagaccgccaagagcaccagcggcggcacccccagcagcgcccccgccgaccugcccgcccccuucagccccccccugaccgcccugcccaccgccccccccggccugcugggcacccccuacgccaucagccugagcaacuucaucggccugaagcccaugcccuuccuggcccugccccccgccagccccggccccccccccggccuggccgccuacaccgccaagauggccgccgccaacggcagcaagaaggccgagagacagaaguucagccccuacuaa

SEQ ID NO: 21232 - RNA, 2187 nt, Artificial Sequence
  PCCA__Homo_sapiens__NP_000273
auggccggcuucugggugggcaccgccccccugguggccgccggcagaagaggcagauggcccccccagcagcugaugcugagcgccgcccugagaacccugaagcacgugcuguacuacagcagacagugccugauggugagcagaaaccugggcagcgugggcuacgaccccaacgagaagaccuucgacaagauccugguggccaacagaggcgagaucgccugcagagugaucagaaccugcaagaagaugggcaucaagaccguggccauccacagcgacguggacgccagcagcgugcacgugaagauggccgacgaggccgugugcgugggccccgcccccaccagcaagagcuaccugaacauggacgccaucauggaggccaucaagaagaccagagcccaggccgugcaccccggcuacggcuuccugagcgagaacaaggaguucgccagaugccuggccgccgaggacgugguguucaucggccccgacacccacgccauccaggccaugggcgacaagaucgagagcaagcugcuggccaagaaggccgaggugaacaccauccccggcuucgacggcguggugaaggacgccgaggaggccgugagaaucgccagagagaucggcuaccccgugaugaucaaggccagcgccggcggcggcggcaagggcaugagaaucgccugggacgacgaggagaccagagacggcuucagacugagcagccaggaggccgccagcagcuucggcgacgacagacugcugaucgagaaguucaucgacaaccccagacacaucgagauccaggugcugggcgacaagcacggcaacgcccuguggcugaacgagagagagugcagcauccagagaagaaaccagaaggugguggaggaggcccccagcaucuuccuggacgccgagaccagaagagccaugggcgagcaggccguggcccuggccagagccgugaaguacagcagcgccggcaccguggaguuccugguggacagcaagaagaacuucuacuuccuggagaugaacaccagacugcagguggagcaccccgugaccgagugcaucaccggccuggaccuggugcaggagaugaucagaguggccaagggcuacccccugagacacaagcaggccgacaucagaaucaacggcugggccguggagugcagaguguacgccgaggaccccuacaagagcuucggccugcccagcaucggcagacugagccaguaccaggagccccugcaccugcccggcgugagaguggacagcggcauccagcccggcagcgacaucagcaucuacuacgaccccaugaucagcaagcugaucaccuacggcagcgacagaaccgaggcccugaagagaauggccgacgcccuggacaacuacgugaucagaggcgugacccacaacaucgcccugcugagagaggugaucaucaacagcagauucgugaagggcgacaucagcaccaaguuccugagcgacguguaccccgacggcuucaagggccacaugcugaccaagagcgagaagaaccagcugcuggccaucgccagcagccuguucguggccuuccagcugagagcccagcacuuccaggagaacagcagaaugcccgugaucaagcccgacaucgccaacugggagcugagcgugaagcugcacgacaaggugcacaccgugguggccagcaacaacggcagcguguucagcguggagguggacggcagcaagcugaacgugaccagcaccuggaaccuggccagcccccugcugagcgugagcguggacggcacccagagaaccgugcagugccugagcagagaggccggcggcaacaugagcauccaguuccugggcaccguguacaaggugaacauccugaccagacuggccgccgagcugaacaaguucaugcuggagaaggugaccgaggacaccagcagcgugcugagaagccccaugcccggcguggugguggccgugagcgugaagcccggcgacgccguggccgagggccaggagaucugcgugaucgaggccaugaagaugcagaacagcaugaccgccggcaagaccggcaccgugaagagcgugcacugccaggccggcgacaccgugggcgagggcgaccugcugguggagcuggaguaa

SEQ ID NO: 21233 - RNA, 1620 nt, Artificial Sequence
  PCCB__Homo_sapiens__NP_000523
auggccgccgcccugagaguggccgccgugggcgccagacugagcgugcuggccagcggccugagagccgccgugagaagccugugcagccaggccaccagcgugaacgagagaaucgagaacaagagaagaaccgcccugcugggcggcggccagagaagaaucgacgcccagcacaagagaggcaagcugaccgccagagagagaaucagccugcugcuggaccccggcagcuucguggagagcgacauguucguggagcacagaugcgccgacuucggcauggccgccgacaagaacaaguuccccggcgacagcguggugaccggcagaggcagaaucaacggcagacugguguacguguucagccaggacuucaccguguucggcggcagccugagcggcgcccacgcccagaagaucugcaagaucauggaccaggccaucaccgugggcgcccccgugaucggccugaacgacagcggcggcgccagaauccaggagggcguggagagccuggccggcuacgccgacaucuuccugagaaacgugaccgccagcggcgugaucccccagaucagccugaucaugggccccugcgccggcggcgccguguacagccccgcccugaccgacuucaccuucauggugaaggacaccagcuaccuguucaucaccggccccgacguggugaagagcgugaccaacgaggacgugacccaggaggagcugggcggcgccaagacccacaccaccaugagcggcguggcccacagagccuucgagaacgacguggacgcccugugcaaccugagagacuucuucaacuaccugccccugagcagccaggaccccgcccccgugagagagugccacgaccccagcgacagacuggugcccgagcuggacaccaucgugccccuggagagcaccaaggccuacaacaugguggacaucauccacagcgugguggacgagagagaguucuucgagaucaugcccaacuacgccaagaacaucaucgugggcuucgccagaaugaacggcagaaccgugggcaucgugggcaaccagcccaagguggccagcggcugccuggacaucaacagcagcgugaagggcgccagauucgugagauucugcgacgccuucaacaucccccugaucaccuucguggacgugcccggcuuccugcccggcaccgcccaggaguacggcggcaucaucagacacggcgccaagcugcuguacgccuucgccgaggccaccgugcccaaggugaccgugaucaccagaaaggccuacggcggcgccuacgacgugaugagcagcaagcaccugugcggcgacaccaacuacgccuggcccaccgccgagaucgccgugaugggcgccaagggcgccguggagaucaucuucaagggccacgagaacguggaggccgcccaggccgaguacaucgagaaguucgccaaccccuuccccgccgccgugagaggcuucguggacgacaucauccagcccagcagcaccagagccagaaucugcugcgaccuggacgugcuggccagcaagaaggugcagagacccuggagaaagcacgccaacaucccccuguaa

SEQ ID NO: 21234 - RNA, 3123 nt, Artificial Sequence
  PCDH10__Homo_sapiens__NP_116586
augaucgugcugcugcuguucgcccugcuguggaugguggagggcguguucagccagcugcacuacaccgugcaggaggagcaggagcacggcaccuucgugggcaacaucgccgaggaccugggccuggacaucaccaagcugagcgccagaggcuuccagaccgugcccaacagcagaacccccuaccuggaccugaaccuggagaccggcgugcuguacgugaacgagaagaucgacagagagcagaucugcaagcagagccccagcugcgugcugcaccuggagguguuccuggagaacccccuggagcuguuccagguggagaucgaggugcuggacaucaacgacaacccccccagcuuccccgagcccgaccugaccguggagaucagcgagagcgccacccccggcaccagauucccccuggagagcgccuucgaccccgacgugggcaccaacagccugagagacuacgagaucacccccaacagcuacuucagccuggacgugcagacccagggcgacggcaacagauucgccgagcuggugcuggagaagccccuggacagagagcagcaggccgugcacagauacgugcugaccgccguggacggcggcggcggcggcggcgugggcgagggcggcggcggcggcggcggcgccggccugcccccccagcagcagagaaccggcaccgcccugcugaccaucagagugcuggacagcaacgacaacgugcccgccuucgaccagcccguguacaccgugagccugcccgagaacagcccccccggcacccuggugauccagcugaacgccaccgaccccgacgagggccagaacggcgaggugguguacagcuucagcagccacaucagccccagagccagagagcuguucggccugagccccagaaccggcagacuggaggugagcggcgagcuggacuacgaggagagccccguguaccagguguacgugcaggccaaggaccugggccccaacgccgugcccgcccacugcaaggugcuggugagagugcuggacgccaacgacaacgcccccgagaucagcuucagcaccgugaaggaggccgugagcgagggcgccgcccccggcaccgugguggcccuguucagcgugaccgacagagacagcgaggagaacggccaggugcagugcgagcugcugggcgacgugcccuucagacugaagagcagcuucaagaacuacuacaccaucgugaccgaggccccccuggacagagaggccggcgacagcuacacccugaccgugguggccagagacagaggcgagcccgcccugagcaccagcaagagcauccaggugcaggugagcgacgugaacgacaacgcccccagauucagccagcccguguacgacguguacgugaccgagaacaacgugcccggcgccuacaucuacgccgugagcgccaccgacagagacgagggcgccaacgcccagcuggccuacagcauccuggagugccagauccagggcaugagcguguucaccuacgugagcaucaacagcgagaacggcuaccuguacgcccugagaagcuucgacuacgagcagcugaaggacuucagcuuccagguggaggccagagacgccggcagcccccaggcccuggccggcaacgccaccgugaacauccugaucguggaccagaacgacaacgcccccgccaucguggccccccugcccggcagaaacggcacccccgccagagaggugcugcccagaagcgccgagcccggcuaccugcugaccagaguggccgccguggacgccgacgacggcgagaacgccagacugaccuacagcaucgugagaggcaacgagaugaaccuguucagaauggacuggagaaccggcgagcugagaaccgccagaagagugcccgccaagagagacccccagagacccuacgagcuggugaucgaggugagagaccacggccagcccccccugagcagcaccgccacccugguggugcagcugguggacggcgccguggagccccagggcggcggcggcagcggcggcggcggcagcggcgagcaccagagacccagcagaagcggcggcggcgagaccagccuggaccugacccugauccugaucaucgcccugggcagcgugagcuucaucuuccugcuggccaugaucgugcuggccgugagaugccagaaggagaagaagcugaacaucuacaccugccuggccagcgacugcugccugugcugcugcugcugcggcggcggcggcagcaccugcugcggcagacaggccagagccagaaagaagaagcugagcaagagcgacaucaugcuggugcagagcagcaacgugcccagcaaccccgcccaggugcccaucgaggagagcggcggcuucggcagccaccaccacaaccagaacuacugcuaccaggugugccugacccccgagagcgccaagaccgaccugauguuccugaagcccugcagccccagcagaagcaccgacaccgagcacaaccccugcggcgccaucgugaccggcuacaccgaccagcagcccgacaucaucagcaacggcagcauccugagcaacgagaccaagcaccagagagccgagcugagcuaccugguggacagacccagaagagugaacagcagcgccuuccaggaggccgacaucgugagcagcaaggacagcggccacggcgacagcgagcagggcgacagcgaccacgacgccaccaacagagcccagagcgccggcauggaccuguucagcaacugcaccgaggagugcaaggcccugggccacagcgacagaugcuggaugcccagcuucgugcccagcgacggcagacaggccgccgacuacagaagcaaccugcacgugcccggcauggacagcgugcccgacaccgagguguucgagacccccgaggcccagcccggcgccgagagaagcuucagcaccuucggcaaggagaaggcccugcacagcacccuggagagaaaggagcuggacggccugcugaccaacaccagagcccccuacaagccccccuaccugaccagaaagagaaucugcuaa

SEQ ID NO: 21235 - RNA, 4020 nt, Artificial Sequence
  PCDH11X__Homo_sapiens__NP_001161832
auggaccugcugagcggcaccuacaucuucgccgugcugcuggccugcgugguguuccacagcggcgcccaggagaagaacuacaccaucagagaggagaugcccgagaacgugcugaucggcgaccugcugaaggaccugaaccugagccugauccccaacaagagccugaccaccgccaugcaguucaagcugguguacaagaccggcgacgugccccugaucagaaucgaggaggacaccggcgagaucuucaccaccggcgccagaaucgacagagagaagcugugcgccggcauccccagagacgagcacugcuucuacgagguggagguggccauccugcccgacgagaucuucagacuggugaagaucagauuccugaucgaggacaucaacgacaacgccccccuguuccccgccaccgugaucaacaucagcauccccgagaacagcgccaucaacagcaaguacacccugcccgccgccguggaccccgacgugggcaucaacggcgugcagaacuacgagcugaucaagagccagaacaucuucggccuggacgugaucgagacccccgagggcgacaagaugccccagcugaucgugcagaaggagcuggacagagaggagaaggacaccuacgugaugaaggugaagguggaggacggcggcuucccccagagaagcagcaccgccauccugcaggugagcgugaccgacaccaacgacaaccaccccguguucaaggagaccgagaucgaggugagcauccccgagaacgcccccgugggcaccagcgugacccagcugcacgccaccgacgccgacaucggcgagaacgccaagauccacuucagcuucagcaaccuggugagcaacaucgccagaagacuguuccaccugaacgccaccaccggccugaucaccaucaaggagccccuggacagagaggagacccccaaccacaagcugcuggugcuggccagcgacggcggccugaugcccgccagagccauggugcuggugaacgugaccgacgugaacgacaacgugcccagcaucgacaucagauacaucgugaaccccgugaacgacaccguggugcugagcgagaacaucccccugaacaccaagaucgcccugaucaccgugaccgacaaggacgccgaccacaacggcagagugaccugcuucaccgaccacgagauccccuucagacugagacccguguucagcaaccaguuccugcuggagaccgccgccuaccuggacuacgagagcaccaaggaguacgccaucaagcugcuggccgccgacgccggcaagcccccccugaaccagagcgccaugcuguucaucaaggugaaggacgagaacgacaacgcccccguguucacccagagcuucgugaccgugagcauccccgagaacaacagccccggcauccagcugaccaaggugagcgccauggacgccgacagcggccccaacgccaagaucaacuaccugcugggccccgacgccccccccgaguucagccuggacugcagaaccggcaugcugaccguggugaagaagcuggacagagagaaggaggacaaguaccuguucaccauccuggccaaggacaacggcgugcccccccugaccagcaacgugaccguguucgugagcaucaucgaccagaacgacaacagccccguguucacccacaacgaguacaacuucuacgugcccgagaaccugcccagacacggcaccgugggccugaucaccgugaccgaccccgacuacggcgacaacagcgccgugacccugagcauccuggacgagaacgacgacuucaccaucgacagccagaccggcgugaucagacccaacaucagcuucgacagagagaagcaggagagcuacaccuucuacgugaaggccgaggacggcggcagagugagcagaagcagcagcgccaaggugaccaucaacgugguggacgugaacgacaacaagcccguguucaucgugccccccagcaacugcagcuacgagcuggugcugcccagcaccaaccccggcaccgugguguuccaggugaucgccguggacaacgacaccggcaugaacgccgaggugagauacagcaucgugggcggcaacaccagagaccuguucgccaucgaccaggagaccggcaacaucacccugauggagaagugcgacgugaccgaccugggccugcacagagugcuggugaaggccaacgaccugggccagcccgacagccuguucagcguggugaucgugaaccuguucgugaacgagagcgugaccaacgccacccugaucaacgagcuggugagaaagagcaccgaggcccccgugacccccaacaccgagaucgccgacgugagcagccccaccagcgacuacgugaagauccugguggccgccguggccggcaccaucaccguggugguggugaucuucaucaccgccguggugagaugcagacaggccccccaccugaaggccgcccagaagaacaagcagaacagcgagugggccacccccaaccccgagaacagacagaugaucaugaugaagaagaagaagaagaagaagaagcacagccccaagaaccugcugcugaacuucgugaccaucgaggagaccaaggccgacgacguggacagcgacggcaacagagugacccuggaccugcccaucgaccuggaggagcagaccaugggcaaguacaacugggugaccacccccaccaccuucaagcccgacagccccgaccuggccagacacuacaagagcgccagcccccagcccgccuuccagauccagcccgagaccccccugaacagcaagcaccacaucauccaggagcugccccuggacaacaccuucguggccugcgacagcaucagcaagugcagcagcagcagcagcgaccccuacagcgugagcgacugcggcuaccccgugaccaccuucgaggugcccgugagcgugcacaccagaccccccaugaaggagguggugagaagcugcacccccaugaaggagagcaccaccauggagaucuggauccacccccagccccagagaaagagcgagggcaagguggccggcaagagccagagaagagugaccuuccaccugcccgagggcagccaggagagcagcagcgacggcggccugggcgaccacgacgccggcagccugaccagcaccagccacggccugccccugggcuacccccaggaggaguacuucgacagagccacccccagcaacagaaccgagggcgacggcaacagcgaccccgagagcaccgccgagaucaccgugcagcccaccguggaggaggccagcgacaacugcacccaggagugccugaucuacggccacagcgacgccugcuggaugcccgccagccuggaccacagcagcagcagccaggcccaggccagcgcccugugccacagccccccccugagccaggccagcacccagcaccacagccccagagugacccagaccaucgcccugugccacagcccccccgugacccagaccaucgcccugugccacagccccccccccauccaggugagcgcccugcaccacagccccccccuggugcaggccaccgcccugcaccacagcccccccagcgcccaggccagcgcccugugcuacagccccccccuggcccaggccgccgccaucagccacagcagcccccugccccaggugaucgcccugcacagaagccaggcccagagcagcgugagccugcagcagggcugggugcagggcgccgacggccugugcagcguggaccagggcgugcagggcagcgccaccagccaguucuacaccaugagcgagagacugcaccccagcgacgacagcaucaaggugaucccccugaccaccuucacccccagacagcaggccagacccagcagaggcgacagccccaucauggaggagcacccccuguaa

SEQ ID NO: 21236 - RNA, 3114 nt, Artificial Sequence
  PCDH11Y__Homo_sapiens__NP_116753
augaccgugggcuucaacagcgacaucagcagcguggugagagugaacaccaccaacugccacaagugccugcugagcggcaccuacaucuucgccgugcugcuggugugcgugguguuccacagcggcgcccaggagaagaacuacaccaucagagaggagauccccgagaacgugcugaucggcaaccugcugaaggaccugaaccugagccugauccccaacaagagccugaccaccaccaugcaguucaagcugguguacaagaccggcgacgugccccugaucagaaucgaggaggacaccggcgagaucuucaccaccggcgccagaaucgacagagagaagcugugcgccggcauccccagagacgagcacugcuucuacgagguggagguggccauccugcccgacgagaucuucagacuggugaagaucagauuccugaucgaggacaucaacgacaacgccccccuguuccccgccaccgugaucaacaucagcauccccgagaacagcgccaucaacagcaaguacacccugcccgccgccguggaccccgacgugggcaucaacggcgugcagaacuacgagcugaucaagagccagaacaucuucggccuggacgugaucgagacccccgagggcgacaagaugccccagcugaucgugcagaaggagcuggacagagaggagaaggacaccuacgugaugaaggugaagguggaggacggcggcuucccccagagaagcagcaccgccauccugcaggugagcgugaccgacaccaacgacaaccaccccguguucaaggagaccgagaucgaggugagcauccccgagaacgcccccgugggcaccagcgugacccagcugcacgccaccgacgccgacaucggcgagaacgccaagauccacuucagcuucagcaaccuggugagcaacaucgccagaagacuguuccaccugaacgccaccaccggccugaucaccaucaaggagccccuggacagagaggagacccccaaccacaagcugcuggugcuggccagcgacggcggccugaugcccgccagagccauggugcuggugaacgugaccgacgugaacgacaacgugcccagcaucgacaucagauacaucgugaaccccgugaacgacaccguggugcugagcgagaacaucccccugaacaccaagaucgcccugaucaccgugaccgacaaggacgccgaccacaacggcagagugaccugcuucaccgaccacgagauccccuucagacugagacccguguucagcaaccaguuccugcuggagaacgccgccuaccuggacuacgagagcaccaaggaguacgccaucaagcugcuggccgccgacgccggcaagcccccccugaaccagagcgccaugcuguucaucaaggugaaggacgagaacgacaacgcccccguguucacccagagcuucgugaccgugagcauccccgagaacaacagccccggcauccagcugaugaaggugagcgccaccgacgccgacagcggccccaacgccgagaucaacuaccugcugggccccgacgccccccccgaguucagccuggacagaagaaccggcaugcugaccguggugaagaagcuggacagagagaaggaggacaaguaccuguucaccauccuggccaaggacaacggcgugcccccccugaccagcaacgugaccguguucgugagcaucaucgaccagaacgacaacagccccguguucacccacaacgaguacaaguucuacgugcccgagaaccugcccagacacggcaccgugggccugaucaccgugaccgaccccgacuacggcgacaacagcgccgugacccugagcauccuggacgagaacgacgacuucaccaucgacagccagaccggcgugaucagacccaacaucagcuucgacagagagaagcaggagagcuacaccuucuacgugaaggccgaggacggcggcagagugagcagaagcagcagcgccaaggugaccaucaacgugguggacgugaacgacaacaagcccguguucaucgugccccccuacaacuacagcuacgagcuggugcugcccagcaccaaccccggcaccgugguguuccaggugaucgccguggacaacgacaccggcaugaacgccgaggugagauacagcaucgugggcggcaacaccagagaccuguucgccaucgaccaggagaccggcaacaucacccugauggagaagugcgacgugaccgaccugggccugcacagagugcuggugaaggccaacgaccugggccagcccgacagccuguucagcguggugaucgugaaccuguucgugaacgagagcgugaccaacgccacccugaucaacgagcuggugagaaagagcaucgaggcccccgugacccccaacaccgagaucgccgacgugagcagccccaccagcgacuacgugaagauccugguggccgccguggccggcaccaucaccguggugguggugaucuucaucaccgccguggugagaugcagacaggccccccaccugaaggccgcccagaagaacaugcagaacagcgagugggccacccccaaccccgagaacagacagaugaucaugaugaagaagaagaagaagaagaagaagcacagccccaagaaccugcugcugaacguggugaccaucgaggagaccaaggccgacgacguggacagcgacggcaacagagugacccuggaccugcccaucgaccuggaggagcagaccaugggcaaguacaacugggugaccacccccaccaccuucaagcccgacagccccgaccuggccagacacuacaagagcgccagcccccagcccgccuuccagauccagcccgagaccccccugaaccugaagcaccacaucauccaggagcugccccuggacaacaccuucguggccugcgacagcaucagcaacugcagcagcagcagcagcgaccccuacagcgugagcgacugcggcuaccccgugaccaccuucgaggugcccgugagcgugcacaccagacccaccgacagcagaaccuaa

SEQ ID NO: 21237 - RNA, 5889 nt, Artificial Sequence
  PCDH15__Homo_sapiens__NP_001136235
auguucagacaguucuaccuguggaccugccuggccagcggcaucauccugggcagccuguucgagaucugccugggccaguacgacgacgacuggcaguacgaggacugcaagcuggccagaggcggcccccccgccaccaucguggccaucgacgaggagagcagaaacggcaccauccugguggacaacaugcugaucaagggcaccgccggcggccccgaccccaccaucgagcugagccugaaggacaacguggacuacugggugcugauggaccccgugaagcagaugcuguuccugaacagcaccggcagagugcuggacagagacccccccaugaacauccacagcaucguggugcaggugcagugcaucaacaagaaggugggcaccaucaucuaccacgaggugagaaucguggugagagacagaaacgacaacagccccaccuucaagcacgagagcuacuacgccaccgugaacgagcugacccccgugggcaccaccaucuucaccggcuucagcggcgacaacggcgccaccgacaucgacgacggccccaacggccagaucgaguacgugauccaguacaaccccgacgaccccaccagcaacgacaccuucgagaucccccugaugcugaccggcaacaucgugcugagaaagagacugaacuacgaggacaagaccagauacuucgugaucauccaggccaacgacagagcccagaaccugaacgagagaagaaccaccaccaccacccugaccguggacgugcuggacggcgacgaccugggccccauguuccugcccugcgugcuggugcccaacaccagagacugcagaccccugaccuaccaggccgccauccccgagcugagaacccccgaggagcugaaccccaucaucgugaccccccccauccaggccaucgaccaggacagaaacauccagccccccagcgacagacccggcauccuguacagcauccuggugggcacccccgaggacuaccccagauucuuccacaugcaccccagaaccgccgagcugagccugcuggagcccgugaacagagacuuccaccagaaguucgaccuggugaucaaggccgagcaggacaacggccacccccugcccgccuucgccggccugcacaucgagauccuggacgagaacaaccagagccccuacuucaccaugcccagcuaccagggcuacauccuggagagcgcccccgugggcgccaccaucagcgacagccugaaccugaccagcccccugagaaucguggcccuggacaaggacaucgaggacaccaaggaccccgagcugcaccuguuccugaacgacuacaccagcguguucaccgugacccagaccggcaucaccagauaccugacccugcugcagcccguggacagagaggagcagcagaccuacaccuucagcaucaccgccuucgacggcgugcaggagagcgagcccgugaucgugaacauccaggugauggacgccaacgacaacacccccaccuuccccgagaucagcuacgacguguacguguacaccgacaugagacccggcgacagcgugauccagcugaccgccguggacgccgacgagggcagcaacggcgagaucaccuacgagauccuggugggcgcccagggcgacuucaucaucaacaagaccaccggccugaucaccaucgcccccggcguggagaugaucgugggcagaaccuacgcccugaccgugcaggccgccgacaacgccccccccgccgagagaagaaacagcaucugcaccguguacaucgaggugcugccccccaacaaccagagcccccccagauucccccagcugauguacagccuggagaucagcgaggccaugagagugggcgccgugcugcugaaccugcaggccaccgacagagagggcgacagcaucaccuacgccaucgagaacggcgacccccagagaguguucaaccugagcgagaccaccggcauccugacccugggcaaggcccuggacagagagagcaccgacagauacauccugaucaucaccgccagcgacggcagacccgacggcaccagcaccgccaccgugaacaucguggugaccgacgugaacgacaacgcccccguguucgaccccuaccugcccagaaaccugagcgugguggaggaggaggccaacgccuucgugggccaggugaaggccaccgaccccgacgccggcaucaacggccaggugcacuacagccugggcaacuucaacaaccuguucagaaucaccagcaacggcagcaucuacaccgccgugaagcugaacagagaggugagagacuacuacgagcugguggugguggccaccgacggcgccgugcaccccagacacagcacccugacccuggccaucaaggugcuggacaucgacgacaacagccccguguucaccaacagcaccuacaccgugcugguggaggagaaccugcccgccggcaccaccauccugcagaucgaggccaaggacguggaccugggcgccaacgugagcuacagaaucagaagccccgaggugaagcacuucuucgcccugcaccccuucaccggcgagcugagccugcugagaagccuggacuacgaggccuuccccgaccaggaggccagcaucaccuuccugguggaggccuucgacaucuacggcaccaugccccccggcaucgccaccgugaccgugaucgugaaggacaugaacgacuacccccccguguucagcaagagaaucuacaagggcaugguggcccccgacgccgugaagggcacccccaucaccaccguguacgccgaggacgccgacccccccggccugcccgccagcagagugagauacagaguggacgacgugcaguuccccuaccccgccagcaucuucgagguggaggaggacagcggcagagugaucaccagagugaaccugaacgaggagcccaccaccaucuucaagcugguggugguggccuucgacgacggcgagcccgugaugagcagcagcgccaccgugaagauccuggugcugcaccccggcgagauccccagauucacccaggaggaguacagacccccccccgugagcgagcuggccaccaagggcaccauggugggcgugaucagcgccgccgccaucaaccagagcaucguguacagcaucgugagcggcaacgaggaggacaccuucggcaucaacaacaucaccggcgugaucuacgugaacggcccccuggacuacgagaccagaaccagcuacgugcugagagugcaggccgacagccuggagguggugcuggccaaccugagagugcccagcaagagcaacaccgccaagguguacaucgagauccaggacgagaacaaccacccccccguguuccagaagaaguucuacaucggcggcgugagcgaggacgccagaauguucaccagcgugcugagagugaaggccaccgacaaggacaccggcaacuacagcgugauggccuacagacugaucaucccccccaucaaggagggcaaggagggcuucgugguggagaccuacaccggccugaucaagaccgccaugcuguuccacaacaugagaagaagcuacuucaaguuccaggugaucgccaccgacgacuacggcaagggccugagcggcaaggccgacgugcuggugagcguggugaaccagcuggacaugcaggugaucgugagcaacgugccccccacccugguggagaagaagaucgaggaccugaccgagauccuggacagauacgugcaggagcagauccccggcgccaagguggugguggagagcaucggcgccagaagacacggcgacgccuucagccuggaggacuacaccaagugcgaccugaccguguacgccaucgacccccagaccaacagagccaucgacagaaacgagcuguucaaguuccuggacggcaagcugcuggacaucaacaaggacuuccagcccuacuacggcgagggcggcagaauccuggagaucagaacccccgaggccgugaccagcaucaagaagagaggcgagagccugggcuacaccgagggcgcccugcuggcccuggccuucaucaucauccugugcugcauccccgccauccugguggugcuggugagcuacagacaguucaaggugagacaggccgagugcaccaagaccgccagaauccaggccgcccugcccgccgccaagcccgccgugcccgcccccgcccccguggccgcccccccccccccccccccccccccccccggcgcccaccuguacgaggagcugggcgacagcagcaugcacaaccuguuccugcuguaccacuuccagcagagcagaggcaacaacagcgugagcgaggacagaaagcaccagcagguggugaugcccuucagcagcaacaccaucgaggcccacaagagcgcccacguggacggcagccugaagagcaacaagcugaagagcgccagaaaguucaccuuccugagcgacgaggacgaccugagcgcccacaacccccuguacaaggagaacaucagccaggugagcaccaacagcgacaucagccagagaaccgacuucguggaccccuucagccccaagauccaggccaagagcaagagccugagaggccccagagagaagauccagagacuguggagccagagcgugagccugcccagaagacugaugagaaaggugcccaacagacccgagaucaucgaccugcagcaguggcagggcaccagacagaaggccgagaacgagaacaccggcaucugcaccaacaagagaggcagcagcaacccccugcugaccaccgaggaggccaaccugaccgagaaggaggagaucagacagggcgagacccugaugaucgagggcaccgagcagcugaagagccugagcagcgacagcagcuucugcuuccccagaccccacuucagcuucagcacccugcccaccgugagcagaaccguggagcugaagagcgagcccaacgugaucagcagccccgccgagugcagccuggagcugagccccagcagacccugcgugcugcacagcagccugagcagaagagagacccccaucugcaugcugcccaucgagaccgagagaaacaucuucgagaacuucgcccacccccccaacaucagccccagcgccugcccccugcccccccccccccccaucagcccccccagccccccccccgcccccgccccccuggcccccccccccgacaucagccccuucagccuguucugccccccccccagcccccccagcaucccccugccccugcccccccccaccuucuucccccugagcgugagcaccagcggcccccccacccccccccugcugccccccuuccccaccccccugcccccccccccccccagcauccccugcccccccccccccagcgccagcuuccugagcaccgagugcgugugcaucaccggcgugaagugcaccaccaaccugaugcccgccgagaagaucaagagcagcaugacccagcugagcaccaccaccgugugcaagaccgacccccagagagagcccaagggcauccugagacacgugaagaaccuggccgagcuggagaagagcguggccaacauguacagccagaucgagaagaacuaccugagaaccaacgugagcgagcugcagaccaugugccccagcgaggugaccaacauggagaucaccagcgagcagaacaagggcagccugaacaacaucguggagggcaccgagaagcagagccacagccagagcaccagccuguaa

SEQ ID NO: 21238 - RNA, 3480 nt, Artificial Sequence
  PCDH17__Homo_sapiens__XP_005266414
auguaccugagcaucugcugcugcuuccugcugugggcccccgcccugacccugaagaaccugaacuacagcgugcccgaggagcagggcgccggcaccgugaucggcaacaucggcagagacgccagacugcagcccggccugccccccgccgagagaggcggcggcggcagaagcaagagcggcagcuacagagugcuggagaacagcgccccccaccugcuggacguggacgccgacagcggccugcuguacaccaagcagagaaucgacagagagagccugugcagacacaacgccaagugccagcugagccuggagguguucgccaacgacaaggagaucugcaugaucaagguggagauccaggacaucaacgacaacgcccccagcuucagcagcgaccagaucgagauggacaucagcgagaacgccgcccccggcaccagauucccccugaccagcgcccacgaccccgacgccggcgagaacggccugagaaccuaccugcugaccagagacgaccacggccuguucggccuggacgugaagagcagaggcgacggcaccaaguuccccgagcuggugauccagaaggcccuggacagagagcagcagaaccaccacacccuggugcugaccgcccuggacggcggcgagccccccagaagcgccaccgugcagaucaacgugaaggugaucgacagcaacgacaacagccccguguucgaggcccccagcuaccugguggagcugcccgagaacgccccccugggcaccguggugaucgaccugaacgccaccgacgccgacgagggccccaacggcgaggugcuguacagcuucagcagcuacgugcccgacagagugagagagcuguucagcaucgaccccaagaccggccugaucagagugaagggcaaccuggacuacgaggagaacggcaugcuggagaucgacgugcaggccagagaccugggccccaaccccauccccgcccacugcaaggugaccgugaagcugaucgacagaaacgacaacgcccccagcaucggcuucgugagcgugagacagggcgcccugagcgaggccgccccccccggcaccgugaucgcccuggugagagugaccgacagagacagcggcaagaacggccagcugcagugcagagugcugggcggcggcggcaccggcggcggcggcggccugggcggccccggcggcagcgugcccuucaagcuggaggagaacuacgacaacuucuacaccguggugaccgacagaccccuggacagagagacccaggacgaguacaacgugaccaucguggccagagacggcggcagccccccccugaacagcaccaagagcuucgccaucaagauccuggacgagaacgacaacccccccagauucaccaagggccuguacgugcugcaggugcacgagaacaacauccccggcgaguaccugggcagcgugcuggcccaggaccccgaccugggccagaacggcaccgugagcuacagcauccugcccagccacaucggcgacgugagcaucuacaccuacgugagcgugaaccccaccaacggcgccaucuacgcccugagaagcuucaacuucgagcagaccaaggccuucgaguucaaggugcuggccaaggacagcggcgcccccgcccaccuggagagcaacgccaccgugagagugaccgugcuggacgugaacgacaacgcccccgugaucgugcugcccacccugcagaacgacaccgccgagcugcaggugcccagaaacgccggccugggcuaccuggugagcaccgugagagcccuggacagcgacuucggcgagagcggcagacugaccuacgagaucguggacggcaacgacgaccaccuguucgagaucgaccccagcagcggcgagaucagaacccugcaccccuucugggaggacgugacccccgugguggagcugguggugaaggugaccgaccacggcaagcccacccugagcgccguggccaagcugaucaucagaagcgugagcggcagccugcccgagggcgugcccagagugaacggcgagcagcaccacugggacaugagccugccccugaucgugacccugagcaccaucagcaucauccugcuggccgccaugaucaccaucgccgugaagugcaagagagagaacaaggagaucagaaccuacaacugcagaaucgccgaguacagccacccccagcugggcggcggcaagggcaagaagaagaagaucaacaagaacgacaucaugcuggugcagagcgagguggaggagagaaacgccaugaacgugaugaacguggugagcagccccagccuggccaccagccccauguacuucgacuaccagaccagacugccccugagcagccccagaagcgaggugauguaccugaagcccgccagcaacaaccugaccgugccccagggccacgccggcugccacaccagcuucaccggccagggcaccaacgccagcgagacccccgccaccagaaugagcaucauccagaccgacaacuuccccgccgagcccaacuacaugggcagcagacagcaguucgugcagagcagcagcaccuucaaggaccccgagagagccagccugagagacagcggccacggcgacagcgaccaggccgacagcgaccaggacaccaacaagggcagcugcugcgacaugagcgugagagaggcccugaagaugaagaccaccagcaccaagagccagccccuggagcaggagcccgaggagugcgugaacugcaccgacgagugcagagugcugggccacagcgacagaugcuggaugccccaguuccccgccgccaaccaggccgagaacgccgacuacagaaccaaccuguucgugcccaccguggaggccaacguggagaccgagaccuacgagaccgugaaccccaccggcaagaagaccuucugcaccuucggcaaggacaagagagagcacaccauccugaucgccaacgugaagcccuaccugaaggccaagagagcccugagcccccugcugcaggaggugcccagcgccagcagcagccccaccaaggccugcaucgagcccugcaccagcaccaagggcagccuggacggcugcgaggccaagcccggcgcccuggccgaggccagcagccaguaccugcccaccgacagccaguaccugagccccagcaagcagcccagagacccccccuucauggccagcgaccagauggccagaguguucgccgacgugcacagcagagccagcagagacagcagcgagaugggcgccgugcuggagcagcuggaccaccccaacagagaccugggcagagagagcguggacgccgaggagguggugagagagaucgacaagcugcugcaggacugcagaggcaacgaccccguggccgugagaaaguaa

SEQ ID NO: 21239 - RNA, 3405 nt, Artificial Sequence
  PCDH18__Homo_sapiens__NP_001287757
augcaccagaugaacgccaagaugcacuucagauucguguucgcccugcugaucgugagcuucaaccacgacgugcugggcaagaaccugaaguacagaaucuacgaggagcagagagugggcagcgugaucgccagacugagcgaggacguggccgacgugcugcugaagcugcccaaccccagcaccgugagauucagagccaugcagagaggcaacagcccccugcugguggugaacgaggacaacggcgagaucagcaucggcgccaccaucgacagagagcagcugugccagaagaaccugaacugcagcaucgaguucgacgugaucacccugcccaccgagcaccugcagcuguuccacaucgagguggaggugcuggacaucaacgacaacagcccccaguucagcagaagccugauccccaucgagaucagcgagagcgccgccgugggcaccagaaucccccuggacagcgccuucgaccccgacgugggcgagaacagccugcacaccuacagccugagcgccaacgacuucuucaacaucgaggugagaaccagaaccgacggcgccaaguacgccgagcugaucguggugagagagcuggacagagagcugaagagcagcuacgagcugcagcugaccgccagcgacaugggcgugccccagagaagcggcagcagcauccugaagaucagcaucagcgacagcaacgacaacagccccgccuucgagcagcagagcuacaucauccagcugcuggagaacagccccgugggcacccugcugcuggaccugaacgccaccgaccccgacgagggcgccaacggcaagaucguguacagcuucagcagccacgugagccccaagaucauggagaccuucaagaucgacagcgagagaggccaccugacccuguucaagcagguggacuacgagaucaccaagagcuacgagaucgacgugcaggcccaggaccugggccccaacagcauccccgcccacugcaagaucaucaucaaggugguggacgugaacgacaacaagcccgagaucaacaucaaccugaugagccccggcaaggaggagaucagcuacaucuucgagggcgaccccaucgacaccuucguggcccuggugagagugcaggacaaggacagcggccugaacggcgagaucgugugcaagcugcacggccacggccacuucaagcugcagaagaccuacgagaacaacuaccugauccugaccaacgccacccuggacagagagaagagaagcgaguacagccugaccgugaucgccgaggacagaggcacccccagccugagcaccgugaagcacuucaccgugcagaucaacgacaucaacgacaaccccccccacuuccagagaagcagauacgaguucgugaucagcgagaacaacagccccggcgccuacaucaccaccgugaccgccaccgaccccgaccugggcgagaacggccaggugaccuacaccauccuggagagcuucauccugggcagcagcaucaccaccuacgugaccaucgaccccagcaacggcgccaucuacgcccugagaaucuucgaccacgaggaggugagccagaucaccuucgugguggaggccagagacggcggcagccccaagcagcuggugagcaacaccaccguggugcugaccaucaucgacgagaacgacaacgugcccguggugaucggccccgcccugagaaacaacaccgccgagaucaccauccccaagggcgccgagagcggcuuccacgugaccagaaucagagccaucgacagagacagcggcgugaacgccgagcugagcugcgccaucguggccggcaacgaggagaacaucuucaucaucgaccccagaagcugcgacauccacaccaacgugagcauggacagcgugcccuacaccgagugggagcugagcgugaucauccaggacaagggcaacccccagcugcacaccaaggugcugcugaagugcaugaucuucgaguacgccgagagcgugaccagcaccgccaugaccagcgugagccaggccagccuggacgugagcaugaucaucaucaucagccugggcgccaucugcgccgugcugcuggugaucauggugcuguucgccaccagaugcaacagagagaagaaggacaccagaagcuacaacugcagaguggccgagagcaccuaccagcaccaccccaagagacccagcagacagauccacaagggcgacaucacccuggugcccaccaucaacggcacccugcccaucagaagccaccacagaagcagccccagcagcagccccacccuggagagaggccagaugggcagcagacagagccacaacagccaccagagccugaacagccuggugaccaucagcagcaaccacgugcccgagaacuucagccuggagcugacccacgccacccccgccguggaggugagccagcugcugagcaugcugcaccagggccaguaccagcccagacccagcuucagaggcaacaaguacagcagaagcuacagauacgcccugcaggacauggacaaguucagccugaaggacagcggcagaggcgacagcgaggccggcgacagcgacuacgaccugggcagagacagccccaucgacagacugcugggcgagggcuucagcgaccuguuccugaccgacggcagaauccccgccgccaugagacugugcaccgaggagugcagagugcugggccacagcgaccagugcuggaugcccccccugcccagccccagcagcgacuacagaagcaacauguucauccccggcgaggaguuccccacccagccccagcagcagcacccccaccagagccuggaggacgacgcccagcccgccgacagcggcgagaagaagaagagcuucagcaccuucggcaaggacagccccaacgacgaggacaccggcgacaccagcaccagcagccugcugagcgagaugagcagcguguuccagagacugcugccccccagccuggacaccuacagcgagugcagcgagguggacagaagcaacagccuggagagaagaaagggcccccugcccgccaagaccgugggcuacccccagggcguggccgccugggccgccagcacccacuuccagaaccccaccaccaacugcggccccccccugggcacccacagcagcgugcagcccagcagcaaguggcugcccgccauggaggagauccccgagaacuacgaggaggacgacuucgacaacgugcugaaccaccugaacgacggcaagcacgagcugauggacgccagcgagcugguggccgagaucaacaagcugcugcaggacgugagacagagcuaa

SEQ ID NO: 21240 - RNA, 3306 nt, Artificial Sequence
  PCDH19__Homo_sapiens__NP_001098713
auggagagccugcugcugcccgugcugcugcugcuggccauccuguggacccaggccgccgcccugaucaaccugaaguacagcguggaggaggagcagagagccggcaccgugaucgccaacguggccaaggacgccagagaggccggcuucgcccuggaccccagacaggccagcgccuucagaguggugagcaacagcgccccccaccugguggacaucaaccccagcagcggccugcuggugaccaagcagaagaucgacagagaccugcugugcagacagagccccaagugcaucaucagccuggaggugaugagcagcagcauggagaucugcgugaucaagguggagaucaaggaccugaacgacaacgcccccagcuuccccgccgcccagaucgagcuggagaucagcgaggccgccagccccggcaccagaaucccccuggacagcgccuacgaccccgacagcggcagcuucggcgugcagaccuacgagcugacccccaacgagcuguucggccuggagaucaagaccagaggcgacggcagcagauucgccgagcuggugguggagaagagccuggacagagagacccagagccacuacagcuucagaaucaccgcccuggacggcggcgacccccccagacugggcaccgugggccugagcaucaaggugaccgacagcaacgacaacaaccccguguucagcgagagcaccuacgccgugagcgugcccgagaacagcccccccaacacccccgugaucagacugaacgccagcgaccccgacgagggcaccaacggccaggugguguacagcuucuacggcuacgugaacgacagaaccagagagcuguuccagaucgacccccacagcggccuggugaccgugaccggcgcccuggacuacgaggagggccacguguacgagcuggacgugcaggccaaggaccugggccccaacagcauccccgcccacugcaaggugaccgugagcgugcuggacaccaacgacaacccccccgugaucaaccugcugagcgugaacagcgagcugguggaggugagcgagagcgccccccccggcuacgugaucgcccuggugagagugagcgacagagacagcggccugaacggcagagugcagugcagacugcugggcaacgugcccuucagacugcaggaguacgagagcuucagcaccauccugguggacggcagacuggacagagagcagcacgaccaguacaaccugaccauccaggccagagacggcggcgugcccaugcugcagagcgccaagagcuucaccgugcugaucaccgacgagaacgacaaccacccccacuucagcaagcccuacuaccaggugaucgugcaggagaacaacacccccggcgccuaccugcugagcgugagcgccagagaccccgaccugggccugaacggcagcgugagcuaccagaucgugcccagccaggugagagacaugcccguguucaccuacgugagcaucaaccccaacagcggcgacaucuacgcccugagaagcuucaaccacgagcagaccaaggccuucgaguucaaggugcuggccaaggacggcggccugcccagccugcagagcaacgccaccgugagagugaucauccuggacgugaacgacaacacccccgugaucaccgcccccccccugaucaacggcaccgccgagguguacauccccagaaacagcggcaucggcuaccuggugaccguggugaaggccgaggacuacgacgagggcgagaacggcagagugaccuacgacaugaccgagggcgacagaggcuucuucgagaucgaccaggugaacggcgaggugagaaccaccagaaccuucggcgagagcagcaagagcagcuacgagcugaucgugguggcccacgaccacggcaagaccagccugagcgccagcgcccuggugcugaucuaccugagccccgcccuggacgcccaggagagcaugggcagcgugaaccugagccugaucuucaucaucgcccugggcagcaucgccggcauccuguucgugaccaugaucuucguggccaucaagugcaagagagacaacaaggagaucagaaccuacaacugcagaaucgccgaguacagcuacggccaccagaagaagagcagcaagaagaagaagaucagcaagaacgacaucagacuggugcccagagacguggaggagaccgacaagaugaacguggugagcugcagcagccugaccagcagccugaacuacuucgacuaccaccagcagacccugccccugggcugcagaagaagcgagagcaccuuccugaacguggagaaccagaacaccagaaacaccagcgccaaccacaucuaccaccacagcuucaacagccagggcccccagcagcccgaccugaucaucaacggcgugccccugcccgagaccgagaacuacagcuucgacagcaacuacgugaacagcagagcccaccugaucaagagcagcagcaccuucaaggaccuggagggcaacagccugaaggacagcggccacgaggagagcgaccagaccgacagcgagcacgacgugcagagaagccuguacugcgacaccgccgugaacgacgugcugaacaccagcgugaccagcaugggcagccagaugcccgaccacgaccagaacgagggcuuccacugcagagaggagugcagaauccugggccacagcgacagaugcuggaugcccagaaaccccaugcccaucagaagcaagagccccgagcacgugagaaacaucaucgcccugagcaucgaggccaccgccgccgacguggaggccuacgacgacugcggccccaccaagagaaccuucgccaccuucggcaaggacgugagcgaccaccccgccgaggagagacccacccugaagggcaagagaaccguggacgugaccaucugcagccccaaggugaacagcgugaucagagaggccggcaacggcugcgaggccaucagccccgugaccagcccccugcaccugaagagcagccugcccaccaagcccagcgugagcuacaccaucgcccuggccccccccgccagagaccuggagcaguacgugaacaacgugaacaacggccccaccagacccagcgaggccgagcccagaggcgccgacagcgagaaggugaugcacgaggugagccccauccugaaggagggcagaaacaaggagagccccggcgugaagagacugaaggacaucgugcuguaa

SEQ ID NO: 21241 - RNA, 3231 nt, Artificial Sequence
  PCDH1__Homo_sapiens__NP_001265542
augagauucagagaccugagcuucuggaacagaggcagcgugcugggccugaccgcccugguggagaacagagugagcgugggcgaggcccugcugauccugggcccccccagaauggagcaccugagacacagccccggccccggcggccagagacugcugcugcccagcaugcugcuggcccugcugcugcugcuggcccccagccccggccacgccaccagagugguguacaaggugcccgaggagcagccccccaacacccugaucggcagccuggccgccgacuacggcuuccccgacgugggccaccuguacaagcuggaggugggcgcccccuaccugagaguggacggcaagaccggcgacaucuucaccaccgagaccagcaucgacagagagggccugagagagugccagaaccagcugcccggcgaccccugcauccuggaguucgaggugagcaucaccgaccuggugcagaacggcagccccagacugcuggagggccagaucgaggugcaggacaucaacgacaacacccccaacuucgccagccccgugaucacccuggccauccccgagaacaccaacaucggcagccuguuccccaucccccuggccagcgacagagacgccggccccaacggcguggccagcuacgagcugcaggccggccccgaggcccaggagcuguucggccugcagguggccgaggaccaggaggagaagcagccccagcugaucgugaugggcaaccuggacagagagagaugggacagcuacgaccugaccaucaaggugcaggacggcggcagcccccccagagccagcagcgcccugcugagagugaccgugcuggacaccaacgacaacgcccccaaguucgagagacccagcuacgaggccgagcugagcgagaacagccccaucggccacagcgugauccaggugaaggccaacgacagcgaccagggcgccaacgccgagaucgaguacaccuuccaccaggcccccgagguggugagaagacugcugagacuggacagaaacaccggccugaucaccgugcagggccccguggacagagaggaccugagcacccugagauucagcgugcuggccaaggacagaggcaccaaccccaagagcgccagagcccaggugguggugaccgugaaggacaugaacgacaacgcccccaccaucgagaucagaggcaucggccuggugacccaccaggacggcauggccaacaucagcgaggacguggccgaggagaccgccguggcccuggugcaggugagcgacagagacgagggcgagaacgccgccgugaccugcgugguggccggcgacgugcccuuccagcugagacaggccagcgagaccggcagcgacagcaagaagaaguacuuccugcagaccaccaccccccuggacuacgagaaggugaaggacuacaccaucgagaucguggccguggacagcggcaaccccccccugagcagcaccaacagccugaaggugcaggugguggacgugaacgacaacgcccccguguucacccagagcgugaccgagguggccuuccccgagaacaacaagcccggcgaggugaucgccgagaucaccgccagcgacgccgacagcggcagcaacgccgagcugguguacagccuggagcccgagcccgccgccaagggccuguucaccaucagccccgagaccggcgagauccaggugaagaccagccuggacagagagcagagagagagcuacgagcugaaggugguggccgccgacagaggcagccccagccugcagggcaccgccaccgugcuggugaacgugcuggacugcaacgacaacgaccccaaguucaugcugagcggcuacaacuucagcgugauggagaacaugcccgcccugagccccgugggcauggugaccgugaucgacggcgacaagggcgagaacgcccaggugcagcugagcguggagcaggacaacggcgacuucgugauccagaacggcaccggcaccauccugagcagccugagcuucgacagagagcagcagagcaccuacaccuuccagcugaaggccguggacggcggcgugccccccagaagcgccuacgugggcgugaccaucaacgugcuggacgagaacgacaacgcccccuacaucaccgcccccagcaacaccagccacaagcugcugaccccccagaccagacugggcgagaccgugagccagguggccgccgaggacuucgacagcggcgugaacgccgagcugaucuacagcaucgccggcggcaaccccuacggccuguuccagaucggcagccacagcggcgccaucacccuggagaaggagaucgagagaagacaccacggccugcacagacugguggugaaggugagcgacagaggcaagccccccagauacggcaccgcccuggugcaccuguacgugaacgagacccuggccaacagaacccugcuggagacccugcugggccacagccuggacaccccccuggacaucgacaucgccggcgaccccgaguacgagagaagcaagcagagaggcaacauccuguucggcgugguggccggcgugguggccguggcccugcugaucgcccuggccgugcuggugagauacugcagacagagagaggccaagagcggcuaccaggccggcaagaaggagaccaaggaccuguacgcccccaagcccagcggcaaggccagcaagggcaacaagagcaagggcaagaagagcaagagccccaagcccgugaagcccguggaggacgaggacgaggccggccugcagaagagccugaaguucaaccugaugagcgacgcccccggcgacagccccagaauccaccugccccugaacuacccccccggcagccccgaccugggcagacacuacagaagcaacagcccccugcccagcauccagcugcagccccagagccccagcgccagcaagaagcaccagguggugcaggaccugccccccgccaacaccuucgugggcaccggcgacaccaccagcaccggcagcgagcaguacagcgacuacagcuacagaaccaacccccccaaguaccccagcaagcaggugggccagcccuuccagcugagcaccccccagccccugccccaccccuaccacggcgccaucuggaccgaggugugggaguaa

SEQ ID NO: 21242 - RNA, 2856 nt, Artificial Sequence
  PCDH20__Homo_sapiens__NP_073754
augagaggcagaggcaacgccagaagcagccaggcccugggcgugagcuggugccccgccaccuggcaccccagacuggacaugggcagacugcacagacccagaagcagcaccagcuacagaaaccugccccaccuguuccuguucuuccuguucgugggccccuucagcugccugggcagcuacagcagagccaccgagcugcuguacagccugaacgagggccugcccgccggcgugcugaucggcagccuggccgaggaccugagacugcugcccagaagcgccggcagacccgacccccagagccagcugcccgagagaaccggcgccgaguggaaccccccccugagcuucagccuggccagcagaggccugagcggccaguacgugacccuggacaacagaagcggcgagcugcacaccagcgcccaggagaucgacagagaggcccugugcguggagggcggcggcggcaccgccuggagcggcagcgugagcaucagcagcagccccagcgacagcugccugcugcugcuggacgugcuggugcugccccaggaguacuucagauucgugaaggugaagaucgccaucagagacaucaacgacaacgccccccaguuccccgugagccagaucagcgugugggugcccgagaacgcccccgugaacaccagacuggccaucgagcaccccgccguggaccccgacgugggcaucaacggcgugcagaccuacagacugcuggacuaccacggcauguucacccuggacguggaggagaacgagaacggcgagagaacccccuaccugaucgugaugggcgcccuggacagagagacccaggaccaguacgugagcaucaucaucgccgaggacggcggcagccccccccugcugggcagcgccacccugaccaucggcaucagcgacaucaacgacaacugcccccuguucaccgacagccagaucaacgugaccguguacggcaacgccaccgugggcacccccaucgccgccgugcaggccguggacaaggaccugggcaccaacgcccagaucaccuacagcuacagccagaaggugccccaggccagcaaggaccuguuccaccuggacgagaacaccggcgugaucaagcuguucagcaagaucggcggcagcgugcuggagagccacaagcugaccauccuggccaacggccccggcugcauccccgccgugaucaccgcccuggugagcaucaucaaggugaucuucagaccccccgagaucgugcccagauacaucgccaacgagaucgacggcgugguguaccugaaggagcuggagcccgugaacacccccaucgccuucuucaccaucagagaccccgagggcaaguacaaggugaacugcuaccuggacggcgagggccccuucagacugagccccuacaagcccuacaacaacgaguaccugcuggagaccaccaagcccauggacuacgagcugcagcaguucuacgagguggccgugguggccuggaacagcgagggcuuccacgugaagagagugaucaaggugcagcugcuggacgacaacgacaacgcccccaucuuccugcagccccugaucgagcugaccaucgaggagaacaacagccccaacgccuuccugaccaagcuguacgccaccgacgccgacagcgaggagagaggccaggugagcuacuuccugggccccgacgcccccagcuacuucagccuggacagcgugaccggcauccugaccgugagcacccagcuggacagagaggagaaggagaaguacagauacaccgugagagccguggacugcggcaagccccccagagagagcguggccaccguggcccugaccgugcuggacaagaacgacaacagccccagauucaucaacaaggacuucagcuucuucgugcccgagaacuuccccggcuacggcgagaucggcgugaucagcgugaccgacgccgacgccggcagaaacggcuggguggcccugagcguggugaaccagagcgacaucuucgugaucgacaccggcaagggcaugcugagagccaaggugagccuggacagagagcagcagagcagcuacacccuguggguggaggccguggacggcggcgagcccgcccugagcagcaccgccaagaucaccauccugcugcuggacaucaacgacaaccccccccuggugcuguucccccagagcaacaugagcuaccugcuggugcugcccagcacccugcccggcagccccgugaccgagguguacgccguggacaaggacaccggcaugaacgccgugaucgccuacagcaucaucggcagaagaggccccagacccgagagcuucagaaucgaccccaagaccggcaacaucacccuggaggaggcccugcugcagaccgacuacggccugcacagacugcuggugaaggugagcgaccacggcuaccccgagccccugcacagcaccgugauggugaaccuguucgugaacgacaccgugagcaacgagagcuacaucgagagccugcugagaaaggagcccgagaucaacaucgaggagaaggagccccagaucagcaucgagcccacccacagaaagguggagagcgugagcugcaugcccacccugguggcccugagcgugaucagccugggcagcaucacccuggugaccggcaugggcaucuacaucugccugagaaagggcgagaagcaccccagagaggacgagaaccuggaggugcagaucccccugaagggcaagaucgaccugcacaugagagagagaaagcccauggacaucagcaacaucuaa

SEQ ID NO: 21243 - RNA, 3768 nt, Artificial Sequence
  PCDH7__Homo_sapiens__NP_001166994
augcugagaaugagaaccgccggcugggccagaggcuggugccugggcugcugccugcugcugccccugagccugagccuggccgccgccaagcagcugcugagauacagacuggccgaggagggccccgccgacgugagaaucggcaacguggccagcgaccugggcaucgugaccggcagcggcgaggugaccuucagccuggagagcggcagcgaguaccugaagaucgacaaccugaccggcgagcugagcaccagcgagagaagaaucgacagagagaagcugccccagugccagaugaucuucgacgagaacgagugcuuccuggacuucgaggugagcgugaucggccccagccagagcuggguggaccuguucgagggccaggugaucgugcuggacaucaacgacaacacccccaccuuccccagccccgugcugacccugaccguggaggagaacagacccgugggcacccuguaccugcugcccaccgccaccgacagagacuucggcagaaacggcaucgagagauacgagcugcugcaggagcccggcggcggcggcagcggcggcgagagcagaagagccggcgccgccgacagcgcccccuaccccggcggcggcggcaacggcgccagcggcggcggcagcggcggcagcaagagaagacuggacgccagcgagggcggcggcggcaccaaccccggcggcagaagcagcguguucgagcugcagguggccgacacccccgacggcgagaagcagccccagcugaucgugaagggcgcccuggacagagagcagagagacagcuacgagcugacccugagagugagagacggcggcgacccccccagaagcagccaggccauccugagagugcugaucaccgacgugaacgacaacagccccagauucgagaagagcguguacgaggccgaccuggccgagaacagcgcccccggcacccccauccugcagcugagagccgccgaccuggacgugggcgugaacggccagaucgaguacguguucggcgccgccaccgagagcgugagaagacugcugagacuggacgagaccagcggcuggcugagcgugcugcacagaaucgacagagaggaggugaaccagcugagauucaccgugauggccagagacagaggccagccccccaagaccgacaaggccaccguggugcugaacaucaaggacgagaacgacaacgugcccagcaucgagaucagaaagaucggcagaaucccccugaaggacggcguggccaacguggccgaggacgugcugguggacacccccaucgcccuggugcaggugagcgacagagaccagggcgagaacggcguggugaccugcaccguggugggcgacgugcccuuccagcugaagcccgccagcgacaccgagggcgaccagaacaagaagaaguacuuccugcacaccagcaccccccuggacuacgaggccaccagagaguucaacguggugaucguggccguggacagcggcagccccagccugagcagcaacaacagccugaucgugaaggugggcgacaccaacgacaacccccccauguucggccagagcgugguggagguguacuuccccgagaacaacauccccggcgagagaguggccaccgugcuggccaccgacgccgacagcggcaagaacgccgagaucgccuacagccuggacagcagcgugaugggcaucuucgccaucgaccccgacagcggcgacauccuggugaacaccgugcuggacagagagcagaccgacagauacgaguucaaggugaacgccaaggacaagggcauccccgugcugcagggcagcaccaccgugaucgugcagguggccgacaagaacgacaacgaccccaaguucaugcaggacguguucaccuucuacgugaaggagaaccugcagcccaacagccccgugggcauggugaccgugauggacgccgacaagggcagaaacgccgagaugagccuguacaucgaggagaacaacaacaucuucagcaucgagaacgacaccggcaccaucuacagcaccaugagcuucgacagagagcaccagaccaccuacaccuucagagugaaggccguggacggcggcgacccccccagaagcgccaccgccaccgugagccuguucgugauggacgagaacgacaacgcccccaccgugacccugcccaagaacaucagcuacacccugcugccccccagcagcaacgugagaaccgugguggccaccgugcuggccaccgacagcgacgacggcaucaacgccgaccugaacuacagcaucgugggcggcaaccccuucaagcuguucgagaucgaccccaccagcggcguggugagccuggugggcaagcugacccagaagcacuacggccugcacagacugguggugcaggugaacgacagcggccagcccagccagagcaccaccacccuggugcacguguucgugaacgagagcgugagcaacgccaccgccaucgacagccagaucgccagaagccugcacaucccccugacccaggacaucgccggcgaccccagcuacgagaucagcaagcagagacugagcaucgugaucggcgugguggccggcaucaugaccgugauccugaucauccugaucguggugauggccagauacugcagaagcaagaacaagaacggcuacgaggccggcaagaaggaccacgaggacuucuucaccccccagcagcacgacaagagcaagaagcccaagaaggacaagaagaacaagaagagcaagcagccccuguacagcagcaucgugaccguggaggccagcaagcccaacggccagagauacgacagcgugaacgagaagcugagcgacagccccagcaugggcagauacagaagcgugaacggcggccccggcagccccgaccuggccagacacuacaagagcagcagcccccugcccaccgugcagcugcacccccagagccccaccgccggcaagaagcaccaggccgugcaggaccugccccccgccaacaccuucgugggcgccggcgacaacaucagcaucggcagcgaccacugcagcgaguacagcugccagaccaacaacaaguacagcaagcagcccuucagaagagugaccuucagcguggugagccagccccaggacccccaccagggcagccugcagagcugcuacgacagcggccuggaggagagcgagacccccagcagcaagagcagcagcggccccagacugggcgcccugccccugcccgaggacaacuacgagagaaccacccccgacggcagcgugggcgaggccgagcacauggagaacgacagcagaccccugcccgacguggcccugaccggcaagugcaccagagagugcgacgaguacggccacagcgacagcugcuggaugcccgugagaaccagccccgagagaaagaagagccagcccaagcugagcaccuucaugcccguggacgagagaggcagccaggagaagcuggccaacggcgaggccgccaucaugggcgacagaaacagaaaccugcugaacaagaagcugaccagcagcuacgagaccuucagcgccgccagcuucagcaagaacgaggaggccaaccccgaggacaucccccugaccaagaccggcgaguacaagcccagccccgugaacacccugaccagaagagagguguaccuguaa

SEQ ID NO: 21244 - RNA, 3213 nt, Artificial Sequence
  PCDH8__Homo_sapiens__NP_002581
augagccccgugagaagauggggcagccccugccuguucccccugcagcuguucagccugugcugggugcugagcguggcccagagcaagaccgugagauacagcaccuucgaggaggacgcccccggcaccgugaucggcacccuggccgaggaccugcacaugaaggugagcggcgacaccagcuucagacugaugaagcaguucaacagcagccugcugagagugagagagggcgacggccagcugaccgugggcgacgccggccuggacagagagagacugugcggccaggccccccagugcgugcuggccuucgacguggugagcuucagccaggagcaguucagacuggugcacguggagguggaggugagagacgugaacgaccacgcccccagauuccccagagcccagauccccguggaggugagcgagggcgccgccgugggcaccagaaucccccuggaggugcccguggacgaggacgugggcgccaacggccugcagaccgugagacuggccgagccccacagccccuucagaguggagcugcagaccagagccgacggcgcccagugcgccgaccuggugcugcugcaggagcuggacagagagagccaggccgccuacagccuggagcugguggcccaggacggcggcagaccccccagaagcgccaccgccgcccugagcgugagagugcuggacgccaacgaccacagccccgccuucccccagggcgccguggccgagguggagcuggccgaggacgcccccgugggcagccugcugcuggaccuggacgccgccgaccccgacgagggccccaacggcgacgugguguucgccuucggcgccagaaccccccccgaggccagaagacuguucagacuggaccccagaagcggcagacugacccuggccggccccguggacuacgagagacaggacaccuacgagcuggacgugagagcccaggacagaggccccggccccagagccgccaccugcaaggugaucgugagaaucagagacgugaacgacaacgcccccgacaucgccaucaccccccuggccgcccccggcgcccccgccaccagccccuucgccgccgccgccgccgccgccgcccugggcggcgccgacgccagcagccccgccggcgccggcacccccgaggccggcgccaccagccuggugcccgagggcgccgccagagagagccugguggcccuggugagcaccagcgacagagacagcggcgccaacggccaggugagaugcgcccuguacggccacgagcacuucagacugcagcccgccuacgccggcagcuaccugguggugaccgccgccagccuggacagagagagaaucgccgaguacaaccugacccugguggccgaggacagaggcgcccccccccugagaaccgugagacccuacaccgugagagugggcgacgagaacgacaacgccccccuguucaccagacccguguacgaggugagcgugagagagaacaacccccccggcgccuaccuggccaccguggccgccagagacagagaccugggcagaaacggccaggugaccuacagacugcuggaggccgaggugggcagagccggcggcgccgugagcaccuacgugagcguggaccccgccaccggcgccaucuacgcccugagaagcuucgacuacgagacccugagacagcuggacgugagaauccaggccagcgacggcggcagcccccagcugagcagcagcgcccuggugcaggugagagugcuggaccagaacgaccacgcccccgugcuggugcaccccgcccccgccaacggcagccuggagguggccgugcccggcagaaccgccaaggacaccgugguggccagagugcaggccagagacgccgacgagggcgccaacggcgagcuggccuucgagcugcagcagcaggagcccagagaggccuucgccaucggcagaagaaccggcgagauccugcugaccggcgaccugagccaggagccccccggcagaguguucagagcccugcuggugaucagcgacggcggcagacccccccugaccaccaccgccaccgugagcuucguggugaccgccggcggcggcagaggccccgccgcccccgccagcgccggcagccccgagagaagcagaccccccggcagcagacugggcgugagcggcagcgugcugcagugggacaccccccugaucgugaucaucgugcuggccggcagcugcacccugcugcuggccgccaucaucgccaucgccaccaccugcaacagaagaaagaaggaggugagaaagggcggcgcccugagagaggagagacccggcgccgccggcggcggcgccagcgcccccggcagccccgaggaggccgccagaggcgccggccccagacccaacauguucgacgugcugaccuuccccggcaccggcaaggcccccuucggcagccccgccgccgacgcccccccccccgccguggccgccgccgaggugcccggcagcgagggcggcagcgccaccggcgagagcgccugccacuucgagggccagcagagacugagaggcgcccacgccgagcccuacggcgccagccccggcuucggcaaggagcccgccccccccguggccguguggaagggccacagcuucaacaccaucagcggcagagaggccgagaaguucagcggcaaggacagcggcaagggcgacagcgacuucaacgacagcgacagcgacaucagcggcgacgcccugaagaaggaccugaucaaccacaugcagagcggccugugggccugcaccgccgagugcaagauccugggccacagcgacagaugcuggagccccagcugcagcggccccaacgcccaccccagcccccacccccccgcccagaugagcaccuucugcaagagcaccagccugcccagagacccccugagaagagacaacuacuaccaggcccagcugcccaagaccgugggccugcagagcguguacgagaaggugcugcacagagacuacgacagaaccgugacccugcugagcccccccagacccggcagacugcccgaccugcaggagaucggcgugccccuguaccagagcccccccggcagauaccugagccccaagaagggcgccaacgagaacguguaa

SEQ ID NO: 21245 - RNA, 3612 nt, Artificial Sequence
  PCDH9__Homo_sapiens__NP_065136
auggaccugagagacuucuaccugcuggccgcccugaucgccugccugagacuggacagcgccaucgcccaggagcugaucuacaccaucagagaggagcugcccgagaacgugcccaucggcaacauccccaaggaccugaacaucagccacaucaacgccgccaccggcaccagcgccagccugguguacagacuggugagcaaggccggcgacgccccccuggugaaggugagcagcagcaccggcgagaucuucaccaccagcaacagaaucgacagagagaagcugugcgccggcgccagcuacgccgaggagaacgagugcuucuucgagcuggagguggugauccugcccaacgacuucuucagacugaucaagaucaagaucaucgugaaggacaccaacgacaacgcccccauguuccccagccccgugaucaacaucagcauccccgagaacacccugaucaacagcagauuccccauccccagcgccaccgaccccgacaccggcuucaacggcgugcagcacuacgagcugcugaacggccagagcguguucggccuggacaucguggagacccccgagggcgagaaguggccccagcugaucgugcagcagaaccuggacagagagcagaaggacaccuacgugaugaagaucaagguggaggacggcggcaccccccagaagagcagcaccgccauccugcaggugaccgugagcgacgugaacgacaacagacccguguucaaggagggccagguggaggugcacauccccgagaacgcccccgugggcaccagcgugauccagcugcacgccaccgacgccgacaucggcagcaacgccgagaucagauacaucuucggcgcccagguggcccccgccaccaagagacuguucgcccugaacaacaccaccggccugaucaccgugcagagaagccuggacagagaggagaccgccauccacaaggugaccgugcuggccagcgacggcagcagcacccccgccagagccaccgugaccaucaacgugaccgacgugaacgacaacccccccaacaucgaccugagauacaucaucagccccaucaacggcaccguguaccugagcgagaaggaccccgugaacaccaagaucgcccugaucaccgugagcgacaaggacaccgacgugaacggcaaggugaucugcuucaucgagagagaggugcccuuccaccugaaggccguguacgacaaccaguaccugcuggagaccagcagccugcuggacuacgagggcaccaaggaguucagcuucaagaucguggccagcgacagcggcaagcccagccugaaccagaccgcccuggugagagugaagcuggaggacgagaacgacaacccccccaucuucaaccagcccgugaucgagcugagcgugagcgagaacaacagaagaggccuguaccugaccaccaucagcgccaccgacgaggacagcggcaagaacgccgacaucguguaccagcugggccccaacgccagcuucuucgaccuggacagaaagaccggcgugcugaccgccagcagaguguucgacagagaggagcaggagagauucaucuucaccgugaccgccagagacaacggcacccccccccugcagagccaggccgccgugaucgugaccgugcuggacgagaacgacaacagccccaaguucacccacaaccacuuccaguucuucgugagcgagaaccugcccaaguacagcaccgugggcgugaucaccgugaccgacgccgacgccggcgagaacaaggccgugacccugagcauccugaacgacaacgacaacuucgugcuggaccccuacagcggcgugaucaagagcaacgugagcuucgacagagagcagcagagcagcuacaccuucgacgugaaggccaccgacggcggccagccccccagaagcagcaccgccaaggugaccaucaacgugauggacgugaacgacaacagccccguggugaucagcccccccagcaacaccagcuucaagcuggugccccugagcgccauccccggcagcgugguggccgagguguucgccguggacguggacaccggcaugaacgccgagcugaaguacaccaucgugagcggcaacaacaagggccuguucagaaucgaccccgugaccggcaacaucacccuggaggagaagcccgcccccaccgacgugggccugcacagacugguggugaacaucagcgaccugggcuaccccaagagccugcacacccuggugcugguguuccuguacgugaacgacaccgccggcaacgccagcuacaucuacgaccugaucagaagaaccauggagaccccccuggacagaaacaucggcgacagcagccagcccuaccagaacgaggacuaccugaccaucaugaucgccaucaucgccggcgccaugguggugaucguggugaucuucgugaccgugcuggugagaugcagacacgccagcagauucaaggccgcccagagaagcaagcagggcgccgaguggaugagccccaaccaggagaacaagcagaacaagaagaagaagagaaagaagagaaagagccccaagagcagccugcugaacuucgugaccaucgaggagagcaagcccgacgacgccgugcacgagcccaucaacggcaccaucagccugcccgccgagcuggaggagcagagcaucggcagauucgacuggggccccgccccccccaccaccuucaagcccaacagccccgaccuggccaagcacuacaagagcgccagcccccagcccgccuuccaccugaagcccgacacccccgugagcgugaagaagcaccacgugauccaggagcugccccuggacaacaccuucgugggcggcugcgacacccugagcaagagaagcagcaccagcagcgaccacuucagcgccagcgagugcagcagccagggcggcuucaagaccaagggcccccugcacaccagacagagccagagaagagugaccuuccaccugcccgacggcagccaggagagcugcagcgacagcggccugggcgaccacgagcccgugggcagcggcacccugaucagccacccccugccccuggugcagccccaggacgaguucuacgaccaggccagccccgacaagagaaccgaggccgacggcaacagcgaccccaacagcgacggcccccugggccccagaggccuggccgaggccaccgagaugugcacccaggagugccuggugcugggccacagcgacaacugcuggaugccccccggccugggccccuaccagcaccccaagagcccccugagcaccuucgccccccagaaggagugggugaagaaggacaagcuggugaacggccacacccugaccagagccuggaaggaggacagcaacagaaaccaguucaacgacagaaagcaguacggcagcaacgagggccacuucaacaacggcagccacaugaccgacaucccccuggccaaccugaagagcuacaagcaggccggcggcgccaccgagagccccaaggagcaccagcuguaa

SEQ ID NO: 21246 - RNA, 2853 nt, Artificial Sequence
  PCDHA1__Homo_sapiens__NP_061723
augguguucagcagaagaggcggccugggcgccagagaccugcugcuguggcugcugcugcuggccgccugggaggugggcagcggccagcugcacuacagcauccccgaggaggccaagcacggcaccuucgugggcagaguggcccaggaccugggccuggagcuggccgagcuggugcccagacuguucagaguggccagcaagacccacagagaccugcuggaggugaaccugcagaacggcauccuguucgugaacagcagaaucgacagagaggagcugugccaguggagcgccgagugcagcauccaccuggagcugaucgccgacagaccccugcagguguuccacguggaggugaaggugaaggacaucaacgacaacccccccguguucagaggcagagagcagaucaucuucauccccgagagcagacugcugaacagcagauuccccaucgagggcgccgccgacgccgacaucggcgccaacgcccugcugaccuacacccugagccccagcgacuacuucagccuggacguggaggccagcgacgagcugagcaagagccuguggcuggagcugagaaaguaccuggacagagaggagacccccgagcugcaccugcugcugaccgccaccgacggcggcaagcccgagcugcagggcaccguggagcugcugaucaccgugcuggacgugaacgacaacgccccccuguucgaccaggccguguacagagugcaccugcuggagaccaccgccaacggcacccuggugaccacccugaacgccagcgacgccgacgagggcgugaacggcgaggugguguucagcuucgacagcggcaucagcagagacauccaggagaaguucaagguggacagcagcagcggcgagaucagacugaucgacaagcuggacuacgaggagaccaagagcuacgagauccaggugaaggccguggacaagggcagcccccccaugagcaaccacugcaaggugcuggugaaggugcuggacgugaacgacaacgcccccgagcuggccgugaccagccuguaccugcccaucagagaggacgccccccugagcaccgugaucgcccugaucaccgugagcgacagagacagcggcgccaacggccaggugaccugcagccugaugccccacgugcccuucaagcuggugagcaccuucaagaacuacuacagccuggugcuggacagcgcccuggacagagagagccugagcguguacgagcugguggugaccgccagagacggcggcagccccagccugugggccaccgccagagugagcguggagguggccgacgugaacgacaacgcccccgccuucgcccagcccgaguacaccguguucgugaaggagaacaacccccccggcugccacaucuucaccgugagcgccagagacgccgacgcccaggagaacgcccuggugagcuacagccugguggagagaagagugggcgagagagcccugagcaacuacgugagcgugcacgccgagagcggcaagguguacgcccugcagccccuggaccacgaggagcuggagcugcugcaguuccaggugagcgccagagacgccggcgugcccccccugggcagcaacgugacccugcagguguucgugcuggacgagaacgacaacgcccccgcccugcuggcccccagagugggcggcaccaucggcgccgugagcgagcuggugcccagacuggugggcgccggccacgugguggccaaggugagagccguggacgccgacagcggcuacaacgccuggcugagcuacgagcugcagcccgccgccggcggcgccagaauccccuucagagugggccuguacaccggcgagaucagcaccaccagagugcuggacgaggccgaccugagcagauacagacugcuggugcuggugaaggaccacggcgagcccgcccugaccgccaccgccaccgugcuggugagccugguggagagcggccaggcccccaaggccagcagcagagccagcgugggcguggccggccccgaggccgcccugguggacgugaacguguaccugaucaucgccaucugcgccgugagcagccugcuggugcugacccugcugcuguacaccgcccugagaugcagcgugccccccaccgagggcgccuacgugcccggcaagcccacccuggugugcagcagcgcccugggcagcuggagcaacagccagcagagaagacagagagugugcagcagcgagggcccccccaagaccgaccugauggccuucagccccggccugagccccagccugaacaccagcgagagaaacgagcagcccgaggccaaccuggaccugagcggcaaccccagacagcccaaccccgacuggagauacagcgccagccugagagccggcaugcacagcagcgugcaccuggaggaggccggcauccugagagccggccccggcggccccgaccagcaguggcccaccgugagcagcgccacccccgagcccgaggccggcgaggugagcccccccgugggcgccggcgugaacagcaacagcuggaccuucaaguacggccccggcaaccccaagcagagcggccccggcgagcugcccgacaaguucaucauccccggcagccccgccaucaucagcaucagacaggagcccaccaacagccagaucgacaagagcgacuucaucaccuucggcaagaaggaggagaccaagaagaagaagaagaagaagaagggcaacaagacccaggagaagaaggagaagggcaacagcaccaccgacaacagcgaccaguaa

SEQ ID NO: 21247 - RNA, 2844 nt, Artificial Sequence
  PCDHA4__Homo_sapiens__NP_061730
auggaguucagcuggggcagcggccaggagagcagaagacugcugcugcugcugcugcugcuggccgccugggaggccggcaacggccagcugcacuacagcgugagcgaggaggccaagcacggcaccuucgugggcagaaucgcccaggaccugggccuggagcuggccgagcuggugcccagacuguucagaguggccagcaagggcagaggcggccugcuggaggugaaccugcagaacggcauccuguucgugaacagcagaaucgacagagaggagcugugcagaagaagcgccgagugcagcauccaccuggaggugaucguggacagaccccugcagguguuccacguggacguggaggugagagacaucaacgacaacccccccguguuccccgccacccagaagaaccugagcaucgccgagagcagaccccuggacagcagauucccccuggagggcgccagcgacgccgacaucggcgagaacgcccugcugaccuacagacugagccccaacgaguacuucagccuggagaagccccccgacgacgagcuggugaagggccugggccugauccugagaaagagccuggacagagaggaggcccccgagaucuuccuggugcugaccgccaccgacggcggcaagcccgagcugaccggcaccgugcagcugcugaucaccgugcuggacgccaacgacaacgcccccgccuucgacagaaccaucuacaaggugagacugcuggagaacgugcccaacggcacccuggugaucaagcugaacgccagcgaccuggacgagggccugaacggcgacaucguguacagcuucagcaacgacaucagccccaacgugaagagcaaguuccacaucgaccccaucaccggccagaucaucgugaagggcuacaucgacuucgaggagagcaagagcuacgagaucaucguggagggcaucgacaagggccagcugccccugagcggccacugcagagugaucguggagguggaggacaacaacgacaacgugcccgaccuggaguucaagagccugagccugcccaucagagaggacgccccccugggcaccgugaucgcccugaucagcgugagcgacaaggacaugggcgugaacggccuggugaccugcagccugaccagccacgugcccuucaagcuggugagcaccuucaagaacuacuacagccuggugcuggacagcgcccuggacagagagagcgugagcgccuacgagcugguggugaccgccagagacggcggcagccccagccugugggccaccgccagcgugagcguggagguggccgacgugaacgacaacgcccccgccuucgcccagcccgaguacaccguguucgugaaggagaacaacccccccggcugccacaucuucaccgugagcgccugggacgccgacgcccaggagaacgcccuggugagcuacagccugguggagagaagagugggcgagagagcccugagcagcuacgugagcgugcacgccgagagcggcaagguguacgcccugcagccccuggaccacgaggagcuggagcugcugcaguuccaggugaccgccagagacgccggcgugcccccccugggcagcaacgugacccugcagguguucgugcuggacgagaacgacaacgcccccgcccugcuggcccccagagccggcggcaccggcggcgccgugagcgagcuggugcccuggagcgugggcgugggccacgugguggccaaggugagagccguggacgccgacagcggcuacaacgccuggcugagcuacgagcugcagcccggcaccggcggcgccagaauccccuucagagugggccuguacaccggcgagaucagcaccaccagagcccuggacgagaccgacgcccccagacacagacugcuggugcuggugaaggaccacggcgagcccgcccugaccgccaccgccaccgugcuggugagccugguggagagcggccaggcccccaaggccagcagcagagcccuggugggcgccgugggccccgacgccgcccugguggacgugaacguguaccugaucaucgccaucugcgccgugagcagccugcuggugcugacccugcugcuguacaccgcccugagaugcagcgcccugcccaccgagggcgccugcgcccccggcaagcccacccuggugugcagcagcgccgugggcagcuggagcuacagccagcagagaagacccagagugugcagcggcgagggcccccccaagaccgaccugauggccuucagccccagccugcccgacagcagagacagagaggaccagcugcagaccaccgaggagagcuucgccaagcccagacagcccaaccccgacuggagauacagcgccagccugagagccggcaugcacagcagcgugcaccuggaggaggccggcauccugagagccggccccggcggccccgaccagcaguggcccaccgugagcagcgccacccccgagcccgaggccggcgaggugagcccccccgugggcgccggcgugaacagcaacagcuggaccuucaaguacggccccggcaaccccaagcagagcggccccggcgagcugcccgacaaguucaucauccccggcagccccgccaucaucagcaucagacaggagcccaccaacagccagaucgacaagagcgacuucaucaccuucggcaagaaggaggagaccaagaagaagaagaagaagaagaagggcaacaagacccaggagaagaaggagaagggcaacagcaccaccgacaacagcgaccaguaa

SEQ ID NO: 21248 - RNA, 2853 nt, Artificial Sequence
  PCDHA6__Homo_sapiens__NP_061732
augguguucacccccgaggacagacugggcaagcagugccugcugcugccccugcugcugcuggccgccuggaaggugggcagcggccagcugcacuacagcgugcccgaggaggccaagcacggcaccuucgugggcagaaucgcccaggaccugggccuggagcuggccgagcuggugcccagacuguucagaauggccagcaaggacagagaggaccugcuggaggugaaccugcagaacggcauccuguucgugaacagcagaaucgacagagaggagcugugcggcagaagcgccgagugcagcauccaccuggaggugaucguggacagaccccugcagguguuccacguggacguggaggugagagacaucaacgacaaccccccccuguuccccguggaggagcagagagugcugaucuacgagagcagacugcccgacagcguguucccccuggagggcgccagcgacgccgacgugggcagcaacagcauccugaccuacaagcugagcagcagcgaguacuucggccuggacgugaagaucaacagcgacgacaacaagcagaucggccugcugcugaagaagagccuggacagagaggaggcccccgcccacaaccuguuccugaccgccaccgacggcggcaagcccgagcugaccggcaccgugcagcugcuggugaccgugcuggacgugaacgacaacgcccccaccuucgagcagagcgaguacgaggugagaaucuucgagaacgccgacaacggcaccaccgugaucagacugaacgccagcgacagagacgagggcgccaacggcgccaucagcuacagcuucaacagccugguggccgccauggugaucgaccacuucagcaucgacagaaacaccggcgagaucgugaucagaggcaaccuggacuucgagcaggagaaccuguacaagauccugaucgacgccaccgacaagggccacccccccauggccggccacugcaccgugcuggugagaauccuggacaagaacgacaacgugcccgagaucgcccugaccagccugagccugcccgugagagaggacgcccaguucggcaccgugaucgcccugaucagcgugaacgaccuggacagcggcgccaacggccaggugaacugcagccugaccccccacgugcccuucaagcuggugagcaccuucaagaacuacuacagccuggugcuggacagcgcccuggacagagagagcgugagcgccuacgagcugguggugaccgccagagacggcggcagccccagccugugggccaccgccagccugagcguggagguggccgacaugaacgacaacgcccccgccuucgcccagcccgaguacaccguguucgugaaggagaacaacccccccggcugccacaucuucaccgugagcgccagagacgccgacgcccaggagaacgcccuggugagcuacagccugguggagagaagagugggcgagagagcccugagcagcuacaucagcgugcacgccgagagcggcaagguguacgcccugcagccccuggaccacgaggagcuggagcugcugcaguuccaggugagcgccagagacgccggcgugcccccccugggcagcaacgugacccugcagguguucgugcuggacgagaacgacaacgcccccgcccugcuggcccccagagugggcggcaccggcggcgccgugagcgagcuggugcccagaagccugggcgccggccaggugguggccaaggugagagccguggacgccgacagcggcuacaacgccuggcugagcuacgagcugcagccccccgccagcagcgccagauuccccuucagagugggccuguacaccggcgagaucagcaccaccagagugcuggacgaggccgacagccccagacacagacugcuggugcuggugaaggaccacggcgagcccgcccugaccgccaccgccaccgugcuggugagccugguggagagcggccaggcccccaaggccagcagcagagccagcgugggcgccgccggccccgaggccgcccugguggacgugaacguguaccugaucaucgccaucugcgccgugagcagccugcuggugcugacccugcugcuguacaccgcccugagaugcagcgccccccccaccgagggcgccugcaccgccgacaagcccacccuggugugcagcagcgccgugggcagcuggagcuacagccagcagagaagacagagagugugcagcggcgagggcccccccaagauggaccugauggccuucagccccagccugagccccugccccaucaugaugggcaaggccgagaaccaggaccugaacgaggaccacgacgccaagcccagacagcccaaccccgacuggagauacagcgccagccugagagccggcaugcacagcagcgugcaccuggaggaggccggcauccugagagccggccccggcggccccgaccagcaguggcccaccgugagcagcgccacccccgagcccgaggccggcgaggugagcccccccgugggcgccggcgugaacagcaacagcuggaccuucaaguacggccccggcaaccccaagcagagcggccccggcgagcugcccgacaaguucaucauccccggcagccccgccaucaucagcaucagacaggagcccaccaacagccagaucgacaagagcgacuucaucaccuucggcaagaaggaggagaccaagaagaagaagaagaagaagaagggcaacaagacccaggagaagaaggagaagggcaacagcaccaccgacaacagcgaccaguaa

SEQ ID NO: 21249 - RNA, 2457 nt, Artificial Sequence
  PCDHB1__Homo_sapiens__NP_037472
auggccggcaccagaagaaagagccugcagaacagacaggugggcagccugcugaucuuccugugcaucagcgugggcgacgccaccaccaucagauacagcguggccgaggagauggagagcggcagcuucguggccaacguggccaaggaccugggccuggaggugggcaagcuggccgccagaggcgccagacuggugagcgagggcaacaagaugcacuucagacugcacagaaagaccggcgaccuguucgugaaggagaagcuggacagagagagccugugcggcaaggccgaccccugcgugcugcacuucgagguggugcugguggagccccugcagagcuucagagccgaggugagaguguucgacaucaacgacaacgcccccguguuccugaacaaggagccccugcugaagauccccgagagcaccccccugggcagcagauucccccugcagagcgcccaggaccuggacgugggccugaacggccugcagaacuacacccugagcgccaacggcuacuuccaccugcacaccagauucugcagccacggccccaaguacgccgagcuggugcugaacaagccccuggacagagaggagcagcccgaggugaaccugaccaucaccgccguggacggcggcagcccccccaagagcggcaccgcccacauccacgugguggugcuggacgugaacgaccacgugccccaguucagcagacugguguacagagcccaggugagcgagaacagccccaacggcagccugguggccaccgugaccgccguggaccuggacgagggcaccaacaaggccaucaccuacagccuggcccagaaccccgaggccauccugaagaccuuccagaucgacccccagaacggcgaggugagacugagaggcccccuggacuucgaggccaucgagaccuacgacaucgacauccaggccaccgacggcggcggccugagcgcccacagcaaggugcugguggaggugguggacgugaacgacaacccccccgaggugauggugagcagcgugagcagcccccugcccgaggacagccccccccagaccgugguggcccuguucaccaucagagacagagacaucagagugggcggcaaggugaccugcuuccugagagaggaccugcccuucgugaucaagcccaccuucggcaacagcuacagccuggugaccgacagaagccuggacagagaggaggugagcggcuacaacaucaccaucguggccauggacaccggcccccccagccugagcgccgagaccaugaucgaggugcugaucagcgacgugaacgacaacccccccaucuucagagaggacagcuacauccugaccgugagagagaacaacagccccgccguguucaucggcaaggugcacgccgaggaccuggaccugggcgagaacgcccagaucaccuacagccugcugccccccaagaacggcgaccugagcguguucgccuacaucagcaucaacagcggcaacggcaagcuguacgcccugagaaccauggacuacgaggccauccaggacuuccaguucguggugaaggccaccgacggcggcuuccugagccugagcagccaggugaccgugagagugguggugcuggacgacaacgacaacagacccaugauccuguacccccugcagaacggcacccugcccugcaacgaccuggugcccagaagcgccgaggccggcuaccuggugaccaaggugguggccguggacggcgacagcggccagaacagcuggcugagcuaccaccugcugaaggccaccgaccugggccuguucagcgugcagagacagaacggcgagauccacacccugagacagaucagcgagagagaccccaugaugcagaagcugaucauccuggugcaggaccacggccagcccgcccugagcaccaccgugagccugaacauccugcugguggacggcuucagcgagcccuaccugcaguuccaggaccccaccaagcacagcagaaaggugaaccccagcaccaaguaccuggugaucagccuggugauccugagcuuccuguuccugcugagcgugaucgugaucuucaucauccacguguaccagaagaucaaguacagagagaaguucaccauccaggagcacuucuacgacgacugcaacuucagcaacaaccuggugcagggccagggcaacggcagccugagcagacccugccccuacgagaugugcagcgccaccggcaccggcaacagcgaguucagauuccugaagagauucaugcccaacuuccccuucccccacgccaccggcgagaucaagauggaggccggcagcagccugccccccaacagcgacagaaacaagagccagagacuggagggccacgaccaggugagcgacgacuacauguaa

SEQ ID NO: 21250 - RNA, 2397 nt, Artificial Sequence
  PCDHB2__Homo_sapiens__NP_061759
auggaggccggcgagggcaaggagagagugcccaagcagagacaggugcugaucuucuucgugcugcugggcaucgcccaggccagcugccagcccagacacuacagcguggccgaggagaccgagagcggcagcuucguggccaaccugcugaaggaccugggccuggagaucggcgagcuggccgugagaggcgccagaguggugagcaagggcaagaagaugcaccugcaguucgacagacagaccggcgaccugcugcugaacgagaagcuggacagagaggagcugugcggccccaccgagcccugcgugcugcccuuccaggugcugcuggagaacccccugcaguucuuccaggccgagcugagaaucagagacgugaacgaccacagccccguguuccuggacaaggagauccugcugaagauccccgagagcaucacccccggcaccaccuuccugaucgagagagcccaggaccuggacgugggcaccaacagccugcagaacuacaccaucagccccaacuuccacuuccaccugaaccugcaggacagccuggacggcaucauccugccccagcuggugcugaacagagcccuggacagagaggagcagcccgagaucagacugacccugaccgcccuggacggcggcagcccccccagaagcggcaccgcccuggugagaaucgaggugguggacaucaacgacaacgugcccgaguucgccaagcugcuguacgaggugcagauccccgaggacagccccgugggcagccagguggccaucgugagcgccagagaccuggacaucggcaccaacggcgagaucagcuacgccuucagccaggccagcgaggacaucagaaagaccuucagacugagcgccaagagcggcgagcugcugcugagacagaagcuggacuucgagagcauccagaccuacaccgugaacauccaggccaccgacggcggcggccugagcggcaccugcgugguguucgugcaggugauggaccugaacgacaacccccccgagcugaccaugagcacccugaucaaccagauccccgagaaccugcaggacacccugaucgccguguucagcgugagcgaccccgacagcggcgacaacggcagaauggugugcagcauccaggacgaccugcccuucuuccugaagcccagcguggagaacuucuacacccuggugaucagcaccgcccuggacagagagaccagaagcgaguacaacaucaccaucaccgugaccgacuucggcacccccagacugaagaccgagcacaacaucaccgugcuggugagcgacgugaacgacaacgcccccgccuucacccagaccagcuacacccuguucgugagagagaacaacagccccgcccugcacaucggcagcgugagcgccaccgacagagacagcggcaccaacgcccaggugaccuacagccugcugcccccccaggacccccaccugccccuggccagccuggugagcaucaacgccgacaacggccaccuguucgcccugcagagccuggacuacgaggcccugcaggccuucgaguucagagugggcgccgccgacagaggcagccccgcccugagcagcgaggcccuggugagagugcuggugcuggacgccaacgacaacagccccuucgugcuguacccccugcagaacggcagcgcccccugcaccgagcuggugcccagagccgccgagcccggcuaccuggugaccaaggugguggccguggacggcgacagcggccagaacgccuggcugagcuaccagcugcugaaggccaccgagcccggccuguucggcgugugggcccacaacggcgaggugagaaccgccagacugcugagagagagagacgccgccaagcagagacugguggugcuggugaaggacaacggcgagccccccagaagcgccaccgccacccugcacgugcugcugguggacggcuucagccagcccuaccugcugcugcccgaggccgcccccgcccaggcccaggccgaccugcugaccguguaccuggugguggcccuggccagcgugagcagccuguuccuguucagcgugcugcuguucguggccgugagacugugcagaagaagcagagccgccagcgugggcagaugcagcgugcccgagggccccuuccccggccagaugguggacgugagcggcaccggcacccugagccagagcuaccaguacgaggugugccugaccggcggcagcggcaccaacgaguucaaguuccugaagcccaucauccccaacuucguggcccagggcgccgagagagugagcgaggccaaccccagcuucagaaagagcuucgaguucaccuaa

SEQ ID NO: 21251 - RNA, 2391 nt, Artificial Sequence
  PCDHB3__Homo_sapiens__NP_061760
auggaggccggcggcgagagauuccugagacagagacaggugcugcugcuguucguguuccugggcggcagccuggccggcagcgagagcagaagauacagcguggccgaggagaaggagaagggcuuccugaucgccaaccuggccaaggaccugggccugagaguggaggagcuggccgccagaggcgcccagguggugagcaagggcaacaagcagcacuuccagcugagccaccagaccggcgaccugcugcugaacgagaagcuggacagagaggagcugugcggccccaccgagcccugcauccugcacuuccagauccugcugcagaacccccugcaguucgugaccaacgagcugagaaucaucgacgugaacgaccacagccccguguucuucgagaacgagaugcaccugaagauccuggagagcacccugcccggcaccgugaucccccugggcaacgccgaggaccuggacgugggcagaaacagccugcagaacuacaccaucacccccaacagccacuuccacgugcugaccagaagcagaagagacggcagaaaguaccccgagcuggugcuggacaaggcccuggacagagaggagcagcccgagcugagccugacccugaccgcccuggacggcggcagcccccccagaagcggcaccgcccagaucaacauccaggugcuggacaucaacgacaacgcccccgaguucgcccagccccuguacgagguggccgugcuggagaacacccccgugaacagcgugaucgugaccgugagcgccagcgaccuggacaccggcagcuucggcaccaucagcuacgccuucuuccacgccagcgaggagaucagaaagaccuuccagcugaaccccaucaccggcgacaugcagcuggugaaguaccugaacuucgaggccaucaacagcuacgagguggacaucgaggccaaggacggcggcggccugagcggcaagagcaccgugaucgugcaggugguggacgugaacgacaacccccccgagcugacccugagcagcgugaacagccccauccccgagaacagcggcgagaccgugcuggccguguucagcgugagcgaccuggacagcggcgacaacggcagagugaugugcagcaucgagaacaaccugcccuucuuccugaagcccagcguggagaacuucuacacccuggugagcgagggcgcccuggacagagagaccagaagcgaguacaacaucaccaucaccaucaccgaccugggcacccccagacugaagaccaaguacaacaucaccgugcuggugagcgacgugaacgacaacgcccccgccuucacccagaucagcuacacccuguucgugagagagaacaacagccccgcccugcacaucggcagcgugagcgccaccgacagagacagcggcaccaacgcccaggugaccuacagccugcugcccccccaggacccccaccugccccugagcagccuggugagcaucaacgccgacaacggccaccuguucgcccugagaagccuggacuacgaggcccugcaggccuucgaguucagagugggcgccaccgacagaggcagccccgcccugagcagcgaggcccuggugagagugcuggugcuggacgccaacgacaacagccccuucgugcuguacccccugcagaacggcagcgcccccugcaccgagcuggugcccagagccgccgagcccggcuaccuggugaccaaggugguggccguggacggcgacagcggccagaacgccuggcugagcuaccagcugcugaaggccaccgagcccggccuguucggcgugugggcccacaacggcgaggugagaaccgccagacugcugagcgagagagacgccgccaagcacagacugguggugcuggugaaggacaacggcgagccccccagaagcgccaccgccacccugcacgugcugcugguggacggcuucagccagcccuaccugccccugcccgaggccgcccccgcccaggcccaggccgaccugcugaccguguaccuggugguggcccuggccagcgugagcagccuguuccuguucagcgugcugcuguucguggccgugagacugugcagaagaagcagagccgccagcgugggcagaugcagcgugcccgagggccccuuccccggccagaugguggacgugagcggcaccggcacccugagccagagcuaccaguacgaggugugccugaccggcggcagcggcaccaacgaguucaaguuccugaagcccaucauccccaacuucguggcccagggcgccgagagagugagcgaggccaaccccagcuucagaaagagcuucgaguucagcuaa

SEQ ID NO: 21252 - RNA, 2406 nt, Artificial Sequence
  PCDHB8__Homo_sapiens__NP_061993
auggaggccagcggcaagcugaucugcagacagagacaggugcuguucagcuuccugcugcugggccugagccuggccggcgccgccgagcccagaagcuacagcgugguggaggagaccgagggcagcagcuucgugaccaaccuggccaaggaccugggccuggagcagagagaguucagcagaagaggcgugagaguggugagcagaggcaacaagcugcaccugcagcugaaccaggagaccgccgaccugcugcugaacgagaagcuggacagagaggaccugugcggccacaccgagcccugcgugcugagauuccaggugcugcuggagagccccuucgaguucuuccaggccgagcugcaggugaucgacaucaacgaccacagccccguguuccuggacaagcagaugcuggugaaggugagcgagagcagcccccccggcaccgccuucccccugaagaacgccgaggaccuggacaucggccagaacaacaucgagaacuacaucaucagccccaacagcuacuucagagugcugaccagaaagagaagcgacggcagaaaguaccccgagcuggugcuggacaaggcccuggacagagaggaggaggccgagcugagacugacccugaccgcccuggacggcggcagcccccccagaagcggcaccgcccagguguacaucgaggugguggacgugaacgacaacgcccccgaguucgagcagcccuucuacagagugcagaucagcgaggacagccccaucagcuuccugguggugaaggugagcgccaccgacguggacaccggcgugaacggcgagaucagcuacagccuguuccaggccagcgacgagaucagcaagaccuucaagguggacuuccugaccggcgagaucagacugaagaagcagcuggacuucgagaaguuccagagcuacgaggugaacaucgaggccagagacgccggcggcuucagcggcaagugcaccgugcugauccaggugaucgacgugaacgaccacgcccccgaggugaccaugagcgccuucaccagccccauccccgagaacgcccccgagaccgugguggcccuguucagcgugagcgaccuggacagcggcgagaacggcaagaucagcugcagcauccaggaggaccugcccuuccugcugaagagcagcgugggcaacuucuacacccugcugaccgagaccccccuggacagagagagcagagccgaguacaacgugaccaucaccgugaccgaccugggcacccccagacugaccacccaccugaacaugaccgugcuggugagcgacgugaacgacaacgcccccgccuucacccagaccagcuacacccuguucgugagagagaacaacagccccgcccugcacaucggcagcgugagcgccaccgacagagacagcggcaccaacgcccaggugaccuacagccugcugcccccccaggacccccaccugccccuggccagccuggugagcaucaacaccgacaacggccaccuguucgcccugagaagccuggacuacgaggcccugcaggccuucgaguucagagugggcgccagcgacagaggcagccccgcccugagcagcgaggcccuggugagagugcuggugcuggacgccaacgacaacagccccuucgugcuguacccccugcagaacggcagcgcccccugcaccgagcuggugcccagagccgccgagcccggcuaccuggugaccaaggugguggccguggacggcgacagcggccagaacgccuggcugagcuaccagcugcugaaggccaccgagcccggccuguucggcgugugggcccacaacggcgaggugagaaccgccagacugcugagcgagagagacgccgccaagcagagacugguggugcuggugaaggacaacggcgagccccccugcagcgccaccgccacccugcacgugcugcugguggacggcuucagccagcccuaccugccccugcccgaggccgcccccgcccagggccaggccgacagccugaccguguaccuggugguggcccuggccagcgugagcagccuguuccuguucagcgugcugcuguucguggccgugcugcugugcagaagaagcagagccgccagcgugggcagaugcagcgugcccgagggccccuuccccggccaccugguggacgugagaggcaccggcagccugagccagaacuaccaguacgaggugugccuggccggcggcagcggcaccaacgaguuccagcugcugaagcccgugcugcccaacauccagggccacagcuucggccccgagauggagcagaacagcaacuucagaaacggcuucggcuucagccugcagcugaaguaa

SEQ ID NO: 21253 - RNA, 2808 nt, Artificial Sequence
  PCDHGA11__Homo_sapiens__NP_061737
auggccaacagacugcagagaggcgacagaagcagacugcugcugcugcugugcaucuuccugggcacccugagaggcuucagagccagacagaucagauacagcgugcccgaggagaccgagaagggcagcuucgugggcaacaucagcaaggaccugggccuggagcccagagagcuggccaagagaggcgugagaaucgugagcagaggcaagacccagcuguucgccgugaaccccagaagcggcagccugaucaccgccggcagaaucgacagagaggagcugugcgagaccgugagcagcugcuuccugaacauggagcugcugguggaggacacccugaagaucuacggcguggagguggagaucaucgacaucaacgacaacgcccccagcuuccaggaggacgagguggagaucaaggugagcgagcacgccauccccggcgccagauucgcccugcccaacgccagagaccccgacgugggcgugaacagccugcagagcuaccagcugagccccaacaacuacuucagccugcagcugagaggcagaaccgacggcgccaagaaccccgagcuggugcuggagggcagccuggacagagagaaggaggccgcccaccugcugcugcugaccgcccuggacggcggcgaccccaucagaaagggcgccgugcccaucagagugguggugcuggacgugaacgaccacauccccauguucacccagagcguguacagagugagcgugcccgagaacaucagcagcggcaccagagugcugauggugaacgccaccgaccccgacgagggcaucaacggcgaggugauguacagcuucagaaacauggagagcaaggccagcgagaucuuccagcuggacagccagaccggcgaggugcaggugagaggcagccuggacuucgagaaguacagauucuacgagauggagauccagggccaggacggcggcggccuguucaccaccaccaccaugcugaucaccgugguggacgugaacgacaacgcccccgagaucaccaucaccagcagcaucaacagcauccuggagaacagcccccccggcaccgugaucgcccugcugaacgugcaggaccaggacagcggcgagaacggccaggugagcugcuucauccccaaccaccugcccuucaagcuggagaagaccuacggcaacuacuacaagcugaucaccagcagagugcuggacagagagcuggugcagagcuacaacaucacccugaccgccaccgaccagggcagccccccccugagcgccgagacccacguguggcugaacguggccgacgacaacgacaacccccccguguucccccacagcagcuacagcgccuacauccccgagaacaaccccagaggcgccagcaucuucagcgugaccgcccuggaccccgacagcaagcagaacgcccuggugaccuacagccugaccgacgacaccgugcagggcgugccccugagcagcuacgugagcaucaacagcaacaccggcgugcuguacgcccugcagagcuucgacuacgagcaguucagagaccuggagcugagagugaucgccagagacagcggcgaccccccccugagcagcaacgugagccugagccuguucgugcuggaccagaacgacaacgcccccgagauccuguaccccgcccugcccaccgacggcagcaccggcguggagcuggcccccagaagcgccgagcccggcuaccuggugaccaaggugguggccguggacaaggacagcggccagaacgccuggcugagcuacagacugcugaaggccagcgagcccggccuguucgccgugggcgagcacaccggcgaggugagaaccgccagagcccugcuggacagagacgcccugaagcagagccuggugguggccgugcaggaccacggccagcccccccugagcgccaccgugacccugaccguggccguggccgacagcauccccgaggugcuggccgaccugggcagccuggagagccuggccaacagcgagaccagcgaccugagccuguaccuggugguggccguggccgccgugagcugcaucuuccugguguucgugaucgugcugcuggcccugagacuguggagauggcacaagagcagacugcugcaggccagcgagggcggccuggccggcaugcccaccagccacuucgugggcguggacggcgugcaggccuuccugcagaccuacagccacgaggugagccugaucgccgacagccagaagagccaccugaucuucccccagcccaacuacggcgacacccugaucagccaggagagcugcgagaagagcgagccccugcugaucgccgaggacagcgccaucauccugggcaagugcgaccccaccagcaaccagcaggccccccccaacaccgacuggagauucagccaggcccagagacccggcaccagcggcagccagaacggcgacgacaccggcaccuggcccaacaaccaguucgacaccgagaugcugcaggccaugauccuggccagcgccagcgaggccgccgacggcagcagcacccugggcggcggcgccggcaccaugggccugagcgccagauacggcccccaguucacccugcagcacgugcccgacuacagacagaacguguacauccccggcagcaacgccacccugaccaacgccgccggcaagagagacggcaaggcccccgccggcggcaacggcaacaagaagaagagcggcaagaaggagaagaaguaa

SEQ ID NO: 21254 - RNA, 2799 nt, Artificial Sequence
  PCDHGA3__Homo_sapiens__NP_061739
augaccaacugccugagcuucagaaacggcagaggccuggcccugcugugcgcccugcugggcacccugugcgagaccggcagcggccagaucagauacagcgugagcgaggagcuggacaagggcagcuucgugggcaacaucgccaacgaccugggccuggagcccagagagcuggccgagagaggcgugagaaucgugagcagaggcagaacccagcuguucagccugaacccccagagcggcagccuggugaccgccgagagaaucgacagagaggagcugugcgcccagaucccccugugccuggugaagaucaacauccugguggaggacaagcugaagaucuucgagguggagaucgagaucaaggacaucaacgacaacgcccccaacuuccccaccgaggagcuggagaucaagaucggcgagcugaccgugcccggcaccagauuccccaucaagaccgccuucgaccccgacgugggcaucaacagccugcagaacuacaagcugagccccaacgacuacuucagccuggccgugaacagcgugagcgagggcgccaaguaccccgagcuggugcuggagagagcccuggacagagagaagaaggagauccaccagcuggugcugguggccagcgacggcggcgaccccgugcacagcggcaaccugcacauccaggugaucgugcuggacgccaacgacaacccccccauguucacccagcccgaguacagagugagcgugugggagaacgugcccgugggcaccagacugcugaccgugaacgccaccgaccccgacgagggcuucaacgcccaggugagcuacauccuggacaagaugcccggcaagaucgccgagaucuuccaccugaacagcgugagcggcgaggugagcauccugaagagccuggacuacgaggacgccauguucuacgagaucaagaucgaggcccaggacggccccggccugcugagcagagccaagauccuggugaccgugcuggacgugaacgacaacgcccccgagaucaccaucaccagccugaccagcagcgugcccgaggagggcaccgugggcagagagaucgcccugaucgacgugcacgacagagacagcggccagaacggccagguggagguguucgugcugggcaaccugcccuucaagcuggagaagagcaucgaccaguacuacagacuggugaccgccaccagccuggacagagagcagaucagcgaguacaacaucagccugagagccagcgacggcggcagccccccccugagcaccgagacccacaucacccugcacgugaucgacaucaacgacaacccccccaccuucccccaccugagcuacagcgccuacauccccgagaacaaccccagaggcgccagcaucuucagcgugaccgcccaggaccccgacagcaacaacaacgccagaaucaccuacgcccugaccgaggacacccugcagggcgccccccugagcagcuucgugagcaucaacagcaacaccggcgugcuguacgcccugagaagcuucgacuacgagcaguucagagaccugaagcugcuggugaccgccagcgacagcggcaaccccccccugagcagcaacgugagccugaaccuguucgugcuggaccagaacgacaacgcccccgagauccuguaccccgcccugcccaccgacggcagcaccggcguggagcuggcccccagaagcgccgagcccggcuaccuggugaccaaggugguggccguggacagagacagcggccagaacgccuggcugagcuacagacugcugaaggccagcgagcccggccuguucagcgugggccugcacaccggcgaggugagaaccgccagagcccugcuggacagagacgcccugaagcagagccuggugguggccgugcaggaccacggccagcccccccugagcgccaccgugacccugaccguggccguggccgacagaauccccgacauccuggccgaccugggcagccuggagcccagcgccaagcccaacgacagcgaccugacccuguaccuggugguggccguggccgccgugagcugcguguuccuggccuucgugaucgugcugcuggcccugagacugagaagauggcacaagagcagacugcugcaggccagcggcggcggccuggccagcacccccggcagccacuucgugggcgccgacggcgugagagccuuccugcagaccuacagccacgaggugagccugaccgccgacagcagaaagagccaccugaucuucccccagcccaacuacgccgacacccugaucagccaggagagcugcgagaagagcgagccccugcugaucacccaggaccugcuggagaugaagggcgacagcaaccugcugcagcaggccccccccaacaccgacuggagauucagccaggcccagagacccggcaccagcggcagccagaacggcgacgacaccggcaccuggcccaacaaccaguucgacaccgagaugcugcaggccaugauccuggccagcgccagcgaggccgccgacggcagcagcacccugggcggcggcgccggcaccaugggccugagcgccagauacggcccccaguucacccugcagcacgugcccgacuacagacagaacguguacauccccggcagcaacgccacccugaccaacgccgccggcaagagagacggcaaggcccccgccggcggcaacggcaacaagaagaagagcggcaagaaggagaagaaguaa

SEQ ID NO: 21255 - RNA, 2772 nt, Artificial Sequence
  PCDHGB4__Homo_sapiens__NP_003727
augggcagcggcgccggcgagcugggcagagccgagagacugcccgugcuguuccuguuccugcugagccuguucugccccgcccugugcgagcagaucagauacagaauccccgaggagaugcccaagggcagcguggugggcaaccuggccaccgaccugggcuucagcgugcaggagcugcccaccagaaagcugagagugagcagcgagaagcccuacuucaccgugagcgccgagagcggcgagcugcuggugagcagcagacuggacagagaggagaucugcggcaagaagcccgccugcgcccuggaguucgaggccguggccgagaacccccugaacuucuaccacgugaacguggagaucgaggacaucaacgaccacacccccaaguucacccagaacagcuucgagcugcagaucagcgagagcgcccagcccggcaccagauucauccugggcagcgcccacgacgccgacaucggcagcaacacccugcagaacuaccagcugagccccagcgaccacuucagccugaucaacaaggagaagagcgacggcagcaaguaccccgagauggugcugaagaccccccuggacagagagaagcagaagagcuaccaccugacccugaccgcccuggacuucggcgcccccccccugagcagcaccgcccagauccacgugcuggugaccgacgccaacgacaacgcccccguguucagccaggacguguacagagugagccugagcgagaacguguaccccggcaccaccgugcugcaggugaccgccaccgaccaggacgagggcgugaacgccgagaucaccuucagcuucagcgaggccagccagaucacccaguucgaccugaacagcaacaccggcgagaucaccgugcugaacacccuggacuucgaggaggugaaggaguacagcaucgugcuggaggccagagacggcggcggcaugaucgcccagugcaccguggagguggaggugaucgacgagaacgacaacgcccccgaggugaucuuccagagccugcccaaccugaucauggaggacgccgagcugggcacccacaucgcccugcugaaggugagagacaaggacagcagacacaacggcgaggugaccugcaagcuggagggcgacgugcccuucaagauccugaccagcagcagaaacaccuacaagcuggugaccgacgccgugcuggacagagagcagaaccccgaguacaacaucaccgugaccgccaccgacagaggcaagcccccccugagcagcagcagcagcaucacccugcacaucggcgacgugaacgacaacgcccccguguucagccagagcagcuacaucgugcacguggccgagaacaacccccccggcgccagcaucagccaggugagagccagcgaccccgaccugggccccaacggccaggugagcuacugcaucauggccagcgaccuggagcagagagagcugagcagcuacgugagcaucagcgccgagagcggcgugguguucgcccagagagccuucgaccacgagcagcugagagccuucgagcugacccugcaggccagagaccagggcagccccgcccugagcgccaacgugagccugagagugcugguggacgacagaaacgacaacgcccccagagugcuguaccccgcccugggccccgacggcagcgcccuguucgacauggugccccacgccgccgagcccggcuaccuggugaccaaggugguggccguggacgccgacagcggccacaacgccuggcugagcuaccacgugcugcaggccagcgagcccggccuguucagccugggccugagaaccggcgaggugagaaccgccagagcccugggcgacagagacgccgugagacagagacugcugguggccgugagagacggcggccagcccccccugagcgccaccgccacccugcaccugguguucgccgacagccugcaggaggugcugcccgacaucaccgacagacccgaccccagcgaccugcaggccgagcugcaguucuaccuggugguggcccuggcccugaucagcgugcuguuccugguggccaugauccuggccaucgcccugagacugagaagaagcagcagccccgccagcuggagcugcuuccagcccggccugugcgugaagagcgagagcguggugccccccaacuacagcgagggcacccugcccuacagcuacaaccugugcguggcccacaccggcaagaccgaguucaacuuccugaagugcagcgagcagcugagcagcggccaggacauccugugcggcgacagcagcggcgcccuguucccccugugcaacagcagcgagcugaccagccaccagcaggccccccccaacaccgacuggagauucagccaggcccagagacccggcaccagcggcagccagaacggcgacgacaccggcaccuggcccaacaaccaguucgacaccgagaugcugcaggccaugauccuggccagcgccagcgaggccgccgacggcagcagcacccugggcggcggcgccggcaccaugggccugagcgccagauacggcccccaguucacccugcagcacgugcccgacuacagacagaacguguacauccccggcagcaacgccacccugaccaacgccgccggcaagagagacggcaaggcccccgccggcggcaacggcaacaagaagaagagcggcaagaaggagaagaaguaa

SEQ ID NO: 21256 - RNA, 2793 nt, Artificial Sequence
  PCDHGB6__Homo_sapiens__NP_061749
augggcggcagcugcgcccagagaagaagagccggccccagacaggugcuguucccccugcugcugccccuguucuaccccacccugagcgagcccaucagauacagcauccccgaggagcuggccaagggcagcguggugggcaaccuggccaaggaccugggccugagcgugcuggacgugagcgccagaaagcugagagugagcgccgagaagcugcacuucagcguggacgccgagagcggcgaccugcuggugaagaacagaaucgacagagagcagaucugcaaggagagaagaagaugcgagcugcagcuggaggccgugguggagaacccccugaacaucuuccacgugaucguggugaucgaggacgugaacgaccacgccccccaguucgacaagaaggagauccaccuggagaucuucgagagcgccagcgccggcaccagacugagccuggaccccgccaccgaccccgacaucaacaucaacagcaucaaggacuacaagaucaacagcaaccccuacuucagccugauggugagagugaacagcgacggcggcaaguaccccgagcugagccuggagaagcugcuggacagagaggagcagagaagccacagccugauccugaccgcccuggacggcggcgacccccccagaagcgccaccgcccacaucgagaucagcgugaaggacaccaacgacaacccccccguguucagcagagacgaguacagaaucagccugagcgagaaccugccccccggcagccccgugcugcaggugaccgccaccgaccaggacgagggcgugaacgccgagaucaacuacuacuucagaagcaccgcccagagcaccaagcacauguucagccuggacgagaagaccggcaugaucaagaacaaccagagcuucgacuucgaggacguggagagauacaccauggagguggaggccaaggacggcggcggccugagcacccagugcaaggugaucaucgagauccuggacgagaacgacaacagccccgagaucaucaucaccagccugagcgaccagauccuggagaacagcccccccggcauggugguggcccuguucaagaccagagaccuggacuucggcggcaacggcgaggugagaugcaacaucgagaccgacauccccuucaagaucuacagcagcagcaacaacuacuacaagcuggugaccgacggcgcccuggacagagagcagacccccgaguacaacgugaccaucguggccaccgacagaggcaagcccccccugagcagcagcagaagcaucacccuguacguggccgacaucaacgacaacgcccccguguucgaccagaccagcuacguggugcacguggccgagaacaacccccccggcgccagcaucgcccaggugagcgccagcgaccccgaccugggccugaacggccacaucagcuacagcaucguggccagcgaccuggagccccuggccgugagcagcuacgugagcgugagcgcccagagcggcgugguguucgcccagagagccuucgaccacgagcagcugagagccuucgcccugacccugcaggccagagaccacggcagccccacccugagcgccaacgugagccugagagugcuggugggcgacagaaacgacaacgcccccagagugcuguaccccgcccugggccccgacggcagcgccuucuucgacauggugcccagaagcgccgagcccggcuaccuggugaccaaggugguggccguggacgccgacagcggccacaacgccuggcugagcuaccacgugcugcaggccagcgagcccggccuguucagccugggccugagaaccggcgaggugagaaccgccagagcccugggcgacagagacgccgccagacagagacugcugguggccgugagagacggcggccagcccccccugagcgccaccgccacccugcaccugguguucgccgacaaccugcaggagauccugcccgaccugagcgacagacccgugcugagcgacccccaggccgagcugcaguucuaccuggugguggcccuggcccugaucagcgugcuguuccugcuggccgugauccuggccaucgcccugagacugagaagaagccugagccccgccaccugggacugcuuccaccccggccugugcgugaagagcggccccguggugccccccaacuacagcgagggcacccugcccuacagcuacaaccugugcaucgcccacaccggcaccaaggaguucaacuuccugaagugcagcgugccccugcacagcaacgaggacauggugugcagcgugagccccggcgcccugauccccccccacggcggcgaggaccugaccagccaccccgagacccugaccagccaggccccccccaacaccgacuggagauucagccaggcccagagacccggcaccagcggcagccagaacggcgacgacaccggcaccuggcccaacaaccaguucgacaccgagaugcugcaggccaugauccuggccagcgccagcgaggccgccgacggcagcagcacccugggcggcggcgccggcaccaugggccugagcgccagauacggcccccaguucacccugcagcacgugcccgacuacagacagaacguguacauccccggcagcaacgccacccugaccaacgccgccggcaagagagacggcaaggcccccgccggcggcaacggcaacaagaagaagagcggcaagaaggagaagaaguaa
